United States Patent 7,750,207 (ZEA MAYS RIBULOSE BISPHOSPHATE CARBOXYLASE ACTIVASE PROMOTER) - sequence listing, part 9

SEQ ID NO: 11726 - DNA, 2638 bp, Zea mays
gcttgcatgcctgcacagctaaccctcaacagaagctcgaaatctggggtgcgaaggataggagagaggagacccctccccctccccctgcccctcctcgtcctcggaccttcccccctcgtcgacacctaccctcaccgcatccgcggtcgcaatggcgctagcctcccaaggcatcaccctgcgttccccgccagcggggtccgggggccacagcgggaggcggtcctcttccgtgcccgccgccgcggccccgcgcggctgggggcagccccacgcggggcaagccttatccatctcgcccgccaggtacgaaccagccgctcgtccaccatggcgaggctccctcgctgccgccatacgtgccgctgcctcggccggtgcgcaccacggcagcgacccggtccctgccgagcccagaatcgagctccccgcgatatttaccgtcttctccgaggccgctaagaccggcgctgccttcttcatcgcctcgtcgagcgcggccttcctcctcggctcgtttggggggttcggaggcggcgctgggggtctcttcggcggcggtggtggagggggtggatggggcgcggggggtggtggtgccggtggcggagggggtggagacttctggtaccggctcatctcttccggcgcggcgcacgcggacgacaagtcatcgggggattgggacgcgcacgggctccccgtcaacatgacggtgccgctcacgaagctgagcgggctgaagaggtataagctgtctgagctcaagttctttgatcgggcagctgccagcggtggcgcctatacggggccagaggattccttcttcgaaatggtgacactgcagcctggtggcgtgtacaccaagtcgcagctgttgaaggagctcgagacactcgtctcctgtggcatgtttgagcgggttgatctggaggtgaagcccaagccagataacacaattgggctcacagtctcctttgtggagagtgtgtggagttctgcaaagcagttcaagtgcatcaatgtggggcttatgtcacagtcagggcaggttgacttcgaccaggacatgacagagagggagaaaatggattacctccgtaagcaggaacgtgattaccagcagcgtgtacgaggtgccaatccctgcatcttgccagaaaatgtacgtggagaggtgctgggaatgatgaagaagcaggagaaagtgagtgccaggatgctgcagaagatcagagatcatgtccagaaatggtaccacaatgagggtttcgtatgcgcacaggtggttaactttggaaaccttaacaccaatgaggttgtgtgtgaggtggtcgagggtgacatcaccaaggtggagtaccagttccaggataagcttggaaatattgttgaaggaaatacccagcttgcgatcatagaccgtgagctgccccagcaggtataccaattacaacccctcgctggacatgttacattgattatcatatggtaatgcttgcgacattctgtattcactaatataactcagtgatgagttgcacactaggatacatggattataacaattgaaatatcatatagcatgcaaatgtacttgcactcagtgtagccgttacttgtgattcttctggtcttgtgctctctatgatgttgtttgacgtgtaacacaaatatttgctctcaatatattttactaaattgtcattgtcctgacatgaatttttcccaacatttttgtgacttcagtttttaatctgtgacactactaatcttctacagcttcgacctggccacatctttaacattggagcagggaaacaggctctgaagaatataaattcacttgctttgttttcaaatatagaagttaatccacgtcctgatgagacaaaggaagggggcatagtagttgaaattaagcttaaggaactggaacccaagtcagctgaagtaagcacagaatggagtattgtacctgggcgtgaaggccggccaactttggtaatgtacctatttatttggatttatctgtttcttctggaacctctctataaaaggaatggtggatctaggattttaccacctagggctggattcatgtgtctcagaagattgtagaattctttgaacttatcttccagtttgaggatatttctattagatatttttgtgctgcacctagggccatagaactagtttctgttggtgcagctcctccactgtatataattgctaggctacactattccaataaagtacatcttgtttgttattattttatgaacctcaaatcttatggcaactttcttttaggcatccatacaacctggaggaactgtgtcatttgagcaccggaacatctatggtctaaatagatctattgttggttctgtcacttccagcaacctgctgaaccctcaggttagttgttgatgaatgttcttttaggaactttgttattttgctggttttgttactggtacctcggtcacttggtgctttatacctgtaagaggaatttgtttaacaacaacgaattcagcatggcattcctaatcttatattggtaccatgtggaaactgtgcattttaagtgctaacaaattaatttctaaaatccctaaacaagtag

SEQ ID NO: 11727 - DNA, 2127 bp, Zea mays
gacttcgaccaggacatgacagagagggagaaaatggattccctccgaaagcaggaacgtgattaccagcagcgtgtacgaggtgccaatccctgcatcttgccagaaaatgtacgtggagaggtgctgggaatgatgaagaagcaggagaaagtgagtgccaggatgctgcagaagatcagagatcatgtccagaaatggtaccacaatgagggtttcgtatgcgcacaggtggttaactttggaaaccttaacaccaatgaggttgtgtgtgaggtggtcgagggtgacatcaccaaggtggagtaccagttccaggataagcttggaaatattgttgaaggaaatacccagcttgcgatcatagaccgagagctgccgcagcagcttcgacctggccacatctttaacattggagcagggaaacaggctctgaagaatataaattcacttgctttgttttccaacatagaagttaatccacgtcctgatgagacaaaggaagggggcatagtagttgaaattaagcttaaggaactggaacccaagtcagctgaagtaagcacagaatggagtattgtacctgggcgtgaaggccgaccaactttggcatccatacaacccggaggaactgtgtcatttgagcaccggaacatctatggtcttaatagatctattgttggttctgttacatccagcaacctgctgaatcctcaggatgatctttcattcaagcttgagtatgtccatccttatttggatggtgtcgatgatcgtagtaaaaaccgcacattcaaaactagctgcttcaacaccaggaaattgagtcctgtctttgttgctggtcccaacatggatgaggctccacctgtttggatcgacagagttggatttaaagccaacataacagagagcttcacacgtcaaagcaaattcacatatggccttgtggttgaagagattacaacacgtgatgaaactaatactgtctgtacccatggttctcgagcaatgcctagcggcggtctgaacatggatggacctcccacaaccctcagtggtactggagttgaccgaatggcatttcttcaggctaatataacccgtgacaatactgagtttgtgaatggtgcaattgttggagacagatacattttccagttagaccaaggtcttggcattggaagcaaaaacccgttcttcaaccgtcatcaacttactctgaccaagttcatcaatttaaataagcaagagaaaggtgtcggcaagccactaccagctgttttggttcttcatggtcattatgctggttgtgtgggtgatttgccgagctatgacgcctttgcacttggagggccttattctgttaggggctttagtaatggtgaactgggcgcttctaggaatattcttgaggttgctactgaactgcgtgtccctgtaagaaacacacacgtttatgcatttgtggaacatgggactgaccttgggagttccaaggatgtcaaagggaaccctacagagtttttcaggcgtgttggtcatggatcttcatatggtgttggtgtcaagcttgggttggtaaggggagagtacattgtagatcacaatgctggtactggaactattttcttcagatttggtgagagattttgagtatgcaacattctgccactgtggaaggcagacttttgaggcactctgtttagcgatgcttgtggactgtgataggattcaatcggcactggagctctgctgaaataatgaagctattttctggggaagagtgatagctagtgtgaaattagtttttttctatgtaggatgtaagatctgttctttcagagtttggagctcataaatagatgaatattcacagatgtctcccatttttttaccgttagttgtgttgtttgtgctgccgtcaaattgtcgagtcgttttgcccttcaccacctgtgagttgcttatctacagttttgttccattttcagattgtgtattctagctgaagtataacttcttgtttctgctggtgccctttcgttggatctgaattttgtccttcgtttctggccagtgctgactactaaccgggcaatggaggcacatgtgcttttataaggg

SEQ ID NO: 11728 - DNA, 1486 bp, Zea mays
  misc_feature (13)..(13): n is a, c, g, or t
  misc_feature (17)..(18): n is a, c, g, or t
  misc_feature (22)..(22): n is a, c, g, or t
  misc_feature (24)..(24): n is a, c, g, or t
  misc_feature (26)..(27): n is a, c, g, or t
gcacgagaccatncctnnaacntncnnatagcgaactagcgaatctagtctgcaccggcctctccctcccatccggcgttggcgaagccgcgcgtcgacgagaggggcggagtcggcgacgagcagatggccggaggcggccccgccgcgtcggcgctttcaagcccctggagggctctgctccagcgagcgctggacgccaacgcccacctcaggcactccacctacttccaactcgctacggtgggcgccgccggcaggccggcgaaccgcaccgtcgtgttcaggggttttcaggaactctgtgataagattcagattaacacggacgcccgaaccaacaagattggtgagatcaagagctgcccctttggtgagatttgttggtacttcacagatagctgggagcaattccgtatcagtggcagcatagatgtgattgatgcttctactacagaccctgccaagctccagcacaaggagaaagcatggttttcaagttcagtgaagtcgagatcgcagtacttaggaccacagccaggcattccggttctagatgatgagcatgttaaggacgttcatctcgatcctttagctggcccagtagatgccttttgccttctggttcttgatccggaaaaggttgattatttgaatctgaaaagcaatcaaaggttgatctttacaagaagacaaaaggatgatggatccaatgattggatggcagtaaaagttagtccttaagctgctgcaaaaactttatttgtgagcttctcttggtaactagactatcatgattcttctgtgttttcatatcatttgaaatgttaggtgcatatcattatgtatatttgagaggccttttcatagtcatacatttatatattgggaatgctttgtaatctcagggatttgttattttttgttaccctcaaatatagaagataaagactgtaaggtatttaggaaggagtcaaagcaggctgtggctattcatgtttgtcaaagccgttggtcttgagatttgtttgaagatgagcgtggctcgtgtttgccactcgtgcttgtttttgtgcataaggtcttaactgataactcttcttttatccatggacctttatgtactttgccagtttgctgacgttgctgctttggcagttatctgtgtgagcagaatgcagagacagcatttgttggctttaataaactaccagcatattccatgggaagcattaaagctgtgtctacacttgcaattgcaacgatgtgctgagaacaagccgttggatggttggagaacttcaggtccgctgcgcaagtcatgaatgtggtcatggaaatcaaagctgattgctgttatcctgcaaaaaccgtcaggcagacacaccacatgatctgccctttttatctaacagtgcagactgccgagcaataaacacatattgattaccgaaagaaccctttgggctttggctgcaggcatgca

SEQ ID NO: 11729 - DNA, 2187 bp, Zea mays
ggcttttaactatttcctccccgccccccccgccagctagcctggcctcccacctcccctcccctctcttgaactgaatcccccactccgtcctccagttcgatcgcgttcgcggcccccactccgtgttccggataagtagccggcggtttcctcaccccaggttttgcagttgctggggagtgggaaattcgtccggctccggtttggccaatgctcctgcggtttcttggagaggccgctgaagcagcagcccttgcctgagggattctccgtttctcgggcggagagttcggttgcggcgggggaaaaaagaattctttcgtcggattggcccaagttcttggttgatccgttacaaaggcccccccactgtacgctgtgttagcctttttccacgcgtttctttccttactctagatccgtgtccccgcccgattatttggggggaataggcggccgatcgaccgggggcagagggatttggaggcctgacctccgatggaggtgcacgccgacgtcgatgggtccggtgtgcccctggccgtgctcctcaagcgggagctgtgcaaccagaaggtggagaggccggacatcctgttcggggaggccaacaagagcaagaaaggggaggacttcacgctcctcttgcccaggtgccaccgcaccacaggcgaaggtggcggcagtggcggcggcgagaatgcaggcgacgacgacgacgacaccatttccgtgtttgcgatttttgatggacacaatggctctttagctgccatatacacacgggagaatctaataaacaatgtgttggctgctattcctccaaatctcacaagtgaggagtgcacagctgcgttgccaagggcactagttgctggttttgtaaaaacggataaagacttccaaacaaaagctgcacgttcagggaccactgtgacttttgttataatagatggatgggttgtcactgtagcatcagttggcgattcacgatgtattctagaatctgctgaaggttcagtatattttttatcagcagatcatcgcctggatgctaatgaagaggaggtggagcgtgttacagcaagtggtggtgaagttgggagaataaatattgctgggggtgctgggattggtccgctcagatgttggccaggcggattgtgtctatcaaggtcaataggtgacattgacgtcggggaatttatagttcctgtcccacatgtgaagcaagtaaagttgtccaatgctggtgggcggcttgtcattgccagtgatggtgtgtgggatgcgctgtgttttcaagaggctctgaactacatcaggggtctaccagccgaagctgctgctaatcgaattgttaaggaagctgtcacttcaaagggattaagagatgatactacttgcatagtagttgacatactacctccagaaaagttaagccccccactaaagcgacctggaaaaggagtcatcaaaactctgttccgtcggaggccctccgatgaaatgtctgaagatcagatggacagaggatgtttagaacctgatgtcgtggaggaaatatacgaggagggctctgcaatgcttgctcgaaggttgaatataaattacccatcgggaaatatgttcaagctgcatgattgtgctgtctgccaattggagatgaaacctggtgagggcacctctgttcatggtaacatgcccaagcattcaagagttgacccctggggtggtccttttctctgttcctcctgtcaattgaaaaaggaggccatggaagggaagctacattcaagaaattcccaatttgatgttcgacctatgcctaagtaggcattccctggcggtttctatacattggttcatacacacaaactaccactaacaacatcattatcaaataaagtagactcgacaatatcatcttattcatcaatcaatgtctgacagaatcaggaattttcacctactacattcttatcaaatggtgaagcagagtgacactgcgcgccctcttgcatatcgaatttaagctatggcagccattgttttctgctgcaaggatgagttcattacttttttggccaaggcagcaagattctcaatacgggagtcatttgtatagacgttcctaatttcctactcgtctttcccatgaaagagcccaaaaaaaaaaaaaaa

SEQ ID NO: 11730 - DNA, 3275 bp, Zea mays
gcgttcggcctgacctcccaccctccctcttgggtccgcgcagggtcccgatctcccaccttgtcctccagctcgatcgcgttcgcggcaccccactccgtgctccagaaataagtagccggcggtttcctcgccccaggttttgcggttgctggggagtgggaattcgttcggctccggtctggccaatgctcctgcggtttcttgtagaggccgctgagattgggatccaaactgcgttaggcgagcagcagcagtagccgcatcgagattcgccgtcgttgtccgagggattctccgtttcttgggcggggatttcggttgcggcggaaaaaaaaagaattctttcaccggactggcccaactcctcggttgatccggtgatccgttacaaaaggcctccgctgtatgttagggtagcctttccgacgcgtttctttcgtcgccccagatccgtctccccgcccgattctttcggaggaatcggcggcggatcggaggcagaggggtttggaggcctgagctccgatggagatgcacgccgacgtcgacgggtgcagcgtgcccctggccgtgctcctcaagcgggagctgtgcaaccagaaggtggagaggccggacatcctgttcggggaggccaacaagagcaagaaaggggaggacttcacgctcctcgtgcccaggtgccaccgcaccccgggcggcagtggcggcggcgagaatgccggcgacgacgacaccatttccgtatttgcgattttcgacggacacaatggctctgcagctgccatatacacccgggagaatctaataagcagtgtgttggctgctattcctccaaatctcacaagtgaggagtggaaagctgcgctgccaagggcactagttgctggttttgtaaaaacagataaaaacttccaaataaaagctgcacgctcagggaccactgtgacttttgttataatagatggatgggttgtcactgtagcatcagttggcgattcacgatgcattctagaatctgctgagggttcaatatattttttatcagcagatcatcgcctggatgctaatgaagaggaggtggagcgtgtaacagcaagtggtggtgaagttgggagaataaatatcgctgggggtgccgggattggtccactcagatgctggccaggtggattgtgtttatcaaggtcaataggtgatatcgacgtcggggaatttatagttcctgtcccacacgtgaagcaagtaaagttgtccaatgctggtgggcggcttgtcattgccagtgatggtgtgtgggatgcactgcgctttcaagaggctctgaactacaccaggggcctgccagctgaagctgctgctaatcgaattgtcaaggaagctgtcacttcgaagggattaagagatgatactacttgcatagtagttgatatactacctccagagaagttaagccccccactaaagagacctggaaaaggagtcatcaaagctctgttccggcggaggccctctgatgaaatgtctgaagatcagatggacagaggatgcttagaaactgatgttgtggaggaaatatacgaggagggctctgcaatgcttgctcgaaggttgaatataaattatccagaaggaaatatgttcaagctgcatgattgtgctgtctgccaattggagatgaaacctggtgagggcacctctgttcatggtaacatgcccaagcattcaagagttgacccctggggtggcccttttctctgttcctcctgtcaattgaaaaaggaggccatggaagggaagctacattcaagaaattcccaatctgctgttcaacctctgcctaagtaggcattccttgacgggttctatacattggttcatagacactaactaccactaacaacagcattagcaaataaagtagactcgtcaatgccatcttattcatcaatcaatgtttgacagagtcatgaattttcacctactacattcttatcaaatggcgatcggtacagattttagagatttatggtgtcatttatatgatgcactacagttgttcggtagtagaaggttcaagtctgagccttatcaagtctatattcagagagaccacaactggcctctaggatcaaatgaactggtggccttaaggtgtgctgctttctatagttcttgcattgattatcaagtctgcacgacttgtctatttgtgaataccagtcgttggttgaaccccatttagtcctaagtcccaacgtagattcctttttgtttcttcacatgacatactgcttgatgggtggccataaagaccatgctttttccactctctcagtcacatgtgatgcttccttattaatcctctcacaacgtggatttccctttttcattctttaccatgtgtatagtcacgaggcacatcagtacatgacattggctattttttttgtatttgcaccataattctgcagttgtaccattgtactctcaattttctaacatttttttattttttttgttattggaactttcgcttcctatgtacttgagatggtgttgctgaatttgaatatatttctaagctttatggatgtaatttggtacatgtaaatcttgtcttggcaaagagtgaacatttccaaatctgctgtatatatttctagcttaactgccatctgcaggtgaaaaaaaatcaatagtcagtatgaattacattagcataaacacaacagagcttttagaggttgtttggtttactgtttaacttgtcacagtttgccacgtctaaggttagacaagtttgatcaaattagacatgtgtttggtttgaagctacaattgtggtaagattgttctcctgctacgtaggtcttactcatcaataacggataaaagtgtggcaagatttccttagacgtgacaaactatggcgtagaatttaaaagtctaaccttagacaccttagataagtgtggtataaaaatatgttgcaatttttagcaacataagtatagaaccaaacagtcccgtagtgccgataactactagctagtttggttggtaattgtcctccaatgttagatgtgttataataataataataataataataatagtccatccagtcgtactagtggagtgtcatgcttcctatttggttgaactcctccataataattcataacgcttagctccttgattttctactattcactaaaagagttattctgatggaggaccagggtagggagcaggttggaagtgattct

SEQ ID NO: 11731 - DNA, 1668 bp, Zea mays
cggtcgcgtgggtttttcttaagtttcttcttgataaggatccaatcaaacaactacttgaagcagatgagagaaaaatcaccacaagttcactgtttgctgctggaacttggtcggtaggttcatttaataatattctaacagactttaaaacccagcagcaaacagtgaacttgtggtgatttttcttaagtttcttcttgataaggatccaatcaaacaactacttgaagcagatgagagaattgagtgtgatatggatactgcatgacatgtagaacagctagtagtttttggaggatttacagacacccaatttttggaaaagagtttggtaaatcaattcaatgaattggaagatagcttgaaggaggctttcttgatgccatttactgctatctcttcgcagatacaatgtcaaggattgcttcctttatatcctgttacatcatcagctaccttgtcatcatcctgctcgccaacatcaatatcattttataaggatgaagattcatcgcatgaggaatcctcctatagcttgactgactatgtatgcttgaagatacctgatggatcattaaataaagtaaattgcatcggtgtgataaagggctctggtaactgttgtactaccctcagcatgatgtcactttcaggttttctgttgcatatacctgacggatatgagtgtgttgacctgtcactttataaggacaaccaggtagttttactactgagtgaaacgtcttgttctgatagccctggaaaatcttggatggtgatgctgcaaatagagaacttttcctttatgccactctcaggaacattccctgcaaatatttacagtttgcaaaaactggtggcactcgatctgcaattggacacagattatgggaaagttcgtagcatacctcacaccgtatctactccatttgcagttagtgcatcgagaggagtagcctgtgtcttttcatcccggaggcatgccttggtttatatccttgatgaggatgaggaagcggagggggatgaaacttccgatatggagtgattattatccgattccttcaccttcggctcagccatttcagcttcaggcttcagcattgtcttatgtcttgttgcaatggaggcagaggcccggagatatcaatatgtacggaaacgtcgtctcattttcacggcaatgcatgcccgggttcagaagctacgtcgcgtggtaacagcctaacaggtcaccacgcacgcgcagccgcttttagagctcatgaaattgtcagtcgtcaccctgatgtgtgtaggccctgcaggttggacttcatcgtggttatttggaaagcgagcaaaattgtacacccatttctgatcgtgttgtgttatacgagtgcttgctagttgtgtaaaaaatctagaggtaacgtcaacgtgcaaaaaaaaagggtctgtcgcaaatcttgacggtcactagagctatcgcatttctaatcgtgtttgtgttatgtggattcattattttattgttcgagctgctaatgtacttggtaaaatacattgttgactgaaaaaaaaaaaaaaaaaaaaaaaaaaaaaaaaaaaaaaaaaaaaaaaaatccaacaacaagaaaaaaaacacaaaaggggaagcgaaaataaaaaagtatacttggg

SEQ ID NO: 11732 - DNA, 3109 bp, Zea mays
ggttacaagtagtcggtgctcctatcggggtggattggagcttatgagctgagaggtggagtcctaactaagtcttggcttgacgtggctctaacctactggtccttgttggttctcctcctcctgttcacccttgtgagttcgtctccgtctgaaggtgtctagtcatctccaagtcgatctcttctctctgtctcaattcaccgccctgttctgaggtgaccctcccccttttataggccgggagaagggtcggcaagtgatggattctctaggaaggagtcgtaaggcaacgttttaccctgggtgagtccatccgtactcgtggggcccaggggtgcctggttgtcgcgtattttatgtagcggatgacgtgggggcggcgatggtccaaggcgtcattatttcggctacgtcgacccctgactttcgtagcctggatctaggtgtagcccgtcatgtagtgccatgtgggaggtgtgcgcacttaggcctagctcgataggccatgagttcgtcgtagactgaggggcgcgtgggctgttaatgcatcgcagttcgggggggtcatgagtgttatgcggcccgaggggttcataggtcatgagtgggaagcggaccgtgcccacgctgtcactcggtgccaggcctgattaatgcggccagtcatttatggcgggccagtccgaggccgggtgcgagatccactcgagtagttcctttccgacacacctgtcctcccttgtcaggctccaccatgcacggtcccaagctcggtgtcgcggggtatcgaccgagaacgagtccttccagggttggcacatctatctcttcggattgactaacgggtcccagtgattaggggctctttccttagcgcgctcattaacatgtgggtcctagggtccgggggtcattcccccgacacagatccatatatatatggagtacaattgatagtgcgcttcaccgatcgaaccaatcaaattatttatcaatgtcttactttcttgctctaggagcagcagtaattagtcttttttatctacgtctttacctctctgtgactctacgtcgtcttgagacgtcttgagtgtcctaccgactataaagcaaaccttataatcgctcctccctgacgggattatttcgagaagacgagatctaggtgttgtagacgaccgccgccgttgccttcgtgcacgcgtgggccatcagaccctagggacggatcgtccaactctaccgtgcactcttgctgcacgatcacagaccgtctagccccgtaatatgaccgtctgtcaccacagagagaccatcaaacagaacaaaccctaatgtttggtcccgattcgggtccaacataatcattccgttttctctgactctttaaagctgtgattagtttcgctaccgtaggagcgaacttgaggttgggagcgcaaataactggcggtgcgtcgagcactagctctgcagtctgcacttgcccggcgccttggtactacccccgaccccgagctctgaaatgggccataaacaactccgtgattctggacggccatgtgagagcacgcgggcgtaccaagcacgccgtccccagtcaccacccggccgaggagaggaggtcgaacggccattccttacccacaccgcgcttcaggtgtcaggagtcaggacccgccggtgatgcgctgctaaccacctcgttcgtggaagcgcccgcggatccggcgcacgtttcgctctgtcggcctgacgaggacgcgcctcggccaggccaacatcgctgccatgattgggtgttccaacgacgagacagagttctctacgccacacgtccccctataagtgcaagcttgaaaatagctatcgacacgaactcagtgtgctcataggttcctgacgtacgtatctcagttgcgttcgagcgttgtggacttgtggtggtttccttcctgcgccggagaaggtagacgatgggaaggggaagcgatgcagtgccggacgcccgtcgagctgcgctgctcttgatcgtctgcttggcggctcgagcggcttctgcgatccaggatggtaagaggtggcaactgtgctgtgtttcgtgaactctctccacgccgtaaacaactagttcgtagcttatgtttgatttttctttcgagctatacttttattgtcaaactgaaattgggggccggggatcatctcctgcagtccgatccatttctaacgatgctagttcagaattcagattaggcgcgtggcctactggcgtctcattgccaaggtgtttgctaagctgaaatgtcagttctaactgcgcggttcaatggttcatgctcaggcctgttgccgaacggcaacttcgaggaggcgccgcccaagtcgcagctcaacggcacgagggtgatggggcgcaacgcgataccgcactgggagatctccgggtacgtggagtacatcgggtcgggccagaagcagggcgacatgctgctgccggtgccggagggcgcctacgccgtgcggctcgggaacgaggcatccatccagcagcgcctcgccgtgacgccgggcgcgcgctactccatcaccttcagcgcggcgcgcacctgcgcccaggccgagcagctcaacgtgacggtcgcccccgagtcggacgtactcccgatccagacggtctacaccagcagcggctgggactcctactcctgggccttccaggccgcgggcagcgtcgtgaccctgatcgtccacaaccccggcgtcgccgaggacgcagcctgcggccccctcatcgatctgtttgccattaagaccatgccgactcctcggagcagcaagagtgagatttctctctagcaccttccgaaccgaagccacgagacgctgaaggaatggctaaattttcctgcaggcatgctgctgaagaacggggacttcgaggacggtccgtacatcttccccaacacgcagtggggggtgctggtgccgccgatggacgaggacgactactccccgctggccccgtggatggtcctgtcgtccaccaagtcggtgaagtacgtggacgcgccgcaccacgccgtgccgcacggcgcccgcgccg

SEQ ID NO: 11733 - DNA, 2104 bp, Zea mays
cattgggtacctcgaggccggccgggaggaccgccggtgatgcgctgctaaccacctcgttcgtggaagcgcccgcggatccggcgcacgtttcgctctgtcggcctgacgaggacgcgcctcggccaggccaacatcgctgccatgattgggtgttccaacgacgagacagagttctctacgccacacgtccccctataactgcgggctcctcgaggccggccggcacgaactcagcgtgctcataggttcctgacgtacgtatctcagttgcgttcgagcgttgtggacttgtggtggtttccttcctgcgccggagaaggtagacgatgggaaggggaagcgaagcagtgccggacgcccgtcgagctgcgctgctcttgatcgtctgcttggcggctcgagcggcttctgcaatccaggatggcctgttgccgaacggcaacttcgaggaggcgccgcccaagtcgcagctcaacggcacgagggtgatggggcgcaacgcgataccgcactgggagatctccgggtacgtggagtacatcgggtcgggccagaagcagggcgacatgctgctgccggtgccggagggcgcctacgccgtgcggctggggaacgaggcatccatccagcagcgcctcgccgtgacgccgggcgcgcgctactccatcaccttcagcgcggcgcggacctgcgcccaggccgagcagctcaacgtgacggtcgcccccgagtcggacgtactcccgatccagacggtctacaccagcagcggctgggactcctactcctgggccttccaggccgcgggcagcgtcgtgaccctgatcgtccacaaccccggcgtcgccgaggacgcagcctgcggccccctcatcgatctgtttgccattaagaccatgccgactcctcggagcagcaagaataatatgctgaagaacggggacttcgaggacggcccgtacatcttccccaacacgcagtggggggtgctggtgccgccgatggacgaggacgactactccccgctggccccgtggatggtcctgtcgtccaccaagtcggtgaagtacgttgacgcgccgcaccacgccgtgccgcacggcgcccgcgccgtggagctggtgtccggcatggagacggcgctggtgcagaacgtgaccaccgttcccggacagctctacaggctccagttctcggccggggacgccggcaacggctgcgtgggctccatgaccgtccaggcgtacgccgcgcggggcagcgtcaaggtgccgtaccagtcccagggcaagggcggccacacgcgcggcgtgctggacttcgcggcggtcgcggaccagaccagggtggtgttcgtcagcatgggctacatcatgaagcccgacggcacgctgtgcggacccgtcgtcgacgacgtctcgcttgtctccacgcggaaccatcctgctcgccgcttgcttctgtgatgctaccgacaagattcgttcatgggttaatgtgaatggctgtgagtgtgctcgaactcgaatgctcgggcttcatttaaccagatctgggtagagtccacggccatcacatgtatttgcatcgttgttttgtctttcttggccaaatgtacttgcttcgttgtagttgtatagactatgtatgcttcgacgggtgtccatcagaccgtgtttactggtacattggtgtttgattaccttcgtcccgagtcgagcccccttcgtgtgtttggttgcacgtccgatgatagcctgactcactacatacgttgactctctaaatgtgttcggttacccgtatgaagatgattaagcatgtatgcatcgatgcacgttacttatttgcagaagtcttttaccttaatgtcgagatacgtgcgaaagtgccatatgtgttgggccatgctcacgtgagtccggctatacagacacaggcatccaatcagcgccactgtaaatacatatcggcatatacaacgtcgatccccttcccaacccaactcttacattgggcttgttcgttttgctcttaatcaatataaattgtatgaggttaaataaatttaaatcctaaataattcaaaatctttcatgat

SEQ ID NO: 11734 - DNA, 1276 bp, Zea mays
cctcgcccccggccggaaagtgttgtagagcagacgaagctagctaacaattaagcagctcgatcgagcacacacacacttgatcactactagacagtaaacacattgcgcaaaggccgccatggcttaccgcgcctttgctacgctgcttgcagtgctagcatttgtgggcttcgcttcagttccccgtggtctggcaactgacccgacccagctccaggacttctgcgttgctgataacaagaaccctgtgctggtgaacggggtggtgtgcaagaacccgaacatggtgaaggcaaccgacttcttctccacgatagtgccggtggcgccaaacgggcagggctccgctgtgacgccggtggcggtgaacgagatcccggggctgaacacgctgggcatctcgctggcgcgcatcgacttcgtccccggcgggcagaacccgccgcacacgcacccgcgcgggtccgagatcctgacggtcatccagggcacgctcctcgtcggcttcgtcacctccaaccagctgctcaacaacacgctcttcaccatgcagctgaacatgggcgacgtcttcgtgttcccgcaggggctcatccacttccagctcaacaacggcaagacccccgccgtggccatcgccgcgctcagcagccagaaccccggcaccgtcaccatcgccaacgccgtgttcggggccaagccgcccatcctggacgacatcctcgccagggcgttcatgctcgagaaggccaccgtcgactgggtccagcaggcgttcggcgcggcaccagtggccggcggcggcggtggcctgcccggaggaggtggctatcccggcagcggtggtggcctgcccggaggaggtggctatcccggcagcggctttccgggctaccccggccgtagctgatcggtacggtggtggctccacggcggcgccgcctagctagcatgctgcacaagtgcagccgcgcgcgcggatcaggccgtcatacacaaagtatacttatatatagtacctcaaagtcctcaagcattaagccacgtgaagtgaaggctatacgtattaagttcggttgtaatggtcaggtgtaccaaacacccaccaacacctagctagtgagcaggcgcaatgcggcgtctgtgttgatcgagccgtagctctagctctagctcgatcgggttgaataatttgcggcaaaacttatagatatatatggaataaaatcgaaaagtttcatcgtttcaaaaaaaaaaaaaaaagacgcgtggg

SEQ ID NO: 11735 - DNA, 2248 bp, Zea mays
gcacgagaccattacctagaacatcctaatcaaaaaccgcccaccgcaggccgcaagtcttgcggctcctgcccggcctagcccggccattgctccttcccagttccgagttccgacctcccgagcccgaagccagaccacgccttaaaccccgtcaatccgagatccgacggcccagatctttcgtctctgcctctccccgtctgttccccatcttcccgtccccccgccatgtcgccgccggctgccggcgcggccgccaactccggcgatgggacgcctccgtcgccgcgcgagctctacaccatcccggcatcatccggttggttccggtgggacgggatccacgagacggagcggcgggcgctgccggagttcttcggaggggcaggcggcgctgggttcgggacggcgacgcggaacccgcggatctaccgcgagtaccgcgacttcatcatcgccaaataccgggaggacccggcgcgccgcctcactttcaccgaggtccgcagggcgcttgtcggggacgtcacgctcctccggaagctctttgccttcctcgactcctccggcctcatcaacttctcggcctcctcgtcctcggtccccgcgtcgcggcagcaggaggtgggggtcgtcgtggaggcgcccgtgggtctgcaggtgacgccgcgtcctccagcgtcctacttcgccgaagagaagcgtgtagcggcgggcggggagaaggagaacgaattccggttgccgccgctgacctcctacagtgatgttttcggggaatgggcacctgggaaggcgcctatatgcggtttttgcggtgaggagtgcaatggtgcggatgttgagacgctgcaggatggttttaaagtatgttcaaaatgttccaaaagcaataatgataatatcaaggaagaggcgaataaatgtcctggtgacaaaaaagagaatatggaaaatcatgcttccagtgcatggacagacactgagacgttactccttttagaaggagtcctaaaacatggagatgattgggatcttatcgctcagcatgtccgcacaaagaataaatcagaatgcatagcaatgcttattcaattaccttttggcgaacatatgctgggcacaataaatggtaaattcgttagcaggctccacataaaccaggcagatgatggaaaaacgaaccagcacattatggagtcttcaagtcactcaaccgaaatggctgatggcatgcagattgatggaagtgaagatagtgctgataaatcagttgaagaatatcctacaaaacgcagacgattgtttttttcaatggatgctaccacttcattgatggagcagttagctatcctgaccacagcagctagcccagatgttgctgctgctgctgctgatgccgcaattaaagcatttggcaatgaaaacccgcaagcaaggaaagcctttcgcctcaacgagcaagaatataagactaaggcttttgcttctaatcatgtccaacagattgaccacaaagttggcaataaggatacggcgatgcatggccagagtggttctgataagcaggaaaagaagttcattgctagcgcatatcaattgagggcagctgttgctactgctgttggtgtagctgctgcccgtgctaaaatgcttgcagaccaggaggagcgagaaatggagctcctaatggcgtctgtaattgaaactcagctaagaaagatgcaatacaagatcaaacactttgaggagctagattcactcatggatcaagagtacaccgctatacagcaaatgaagggatccctcatgaatgaatggataaaggtccttgagcatgcattccgggctggagtgtctctaccgagagatgaattgctcaccaaactgttgctgaactagccgcccatcccatgaggacctggctgtagtcgagtagttctctgatatgcgtcacccccttgactgttgctggtagatagcttcctgcgtgggtgcgtctgtaaaggtgccgattgtgctttcgatttctcagaattttggggatcagaacaacccttcgtaactctttgccctgttgtaccaactaggttagatggcaaaattgctgaaattttcttgtagctgttgacatgtatggtttcgttcgtatggatgtgaaaatggtacctcagttttggagtttcaaaaaaaaaaaaaaaaaaaaaggccccccgcgtccgccctcgcgtccgcccaccgtccg

SEQ ID NO: 11736 - DNA, 790 bp, Zea mays
gccagagcagcctactcggtctcggaccaagcagcggcagcaaagccacgacagcagtcgaagcgcgcggcgcgcctgcctagccatcccggccacccggggcccagggcccagggggaggggaaaccgaggcaggcggcggcggcggcgcagggcgcacgcgcttctcgtttcgtgtccccactccccagccgagggggagttggagggaaggaacgggaggcagcttcaaggaggaggctggcggccgagcgtccgtgtggcatggggagggacgagctgctgcggcggagcctcgtggcgctggcggcggccgtggcgctcacgggcttggccacggcgtcgctgcgcaaggcggcggccacgtacggcttcggcatcctcgccatcgctggcgtgctgcttccggactgggagttcttcgaccgagactactcccagtggctcacccccatgcccgcctcccgacgcacggccgcggccgcggccgccgaccgggagcacgacgtctggaaattcaagccctatcctctcagggtggccatgctgacgaccatctacgggttcggtcttcacaagtggtggacgtacgtatctagctagcggagtgggtcttcacagcatgaccgacgaacccgaaggttgaaatatcattgattaggttgtagccaagttcctcttttttttgttgttggattggaagaagcaaaatactgtgacagcgccttgtcatatatcatcagttcttcactgtgaccatgagatgagccagctgatatgaaaaaaaaaa

SEQ ID NO: 11737 - DNA, 5276 bp, Zea mays
ttcattttcctcatgtctcacccaaatccaccgcgacacaacaaccacctgtctcacccaaatcctccgtgacatttcaatcgccgcaatggtcgccgcctcttccgttacgcatccaccgccagcttctccgtcacacgaatcctcccacttgcatgcttcctcatctccaagaggcgacccggaggaacacacgctcccagggacctccctggcgccgaggtgatttgtgctgctcccactcgccgtgttccgcctcgccttatctctgttccacgcagccttatctgatcctgcttccatttctctgataggtttcggtggagacagaagtaaagacgacagtacccgacgaggtcctgggcaaggccaaggcaaggtgttccattgccctatcgtgttttattttatttgtactactgttgtcccctatggtttaatttcagcagtatagacagagctcgtcctatctctttggttgaagctttcccaaatatgatatctttaaaggtcattatgatatcaaattattaataatggatctctcaggcttggtaaattagtggttttaaggtattaacactacaatttttggtacatctcaatcctgtctcctgtgcattgtccatctatataggtgagtttgtctatgtcaatagaatcatttgctgaaccgaggacacattatttatctatcaagacagtttgtaacaaatgagatgattggcaatggttataaatagtgtagtataaactttatatatgtaaaaccaactaaagttgttattttatttctcggagattatattaattatttggttgttttatgatgaaatgtaatgaataaagtatgtacatgtagcgatattaatctaatcctatgagttctaatcctatgagttgcgctagatcaccttccaaataattatgagggttgtatttcttgggcaatgtcactttttctgtgaaatttggttctgaataatcacatgtacttgtagtgcttgcgcaacattacagtagccaatcaatgaatttgactttacgcaggtggcgagctgggagcataattgctgtcatgcaacatccttgcaatgtccttcgtcccgcgagactcccacaaggcgcaggttcagtttgcactagagcgtggcgatgattggggtccttgcctctaatcggttcgcttatccggcacattcctttgacatggcgcactgatctcattgcctcatcctatggcagctttatggtatgttgaattactatcccccaggactacaagccttcaatgtctccagctgattacccattgcttcctgctcctatgtatgtgcagatgggttgtacttgatagaggttgatcgtatcctgcgtcctagaggttatttgattttgtctggacccctaatcaactggaagaaacactggaaggggtggcacaggactaaagaggacctagatgcagagcagaaagccattgaggcagttgcgaggagcctctgctggaagaagatcaaggaggaggacgacattgctatcgtgttattatacggttccgttgcaacgcacgaacactcatctagtaaaccattattacacgtactattaatggaccagacggtggttaatgggcgaaatggatatagctgccacatgcggaatggcaacactcccttttgagatgaccctcattagagatggcaatgggtatatacgcgtcggatagtagcattcgataccagtacccatcacaaaaattatacccattgggttatccatatacactcgcgggtatcaaatcttacccatgtctgtacctgcgtgggcaattttacccgtcgggtaactcgtacccgttaagaagatctcaaattatattattccgatcactcaaaatgtcaaataaatactcaaaaataagtttaacttgaaatattacgaaccatataattgcacaacatgatagttaaataaacaatagctaaaggagagttttattttatctatgatggatttttttagataataatagtgatataacatgtgtatattttacccacggatatatgggtatgaatagtatccacccttacttgtttactcaataggtagaaattgttactcattaacatatccgcaggtatcaaaatcatctatacctgcgtcggatagggtaccgatcgccatttctaacccgcatacagtcgtgcatgtgaaaaaggagttcacggttctgttttatcaagagaaaaaaaaaagacctcacggtttcgagcccatcaagccgtcacgatttaacaagtgcttcgacgaggccgggccttgggcgaattgcggcccatataggcgttcaactgcatgacaaagcaagcgcggtcacgtccgagatgattttttacttgtcgtgggccgtgtccagtgggtgatcctgtctctgacggtctgacccgtcgcctccctctccccttgacgtgcgggtgcggctcctcctcgccgacggcgccagcgccgcctccctcgccctctcggcatagaccggcgacggtagctgcatcttcgagtccgcaggtgctgacttctcactccggcagccccccttcccccgctcctcttctctcgcacgtcttcgcgttccaacggatgtgacatttcctcgcgaatccacggctcctcggatgggatggtaggtctggttgggctcgtcgttgtcccagcgcctaagagagcgtcctcctaattctatgcaataattttctttttaacgactgagagcctcgaatcctcctattattatgcaatagagttttttctgactgctccacgcgccgttccccttggaaatttcgaccgctttcgcgttccccgccgccacgtctggtattattccttcctcccgctcgcttcgcttccttgccctcgctgctaccccacgaaaattctcgaatccccccgaaccaaagggcggcagaggagtcgtgctccggtgacgggcttggtttcgttcgcttccctctcgcagtctcgctgctgattcgccgccctgttcgcttgtttctcatgttcggaacgcggttactctctgtgggtttcgtcgtcttctgtgctgttttttttcgtgggagatcggtggcattttagtggcggaacctggggcttctcgcacgaatcgtttgcagcggggcgcaagtgctcttgagatggaagttgaattgcatctgttgataatttctatcccatcctcccctttttgggagagattgggggtgcattcggaccatttccttcgtcttttgcagtatgttattttgcgttagccctatgattggttcaattgcataccctattgttgatacactattttcatctggattttttgtgctaattttgaagggtgaacatcatggtcaattttgcgtatacttcacatatagtccaatctgtgtatatagtactccgaccaagtcttgtacaagtgcaattctccatgcacctaatctcttagtcaatgttcaacttgtttggacctataacttcagagccttggtctttactttccacttttctagctccatatggcttctttgctgtgccgctgctgaaactgtacttaattcacattctgtatttcttgactgttgtggtgattgaagtggttgcagtgaaaactagaagggaagaacagcctcctaatggataggaacaacgaactggaagaggtggtcccaaatgactcggaccctcttattgggagggagaacagggagtcagagtcatcggtagagctgtcaccgccacagccagcaactgtgaacctgctggagattgaggatgaagagaccgacggctcttctgctgcgtgctgccgcatttgccttgagaatgagtctgagataggtgatggtccctatgatgctacctcagtgcattttttgttatgtcagttagttcactttattttgattcagaaatgcttctgcctggtgttaatcttctttctggttgtaacatgttcaaaaatatgaagaatactcatacctttgatttgttacttacctcgtcaattggtctaataaaattctctgtactgcatttactgtgtgactagagaatatgatatggcttggccatactgccataggatacatgcaacaaaataagaccaggaatgttagtttgctcatgttgaacaacaaccaatttgtaattcaaccttggtatgtgaataaattgaaatttattgcctgtttatcaggattcatgatgcatattgggctaacatttgttttgggtaattgaacctatagaaatgatggatacaatatattggttgggtgcttcagttttctttccctatccagccaacaaatgatgtaactgagcttgtcattcttcttttaatgtttttgcaggtgatgagctaatatcaccttgcatgtgcaagggaactcagcagtttgttcaccgttcttgtcttgaccactggcgatctgttaaggtacacccagtgctttcataacatcttccatatcaatttccttcaaggacattatatgtgctgtgtgcttttcaattatattgccaacactaatgccattaggttggtaattgctaatgaagactctttgtggggtaactggaacatattacatagaaaatatacacaaggcagtgctggagtagttgaagtttaaatggagattaaggcatctattgttggtcaggtactcaggtcatgtgtaatgagcaagaaatggcaatgctgcatagatgttaggttttgtttttctctggtggtagtagatgattgtgttcctgcaatgcacaagaacccaagcttttttttcttcattaaccaatttttttctttcaaatggcagattttgacacaaaatcagatttttgacatgtactggcagtacactacttgttagaagttgagccgcatctcttcaagctatttttttcagcttgatctggaggttaaactgtagaatgcatggtcttggctgccatttctgtgtcacgtaaagtctagctgcactaaaccttctattaaagtgcttgaacttctgctccttagtggccttagtgattctctttgctcttatttcctagtttgatgtcatgggtattcaaatacagtatcttaacttttatctttaagctgtcctctatttatgtggaatcaatggagaataaagttatgtactagttttgattttcatatttcatgattttgtaggaaggatttgcattttcacactgcacaactg

SEQ ID NO: 11738 - DNA, 1451 bp, Zea mays
cctcgaggccggccgggattttttacttcttgccgtgggccgtgtccaggccgggatcctgtctctgacggtctgacccgtcgcctccctctccccttgacgtgcgggtgcggctcctcctcgccgacggcgccagcgccgcctccctcgccctctcggcatagaccggcgacggtagctgcatcttcgagtccgcagtggttgcagtgaaaactagaagggaagaacagcctcctaatggataggaacaacgaactggaagaggtggtcccaaatgactcggaccctcttattgggagggagaacagggagtcagagtcatcggtagagctgtcaccgccacagccagcaactgtgaacctgctggagattgaggatgaagagaccgacggctcttctgctgcgtgttgccgcatttgccttgaggctgagtctgagataggtgatgagctaatatcaccttgcatgtgcaagggaactcagcagtttgttcaccgttcttgtcttgaccactggcgatctgttaaggaaggatttgcattttcacactgcacaacttgcaaagctcagtttcatcttcgagtggaaacctgggaggataactcatggcgtaaaatgaagttcaggatctttgttgcaagggatgttctactcgtgtttcttgctgtacagcttactattgctatcatcggtgcgattgcatactttttagacagggatggaagtttccggaacagttttagcgatggttgggaccgcttcttgtcaaagcacccaatacccttctactattgcataggtgttgtgattttctttgtgctgcttggattcttcgggctgatagtacactgctcatccttcaacgacaaccaggatccatgcctagctgggtgccggaactgctgctatggttggggcatcctagactgcctgcctgcttccctggaggcatgctttgccctggttttggttttcgtcgttgtgtttgccatccttggcatcgcctatggcttcctcgctgcaaccatggcggtccagaggatttggcagaggcactatcacatcctgaccaaaagggagttgacaaaggaatacgtggtggaagaccttcacggcaactacacagcgccgaagcttgatccggagcatgaggaacggctgaagatgctgaagcttctttagagagagaaagaggtgcacgccttcctgtatccgtggcaagtgcatcaacatggggcaaccctctctgcgtgccagattagggaatggccatcccataacactgtacaaaatgatgaaatcctgcttggacttgtatgaaatctctatccgacgaaacaaacagaagttctcagttttaccttctcggtaaccttcctcgacaaaaaaagtaacaaaaaatcttccggccaagtgtacgtgttcgtctttaatctttccctttttttttt

SEQ ID NO: 11739 - DNA, 831 bp, Zea mays
cgttttttacttcttgccgtgggccgtgtccagtgggtgaccctgtctctgacggtctgacccgtcgcctccctctccccttgacgtgcgggtgcggctcctcctcgccgacggcgccagcgccgcctccctcgccctctcggcatagaccggcgacggtagctgcatcttcgagtccgcagtgaaaactagaagggaagaacagcctcctaatggataggaacaacgaactggaagaggtggtcccaaatgactcggaccctcttattgggagggataacagggagtcagagtcatcagtagagatgtcaccgccacagccagcaactgtgaacctgctggagattgaggatgaagagaccgacggctcttctgctgcgtgttgccgcatttgccttgaggctgagtctgagataggtgatgagctaatatcaccttgcatgtgcaagggaactcagcagtttgttcaccgttcttgtcttgaccactggcgatctgttaaggaaggatttgcattttcacactgcacaacttgcaaagctcagtttcatcttcgagtggaaacctgggaggataactcatggcgtaaaatgaagttcaggatctttgttgcaagggatgttctactcgtatttcttgctgtacagcttactattgctatcatcggtgcgattgcatactttttagacagggatggaagtttccggaacagttttagcgatggttgggaccgcttcttgtcaaagcacccaatacccttctactattgcataggtgttgtggttttctttgtgctgcttggattcttcgggctgatagtacactgctcat

SEQ ID NO: 11740 - DNA, 5608 bp, Zea mays
  misc_feature (4899)..(4899): n is a, c, g, or t
accaacatggccaggcgcagttcaagcactgcgatttcgtttcaggtcagccgatggcgacggagatgtggtcaactaaaacgatccgacagtaactacagtgagttaatgtttaccaaaacccaattcatcacaactgtcacgcttccggatcgacgacacccgtggcaatccgaaggccagccacgctccagttgccgcagtttccacgagaacactagaccaggccaggtgtccccaaagcgcgaccgtttgcatgccaaaaattaaaattaaaaataaaataaaaccaccagcagccgcttccttcctcctccacataaataagcacacctgacacctctccgtctctccacctccacccgtggccgtggtaatcaaatcgaacgcacatgcggtgcgcctccctttcccgacctccccctgtctcggcctccacctaatcccgggcaccccaatccgaggagtcggcacgtgcgctttaagtgagcgcgtcacacgaaaagcagcaggtagccagccgagaccgggagagaagcagcagcagggccgccaacgccatggcggtaggcgcgaccgccgcgaagctgcacctctcgtcggcggcagcggccgcgcgccgcccgtcgctgctccacctcgcggccgtggccgtcctctgctcgctgtcctacctcttcggcatctggcaccacggcggcttctccgctggccccgccgccggcggcgccacctcctcctcctcggtctccatcgccaccgccgtgtcctgcgcctcccccgccctgacgaccgccccctcgtcaccccccgcggggccgctcgacttcgccgcgcaccacacggcggaggggatggagtccgaggccgcgctccgccagcgcagctacgaggcgtgccccgccaagtactccgagtacacgccctgcgaggacgtggagcgctccctgcggttcccgcgggaccgcctcgtctaccgcgagcgccactgccccgcggacggcgagcgcctgcgctgcctcgtgccggcgcccaggggctaccgcaacccgttcccctggccggccagccgcgacgtcgcctggttcgccaacgtgccccacaaggagctcagcgtcgagaaggcggtgcagaactggatccgcgtcgacggcgacaggttccgcttccccgggggcggcaccatgttccctcgcggcgccggcgcttacatcgacgacatcgccaagcttatccccctccacgacggatccatccgcaccgcgcttgacaccggctgcggggtaagccacttcgatcgcaatcgtacacgaacgcgcactccatttttcgtgaaatgatgatcacgtgcacgcaacaatgccttgtcaaggcctgcacaaattcgaggtcaatttcagtcagagtttggagaacagcaatcggagatctcgggaatggcgttggctagctttgcgggtgtcggaagtttccaatcccttctccgcttgtcgggtcagagggtttttgtgtctgtgaacgggtctcacccaggtaaacctcgtgcctgacccgataagagagcatcgaatcccttcacttggcaacggcggtcaagccgcagtgaactgtcacacgctgtttccactgacagaccagaccaagccggatcactgctgaagcgtatagtagatctgaaatctctgcaataataaattaataatgctgctgccaactatggttgatatctacgtgcttgtctttttctatgcagctgtatcgagaacgtaccactaatccatcagaacgttttcagccatatatttgcaatcgcgatatcatcgaattcttgattggaagttaggaaggtgtatctgttgtttatgccgctggctgtggcgtcgttgtaatgggtcccctcttacagctgtgactgttgccagcttgaccttggcattttgatctgattgttcgatgcataggacctgcagtaatagcgattttttcccattgtggtgctccttgatttgggaactaaacctgtgtggtaactgatgatcaggttcattttgctgctttgtacaggtggcgagctggggggcctacttgctgtcacgcgacattcttgccatgtccttcgccccgcgagactcccacgaggcgcaggttcagtttgcactagagcgtggtgtgccggcgatgattggtgtcctcgcctccaatcggctcacctatccggcacgttcctttgacatggcgcactgctctcgttgcctcatcccgtggcaactttacggtatgttgaatttgtatcgcccccaatgctacaagggatcattatcttcagctgattaccccgtcgcttcatggtccgatgtacgtgcagatggcctgtacttgatagaggttgatcgtatcctgcggcctggaggctattggattttgtctgggccaccaatcaactggaagaaacactggaaggggtgggacaggactaaagaagacctggatgcagagcagaaagccattgaggcagttgccaggagcctctgctggaagaagatcaaggaggcgggcgacattgctatctggcagaagcctactaaccacattcattgcaaggccatccacaaagttagcaagtccatacccttctgctctaaccaaaacccagatgctgcctggtacgaacagcaccatgctagccattttcagttgaagtcatggtactctatggtaaatcactaaccatgttcgtgtgattaattttaggtatgacaagatggaggcttgtataactcgactcccagaggtcagtgacttaaaggaggttgccggcggtgcgttgaagaaatggcccgagaggctcactgcagtgccacccagaattgccagtggcagcatcgagggggtcacggaagagatgtttgtggaagatactgagttatggaagaagagagttgggcactacaagtccgtgattgcgcaacttggtcagaaaggccggtaccgcaacctactcgatatgaatgcaaagtttggcggcttcgctgcggcattggtgaatgatcccttgtgggtcatgaacatggtccctactgtggggaactcaacaacccttggggcaatatacgagcggggcctcattggaagctaccaggactggtacgtagtcgtactgcaaacatggctcctccgtggtagacggttatatattcgtccgtgcctgatcagaagtctccataattcactgcaggtgtgagggcatgtccacttatccccggacctacgacctcattcatgcggattcactgtttacactgtacaatggcaggtaaaaacatatttacgatccagtctgtcacagcagaactgtagtttgctgctgttctctatctattttagcgaaaaaaaatgtcctgccacaatgtaatagccttacggttatgctttatgtaaacttctaatctaggaactaccaattgtcattgctgcaatccatttttcaagataacatttctgttgaagactgacaattatcctctgctttgcaagatgtgaggcggacaacattctgctcgaaatggacagaattctgaggccagagggcacggtcatcatcagagatgacgtggacatgttagtgaagataaagagcatcacggacgggatgagatggaatagccagatcgtggatcacgaagatggtccgctcgtccgggagaagctcctccttgctgtgaagacatactggactctggacgacagcaaacaatagcaataacgtggaatagagagttttagaatgattattgacatgatcggcaaatcttgcgactgccttaccgtttgccctgtgaatctggtggactttgggttccattttctttttgggtattcattggggggagatagttcacataatggagatataatctccttgttaagatataagagggaacccagcccagattttgacataaaaaacatacattgtgcaaagtgggtaaatagaaagtacaatattgggactacctttttctccggatgcacattgtctggttatggctatgatgtcatatgatccctttcacacaaatctaaactaggtctaatcgtcatccaatgtctttgctcagaattcacgagttgtaaacttaagattcttgccagctttcgtttagcgcgcaatgtacagaatcaagttgacctatctatcctctaactattctgaacctgatgttctgatcatgaaaagctcgccggctgtgtagaatgcagctgcagtcacagcatttcttctcaagcaaaaacatggaactgtatgccaactaaacgttctgattagaccactaatttggttccaagtttggtgctgcacacaaaacgcatcaacggttacttgtgcggttctgccccccaccaccacacacacacagacagcacttgcgtctccccattattttctgccaatgaatgtgtctgtgccgaaagtacaagaggaagacaaggcaagaaaaatggaaaaatgtcacagagttctgactgagctgtcagatataatggagaataaatgttgaaacagtccgaaccgctttattattgtgattttgcgcaaatatagcacaaaattgtcactgtcacgccgcacatgttttgtctactggcatcaatagtcatcagtcatcaccaagttttctggcaggacaaactttaatagtagagctggaatcatgttttcagtgcagtaggtgcctgaattattctgtcacacgttaaaccgtgtggtcctcaagtccaacaacactaaattattgtgactaacatgtattatatagagacaataaaagttagatcacaataatagtgattaattgagcatataaagatttcgtgctcctatgatgtattcaatttccnttttaaaaggacgagtgagagggttaagaatcaaatagttctaaatatcaataaagttgatggataaatagattagcgacatattttttttgttcgtactataaaggggcatagatacataacttgatctaactaaggctaacgatgagcggtgatgtacacttatcaaatctagtactaggtaaatcaatcgaagcctaagaccagtttgacatcgaagccagctcaaataatatttaaaatgtacgagatagtgataggcaacaacatcgagtggcggagctccgtaaaaataacgccccgggccactttacaaatataacgatatactactcgtcttttaatttttcgcactttagggatagtaacatttaaaacaatccaatggaacttttaattttttgcactttagggtagtaacatttaaaacaatccaatggagctgtggcaaatagggaaaatgaatcagaagttcgggaacaattactcacaatagaggagaagcactcagcacatagcgcttgccgctcaggtggttgctgtaaattggctagggaggtgctccgccttcgcctatgaataagaaaagaaaaggaatcaggttgaggaagttgtatagtttggaagaagatgtaatggcaggggtagatttgggcggtggtgcgacgcccagttgagagcacctagaggggggggtgaatagggatca

SEQ ID NO: 11741 - DNA, 702 bp, Zea mays
  misc_feature (698)..(699): n is a, c, g, or t
gacaaccaggatccatgcctagctgggtgccggaactgctgctatggttggggcatcctagactgcctgcctgcttccctggaggcatgctttgccctggttttggttttcgtcgttgtgtttgccatccttggcatcgcctatggcttcctcgctgcaaccatggcggtccagaggatttggcagaggcactatcacatcctgaccaaaagggagttgacaaaggaatacgtggtggaagaccttcacggcaactacacagcgccgaagcttgatccggagcatgaggaacggctgaagatgctgaagcttctttagagagagaaagaggtgcacgccttcctgtatccgtggcaagtgcatcaacatggggcaaccctctctgcgtgccagattagggaatggccatcccataacactgtacaaaatgatgaaatcctgcttggacttgtatgaaatctctatccgacgaaacaaacagaagttctcagttttaccttctcggtaaccttcctcgacaacttgtctccgaaagtgtacgtgttcgtctttaatctttcccttttttttttaatagcctttagcgtccgaagcgaagatctcttacaatgtgcggtttgtgtaagtactgtggtaatatgcattctcataccattctagtgcttttcgcagttattccctcttaaaaaaagcggccnnaaa

SEQ ID NO: 11742 - DNA, 2474 bp, Zea mays
gccggccgggccccggcggcgctcgaggcggccgggccccacctccacccgtggtaatcaaatcgaacgcacatgcggtgcgcctccctttcccggcctccccctgtctcggcctccacctaatcccgggcaccccaatccgaggagactgccgtgcgctttaagtgagcgcatcacacgaaaagcagcaggtagccagccgagaccgggagagaaggagaagcagcagcagggccgccaacgccatggcggtaggcgcgaccgccgcgaagctgcacctctcgtcggcggcagcggccgcgcgccgcccgtcgctgctccacctcgcggccgtggccgtcctctgctcgctgtcctacctcttcggcatctggcaccacggcggcttctccgctggccccgccgccggcggcgccacctcctcctcctcggtctccatcgccaccgccgtgtcctgctcctcccccgccctgacgaccgccccctcgtcaccccccgcggggccgctcgacttcgccgcgcaccacacggcggaggggatggagtccgaggccgcgctccgccagcgcagctacgaggcgtgccccgccaagtactccgagtacacgccctgcgaggacgtggagcgctccctgcggttcccgcgggaccgcctcgtctaccgcgagcgccactgccccgcggacggcgagcgcctgcgctgcctcgtgccggcgcccaggggctaccgcaacccgttcccctggccggccagccgcgacgtcgcctggttcgccaacgtgccgcacaaggagctcagcgtcgagaaggcggtgcagaactggatccgcgtcgacggcgacaggttccgcttccccgggggcggcaccatgttccctcgcggcgccggcgcttacatcgacgacatcggcaagcttatccccctccacgacggatccatccggaccgctcttgacaccggctgcggggtggcgagctggggagcctacttgctgtcacgcaacatccttgccatgtccttcgccccgcgagactcccacgaggcgcaggttcagtttgcactagagcgtggtgtgccggcgatgattggggtccttgcctccaatcaactcacttatccggcacgttcctttgacatggcgcattgctctcgttgcctcatcccatggcagctttacgacgggctgtacttgatagaggttgatcgtatcctgcgtcctggaggttattggattttgtctggaccaccaataaactggaagaaacactggaaggggtgggacaggactaaagaagacctggacgcagagcagaaagccatcgaggcagttgccaggagcctatgttggaagaagatcaaggaggagggcgacattgctatctggcagaaaccaactaaccacattcattgcaaggccatccacaaagttatcaagtcaccgcccttctgttctaacaaaaacccagatgctgcctggtacgacaagatggaggcttgcataactccactaccagaggtcagtgacttaaaggaggttgccggcggctgcgttgaagaaatggcccgagcggctcactgcagtgccgcccaggattgccagtggcagcatcgagggggtcacggaagagatgtttgtggaagatactgagttatggaagaagagagttgggcactacaagtccgtgattgcgcaacttggtcagaaaggccggtaccgcaacctactcgatatgaatgcaaagtttggcggcttcgctgcggcattggtgaatgatcccttgtgggtcatgaacatggtccctactgtggggaactcaacaacccttggggcaatatacgagcggggcctcattggaagctaccaggactggtgtgagggcatgtccacttatccccggacctacgacctcattcatgcggattcactgtttacactgtacaatggcagatgtgaggcggacaacattctgctcgaaatggacagaattctgaggccagagggcacggtcatcatcagagatgacgtggacatgttagtgaagataaagagcatcacggacgggatgagatggaatagccagatcgtggatcacgaagatggtccgctcgtccgggagaagctcctccttgctgtgaagacatactggactctggacgacagcaaacaatagcaataacgtggaatagagagttagaatgattattgacgtgatcggcaaatcttgcgactgccttaccgtttgccctgtgaatctggtggactttgggttccattttctttttgggtattcattggggggagatagttcacataatggagatataatctccttgttaagatataagactgaacccagcacagattttgacataaaaaacatacattgtgcaaagtgggtaaatagaaagtacaatattgggactaactttatctccggaaaaacagcctctggttatgccgccgaaaaaaaaa

SEQ ID NO: 11743 - DNA, 3177 bp, Zea mays
atagaataaaatatagagactaaaaattagcatctgaaaactatacgttagcacatgcgtcatgatgcgtgattactcgcgaaaagtccaccccagcagagaatagaattaggaatggaatcagccaccagcccaccaccaacacctatgtttcactggcctgttatcatgtcgacaccacaccacccatacggaggagcttttggagtcacgtggctttatttgcctgtatatatactccggtgccccgagcccggccgggatagtcacaagaaacacacgcaaacgagaagatctgcaaccagagagtgagaccggatcggacggaaatggagagagcaacagcggaccctcacttcctgctgcttccatggcaaggagccatcagccacatcatccccatgaccgacatcggccgcctcctcgcctcccacggcgcggcggtcaccatcatcacgacgcccgccaacgcgctgctcgtgcagagccgcgtggaagacctcgccgcggcactgcaccgtccgcacgggcacggcgcggcagggacgatcacggtcaccgcgatcccgttcccagcggcggaggccggcctgcctgagggcagcgagaggctcgacctcctccggtccccagccgacgtgccacgcttcttccacgccaacagactgttcggcgaggcggtggcgcgctacttccgcggcgaggctctgccgccgcgccgccgcccgagctgcgtcgtcgccgggatgtgccactcgtgggcgctcggcctagcgcgcgagcttcgcgcgccgtgctacatcttccacgggttcggcgcgttcgccctgctctgcgtcgagtacctctacaagcacaggccgcacgaggcggtttcgtcggcagacgagctcttcagcatcccggccctgccggcgtttgactgcagggtctcgcgcgcgcagctgccgcagcatttcgcgccatccacttccatgggcggcgggacgctacaggagatacgggagttcgacgtggcagtggacggcgtcgtggtgaacagcttcgaggagctcgagcacggctcctgcgagcttctcgcggcggcgaccggcaagaccgtcgtcgccgtcggccccgtctcgctgtgccatcaacatcccatgacaatgacagacgacgacgacggcggcggcggcaggcgggtcctggagtggctggacaccaaggagaccaagtctgtggtgtacgtcagcttcggcagtgccgggtgcatgccacccgcgcaggtcgtgcagctaggcatggctctagcgtcgtgcgcctggcctgttgtctgggtgctcaagggcgccgactccatgcccgacgacgtcaaggagtggttgcgtgagagcttggacgacaagcagtgcttgctggtgcgaggctgggctccccaggtcgccatccttgctcaccgcgccgtcggcggcttcctcacgcactgcgggtggggctcgactctggaggccattgccgccggcatgcccatggccacctggccgctcttcgccgagcagtttatcaatgaaaggctcgtcgtggacctgcttggtgttggggtgtctgtaggcgtgacaaagccaacagaaaacatcctcactgccagcaagctcggagcggatgtcgaggcggaggtgggtatggaacaagtggcgaaggccttggagaggctgatggatcagggtagccaaggggaacacaggaggaggaaggctcaggagctcaaggccaaggcaactggagcattgcaggatggcggatcatcctacatgaatttggagaagctgatagtccaatcttcggtttcgagaccgaatacatgtggcgtttaattagtacagtattatatttgctgaataacgtacatagctggtgctcatccatgtcatgagtgactcacaaataatcaaattcaatttgtttgatgtcttcgtgtgaacatatgattgacatttaattagtttaattgtttttggtcgtggtctgcagccgcgcgagccctcgcatgggcatggctgctgcgcctagagtcctccttggccttgtcggccgcacgccgccgtcggcgtttctagggattgtatttccaataacattcattctgggcgtgagactgcaacggtatgtaaaccatcctgtccgctaaatttagtagacgaggagcttcttttcacctccagcaaggcgctccaaaccgtccgctaaattttacgggcgtcgccagagctgctaattgtggcagatcttcggacgtccgctacacaccgatacactccctctcccgcgctggggcggaaccttctccattgcgtcttcccatcgcgaaggtcttgttcatgccgacagctagttcccgacagacttcctcggaggcggtcagcaccgacaacaaggaggctgcgcggggaggcaaggccggacgaccctcgccgccatgctacttgtccgccacgctacttgtcgtgcaggtagtctgctacttcttacacggtcgccgtcggtgttgggctctccgacggtgctgccgtcgacggtgcggactctctgcacaaccacaccaatgagctctcatccgccgtcatggacatgcttcacgatccccctggccatctgcttcacggttcctcgcctcgcggccacaacaagcggtggtggtggctggtgcgctctaggtgctcgacgaaaggtgtgtttgtagttcggcactttgtaccaatggaaagagagagaagtaaagaatatgcatgcgaagtcaaaaaaagtgaaatcgaaattcttttctttggttatttgaaaattgtagaaaacgggcaaaatctttgtacatttattcatgcggacacaaaaataaagaatagtatatttaaaagctagttctacagtttcagaacgtgttcacaaatttaattttaactaatatgtatactatatttttgcataatatttagacgtttacaaatttgtattattgcaaaatatttatttcatcaatttttaatgtcgtactttcaatacaagtgcaatattaaaaaacaataaataaatatggctattatgtaatctgttaacactgtagatatagagtaccgaatttagaggacattgttagagactgagaagatatagaggacaaaattttttagagtgtgctgt

SEQ ID NO: 11744 - DNA, 1312 bp, Zea mays
aacttaataggctgccacttgccagtagaaccgtttgcctctcgcctgcatcctagtccggcggccgcacccgggcagctccggcggttccccgccgccgtcctccgtctatccccgactgcgctagagctccgtctcatgggggcgtccgaatctctcctatctaggcagcagcttcagcagccgcggcctcagtgggcggatgagatcacgacggtgtccgagggccggcgcgacgacgccgacgccgatcccctcgtccgccgtatccggtctctcaccatagctcctccgctattgagctcccaatctgaagcggaagcagagagcagcctcacggatatcctcgtcgggaagccctctaactcctcagccacctctggaaatctgaacccaaatgtcctagctgagcttttcgccatgtaccgcgaatggcaagaagagaatgccaagaaaattagccgaaaacaggaggagatagaaaacaagatagaaacagctgatgcattggcagttaaacttctccagcggttcaattattgtcttacttacatgagatccacctcccacaatcttgctgaagtgcatccgctgcagatcgaagttggtgagtcaaagggcaggttaactgaagtcataagcaactgcgatgcattgtgtaagagaattgctgcagaaggaccagaaagcctacgatcatctgttcaacctttcatggctgctagagcggaggcagaagggagtggttcacttgacccaaaacaagagtcctgaattgtacaatctaactgctgacagcatgcgcaaagaaacttcagaggatgattagtttgtcctgaacaaatatattatataaacacgtttaggaattgttcggttattctcaatacatatggattggatgagattggaaaaaattaagaagaagtttgacttgtttgggattcaaacctatcaaatctcactcaattcacgtggattgagagctaatcgaacaagcccttataatgttggaaaacatgttttagtcttagaaaccgtctacattgacactagtatatctatcacgttaaccaacgtatcattcgaatggagaattgtatcattcgaatagagaattgtagatctttactactagacgcatagcgtagatgtagtggaagtagtcgaatgttcttgtgttcattcatcctcaagtttgttgttgattactgtcgcaataatagcagcttctccgcggtgttcacacatgtggtgatgaaacgatgtaataccattgtgctagcataatatcacatccagctttaaggag

SEQ ID NO: 11745 - DNA, 2367 bp, Zea mays
tcttatcatgtgtgcgaaaaaaatatattgatattttatttagaacatgtatatgatgacaaaataaggtactagataaaaattgcagtggtgtatataaagaatcttctctttgtttatctacagtcagcatgtgcctattacataagctgtacttttgacctcttataatactagtacttggcagccacggcagctgcatagctaaccactccctccgtgcatcatgtaatttaacgaaagagtatcaatatctgagtcacgaaatagatctgatataaagatatgtttcatggcgaatctagtgatacctagtataagatagcatacaaatttaaacaaactaaaatgatgtagctcaaaaaagtagtaatattcttggagaattttgagctttagcagttcatttccgaggaagtagcagagtccaagtatccaagctgtggctagctacgagctacgcggcagcttcccatttccgaatatctagaatcttctgcccagcttcatgtataaatcctccgcgccagctacccggccgcccggctccagttctcctgcactctgctccccatattttatcccttcggagttcggtcggatcagacgcttgtgaatcctggtcatcattcatggagaagaaggcagctactacagaggaaccccttctcgcgccgcggtccgagcacacggtcgcggcggaggccaagcggctgctgagcctggcggggccgctggtggccagctgcatcctgcagaacgtggtccagctggtttccgtgatgttcgtgggccacctcggcgagctgcccctcgccggcgcgtccctggccagctcgctcgccaacgtcaccggcttcagcctcctcgtgggcatggcgagcgcgctggacacgctgtgcgggcaggccttcggagcgaggcagtacggcctgctcggcctctacaagcagcgggccatgctggtgctcgcgctcgcctgcgtcccgatcgccgcggtctgggccaacgccgggcggatcctcatcctcctcggccaggaccgcgacatcgccgcggaggccggcgcctactcccggtggctcatactgtccctggtcccctacgtcccgctcgcgtgccacgtccggttcctgcagacgcagagcatcgtcgtgccggtgatggccagctccggcgccaccgcgctgggccacgtgctggtgtgctgggcgctggtgttcaaggccggcatggggagcaaaggcgccgcgctgagcggtgccatctcctactccgtcaacctggccatgctggctctctacgtcaggctccccagcgcgtgcaagaggacgtggaccggattctccacggaggccttccgagaccttctccggttcaccgagctcgccgtcccgtcggcgatgatggtctgcttggagtggtggtcctttgaactgcttgtgcttctctctggtctgctgcccaatccgaagcttgaaacctcagtactgtcaatatgtctaaacactggcgccttgctgttcatggtgccgtatggtctttccgcacccgcaggcccgcccgtttccggggcgcctcgggccggcgagcctcaagcagcgaggctagcagctcgagtggtgatgtgcatcgccctgtctgcaggcttgctgctcggctctaccatgattctcctgcgcagcttctggggctacatgtacagcaacgaacctgaagtcgtcacgtacattgctaggatgatgccggtcctggcgatttcgtttttcacggatgggctccacagttgtctatcaggagtgctgactggagtgctgactgggtgcggtcggcagaagattggcgcgcgcgtcaatctcggtgcgtactacttggccggcattcccatggccgtgctgcttgcatttgtgcttcacctgaatggaatgggcctgtggcttggcatcgtttgtggcagcctcaccaagcttgtgctgctcatgtggatcacactgcggataaactgggagaaagaggcaaccaacgcaaaagaaacggtgttcagttcatctcttcccgtagcattatagagctgtatcctatatatgtgcagctggacgtaacaacaccacaacatgaaaaggctctattgctgcatgctgctacactaccttcccaattgagagacaatatgagttctatgcgttctctaatacgttacttagtatacatattttgttattaaatatccatatcgtcagggatattatatgatattgattatctctattcatcatagaggatccgttagttaaacattgtagcttgtcaaaatcattattactccctccgttttaaaacgaagagggagtataacttaatatcttt

SEQ ID NO: 11746 - DNA, 1535 bp, Zea mays
ccgtccggtttggcttttggcttttaggggtagtgctttgtgtgaggtgtcagctgagggatttacggggcctcaccagctcacctccaccaaaaaaagatccctagtagtagtaggatatagtggagaaattcttcgacagaactgaagaactgaacgaggagagacaccaaaggaggagaggcatctctcaggcatggagctcaatccgaccgaagactctgtgatctccgagttcgtgatcgttcagagatgaaacatatagtccactctttctgtcatgtgagtgaacaatttagcccccaaaaatttactctctgaaacatgggtgaccttcccgagccagaagctgccatggccgtgccggagccgtcgtccagcctagcactccgagtcttctacctgcgggtgagcaggtgcgaggtcgacgagtccatgctggatactctcgccctcacccacaccccgctcacccctgacaccatcctggacgtgagcggcgccgagcaccagccaggcatgggcaaaggcaacggcagcgtgtccttctgcctccgccgagaccgcgtcgacaagagatcgggggaagccaccttcgtctgcacggcgaccgtcagggtgtcgggcagcgtgcggttcgaggtccagagcaaggacgagaggatcgtcgtcgggatcctggaggcgtgcgacgtggacagcaagggcaccaagagctgggcgatgaagtgccaggcggcgacgcagcgcggctcggggttcctcaggtgcggcggggagaagagggacacgaagccgccggtggtggaggtgtacgttgcaggcgtgttccggggcacgcccgtcgtgttcaccaaggccacgcagctgcggttcaggcggcggcggcaggtgagggcgttcatggacccgatcccggagtgccgcgagcaggtggaagaaacgcatcacccagaggaatcgggataccggtgctacaagcccgatccgaactgggacgacgacgacgtcgacgacgacagcctctacatgagatccgacgggaccgacgacggcgaggagtacagcgagctgtcatggttcaccgccggcgtgagggtcggcgtcggcatcagcctgggcatctgcctcggcgtcggcatcggcgcgggcctcgtggtccgttcgtatcagtccacctcgaggaccctgaagcggcgcctcatctcaaacctgctctgaaacgaccacactgtgagcgcttatccggtggttcgaaaactttcctactgatgatgatgaaaaatatatgtatgtagatgctgcaacgttgtgcgctgtgccgaatgcatttgatttatagatcgaggaaaacaatctcttctccctgtaaactgttgatacggaggtgttgagcactaaaaatgccaccagaaagtccgcggtccggatgatccgcgttgccaatacgaacggttcatgcgtgcacaaaattagttaggttttatgtatttgttactgcaggattaattgtgaaactgacttttaataggtcc

SEQ ID NO: 11747 - DNA, 1008 bp, Zea mays
  misc_feature (30)..(30): n is a, c, g, or t
gccggcctcagccagtcagcctccacccgnaaattcccggcccctccaccatctcgccgcttttccaccctcctgctgctgttggtaggagagtacttgtcaattgcttttccaccctcctcctccgccatcccaattcttgcctaccggctaccgctgctcctgttaggagtacttgccaattactgttggaatcaccttcgccgcctcctcgagaaccaattctagcctaaaacccgcagtgatccgcccaactcccgacccactcatggtcgatcggcgcggccgctgaactgcctgcggcgggggcgagaggacgcgggtcgaggcgggcgatggccgggctggcggggaggcctggttcctggggcggcctggtgctgcgggtggggcaggctctcttcgccgccgcctgcatcggcgtcatgggcagctcgctcggattcgccagctacaccgccttctgctacttgattgcgtcaatggggcttcaaatgctgtggagtttcggacttgcatgtcttgatggatatgccattagagccaataaagatctcaccagtcccattctattgagcttgtttgtcgttggagactgggtaacagcaatcctgtcattcgccgcatcaagctcagctgccggtgtagtaatcctatttcaaaaggacgtgctcttctgcagaaggtatccccagctcccctgcggaaaatacgagctcgccacggcgttcgccttcctgtcttgggcgctcagtgcgacatcagcattgatcatgttttggctcctggctgcgttctgattttgtgtaaaaattttgtgacagcgatgttcatagtgcccacttcgctgttctctcatcgcattcttttacgaccatgtcacatatttagagccacatagccccccccccccccccaccccccaaaaaaaagaatgttgggatcatgtaaagtccttgaagggaacagttactaatggaagaaattcactgaaaaaaaaaaaaaaaa

SEQ ID NO: 11748 - DNA, 2211 bp, Zea mays
gacgcgtaggttcatagaatcacggggttgtgatagcccgatgcgtgttgagcggagacgattgaaggtggcaaaggagaagagggtaatggaaatggaggcggctagagccgagaaacagatgttggagaatcttgctggttgtctgcgtgcaactgagtgagaaagacatgttgattgaaggcagccaagtcagccataccacgccagcgccgcatgtaccttgacgccacaagctgcggcgccgagtagagggtccaataacgacattaagccgtccaaaaaatctaaacatctaaacgtgaaattgttaaaaaaaaaaggctaaaatacaaaaaaatttgggcttatactgcgttggcatattattggcctaaatgtcaccgttgatctcaacagtggcccaggcactatcttgttttcgtaccaacgcatcgatacgattctagtgaaacaataaagcctctcgaggaagaaaaaaaaggaaggtagacagtgcacgctggtcaatcgtcaaattgtcatcgcacagaagacgactccaagtcaacgccactgttatccctaccgttacgcgcgcgtgagcactttggattatggatacgtgataccaccactcttcatgtcgttcggtgatgctgatgcggcaagagtcgtgacgagcacgaccaaattgtcaccggaaatcgtgtggaaaaacacagagacggaccgactaccaggtctaccgccagctagctatagctcggagaaaacaaacaaacaaaaggaattttcgtggcacgccggcccttgaaacaaaaggaaaggaagtttcccctccaattccttccatctataaatacagcgtacgcatccgcctcttcttcccatcctgagcctcctcggctcctcctcagaaaacacaagggaagacagctgcctacccaacctctaccagccatggcgccaccttcttactccatagcccccgtccaaagcgagctgaacatgacgctgtacaacaaggaggtgtacggtgggcgggggaccaacggagtgaccactctagtgaaccgagggccaatcggcaccacctgggtcttctcgtggcctgtcaccgacgggcccgccggcgccgacgcgaacgtcgtcggccatcttcagggcaccggcgttcaagtcgccacttaccccgactacatgtggcactactcccttgggctggtgttcggccagggaaccaggtcagtccccgcgaggtcgttcggaaattgtagattttaaatatttaaaaactaagaagtcagaatagaaaatatttaaattcatcttcatccaacgtcatatgaaaatttttagattattctttataatgcaactgtttttagaggtaggtaggcctattgcaacttgtaattgtttttttataggtggacgaccccttagaatacccgcctacctttgttaatttaatcaactaacaaaggcagttgtttgtttttgttcacgacacaggttcaatgggtccacactacaaatacaagggacttccaaaataaatggcgagtggagcattgttggagggacaggagaacttgctatggcaaagggcacggtcagacgcacagaagtttcgtatacgggaaatataaggatttcagaactcaatatacatgtgctttacactccaatgtgacctatacagatgtaagtataatgcaccccagtgtttaatgtgatgggcatttatttttcctatttaacaagttagctacgtacatatttagtttaccagaatttccataataacgtccagactatatatgtaacacatttggaaaatgatgatgcattggttgtttgttgaactgtttctttttttttacttatatattacgcccttcccctcaaatacaagctatcatagaaattttggatatattatgggataaaattaaagaaatgacacatgtaactaaagagatctcgagcataccatatattggtgctttacgaagttcatttgttttaaaatgcttataatttggaacaaattttgaatgcttaaggttctgtttgggtcctcttagctaatagatatttttttctctttttatgatctattagcacctattagtaaggtcaaatggctaataggcaaataatttatcggctctctaactagcaattagtcaatttattagctagcccgttgaaacctaaggtgct

SEQ ID NO: 11749 - DNA, 1461 bp, Zea mays
  misc_feature (801)..(806): n is a, c, g, or t
  misc_feature (821)..(821): n is a, c, g, or t
  misc_feature (828)..(828): n is a, c, g, or t
  misc_feature (936)..(936): n is a, c, g, or t
  misc_feature (985)..(985): n is a, c, g, or t
  misc_feature (1005)..(1005): n is a, c, g, or t
  misc_feature (1020)..(1020): n is a, c, g, or t
  misc_feature (1101)..(1101): n is a, c, g, or t
  misc_feature (1346)..(1346): n is a, c, g, or t
ttgggaccctccgggcccggccgggatcctcggctcctcctcagaaaacacaagggaagacagctgcctacccaacctaccagccatggcgccaccttcttactccatagcccccgtccaaagcgagctgaacatgacgctgtacaacaaggaggtgtacggtgggcgggggaccaacggagtgaccactctagtgaaccgagggccaatcggcaccacctgggtcttctcgtggcctgtcaccgacgggcccgccggcgccgacgcgaacgtcgtcggccatcttcagggcaccggcgttcaagtcgccacttaccccgactacatgtggcactactcccttgggctggtgttcggccagggaagcaggttcaatgggtccacactacaaatacaagggacttccaaaataaatggcgagtggagcattgttggagggacaggagaacttgctatggcaaagggcacggtcagacgcacagaaatttcgtatacgggaaatataaggatttcagaactcaatatacatgtgctttacactccaatgtgacctatacagatgtcaagaacaagtatctctggaggaggactactatgataagttcgatgagatctagggtgtggagaagttatcttaatctggtttattttatttagttatttttgtaagatgtttcgtcatgtaataaagattgtgacattggtttatatacacactgagtcgtcatatatgtgaaatttgatcctgacacgtcggcggcccccgcccccgtttccccctatagggagtcgaattacaannnnnngggggggccccgggnccccccnccccccttcttcggccaaatccccccccccccccccgctttgcccctctccccctcctctcccttcccccccccctcttctccctcctctttttctgccccctcccgntgcccccttgtttctcccccccttctggccgccctccctcccctcccgncccccccttcgccccctccnctgttcccccctccnctccccccccgttgccgcccccgtccgttctcggcggcgccactccccccgtgccccctttccgtcatccctttttttccntccctctccttcccgcgctctcgtcccccgtccccttcccgcttccgcctccctcctcgctccacctcatttcccccccccgtctgtctgtgtgtttcgcttgcccccctttttccccttcccccttattctattgcctccccccttgtccctcggttttggctattcccccgccgcctccaccttgtccgcggccccccccccttatacgcctccccccgccccccccccccatcgcccccacntccccccaccccaccgttccggtatccgtgtcattcgttccgccccccccccccgaatttttgctcgtgttgccatcccgtcgctgcgacgccctccgcctgcaccaccacaaat

SEQ ID NO: 11750 - DNA, 1504 bp, Zea mays
gaagtgcctccgcgacgccaagatggacaagtcacagatccacgacgtcgtgctcgtcggaggttccacccgtatccccaaggtgcagcagctgctccaggacttcttcaacggcaaggagttgtgcaagagcatcaaccctgacgaggccgtcgcgtacggcgccgctgtccaggccgccatcctcagcggcgagggcaaccagaaggtgcaggacctgctccttctcgatgtcacgccgctctcgctcgggctggagactgcaggcggtgtcatgaccgtgctgatcccgaggaacaccaccatccccaccaagaaggagcaggtgttctccacctactccgacaaccagcccggcgtgctgatccaggtgtacgagggtgagaggacgaggaccaaggacaacaacctgctcggcaagttcgagctgaccggcatcccgccggcgccacggggcgtgccccagatcaacgtgaccttcgacatcgacgcgaacggcatcctgaacgtgtcggcggaggacaagacgacgggaaagaacgtcgcggtcgccatcaccaacgacaagggccggctgagcaaggaagagatcgagcgcatggtgcaggaggcggagaagtacaagaccgaggacgaggaggtgaagcgcaaggtggaggcccgcaacgcgctggagaactacgcgtataacatgcgcaacacggtgcgggacgagaagatcgcgtcgaagctgcccgccgatgacaagaagaagatcgaggacacgatcgaggacgccatcaagtggctcgacggcaaccagctcgcggaggccgaggagttcgaggacaagatgaaggagctggagagcatctgcaaccccatcatctcgcagatgtaccagggcggcgcgggcgctgcgggcatggacgaggatgtgcccggcggtggcgccggcaacggaggtggcagcggcgccgggcccaagattgaggaggtcgactgagcgagccatggacggtgatgatctggatgggaagcttctgtgcgtgcggtgcagctagagagtgtgctacgtgaactcgtgaaggcgtattaatctgtgtgtgcgataataatctggggttaacacctgcagggtgttctctgtttccgttgtcaagtggttgtaggttcagtagggtgaaagtgtgaggcatatccattaggcttagtaaaatagtaaccctagtgttactgtaaccgcctccgcgagttcaggagtctataaatatatcagtatgtaatactgtttgtttttttcaaaaaaaaaaaaaaaaaaaaaaaaaaaaaaaaaaaaaaaaaaaaaaaaaaattaaaaagaaatatttaataaattaaaaattttttttaaaaattttttaaattttttttttattttatttaatataaataattaattatttttaaaaaaaatttttaagggggggccctttttaaaaaaactatttttctcccgggtgtttacggtgttattttttttttt

SEQ ID NO: 11751 - DNA, 2306 bp, Zea mays
agtctgtatgagcgccgagaatcgagtttgcgctctcctttccggctttccgcccaaacagccgtcgggcgtcccacggccgccgcccctgccggagatacgcgtagccgggagttaagggatgagtcctcaaatgctgttattggaaacatcttaagttagagtaagttgctgaaactatggaagaggttcaaaactgtgtgatgaagctgcggagcaatccaaggcggcacagggataaagtgtatgttggctgtggggctggatttggtggagacaggctaatggctgcttataagttgctgcagagagtcaaggagcttaattacctagttctcgagtgtttggcagagcgaactctggcggatcgataccgaattatggtgtcaggaggcaaaggctacgatcctcgggtcaaagagtggatgtctttgcttctacccttggcttttgaacggaaagtttgcatcataactaacatgggggcaatggatcctcttggagcacagaaagaagtactgaacctggcatctgtcttgggactggagataacagttgccgtagcttatgaatcatcctttgaaactcaaggaagccctgtattgtccgatgaatcaacaggagggagagggggatgtagcacatatcttggggcagcttcaattgtacattgcttggaaaactataaaccacatgttgtcattacttcacgggttgctgatgcttcactcttcttagcacctatgatctatgaattaggttggaattggaatgacacacagttggcacaaggaacattagcaagccatcttctagagtgtggctgccaactcactggaggatatttcatgcaccctggagatgcatacagggattttccttttgaacaacttctggatttgtctctcccatttgccgaagttagttgcagaggagaagccattgtcagtaaggtagatggcagtggaggccttttgagcccccatacatgtgctgttcagcttctttatgaagttggagatcctgcaaactacataactcctgatatggttgtagatttctgtaatgtacagttccatcaaatatcaaaagacaaggtcagctgtgatggagcaaaaccttctaatgcttgttgccctgagaaactcctgcaattatctcctactgaaagtggatggaaaggctggggagagatctcatatggggggcatcaatgtttaaagcgtgcccaggcagcagaataccttgtaaggtcgtggataggtgaaaggtacccaggcattaatgaaaaaattgtctcatatgtcatgggctatgatagtttgaaagctattggaggtgatgaggatagttacttggccaagcaagtattggatgtaaggcttcggatggatggtctcttcgagcttgaagagcatgctgttcagtttgtcgaagaatttattgctctatatacaaatggtccagctggtggcggtggaatcagcactggacacaggaaggaaattattctgcaaaagatgctggttgatcgggaaaacatcttttggcgatcgcatgcaaagaaggcgagcattccctgcctgcataatcaagctacatattctgaaacaggtccggcacgtatttcacaagcgcaacgaaacccaacatgtcgtacaatggccattcaacactttgaagcaagcacggagaccccagcatcccctgctccagctttacctgggaaaagggtcgctctctaccatgtggctcacagcagggccggtgacaaggggaatgatatgaacttctctgtcattcctcactcccctgctgacatcggccggctcaggtccgtaataactccggattgggtgaagaacgctgtgtcacctctgcttggttcgtcttcgtttcctgacgagcgagatgttcagcatcgaaacaagctgcttgagcttgtcaccgtggaaatttactacgtcccgggcataagctccctgaatgttgtggtgaggaatatcctggatggtggcgtcaactgctcgaggaggatagatcggcatggaaagaccttgtcagatgtcatattgtgccaacaagttatcctaccgccatgattgtcaatattcttatccgtattcgaattaaaatatggtaaatagtatctgtattcgaaccaaaatatggtaaatagtgacatccgaatttgtatccgtgcgtatttgatccgaatacatctctattaattgactacagtacccactataaacttatgtgtattaatattattaaggtttgttttttaaaaaaaaaaaaaaaaa

SEQ ID NO: 11752 - DNA, 1593 bp, Zea mays
  misc_feature (1504)..(1504): n is a, c, g, or t
gagatctttttaggtgaatagtttacatgaatattattgtgaaccgtcgcaacgcatgagcaaccgactagtactgatctatatctcagtttatagaaatttgattatcagtttcttaaaaactaagaagctaatctgtcataactgaaagataaaaattgatttcttaaagactgtgttgcttccgaatatgaccttagtgactgaacttgatatcaacaagacatgaacgtgtttccacttctcaattggaatccacaagacatgaacgtgttcacgtatatatctcgctgtactgaatattgaccaagctgccgtacaaagctatgtccgggtatcaaaatttttcgcatccagacatcgcagtagttgccaagcgagcagcggaggaggccggcggctagagggtggcgatggcgcgtgcggaacaggaatcgctggctgcgccgccactggagtcgaccgcgacggcgagacagcgcgtcccgtccgtggaggtgcacttgtaccggcggggcgccggcccggtggccatcttccggtcggacctggcgggccctcggcgggaccgcctcgacgtgcgccgcatccaggcgagccacggcctccgggcgctgttcgccttcaggcccgagggatcccgccgcggccgtggcctccggatcaggtgcgacccggccgccggctactccgcgctgcccttccgcgacggcgccgccatcgccctcgatggcgagcccggggtgagttgagttggtcgtgttcctctccattcctttttttacggtttgcacctcgcggcacgtggatttcgcggaaccaacccccacggcctcccttttcgttgccgtaggagtcgtggacgaagccggtgtcggtgatcgtcgccggcctgctggtgctcgctgtgatggcggcggttgcggccaacggggtgccggagccgctgcggtcgtcgaggctggccaacgggatctttgcgccgtggatcctcttcagcgccgtcatcatcttcgctcgtgccaggacgcggccaagggctccatgaatttgctagagagcacgctgccgccagtttcttatgtacttactttcccatatcaaccatgttagaatgtaggaatttgctaacgattccaattatcaccggattttgtttgtgtttgctgacggcacgttatctgaaatgctatagattcagactgtcaccgttgttccttgctaacaggaacaagataaaattgtttagcgtagtttcaaacatctcttgcttttcttttcttctatagtgtgtggttggtcaagttacgggctcctagttcattttaaaaggagaaataaaaacggatcgcttgcattggtatcacccgcttaattcactattgtttagtccaagtcattgtcacgtcatcagtcatctgcattttcgtctaacagccacgccaacttttctcctctagatttaactgaaagtcgcctagaggggtgaatagacgaaacatgnaaattataaactttgaacactcaatagtcgcctagaggggtctactccaaccatttctctctctcataggtcacacaaccggtcgagtg

SEQ ID NO: 11753 - DNA, 802 bp, Zea mays
atccagacatcgcagtagttgccaagcgagcagcggaggaggccggcggctagagggtggcgatggcgcgtgcggaacaggaatcgctggctgcgccgccactggagtcgaccgcgacggcgagacagcgcgtcccgtccgtggaggtgcacttgtaccggcggggcgccggcccggtggccatcttccggtcggacctggcgggccctcggcgggaccgcctcgacgtgcgccgcatccaggcgagccacggcctccgggcgctgttcgccttcaggcccgagggatcccgccgcggccgtggcctccggatcaggtgcgacccggccgccggctactccgcgctgcccttccgcgacggcgccgccatcgccctcgatggcgagcccggggagtcgtggacgaagccggtgtcggtgatcgtcgccggcctgctggtgctcgctgtgatggcggcggttgcggccaacggggtgccggagccgctgcggtcgtcgaggctggccaacgggatctttgcgccgtggatcctcttcagcgccgtcatcatcttcgctcgtgccaggacgcggccaagggctccatgaatttgctagagagcacgctgccgccagtttcttatgtacttactttcccatatcaaccatgttagaatgtaggaatttggtaacgattccaattatcaccggattttgtttgtgtttgctgacggcacgttatctgaaatgctattgatccagactgtcaccgtagttccttgctaacaggaacaagataaaaaaaaaaaaaaaaacggcacgag

SEQ ID NO: 11754 - DNA, 4155 bp, Zea mays
cacactagctatagctacttgatctcctccaagcaacacgtatgccctagtaggcagcaattataataagtatacggggagtgacaccgcgagggtaatgccaaaagaacggcctagatagctagcaagtagcgatgcaaagccaaagcctctctctctctctctctctctctctctctctcagctgctggccgaccatcttcttctgatcttctctccaacagcagctagctagcgagtagcgacgcactggactggagcactgctcctgcacagatatccatgcatatgcatatataatgatgagtgagagagagagcgctctgctggatggccgtcctctggctagctgatgctagggcagtgagagagagagagagaggcctgtgggtgggtggggaagaagagaggcagcagcggtccaggtcgtccaggcacagacagtggccggctgacccacacacacgagagagaatatttgaagggaggaggtggaaggagctgagcctgactgagctcgtggggtgggggtgtggtgtgggtgcatagtgtagtacgtgtgtgtgcggtcatatgtgtgcgagtgcgagacagtgagactggagatagggctaaagagcggcagcctttaattcctctctagctcgcagtctcgcacacaacacatcacatacccggccggccctctctttctccccctgcccgcagctgagctcccccatagttactagctagcttatattgcatatctcctccccctcctccgtcctcgctagctcgtgttcttcttcctctcatcttttgcttgtcctccattccatcgatctcctattcctgtgccgaccgcgaggccatcgtcaaagagaaacacagagcgggtcggggactctcggggagtcgggggaggctgctagtgctagctagctcgaccatatacagtttgtgggcgcggccgggcgggcaacaagctgctaaggtaccagcataccacccatctccatggctttcctggtggagcggtgcggcgagatggtggtgtcgatggagagcccgcacgcgaagccggtgccggcgccgttcctgaccaagacgtaccagctggtggacgacccctgcaccgaccacatcgtgtcgtggggcgacgacgacaccaccttcgtcgtgtggcgcccgcccgagttcgcccgcgacctcctcccaaactacttcaagcacaacaacttctccagcttcgtcaggcagctcaacacctatgtacgtacgtagtagtattacattacatacacataatgcattgcattgcattgcattgtactgcatgcatggtttcagttcccttgctcgatcttgtttgtttcctgctagctctacaatgtgacaagatatcacaagcaaaaagttctctctttttttttctcgtcggattttatttattggttgttggactactgtgtgtgtggatgaatatacggcaggcacaggcattggtgtgacctgccaacgactagctagccaatcggttggttgcatgcattcatgctcccctctctgtgacaggcagatatgtatgtagcatgcagcatttaatttgtgtggtttgcatttgggtagagaagagggaagagcacacgaccgcatgtgtgtgcgcccgcaccagccgttcgttccgcatgcgggcccgtcccgtgttcctgggccatagagttcgcgtgatgcttgcgtcgcccgcgccgtggagctagctctcttcttcttcgtctccgacgggacttagaaaggggggtcggaggaggtagctagctagatccgacggcgtggacgagagagagatggcagcgagcttaggcagaggtaaaggaacttagaaagggggggttcgtgatgccgccggagcaggtggaggaggagacagtccgacagacagggctggagaggtgatggcgaccatggctatggcgcgggggaggaggaggaaggaagaggtcgccacgagcacgccgtggtcgcgacagtggtggccacatccattcggctttctggttgctgttgacttgttgaaagggacttcattcacttgcattattacttcgagagtaaaggatatatacatgcatacaaggtttaatttacagcctttaatttcataacaacagtcaaaagatcttttgtgtgtgcgtgtgtgtgtttgattttgtgccaagatagatacagtactgtttgggtactagaagaatctcatcagccttcgtgtgcgctagtctcattcccaatcattgggagaggagaggagaggattgtgcacaacgaaattaaaagagaggagagaaatatataccctatggtattctgtgccaagcagtcgtatatacccttatacctgtagtaccatgcattagcaccacaacacacgcgtgacatgactagcagcgctgagctgactacacagcagtacagtggcacacacagctgcagcagcactgatctgatgagcatcgtccatcgtcatggacaccacgtactggcgtacgtctctctctctctcttcgcattgctagctagatgatgcatgtgcacgtacatctgccatgcatggtcgtagccgcaattgcaatgtgtgctgttgtgcaacagtgtcgtcgtcgatctctgatctcatggaaaagaatgctagctaataacacaacttgatcactgtaagaaaggaaatgctgaattttttctctttggtttgctgttgctgttgttgttggctgatgcagggcttcaggaagatagtggcggacaggtgggagttcgccaacgagttcttcaggaagggcgccaagcacctcctcgccgagatccaccggaggaagtcgtcgcagccgctgccgacgccgctgccgccgcaccagccctaccaccaccaccaccaccatctccaccaccacctcagcccgttctccccgccgccgctggcacagccggtgccgtcgtaccaccaccaccacttccaagaagagcccatcgccaccgccaccgcgccgcacggcggtgctcaagccgccgccgccggcggcaacaatgaaggcagcggcgccggctccggcggggactttctggccgcgctgtcggaggacaaccggcagctgcggcggcgcaactcgctgctgctgtcggagctggcgcacatgaagaagctctacaacgacatcatctacttcctgcagaaccacgtggccccggtgacgagcccctcgtcggcggcgcacgcgtccctgcccagcgccggcggcggcggcgccgcggcgtcctcctgcaggctaatggagctggacccggcggactccccatccccgccgcggcggccggaggcggacgacggcacggacacggacacggtgaagctgttcggcgtggccctgcagggcaagaagaagaagcgggcgcaccaggaggatggggacgacggcaaccatgagcagggaagcagcgacgtctagccgccggccggcttgcattgctagctctctcgttcgtgtacatacagagatcagatcagagagtagtagtttgcctcgctagctaggctaggctttggtaattttcttctgagtgcgtactgaaattaatgtgcaagagcgaagtgtttgtctgagtaaaactaacaacaatctacggatgcgtgcatggaagctaagctagatatgcagaggcttgcaccaccttctcaattcgcaatcgcaacaagttcttcctcgccgcggatgggaatacggaatggagtgggctgtgcattactgctcctctagcttagcacccagtaatcttttgttttgaacacacatgaagacaaagaaaccaactgaacgaaggaacatggtgtatataagagcagtcatatctgaactctgaagccaatcagttttcatgctcagattcagacaccatctgcttttgctgttccccttctgtcaagctctcaagccatatatatagttcatgcatccatctcaagctattatgtcatctcatagatggtaagtgcttggtcatctttgcgaaaccactaagatcagtgatccagttggaactaagaagtatctacctaggaacacaaaacagctgccgtcagtcatgtataaaccgtaccggttcctgccgctgccagtcttt

SEQ ID NO: 11755 - DNA, 1523 bp, Zea mays
actagctagcttatattgcatatctcctccccagctcctccgtcctcgctagctcgtcttcttcttcttcctctcatcttttgcttgtcctccattattccatcgatctcctattcctgtgccgaccgaggccgccatcgtcaaagagaaacacagagcgggtcggggactccctcgggggaggctgctagtgctagctagctcgaccatatacagtttgtgggcgcggccggccgggcaagctgctaaggtaccagcataccacccatccatggctttcctggtggagcggtgcggcgagatggtggtgtcgatggagagcccgcacgcgaagccggtgccggcgccgtttctgaccaagacgtaccagctggtggacgacccctgcaccgaccacatcgtgtcgtggggcgacgacgacaccaccttcgtcgtgtggcgcccgcccgagttcgcccgcgacctcctcccaaactacttcaagcacaacaacttctccagcttcgtcaggcagctcaacacctatggcttcaggaagatagtggcggacaggtgggagttcgccaacgagttcttcaggaagggcgccaagcacctcctcgcagagatccaccggaggaagtcgtcgcagccgctgccgacgccgctgccgccgcaccagccctaccaccaccaccaccaccacctccaccaccacctcagcccgttctccccgccgccgctggcacagccggtgccgtcgtaccaccaccaccacttccaagaagagcccatcgccaccgccaccgcgccgcacggcggtgctcaagccggcgccgccggtggcggcaacaatgaaggcagcggcgccggcgccggcgccggcggggactttctggccgcgctgtcggaggacaaccggcagctgcggcggcgcaactcgctgctgctgtcggagctggcgcacatgaagaagctctacaacgacatcatctacttcctgcagaaccacgtggccccggtgacgagcccctcgtcggcggcgcacgcgtccctgcccagcgccggcggcggcggcgccgcggcgtcctcctgcaggctaatggagctggacccggcggactccccatccccgccgcggcggccggaggcggacgacggcacggacacggtgaagctgttcggcgtggccctgcagggcaagaagaagaagcgggcgcaccaggaggatggggacgacggcaaccatgagcagggaagcagcgacgtctagccgccggccggcttgcattgctagctctctcgttcgtgtacatacagagatcagatcagagagtagtagtttgcctcgctagctagctaggctaggctttggtaattttcttctgagtgcgtactgaaattaatgtgcaagagcgaagtgtttgtctgagtaaaactaacaacaatctacggatgcgtgcatggaagctaagctatagatgcagaggcttgcccccccttctcaattcgcaatcgcaaaaaaaaaaaaaaaaaaaaaaaaa

SEQ ID NO: 11756 - DNA, 1505 bp, Zea mays
cctcgaggccggccgggttgtggatttaagcagaagcttcagcttgtaaactcaaatatgagcttcaacatgctctcctgaagctcccggcagccccgggccgccccgcccctccgaaagcccctgactcattggaagacagtaaaggctctaactcatacattttcagtaacaaaccacagaaccatgggaaaggaaccgtttcatgcgctgcggcctttcagggccacggaggagattctcgtgacaagcaatctcctgttgtaaataggagcattttcaatggtgttgatgctgatgtgtttgcccgatttgaagttttgcagtcccgtattgataatataaactccttgagtgagattgactgtggggagcagaaagaagcaagcaagagaccatatgcagtcgaagatactgttatggcgagactgaaagttttgaagtctcgtcctgacaatataacctctttgagtcaaggaagcactaaacaccagctagatggaagcacaaacagtgcagataatgttgatgacactgttattgctaggctgggaattttggagtcccatcctaataatgaagccctattgggacaggaaagcagcaagcgacaactggatgcgagaacaaatagagaagatgggattgatgctgctgttatggctaggctgagaattttgaagtctcgacctgataatgaaacctcaatgggcgatgccaacaaggagcagcaagacgcatgtggtgaacaattaaatggggatgaccttggtattgtgtccaatggagccattagcaacaccctgagtgagaagtgctctaagtttacgcactctgatgatcatttaggagaaaaaaactcagtaggtgtcccggacacatttggtgatggaaacagtgctagggagaaaaaggaggttggtggttcagcagatgttgctacccccatgaggtgcaaaggtacatctgatggagtgagcgtcggaagcgcagtacatagtgaagataatcttggtgaaaaccatgtgtggcttcaaactgctggggactctcatgtttgcacagaagggtctcaggaagcgcacccaatctcctctccagttgaccagtatggtggttcacctacagagtgggagcatgtgctgaaggagaatttcttccatccaggcaaattggcgaattctgacccataaactggaaagcttttgtttcagctcatgttgcctcaaaatgctgatgcttcttgtaaatatatgatacgatattatacatcccctccccccgaacctttgtctctatgttcaataatctgcatatctggtgatcaaggaaacgcactgtgcccccgatggtgctatatggaactagtctggtttgtctgcttgggtctatcatgccatagtttatctgtaaatggcacatgtatgttctggaccgagagtgaattattgtatatatttacttccagcaaatttggataaaaaaaaaaaaaaaaaccggcccaa

SEQ ID NO: 11757 - DNA, 1865 bp, Zea mays
cattgggggcctcccgcccggccggcccggacggacggtgtcggcggacggccgcgatgggcgggggcgacgacgcggcggcgggcgttggagacgggttcgagtgggatgccgactcccagctctactaccacgccagtactgctttttaccatgaccctgttgctggatggtactacagcagcagagatagccaatattacgtctacaaaaatggaaattacatgccattgacaacagatctggaaaatgaacccacagccaatcatccatatgatgaggccaaccaagatgtcttggaacactcttcaggcttggaaacaactatacttgacaatgagaatgaaataccaggacctccatcagaatggatggaggaaacactgataaacttgtatttgtcaggctactcaaacaatgaagtcaatgctgaaagttcactagtaatcgcacattcaaatgaggaagacagaattgaaacaaccgggaacaaactagatagcttgacctcggacagtgcttcagcctctctgcatgatgctacatcacagcaaactgaagttgaaacagaaacaaagaattccgcttatgtgtatgaatctttgggggaagaggaagagaaatggcacgctcagtatggtcaggtcgagaggtcaaatgatgatcaacatttacctccaacaattgatatatgggattgggatgtggtccaagaccatgttaacaaaggtcagcccgtggttaggcttgtgggatgtttatctaggggttcaaataagcttcatccttctcttcctactcgtggtggccttgtaaggactgctcctgtgcgtgaagttcatcttgacctcgtgcaagtttcaacagggaagctgtacaggctaaggaaccctagcagaaagtacttagccactttatccgcatatgactcctccaacccaacaaaggattgggggtttcctgatattaatttgaataagcaatccactgcaaagtgccaatctgaagttcttgctgataaatcttgtggcggaggaagtgtctcagctgctaataccatggagccgaacacaaaagtttacagggacagagctgctgagagaaggatcctacatcgtggcttaggggttgggcctggacagaagcagagtaacaccaacaatttcgatgaatacgaggaatcaatcgaggacatggattcaatgggagttgcgtcagctgatttgaatttccaatccagcggtttgctttcggctaagagaataatggagaacatgggctggaagcagggagaagcccttggaaaaagcagaaagggcattgtagaacctatacagccttccatcaacaaacatggtgccggtttgggatggaggcaaacccgctaagatgttcctttgaagattccagtctttgtatttgtatcctctgaaggtaagttccaattgtatcgaataaaccggagggaactgaattgaacttgattctaaattttgctgcttctctcacacagttttaaaaagttgcaacttgtacttaaatgtggtctatgtgtattagcctgtcagatttggtgttcttaattcaagtgcaactacaacggaagaattgaggcaactgacttgtgcttgctgcttaaatctggcgtttttttggacagcagtatattcacaggctttcccttctcatttttcttctcatgggcacgagagtaatcagctggggctttgttcttgttcttgtcaccaccttgtctgctcctcttcttatagatgggcttttttatcttgtatgagctagcatttacttcgatgctttgccatttggatgagcattgaagtttgtcttcacaacctcatcttgtg

SEQ ID NO: 11758 - DNA, 6726 bp, Zea mays
  misc_feature (247)..(247): n is a, c, g, or t
  misc_feature (5430)..(5430): n is a, c, g, or t
ggacgagacgaaggaagcggcgcactcggcaggacgcgtctggtgtgggcgtccgatcagacgcttgttggcaagcgagcgtgacgatcggcgccacttgccacgccgagctgtgtcgtccggtgactccggtcccgggagctaacgaacgaccaacggccgagagagcgcgtccggtacggtaggtgggcgctgggcggcgcggctggacgcgccgctgctggccggtgctaggtggcgacgaccngtagagccggatccgttgagcgtgacatatgcagtgtgcatgcgtggcacaccctcacacgccctgaaaacaggaaccgagacacggcacctgcacagtggccagtggggtctggggaggggggcaaaatcgtcgttcaggataaagctacgactcggatgccgattaggaagcaataacgaccgtcgactgttccctttgttgaaatcggagtagctgttcgcctgatcaggtaatcgtactactataatcaattgcttaaagaaaccgagggcacggaaagaattgaccggtgcgcgcgacgtgcagtatagtgatcgcgaaggccatgacatgtactactagtagtatagtacgcgcccatacgatgacccgtcgttcgcttgggcggtggcaccgacaggcgacagcgacacgtagcgcgggtcggagtctcgctcaactcccaactgttcctgcgccgtgcatgcatgccaccgtacacactacccgtcactttcctggaattgaaagggcaaacgcgcattttttttttctggtctagttaaaacgctacagcacacaataatagctagtcacacttcaccggctgctcctccgatccacaagtctctgctcttttattgagaagaagagggacacccattttttgtagaaaaaaaggtcacaccattattattggaaactaactcagcttgcttgttgagagagagagagagagagagagaatccgttcaatatccattttgttttgattattccaaatagcacaagtaaaacctgtaaagatgaacatgcgaagacattttgaggacttggatttttttttattatccagacactccataaatccatatttgggcatccattccggagacctacctaggtgtatttggtttccaacggaggagagcagagtggtttctggagtctatatatgataaatatttaggatgctctcgcttcaccaaaatgacgggatgggagcgctcggccgctcacgcgtactggagcactctcctcatgggggtttgagttgagtgggtgcagctagcagcttccggcccacgagtccgcatctcgattcttttctccttttccccctttcgcgtagattcctgtacacgcacgaagcatctggattccgcaagcagcagctgcaactgcaaaccgtcatcgcgttccgccttccgttgcattgcacaccagtagaacaggacgcgcactacactcgaataagaatgtactgtaaaaaatcctgcaggatttcaagcatccgccgtatctagtacagagcatgctgtactcgatggagtatttccaaagaaactgacccctttaattttgcagcttaataaatgcacctaaaaaattgttttgtctctcagaattctagcagaaaattacagaagtttgtacagaatcgaccccgggcattaccaacatccaaccaactagtgaggtgaaaaaaggcctgcctaacaactgggccttttttttttgatgaggccgacgaccacctaggccctcacgccacgagaaaccccgagcccccgacgattttccggcccattataggccgctacgacggatctcaataaaaaaaaaaccgcccatagcgcgcaggatgccgtacggtatcggcggacggccgcgatgggcgggagcggcgggggcgacgacgcggcggcgggcgttggagacgggttcgagtgggatgccgactcccagctctactaccacgccaggtagctgcttcctttctctctacgtgctctagcgtcccggccgctgattgggcgccgcagacgggcggttcctgtggctgcgtgcctgggatttccagcgacccttctccgcttttcggttgtcctcacggtccgagctcgcatagctgatgcatgaccatgatcattttggcagaaagctggtagaaactcttgatgaactaatgaaacgaagctctgccgcttgcgtgcggacctgttatttatttatttatttttgttcaattgattagcggttggttctctctgtatttgttattttcacttgaatatatgcttctatctgtatccacataaggctcatctgtctcagttgtggatatcatttgtgctgctattggctccaaaacactggctcctatggcctatgcgctatatgttagccttgaacacctgtacatgcttactggagaaatctgtgagatataatggatgttgggctctgtgtatcgagcagtttgacaatcatatgggttactgtactgacccttggccaccggcgcaccccaaacgccgagacgtgagacagcagaagaaccggaagggaatcacggtggggaaatagaaactgacgcaaggtgtgattctgtttttccttctgttatttctctgatcccctgattctgttacagacacggcttataagccactatgacagctaatgacagctaatgacagctaatgactatggcccaccatatggcctaaaagtagttaatcatccaacaaagctactcagaccttcgaagtcgtcacactcgccccctcttcagttggtacttgaccccaagtacttaattcaggaaagagctgaataagcacattccaatcctcccaggaagtagcttcatccttcttgttagtccactggatctgcacttgaggaacagcctgattccctttacggaccaaacgacgatccaaaatacgaactggtttcagaacgccctgatctaaagacagagtagtgggcaactcagaaaacactggacaatgatttggggtgaaactcttgagctgagacacatgaaagacaggatggatcttagaatccgggggtaaatccaacttgtaagccacctgcccaatacgctgcaacaccttataaggcccaaagtaacgaaaagccagcttcggacaggaacgaaaaaccacagaatgttgcacatatggctgcaggcttgccagcaccaattcaccaacttgaaactccctctcagtacgggaacgatcagccttctgtttcatacgattctggcctcgggccccctgcaccttaagcaattccagatgtcgttcgcgagacaacagcagatcctggacagccatatcaatcgcaggcacaaccccattcccaccagattcaggtaacaaaagactaggagcagcagccacagggggatcattagccatagacgactttaaaaggagatgcaacccagagaggtgtgatgtgtagtattgtaccaaaattcagccaaaggtaaccacagcttccacttagtaggagaatcatgagtagcacatctgagattacatctcaagacattgattgacacgttcagtttgaccatcactctgtgggtggtaggcagtagacaataagagcttggtctgcatcagagtaaacaactgcttccagaaagtgctagtgaacactttatcgcgatctgagacaatcgatttaggcaatccatgtaacttgcagatgttgtcaaacacaacttgagccacttgaccagctgtaaatgggtgcttgagagggaaaaaatgggcatacttggatagcctatccaccaccactaaaataacagaatagccatccgatttaggtaacccttctataaaatccatagagatatcttgccaaataccagtgggaataggtaaaggttgaagaagaccagcagggtggacatgctcagatttggctttctgacaaatgcagcactgtttcacaaagtcctccacatccctcttaagaccttgccaataaaatgctttcttcaccctttgatatgtagccatgataccagaatgacctcccaaagcactatcatgtaaaacagaaataagtttggtcctgagagctgaattgtgacccacccaaagctgattccctttttttatcagaccttggtgtatggaaaaaccttcttcattaggactactgacagccaactgagccaaaagttgttgggccaccgggtctgtcatataagaattaaggatttcttgcaaccacattggttgaacttcagacacagtctgcaaagacaggacagatcccatcctggataatgcatcagcagctaagttctcccttccttttcgatatacaattctgaactgcaaacccatgagtttagacatagccttcctctggagatcagattgcagttgctgactttccagataacacaaactttgatgatcagtaagaataacaaactcttggtactgcaaataagatctccatctttctactgccataatcaaggccagaaactctttgtcatagatggacaaatgtttgttcttctcagataaagccttgctcaagtatgctagaggctgtcctttttgcataagcactgcacccaacccaacatcactagcatcagtctcaactgtaaaaacttcagtgaaattaggcaatgcaaggacaggggtactggccatggcctgtttcagagcagtaaaagccacagtcgcagcctcactccaaaggaattgtttcttcttcaacaaagtagtcaaaggcttggcaatgagaccataatgtttaacaaaacgtcgataataaccagtaagtcccaaaaaagctcgaagttcagtcacagtagaaggagtaggccactttaacatgacttcagtcttgctaggatcggtagagactccttccacagaaataatatggcccagatacatgagtttctgttgtgcaaactggcacttagactgcttcaaataaaactgatgttgcctgagggtgtctaacaccagttgcaaatgttgcaaatgcaagtcgaaggtagggctgtagatgagtatatcatcaataaaaaccaaggcaaatttacgcagaaaaggagtcaaaatagaattcattgcgcactgaaaagtggcaggggcattggtcaatccaaatggcattactttaaactgaaaatgaccactgtgtgttttaaaagctgttttaaattcctcgccctccttcatgcgaacttgatgataacccgccctcaagtccagacttgtaaaatatttggtgccatgcaattcatctaagatttcatccaccactggcataggaaatcgattcttcactgtaagctcattaagcttgcgataatccacacagaaacgccatgacccatcctttttctgcacaancaacaccggagaggcaaatggactgacactaggttcaatcaaaccggctgtcagcaattcttccacctgacgttctatttcagtcttatgaaatggagaataacgataaggtcttgaattcactggaacagcaccaggaatgaggggaatggcatgatcgaatactctcgctggtggtaaagttttaggatcatcaaaaacatccttatactgaagaagaagattatgaactgctagactggtagcagcagactgagaagaagaggtgccatccggatagaaatccaacaaagccaaagcccacacctcattgccagaaaaccacttgctcaactggaccaccgacaattcagtcaccgtctgctggaccgtaggtaacagaccttgcaactgcacccaggagccttgataagaaaatcccagagacttttgattccaattacaagtaatgggactgttttgtttcaaccaatcacaccctaaaatagcatcataaggccccaaatccaataccctcatgtcagtggtgaaagtgtgtccaccacaccaccactcaactgccttcaccatagtagtgctcaccagttcttgcccactagcagtcttgactcgaatagtggaaacaggttgaggaaacaaccctgcttgttggacaaacgtggaattgatgaaagttgctgaactgcctgaatcgaccaacaatagaaacacctggtttttaaccaaagcacgcaagcgaatgctatccactccttccgtcccagaaactgcatgaaccgacaaactgcacaagtccaccacagagtgatcctcctgatccaactgctgtaaaacttcatctgataattccaaagccatgtcatccacagtcaaaacattaagcaccgccggtactcgttttccacatttagcagcatgtccagcatcaaacttgtcaccacaagtaaaacataaaccatgagcccggcgataatcccggcaattgtcgttccttggacaaccccacaccttcctgagagtcaggcggtagccctggaatacctcttttccccccaacagtggactgaaacttaggccgactcttgtccaaaacatcctgctgtaaggtggccaacagaacagcacgattcaccgtagttggtacttgacaacgcacaggaccttgaatctcgcgcttcaagcctttaacaaactgagcgacaaagaaaatctcatccagctgaggattatggacagcagtactgtaacgcaaatcatcaaatactgaaacatattcctcaagagagccagtctgtc

SEQ ID NO: 11759 - DNA, 2104 bp, Zea mays
cgggagccttctgatgggtcacctgctcggcccgcgacggctacttcacaagctcaagtcttccccagtccattccatctcgatcccccacgagctccaataaactaatcacagatttcaagctcgcttcaaattcttaaatccaaccccattttcacctgagcacacgcattgctcgagaactcgcgtagcaagaaaccatcaacaagggaagggagcttaggcaaagaatccaagaaggcaagaaccatgctggaagatgacgccgccatggacgcggatagcctcgtcggccaggacccgaggtcgggggtgcggccaagcggtggtgagcgcgactgggcggcggccgtgctggagccagtgcggtggatgcggatgctgtgccgggagctgggcgcgacgttcgtggctggggtggtgctggtgtacggcctcagccagggcttcgccggctccttcttccgagtggcgtcggactactactggaaggacgtgcagcgggtgcaaccagccactgtgcagttcctctccgtcgtcttcttcattccatgggtgctcaaaccgctctgggggatcatgaccgacgtctttcccatctgcgggtaccgccgccgcccgtacttcctcttctcaggaatacttggaacggtttcagctgctatcgttgcagtaactattggattgccaatgagttctgctgtactttgcttgatgggaatctcaacagcagtcgccattgctgatgtaacaatagatgcttcaatcgcaaagaatagtattgataagccggcgctggctccagacatgcagagcctttgtgcattctcctcatctctaggtgcacttgttgggtatgctacaagtggattatttgtccatcatcttggagcacagggtgcgttaggtgttatggctatacctcctgccacagtggttttccttggttttttcatatatgagctgaaaacacatcaacataatgttaaagagaaggttttaaacaaggttagtggggcagtgaaaggaatggttcggactataaggtatccagtagtgtggaggccatctctttacatgttcctttcgctggctctgagtatcagcacccatgaggggcaattctactggtatactaacaagacaccacctaatcctggattttcgcaggaattcgtcgggctggtccacgccatcggcgcggtggcgtccatgctgggcgtgctcgtctaccacaagtgcctcaaggattacccgttccggagcatcctcttgtacgcgcagctcctgtacggcgtgtcggggcttctggacctcaccttcgtgctccggtggaacctggcgctgggcatccctgacgcggcgttcgtgaccctggaggagtgcgtctcccgcgtggtggcccgcgtccggctgatgccgatgatggtgctgagcaccaagctgtgcccgccgggcatggagggcaccttcttcgcgctgctcatgtgcatcgacagcctcggcatgctggcggccaaggccggcggcgcggcggtgctgcgcgcgctgcgcgtcaccaggaccgacttcggccacctctggctcgccgtgctgctcaggaacgtgctcaggctcgccacgctgggggccatcggtctcgtgcccaccgcgggccagactgacgtgctggtgccgcgcgagctccttgtgagctcgccggctggtgtggccgatgacgaggaagagaggctgcagctggcgatgctcacttcacacactgacgatgtataataatgatccaggttgtcttacacagagggagatactgatccattgagcaagagcaggagcgaggcctccaggaaaaatgttttttcgtcgaggatgatctgggcatccttacttccgcttccgagtcctgttaaaaatcagattcacatactctagccaggggcgtcttgagatttttggaggccatgtgcaaaattaacacacataaggtctctttgattcaactttttttactagcttttctaaaaaaactgtctgtagtgagaatctaaatatcacgtggattacgtgtggagtaagattaaggtgttcatgaaaaaaaaaaaaaaaa

SEQ ID NO: 11760 - DNA, 2203 bp, Zea mays
ttgggtacctcgaggccggccggggactcgagtcgaggccgaggaaaagtttcgccatccggtttggttgtgttggattttccttctattaaaccaaaccttctgggctcctgactccgctgctctggtctctcccaccaccgcgaacacctggcaatggcggcctccgccccgtcggccacctcccagatgtcctcaagcggcctcctttcttactgagctcacccaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccgggatctaggccctgagcaatggcagcggcggtggcgccgccgctctgcacctggctcgtcgccgcctgtctctccgcggcctgcggcgatggcgagaaggagaatgaacgcaggcaccgcggtggcggcgtagggggtttcttcggctcgcgccgccgcctcggctcagggcgccgcggcgtggggcgctctggaatggccatgtctgttgccttgcatcctgaaaggacagctgtggaaaataagaaacctgatatgaaacagaggagagtggttgtcactggcatgggtgtagtgacgccactagggcatgatcctgatgaattctacaataaccttttaaggggtatcagtggaataagcgagatagaggcatttgattgttctcactatcccacgagaatcgcgggagaaatcaaatcattttcgacagatggttgggttgcaccaaagctagctaagcgaatggacaagtttatgcaatatttgataacagctggaaagaaagcattggagaatgctggaatcactgaagaagtcatgaatgagttggaaaaatcaagatgtggagtcctcattgggtctgctatgggtggcatgaaggttttcagtgatgcaattgaagctttgagggtttcatacaagaagatgaacccattctgtgtaccttttgcaactacaaacatgggttctgcgattcttgctatggatctgggttggatgggcccaaattactctatctctactgcttgtgctactagcaacttctgcattctgaatgcagctaatcatatcagaaaaggggaagctgatgttatgctttgtggtggttctgatgcaccaatcatccctattggattgggaggttttgtggcctgcagagctctttcacagagaaacagtgatccagcaaaagcttctcgaccttgggatgtggatcgtgatggatttgttatgggagaagggtctggtgtgcttgttttggaagaacttgagcatgcaaagcaaagaggtgcagaaatatatgctgaatttctaggaggaagtttcacatgcgatgcataccatatgacagaacctcatcctgaagggaaaggggttattctttgtattgaaaacgcattagcagattcaggagtaacaaaggaggacattaactatataaatgcccatgcaacatctacacagatgggtgatttgaaagaatttgaagctctcaaccgttgttttggccagaatcctcagctacgagtgaactcaacaaagtcgatgacaggccatctgctaggagctgctggtggaatagaggctgttgctgctatacaagctataaggacaggttgggtgcatccaaatctcaatttggacaatccagagaaaaccgtggatgtcaggatgctggtgggcccgcagaaggagagatgtgatgtgaaggtggcgctgtcgaactcgtttggatttggcgggcacaactcatcgattttgtttgcaccattcaagtgatagccgttgacaaatttcttgtggtgggctacacaccgtcgaactgagaccttgtataagaaagtatttaccggacgcagcaatatctcctgtactgcaagattaggaagagatccaaaaggcttagtaggatgtgtattgccccacaaccggacgaaagatggaaactggtccgaaattatgtcgaccgagaagggcatccgttcagatgcccccccccccctttacgtgttatattttcttccagatgcaagtgtaccctatatataattaaacaattaatatcatcatcattaacat

SEQ ID NO: 11761 - DNA, 2742 bp, Zea mays
gttcggcattactccacttcactccctccctccctcacctctggctcatcagtgcctgcctcactaacctcaccattactgaaatgcagagctcgcataaataggcaggacccgtggtgctactctcctgtccccttccggccttttccccccttctggagcttggggggaggcactctgcaccttcgtcttcgtcttggcgtcctccagcgctctgccttcctgagctggcttcttgtccgcagatccatggcgaaggactacccagcttctccgaaagctcagcagctccaggaatccaagaagcagcgcctgacatacatcctcgtcgtaagcgcgctctgcatcgccttctacgtccttggcgcatggcagaacaccacgcttccaaagcccataggcaactcggcgatcacccgggttggctgcgatcccactgccgccacggcacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccgtaggcgcgggcgccggttcgaccgaaacatgctagtgtatcgggagcgccactgtcctggcaaggacgagcaggtccgatgcctcatcccagcaccgcctgggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcaggacggctgttgacacaggttgcggggttgctagttggggagcttacttgctgaagagaaacatcatcgccatgtcatttgcgccgagagacacgcaccaagctcaggtgcaattcgcgctggaaagaggtgtccctgccatcattggcgtcatggcgaagcagcggttgccttacccatctagggcgttcgatatggcacattgctcgcgctgtctgattccttgggatgaacacgatggactgtaccttgctgaagtcgataggattctgaggccaggaggatactggatcctctcgggacctccgatcaattggaagacacaccacagggggtgggagaggacgaaggacgacctcaagcgggagcaggacaagatcgaggatgttgcgaggagcctttgctggaacaaggtggttgagaagggggatctgtccatctggcagaagcccaagaatcaccttgagtgtgccaacattaagaagacatataagacaccccatatctgcaagagtgacaatcctgatgctgcctggtacacacagatggaagcctgtgttactccactgcctgaagtgagcaaccagggagaagtggctgggggagcggtggagaaatggccagagagggcgttcttggttccccccaggatcaaaaggggcatgattccaggactggacgccaagaagtttgacgaggacaagaagctttgggagaagagggtggcctactacaagcgcaccataccaattgcagagaacaggtacagaaatgtgatggacatgaacgccaacatgggtgggttcgctgcttctctagtgaagtaccccgtgtgggtgatgaatgtcgtccctgttaactccgaccgggacaccctcggggcaatatacgagcgagggttcatcggcacgtaccaggactggtgcgaagctttctcgacgtatccaagaacatatgacctcctgcatgctgacaatctgtttagcatctaccaagacaggtgcgatataactggcatcctcttggagatggacagaatattaaggcccgagggcacagctatcatccgcgacacagtcgacgtgctcacgaaggtccaggcaataaccaagcggatgcggtgggagagccgcatcatggaccacgaggacggccccttcaacccggagaaggtcctcatggcggtcaagacgtactggaccgccgaagccgaggaggagcactagcacacgagtgacaccgagctcacttgaaagcgtgaaccaagcctgttctacacttctactaccggtcgagagggatggcgtcagcgttttgcgtctcagtgtagtatgtatgtcccttttcaccttttctctagttctttgtagctagctacaatcagatgggaaggtaagggagagttttgagacgggggggggggggggttggttggtcctctagttgagatacaggaagcggttttgtagcaggggaaggtttcgctggtcttgcgtaggttcctggccctgtttcacgaggggttgaactaggttttagtttgtaatgcgatggcaccgggcaggcattgttaatcgtatattggggtgaccataatagtaacaggtatttatttagttttcatctgaaaaaaaaaagaaattgggcggccgaactgtcggtgcatttctgatgcaaccagattctggttgttccgttgtggaagtagcagtcgacggtccctactgtggctatcactagacagaagacatccatatgggttttggcttattgcttccctgcactggctggcccgatgaacagttcag

SEQ ID NO: 11762 - DNA, 2790 bp, Zea mays
gcttgctattatagttattactagcgttatatatgtggtggatgtataagtgcaaggtaacttgattatacaacttattatttgtatttaattctctctactaatattttgtataccaaatcatgaactcgttgttcattacttaaattttggaccatgatctcattaatcattacgatacttattgattataaaaagaataagcatattggagataaaaacccgcgggtaacccgtgggtacccgcaaacctgatgagtacgggtttgggaaaaatttcaaacccgtcatgggtacatgtttttttaatgggtgtaaataattttcacgggtacgagtttgggatagcaaaacttggcgtgtttgtacccgttgccatctctagtcacggggaaagccgttgttgttgggatgtagactcccgtgagtggaaggagtttttcagtcaagttggttagagatgtccgagacctgcagtacctgccgaattgagagcaatcagatcagagaccaaggcacgaagaaagaagaagcagacatgtcagcacccgccacccgcctcccgccgacaggctacaggattcatgcagccaacaaggacgagcttcctttcgctcgaaccggcctgggactatctcattgtctccggcatccggctacagcttctttacgccgagggggagaaggaaggcgatgcccgtgtgacgccgaggctatcagactcactgacctgacttgttggggctgggctgctggggtcgacgacgatcccggccctttcggtctcactcactggcgctcgccgtcgattggcctacgtctaggctaacgtgcgtcggctcaatgattaccgtggttggtggtatccgccagtagactagtagagtagtactctgcctttctggggtggctttgcgcggtaccgacgtaccgtcgcggtcggcagtaaaaaggaccccgttgcgttgagatgaaagattgacgagtacctgcggcagtgtacaaagagcacacagggtactgtacacggtttgattggcgcgggctggggtgtaccgccgctgcagcccggcggtccccgcccacgtgcgccaccgccagccagccagcagcctgccccgtccccttgcctgccttgcccagtaggtgcgacgtcacggtggaaaccaaaaatctagcccgtactagatcttcttcgtatagccattgtttatacttttcgcctcggcgaatgtttccaaaccagcgccgcgccgcgctcctttttcgtttcctcgaaagggtcagccagccaagacagacaaacagaggaacgtgaggaagatgcggcatgtcacgtgacatgacacgagcgccgagattgggatggatggcgtcacgggctcaacaaatccattcaattccccccgtctaccctgccctggataggtggaatggggaaacccgacgactgatgcagtgtgtttagactctgtgctcgtgtcacacgcactctcgccaccgtgtctgtgccagtagtagtagtcgtagctccagctcagctattgtccctgctaatcacctcccgtaactgtcagcacccgtccaaatctactactcctacaatagtcctattatacaaaactcatcagctcatgcccaggagagcgcacgctcttaagcagcgggcggcagtggcaccgggcacactccccagtccccagtcccccgctgggagcggcagccagcacgaggcaggagcagcgcgagggcaggcgccatgggggtccggtcggcggccacaaagctgcacatcccaccatccgccgcccgccgacccacgttcctgccattcgtggccgtcctcctcctctgctctgcctcctatctcatcggcgtctggcagcacggcggcttcgccactccatccgacaaacccgccgccgtctccaccgctacggccgtcgcctgcaccaacgtcgccgccgccccgaagaggaggacccggtccggcgccagctccccgtccctcgacttctccgcgcgccacgcggccgcggcggacgacgcgctcgacgctagcaccgccaccgccgcctcctcggccgcgccgcggaggtcgtcgtacccggcgtgccccgccaggtactccgagtacacgccgtgcgaggacgtggagcggtcgctgcggttcccgcgggaccgcctggtgtaccgcgagcggcactgcccggcgtcggagcgggagcggctgcggtgccttgtgcccgcgccgcccgggtaccgcaccccgttcccgtggcccgccagccgcgacgtcgcctggttcgccaacgcgccgcacaaggagctcaccgtcgagaaggcggtgcagaactggatccgcgtcgacggcgacaggctcaggttccccggcggcgggaccatgttccccaacggcgccgacgcctacatcgacgacatgccaagctcgtcccgctccacgacggctccatccgcaccgcgctcgacaccggatgcggggtaagcagtagacgctcacgctctcgccccacctcgttggttagctttagctagtacagaaaaaataagtggatttggtcgactgacgagcgtcgacaaggttagattggagaatttagttccaatagcattgacttgagatcaaggccagtctcttgctagttccagtcccaaagggcactggactggatacattggaaaagcgagtactactctgctccgcttctttcagagacgttctttttgtgacgaaacgaaactttgcgcaggtggcgagctggggcgcgt

SEQ ID NO: 11763 - DNA, 5934 bp, Zea mays
  misc_feature (3433)..(3433): n is a, c, g, or t
  misc_feature (3639)..(3639): n is a, c, g, or t
  misc_feature (4465)..(4465): n is a, c, g, or t
  misc_feature (4708)..(4708): n is a, c, g, or t
  misc_feature (5157)..(5157): n is a, c, g, or t
tgcagttgagcacctgatcaggtgagagttgcatacgcggttgattttcagttttgttttatttatagtcgatactgttctgttgcggaaactggaattgtgcctcgcattgcgtgatcgagggactccaatcccgttctatccttcattttgagacgagagactcctgtgaaagagggggagggggggcttgtgcccgaggaaccctcatcactgatgcgccaatgcgtcaatgcgccaatcgccattgcgtgtgtcagcaggaaggaaaactggtgagtgatgcgccattgcgtgtgttcactttttcccgctttttctggagatcccatccatggcgttctcttttctttcctttttcccgtggttcttatttcgatgataaagagaatatgtgttcctaccgtggttcaaaaacattgtctacatagaaagcaccaggatatgtcttgccgtgttctgcagattttctaactgtgccatcaaatgtgaaataatgcacctctgaatgtctatcagctttgctactatagttcttctagaaacaattgttttcttgatgaactatagaaacacaattgaattcagaaagactgaccattttagcagtaaatataccggactacgatgaagaggctgaaacctggttggatatttgataacatgctaagtaaaaagaatgcaatcattagatatttgataacatactagctaaacaatctcaaatgtaaccaaatttagagtaaaaaaactccctgtgtcagatattgtattaagaagaagacctttctacgtctagggcggctcaccttctaaaattgagtccaggaattaggcgtgtatagacagggattcaaggaagcatatcattcattatttgccagtaacatcctttgcaaaatatcatgccaaataggtaggacacgcccatgaccatgaacatgaaccattggagggttgcatcagtcaaggtgtgtggtcccagcattttattgcaccgacactgtccgagcttggcagcttgccatcggcccatcacaaaactgcattttacccccttccacatgaggttttctatctttcaagccaaaaggaaaagcaaaaaaaaatgctgggagcaaatggaggccctacaatatctcccccccataaccctccgcggtgccctttggccattgaccaaatcctgtccaccctccaactcctccatgaaggcgaaagaacaaacggggtgaatcatctcctgtgccagactgccagtgcgtgacgggggagataaaagagggcaacagctcaaaaggagagccttttggtcttttccccccgcttctactgcaaacaaccatcatgggcgggcaaagctgcccctgcccagatcaatgatagagtgggcgacagtcagagacggcacagcgaatttgctacggcgacagggggaatactggggtatatatatatatccactgttatagtgttataaggtgggtgattccaagatttactgcagttctcgtgtggtcaatttcgttgtgttagctcatgttttttattgattaattcttggaattgtgttaaggctttctgtctgccatcgacaattgtcttgggtccttccaatgtagtcggttaaattagccaacaagattattggcgggcgacattgtcaagaaaaaaaatgagcagggttttgaaatgtcaaaaagattgttcagaaaccaatagtccggaaattctgttcagaaaccaatatgtcagaaatctagatcacatttctcgtcatggttcatgcatgaagtcaaggacagaaacgttcacattcgtgcaagaggcctaattcagaggagcgaaggctatttcttcttcggaatcatcttcctcccaggatccactgcgctcgctggggtctccacaccattaccacgtgagcaaggacaggtcgtggtctcgcctcgccctcggtggctccccgctttttccttcccaccaatgccacactatttttattctgatgtcggcctcatctttccgggtgtggcctccattcaacacccccgctttctttatttatgaaaggttagctagggcgccgctgacaacatgtgagcgtgttcggcattactccacttcactccctccctccctcacctctggctcatcagtgcctgcctcactaacctcaccattactgaaatgcagagctcgcataaataggcaggacccgtggtgctactctcctgtccccttccggccttttccccccttctggagcttggggggaggcactctgcaccttcgtcttcgtcttggcgtcctccagcgctctgccttcctgagctggcttcttgtccgcaggtcaggttcctcccgctgatttcgtttcgtgcgctttgtttctcggaggggatggatccatttgggaatgcaacggctcccgacttaggggcattcatgggggtctgcttcccatttcgttaagtttttcggattcatggggcatgggctggtgcttagctgccattgtcgtgtggcttctgatttgccttttgctgggaatctttactgtttagcctgctttgccctttatgctagaaggacatacttgccttcagcaagaagcataagtctgctggtttttatttgaggcgtgctttatcacgatctgagttttctcctctcgggcaaagcaaaaaccttttggagatttatcccgatctgaggttcttatcgtccctcttttttttctctgcctgcttcttcgatcttgtttttatgggttaggtaggtaatttggtgcctctttaatttttttgggcaaacataaattcaggtgttattcagaaatcaaaccaagcaaatctactgccagtgaatttcgttttaagttataaagtcagtagctaaccacagaaatttactgccggtgttcagactagttagttctgatctcaccaaacggtacattaattgtgctaaaaaaacctcgctgaaacagagactccgctgaaacatgtcgatttactaagtttcaatttttgatattttcttagattcctttcactgctcacagtaaaattagttcatctgtcagtgctgaccatgtgccttcatcttcagtgttcagttcaattgctcaaataaaaaatgcgtagcctaaatttgtcagtttaacccatctaccctgaactctgagatgttcctgagttggctgcctttctccattagatcaaattaaattctgttggcaccttactatgttcttggaactgcaggatccatggcgaaggactacccagcttctccgaaagctcagcagctccaggaatccaagaagcagcgcctgacatacatcctcgtcgtaagcgcgctctgcatcgccttctacgtccttggcgcatggcagaacaccacgcttccaaagcccataggcaactcngcgatcacccgggttggctgcgatcccactgccgccacggcacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccntaggcgcgggcgccggttcgaccgaaacatgctagtgtatcgggagcgccactgtcctggcaaggacgagcaggtccgatgcctcatcccagcaccgcctgggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcaggacggctgttgacacaggttgcggggtaagtggaaggacaccttggtgggtctaggttctagatttgcgttgtgatagtgctgatgcttttgctgttgaaggttgctagttggggagcttacttgctgaagagaaacatcatcgccatgtcatttgcgccgagagacacgcacgaagctcaggtgcaattcgcgctggaaagaggtgtccctgccatcattggcgtcatggcgaagcagcggttgccttacccatctagggcgttcgatatggcacattgctcgcgctgtctgattccttgggatgaacacggtgagtactccaaggacatttttcaagttgttcttgggtagaaaacgaactgactgacttggtgcatgctctcaaacttcctttagatggactgtaccttgctgaagtcgataggattctgaggccaggaggatactggatcctctcgggacctccgatcaattggaagacacaccacagggggtgggagagnacgaaggacgacctcaagcgggagcaggacaagatcgaggatgttgcgaggagcctttgctggaacaaggtggttgagaagggggatctgtccatctggcagaagcccaagaatcaccttgagtgtgccaacattaagaagacatataagacaccccatatctgcaagagtgacaatcctgatgctgcctggtatagaaccgcttaaccaataaaaaattgtgtgatgatccatttagctgtntaggagtacttattttttcttatgtcccattatacaggtacacacagatggaagcctgtgttactccactgcctgaagtgagcaaccagggagaagtggctgggggagcggtggagaaatggccagagagggcgttcttggttccccccaggatcaaaaggggcatgattccaggactggacgccaagaagtttgacgaggacaagaagctttgggagaagagggtggcctactacaagcgcaccataccaattgcagagaacaggtacagaaatgtgatggacatgaacgccaacatgggtgggttcgctgcttctctagtgaagtaccccgtgtgggtgatgaatgtcgtccctgttaactccgaccgggacaccctcggggcaatatacgagcgagggttcatcggcacgtaccaggactggtgcgaagctttctcgacgtatccnagaacatatgacctcctgcatgctgacaatctgtttagcatctaccaagacaggtaagggaactatgtgcttcgatctttatcttaaatactactatatggcaagcaaatttttttacaacatacaggccatcatgacgcgttttgttatcccctaaactttccaggtgcgatataactggcatcctcttggagatggacagaatattaaggcccgagggcacagctatcatccgcgacacagtcgacgtgctcacgaaggtccaggcaataaccaagcggatgcggtgggagagccgcatcatggaccacgaggacggccccttcaacccggagaaggtcctcatggcggtcaagacgtactggaccgccgaagccgaggaggagcactagcacacgagtgacaccgagctcacttgaaagcgtgaaccaagcctgttctactaccggtcgagagggatggcggtcagggttttgcgtctcagtgtagtatgtatgtccctttcaccttttctttagttctttgtagctagctacaatcagatgggaaggtaagggagagttttggggggtagttgagatacaagacgcggtttcgtagcaggggaaggtttcgctggtcttgcgtaggttcctggccctgttccacgaggggttgaactaggttttagtttgtaatacgatggcaccgagcaggcagtgttactctcgtatattggggtgaccataatagtaacaggtatttattcaaaaaaaaaaaaaaaaaactcgagcccgg

SEQ ID NO: 11764 - DNA, 2590 bp, Zea mays
gccgggggcgccgctgacaacatgtgagcgtgttcggcattactccacttcactccctccctccctcacctctggctcatcagtgcctgcctcactaacctcaccattactgaaatgcagagctcgcataaataggcaggacccgtggtgctactctcctgtccccttccggccttttccccccttctggagcttggggggaggcactctgcaccttcgtcttcgtcttggcgtcctccagcgctctgccttcctgagctggcttcttgtccgcaggatccatggcgaaggactacccagcttctccgaaagctcagcagctgcaggaatccaagaagcagcgcctgacatacatcctcgtcgtaagcgcgctctgcatcgccttctacgtccttggcgcatggcagaacaccacgcttccaaagcccataggcaactcggcgatcacccgggttggctgcgatcccactgccgccacgacacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccgtaggcgcgggcgccggttcgaccgaaacatgctagtgtatcgggagcgccactgtcctggcaaggacgagcaggtccgatgctcgagcggccgcccgggcaggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcaggacggctgttgacacaggttgcggggttgctagttggggagcttacttgctgaagaggaacatcatcgccatgtcatttgcgccgagagacacgcacgaagctcaggtgcaattcgcgctggaaagaggtgtccctgccatcattggtgtgatggcgaagcagtggttgccttacccatctagggcgtttgatatggcacattgctcacgctgtctgattccttgggatgaacacgatggactgtacctcggccgcgaccacgctattctaaggccaggaggatactggatcctctcgggacctccgatcaattggaagacacaccacagggggtgggagaggacgaaggacgacctcaagcgagagcaggacaagatcgaggatgttgcgaagagcctttgctggaacaaggtggtcgagaagggggatctgtccatctggcagaagcccaagaaccaccttgagtgtgccaacattaagaagacatataagacaccccatatctgcaagagtgacaatcctgatgctgcctggtacacacagatggaagcctgtgttactccactgcctgaagtgagcaaccagggagaggtggctgggggagcggtggagaaatggccagagagggcgttcttggttccccccaggatcaaaaggggcatgattccaggactggacgccaagaagtttgacgaggacaagaagctttgggagaagagggtggcctactacaagcgcaccataccaattgcagagaacaggtacagaaatgtgatggacatgaacgctgcttctctagtgaagtaccccgtgtgggtgatgaatgtcgtccctgttaactccgaccgggacaccctcggggcaatatacgagcgagggttcatcggcacgtaccaggactggtgcgaagctttctcgacgtatccaagaacatatgacctcctgcatgctgacaatctgtttagcatctaccaagacaggtgcgatataactggcatcctcttggagatggacagaatattaaggcccgagggcacagctatcatccgcgacacagtcgacgtgctcacgaaggtccaggcaataaccaagcggatgcggtgggagagccgcatcatggaccacgaggacggccccttcaacccggagaaggtcctcatggcggtcaagacgtactggaccgccgaagccgaggaggagcactagcacacgagtgacaccgagctcacttgaaagcgtgaaccaagcctgttctacacttctactaccggtcgagagggatggcgtcagcgttttgcgtctcagtgtagtatgtatgtccctttcaccttttctctagttctttgtagctagctacaatcagatgggaaggtaagggagagttttgagggggggtggttggttggtcctctaggctctagttgagatacaggacgcggttttgtagcaggggaaggtttcgctggtcttgcttaggttcctggccctgttccacgaggggttgaactaggttttagtttgtaatgcgatggcaccgggcaggcattgttaatcgtatgttggggtgaccataatagtaacaggtatttatttagttttcatctgaaaaaaaaagtgcttgg

SEQ ID NO: 11765 - DNA, 2151 bp, Zea mays
ttaaaaacaatactagattgtttgattcagattacgctccgtttggatcattaaaattaaattctattttaataatagtaatttaaacttatatcaattaagctaattcggcttttatgtaaaatatatttatatattattaatagcaagatgttggagatatttatgtgctacatttttactatatatgaatagaatgaagagtgtcatgtaagttatatagtagaaataaattttctagtaatgtataaaatcattttatattctccgccctataaatttgagatagtcttatatctgaactttggaaagtggtggaatgtaaaattccaaactaaataagttactttattgagtgaattctaattctgaagagatagtattatttgttgcgcatgatatttttccaaagtagcaaatgggatggcagtttgggacccgtacgctgacgataagttgagcgcacctccaggccactcactcccagttctaaaccctaaacctgacgccgccatggccgccgccgttcgccacatcgtgcgccgccgcctctccacggccgccgccatcactgcaccggtccccactccggcctccatcctcaacccgtcctcgccgagcactcccctcacctcgcgacataagacccgactcgccatctccctcctcaagtcttccccgccgcctccccccgaccagatcctctccatttgccgcgccgcggcactgaccccggagacacacatcgaccgcatcgcgctgtcgctagccgcatcaaagctctcctccgctccggacaccctccgtgacctcgcctccaccgtcctcaccccgcgccacgcaccccacgccatcgcgctcttcggccaggcacacctcctccccgacgccatctccactttccagtcctccccctccacccgctccctcaacgccctcatcttcgcgtgcatcgtctccggtaaccacacggaggccgcccgcgtcttccagacattcccagacgcccatggcgtcaagcccaacactgagaccttcaatgccatcatcaaatcattcgccgagtctggcaccataaggtccttttactcggttttcgatgaaatgtgcaagaagggcttgaagcccaactccatcacatttaccactgcgctcgctggtttctacaaggaggagaagttcgatgacatcaagaaggtattagagctcatgaagaagaatggatgtggtgagtccctgccggtatacaatgtgagggtgcagagtttgtgcaaactcggtcggagtggtgaggcgagggcattagtggacgagatgatgaagaagggcacaaagccaaattgggtgacctacaaccatctgatttatggattctgtaaggagggggatttggaggaagcaaagcgtctgtacaaggagatgggaagaaaggggcttgttggggatagcgatttctattttatgcttatttattacctttgtaagggtgatgatttggacactgcccttggactatacaatgaaatagcagctaagaattgggtgccatgcttctcaaccatgaaaatgcttgtgaatggacttgctgggagctcaaggatcgatgaggcaaagggaatcattgagaagatgaaagagaagttcccagataaaactgaggggtggaaggaggtggaggaagcatttcctcattagagtaaaacatcgatgatctcagcaaatttgccagtgctgaagacattgttggttggtagttgggactgcatctatatttgatcaactgtttcgagtatatgaagatatggcctggattcaattttatatagatgtgaatcatgctccagctgtgatgactgattaacagtggcagctgcaggttgttcttggcgatgccccagtagttaataccttttgcatattgaagttttagttgtgggaattagagagaataaaactgtcagttttgttggcacaggctgagcctgtcattgccttgtacggaccttgcgcctgcaatttttgcagtctgtaagcgatgcaatgtatgctataactgtaacgacttccgtttcagtttgaatggactgaaattaatgtttccgaaaaaaaaaaaaaaaaagcaacgtaaatgtcattgcgccccggtaccca

SEQ ID NO: 11766 - DNA, 2665 bp, Zea mays
accgtccgatcccgcgtcaaaattgcccatcccctcgttacgcctgctcgggccggcgggtttctcggacacgccgccatcgccactcgcaggttcgcccccaccacccccccccccccccgattatttcgtccagccctacccgacagcgacgacctccgccaccaccttccgcgctaacgacgtcgccatcacctcgcgtcgagccagacgctcaggtcttcatcgtgctcttcaccggcgacgagaacccaccaacaggccatccgagtcggtctcgatgatggcccataagctgagtcctgacacttccaacctcaggaggccaatggcccagtatacggtgttagtgtagccagtggctgcctgcttctccctcctcaaggcggagcgcagcaccgcggctgcgctgctggcggccagagatgatgacgcgttgcggtgtacaactcctggtggcacgggggatctcctcatcaccatgcctttctcggaggatcaaccaaacggaaagtgaaattgttcggatgtttcatcctccaattcgtcagagtgaggaagcaatagcaaccattgtgccaaggtacacatattctatgcgtgtcttggatgagaggttcattaggatcctgaagatattcaagtggggccctgatgctgagaaggcgctggaggttctcatgcttagagttgatcactggttggtacgagaggttatgaaaactgacgttggggtcaatgtgaagatgcagttcttcagatgggctgcaaagcggaggaattatgagcatgacacatccacttacatggcattgatacattgtttggaagtagtggagcagtatggtgagatgtggaagatgatccaagaaatggtacggaatcccatttgtgttgttaccccaacagaactttcagatgtagttcgaatgctggggaatgctaagatggtcagacaggcaattacaatcttctaccagatcaaaacgcggaagtgtcagccaattgcacaggcatataacagcatgataataatgttgatgcatgagggccaatatgagaaagtccatcaactatacaatgagatgagcactgagggtcattgcttcccagacactgtgacatatagtgcattgatttccgccttttgcaaattaggtcgacgtgattcagcaattcagttgttgaatgagatgaaggagatcggtatgcagccaactactaagatatatacaatgttaatagctttgttcttcaaattcaatgatgctcatggagcattgagtttgtttgaagaaatgaggcatcagtattgccgaccggatgtgtttacttacactgagctaatcagaggccttggtaaagctggcagaatagatgaagcatatcacttcttctgtgaaatgcagcgagaaggctgcaggccagacacagtttttatgaataatatgataaatttcttaggcaaggctggccgtttggatgatgctacgaagctgtttcaggagatggaaacattgcggtgcattcctagtgtggtgacatacaatactatcataaaagcactttttgaatcaaaatctcgtgcttctgaggttccatcttggtttgagagaatgaaggcaagtggaatctcccccagttcgttcacctattctatccttattgatggattctgcaaaaccaacaggatggagaaggccatgatgctactggaagagatggatgaaaagggtttccctccatgtccagcggcatattgtagcctgattgatgctcttggaaaagccaagcgttatgatcttgcttgtgagctttttcaggaactaaaggaaaattgtggctcgtccagtgctcgggtatatgcagttatgattaaacacttaggaaaggctggacggcttgatgatgctataaatatgtttgacgaaatgaacaaacttggttgcgctcctgatgtttatgcgtacaatgctctcatgtctggattagcaagaacaggcatgattgatgaagctcttagtacgatgagaagaatgcaagagcatgggtgtattcctgatatcaattcatacaatattatccttaatgggctggcaaaaacgggaggacctcaccgtgcaatggaaatgctttccaacatgaaacaatctacagtaagacctgatgttgtctcctataatactgtccttggtgccttgagtcatgctggcatgtttgaggaggcatcaaagctgatgaaagagatgaatacattggggtttgagtacgatcttattacatattcatctatacttgaggctattggaaaggttgatcatgaatgtgacccttaaggttggaggtgtatcatatgcagtcactcatttggtgcaagcagagcattcaatctagatctagcaatttcatatggaagagattaaacataaaatagtactaggtttcagtaaatgtaaatagccgtcaccattggattttgattagacgcactagatcgtttaattgcacacttacatcaatatgattgattgcactgtatatcttcccctcaaggtcagtccatcttggtttgtaaattaattgtattacagaagctggagtctatatgcaagccaaacactctcgaacctgacttaccaaaaaaaaaaaaaaaaaacggcacgag

SEQ ID NO: 11767 - DNA, 3742 bp, Zea mays
aaggtatttctttttacttttgcgtttgcacaggccactccaccggttctcctattcttcctagcacaaaggggaggaagtaaagccttcccctcgccggagatgctgccgtcggcgaccgggtacactgccggcgacgtccactcggcacgcgagatgttccatcccttctacctctgacttcttgcgcacgcggcctctagtagatagtaattggacacttcatacttggattggatctctagatagcctagaaggtgagcgggcgtggaaggagaaatccgggaagcgatgagctttagcgccgcaagagtctcggagcatggcggcgagttcgaggaggcaagggggatgccggcagaggtgagctgggagatgctcgacaagtcgcggttttttgtactcggcgccgcgctcttctctggcgtctccgcggcgctatatccggccgtcgtcctcaagacgcacctccaggttgctgcccccgcacaggccgcggcctcggcggcagcggcggcgattctccggcgcgacggtccccgagggttctaccgtggcttcggtgcgtccctcgcgggcacggtgcccgcgcgcgctctctatatggcggcgctcgaggccaccaagagcgtcgtgggctccgccgccctccgcctcggcgtcgcggaaccggccgcctcggctgccgcctcggccgcgggcggcgtctccgctgccgtagccgcgcaggtcgtctggaccccggtggacgtcgtcagccagcgtctcatgcttcagacggcgcccctcgctgccgcccgctaccgcggcggtaccgacgcgttccggaagatcctactcgcggacggcgtgcgcggcctgtaccgcggcttcggcatctcggtgctgacctacgcgccctccagtgccgcgtggtgggcctcctacgtgaccgcgcagcggctcctctggcgcgccgtcggccccgcggcgcacgacagccgcggcgccgcgatagccctgcagggtgcgagcgcggccgcggcgggaagcgcggcggcgctggtgacgatgccgctggacaccgtgaagacgcggctgcaggttatggacgctggggcgcaggcgccgacgctcgcggccgcggcgcgcgcgctagttcgggagggaggttggtctgcttgctaccgcgggctcgggccgcggtgggcgtccatgtcgctgtcttcggccaccatggtcaccgtctacgagttcttgaagcggctctcggccaaggaaggctccctctaagctctggatcaaagtgtatccatggatgatccttgtaagcatccatgtccaaatgcgaatatcctgcactgatctcttgatgggatgttaggaagcaagatttctgctgggtttgtctgttgatgacgatgatgatgaattttgtaaaataaagatttgtgtatatacttcgaggaatattgttgtgggtctcattcctccatggtgcgaatgttggcaactgtggccactagaactgctggtgggcatttacgctttcgcgtgtaacaaagatcagaagatatttcgagggaaatgttctgttgcggaccaagagaatggtgaagtcgtgttcaaaaggattgggtgcctgtgtcagggcaggatttgataattttgttttttaaaaaaatactgaaatctcttaaacacttcctctgactttaattatatgattagcgcgcattttaaaattcgattttttattatttttaactaataactagtttaatagtatgaaaatgttgggtttcaaaagtggctagattcttttgtatttagcactgtttttttaattattaaacttctggaactataaactttatattatattatacgagaaattagcaattaaattgtattttaaaaaccgcactaaatcaaattgcgcttatctgtatcacgaagatcgaacgcttggaagttgatctgggactgggaacatacaataatttgtgcctagtctactcggtgtgcatcacaaagcaaaactgcagaagactattgtgcttgtgcctgcacacgatgcactcgtactcgcaggcatgttcacagtggctttaaaccaggaccgttgtatctataaattttatagagataaaatattagaagtggtttcagaataaacagtagatttgtgaaaaatcaccatcataggaaatccgtatgatatgtcacatctcgattaatttaagaggtttagacctctagtacgtgggtgcaataccactaaacacacaggtgtgtactctatacccaagaaaattccaggtaaatagtgcgtcacccagagctcgaacgagcgcttccggccagtggcctttggcactgcgccgtgagcccctttgctctcagatcaagattaatactactaataccatcagatagcaacatctaacaacaaaggtagggtggcccagtacgcaaggaccttttttccctaccttgtggggccatgctgaggtggatacatttagttggcatatctagccattatgtctcaagtcactctggattaggtttggtcctggtggttgccgatatgactggactggcaatggcgatccagcagcggttggtacccctagctaaccagttacttcctcctgccacaatgcctgccttgtgcaaacaatgtgtggcgccgttgcttttctgcttcgtgagtttttcatcagttgaaacggcgggctggaaaaaaaagctagagttcgaccagcacgttcgggttcgcggcgggtcagctcgggtcagagcaactcggtgcttataacgagtttgggtcgagcatatttttctgactcgagaaaaaagcgagataatttagcttagctcgctgtggctcacgagctgactcgtgactcgacactataataatttgttacataaaatcataattagcatctagtgtcagtactaaatattagtttatatttttcagattactgtataaaattaacatattttctatattacattagtaatatatttattttactaatttaaaatatgttacttaaattatttttaagattttatattatattttagagagcgagttcacgtttatggtcaggatcattggctcaacgaaccggctcacgagccgacaagtctaaccaacttttcagtctcgtcatagaaccaagccaaacccgactgaactactttatcgagccacagtgagtcgagccggctcatttccacccctatccaggagtatacttatcatgcctctgctatttcaatattcaatgtcaggagatggcaagtatttggaaaattatcagcttctgattggcacggtcatgttcttggaaacatcgcttcttgtcccatgagggtgagagctcctttgtcatgctcctttctataaaaagttcacgtttcatagacttcaaaatgttaaataaaaaaatcacggccacttgtcacttgtgaatattaagcttgtatgaaaatgaacgatgtggttgatagtagcttcattgagaatccaaagaccggtgctctcgttggttccaataagctgccgaccgtgaatgcaacaacaacatgtatttatatgatttctctgctactataaaacaccagtttcgatggtcattctgcgtcacgcgcttcgcacgtggatttatttttctccctctagcagtgagccgtttcccatagatagaccgcgaaaaccactcaagccactattagtttgtcg

SEQ ID NO: 11768 - DNA, 1850 bp, Zea mays
agcaaccaaagcacacccctcctccttgctctgccgtgctcggagttgggagttggagcaccaccaccaccactcttcccctctcctctccctcctcgctcgtcctgttggaagcagcacacacacgagagagaaagagagacacaaggagatggcgctgctgttgctcctgctggccgtgctcggcgtggtgctggcgagcagcctgctgctgcggtggaacgagctgcggtacagccgccgccggggcctgccgccgggcacaatggggtggccgctcttcggcgagaccaccgagttcctcaagcaggggcctagcttcatgaagcagaggaggctcaggtacgggagcctgttccggacgcacatcctgggctgccccacggtggtgtgcatggagccggagctgaaccggcgggcgctggccagcgagggcgccggcttcgtcccgggctacccgcagtccatgctcgacatcctggggcccaacaacatcgccgccgtgcacggcccgctccaccgcgccatgcggggcgccatgctcgcgctcacgcggccacacatgatccgcgccgcgctcctccccaagatcgacgccttcatgcgcgcccacctccacggctgggccggacgccgcgtcgacatccaggagatgaccaaggagatggctttgctctcggctctcaggcagatcgctggcatctctgcgggcccacactccgacgccctaaaggcagagctgtacacccttgtacttggcaccttctccctgccaatcaacgtcccaggaaccaactacagcaaagggctccaggcaaggaagaagctcgtggcaatgctgcggcagatgatcgctgaccggaggtcctctggctgcgcccgagacgacatgctggacgcgctgctcagcggcaacgagggtaccagggcgaagctcagcgacgaccagatcatcgaccttctcatcaccctcatatactctgggtacgagactgtgtcgaccacctcgatgatggcggtgaagtacctgtcggacaaccccaaagctctcggacagatcaggaaagagcaccttgacatcaggaaggctaagtcaccggaggatccccttgactggaacgactacaagtccatgaccttcaccaaagctgtcatttatgagactctaaggctagctacagtagtcaacgggctgctgaggaaaactacccatgacgtagaaatgaatgggtatgttattccaaaaggctggagaatttatgtatacacaagggagataaactacgacccgttcctgtacccggaacccatggttttcaacccatggagatggatggagacgaacctggaatcacatccgcacttcatgctgttcggaggaggtgcccgcatgtgcccagggaaggaagtaggaacagttgaaatcgcaacgttccttcactatttcgtgacgcgttacagatgggaggaggagggaaacaacacaatatcgaagttccccagagtggcggctcccaatgggctacatatccgagttcaagattactgaacttcgtgaggcgttttgtgaagtttaggtagggattcagacagatagaaataacccatgcgatgctgatgctgctggcctcttcgaaaggactagaacagccattagtgcctgtaaaatgtgtccatgccgatagtaatgttattatagggaggatataggtatcataggtttattagaaatttgatgtagaaagccaacagatgctcctgtattcttttgctccatcaaaacagaggtatcatttggcttctatgcttttgaatcgaacatggtacagaacccaaaaaaaaaaaaaaaa

SEQ ID NO: 11769 - DNA, 1641 bp, Zea mays
cacgcgcaccagcccaccgcccagcactccagccgccagaacagagtctacggcgccgccgtcgcacgacaggagagggagagggagagagacgcgggctttgacttgccgccggtgcgtccgtgcgtgcctggtgggaggagtgggagacgccggtacagtacaggagccatggcgccgagctgctacgacgcggcagcgtccatgctcctctgcgccgaggagcacagcagcatcctgtggtacgacgaggaggaggaggagctggaggcggtcgggagaaggagaggccagtcgccgggctacggggacgacttcggcgcggacttgttcccgccgcagtcggaggaatgcgtggccggtctggtggagcgggaacgggaccacatgccggggccgtgctacggcgacaggctgcgcggcggcggcggctgtctctgcgtccgccgggaggccgtcgactggatttggaaggcttacacgcaccacaggttccgccctctcactgcctacttggcagtgaactacctcgatcgcttcctctcgctgtctgaggtgccggacggcaaggactggatgacgcagctcctcgcggtggcgtgcgtttctctggccgccaagatggaggaaaccgccgtcccgcagtgcctggaccttcaggaggtcggagacgcgcggtacgtgttcgaggcgaagacggtccagaggatggagctcctggttctaacaaccctcaactggaggatgcatgccgtgacgccgttctcctacgtggattacttcctgaacaagctcagcaacggcggcagcacggcgccgaggagctgctggctcttgcagtccgcggagcttatcttgcgtgcggccagaggaaccggctgcgtcgggttcaggccgtccgagatcgccgccgcggttgcagccgccgtggccggagacgtggacgacgcggacggcgtcgagaacgcctgctgcgctcacgtagataaggagcgggtgttgcggtgccaggaagcgatcgggtccatggcgtcctcggcggccattgacggcgacgctaccgtgccaccgaaatctgcgagacgcaggagctcccccgtgcccgtgcccgtgcccgtgccgcagagccctgtgggggtgctggacgcggccgcctgcctcagctacaggagcgaagaggcagcgactgcgactgcgacttctgctgcctcacatgggccccctggctcttcaagctcgtcctcgacctccccggtgaccagcaaaaggaggaaactcgccagccgatgtgatggatcgtgcagtgaccggtcaaagcgcgcgcccgcccaatggaccaaagagtgaattgactagggcgtttgcttgctttctgatcaaagagtgcatcgagaggcggcagaatggaggaaaggggattttggcatgacgagggcaaaggagttgatgaataaagacgcgacgaggtggacagtacctaaattgctgatcttttctttgcaaggggagtaggggggaccttgctgggggtgggtagtagacagcccagcacaaaacctggttggtgtgccacgaccacaatggccgcgccagccatggctttgtaggaaacacaagggcgctagaggagatccgatggga

SEQ ID NO: 11770 - DNA, 2201 bp, Zea mays
  misc_feature (111)..(133): n is a, c, g, or t
  misc_feature (786)..(808): n is a, c, g, or t
  misc_feature (818)..(822): n is a, c, g, or t
  misc_feature (1090)..(1115): n is a, c, g, or t
  misc_feature (1223)..(1227): n is a, c, g, or t
  misc_feature (1250)..(1254): n is a, c, g, or t
  misc_feature (1490)..(1535): n is a, c, g, or t
gcacgagggacgacttcggcgcggacttgttcccgccgcagtcggaggaatgcgtggccggtctggtggagcgggaacgggaccacatgccggggccgtgctacggcgacnnnnnnnnnnnnnnnnnnnnnnntctctgcgtccgccgggaggccgtcgactggatttggaaggcttacacgcaccacaggttccgccctctcactgcctacttggcagtgaactacctcgatcgcttcctctcgctgtctgaggtgccggactgcaaggactggatgacgcagctcctcgcggtggcgtgcgtttctctggccgccaagatggaggaaaccgccgtcccgcagtgcctggaccttcaggaggtcggagacgcgcggtacgtgttcgaggcgaagacggtccagaggatggagctcctggttctaacaaccctcaactggaggatgcatgccgtgacgccgttctcctacgtggattacttcctgaacaagctcaacaacggcggcagcacggcgccgaggagctgctggctcttgcagtccgcggagcttatcttgcgtgcggccagaggaaccggctgcgtcgggttcaggccgtccgagatcgccgccgcggttgcagccgccgtggccggagacgtggacgacgcggacggcgtcgagaacgcctgctgcgctcacgtagataaggagcgggtgttgcggtgccaggaagcgatcgggtccatggcgtcctcggcggccattgacgacgctaccgtgccaccgaaatctgcgagacgcaggnnnnnnnnnnnnnnnnnnnnnnngagccctgtnnnnntgctggacgcggctccctgcctcagctacaggagcgaagaggcagcgactgcgactgcgactgcgacttctgctgcctcacatggggcccctggctcttcaagctcgtcctcgacctccccggtgaccagcaaaaggaggaaactcgccagccgatgtgatggatcgtgcagtgaccggtcaaagcgcgcgcccgcccaatggaccaaagagtgaattgactagggcgtctgcttgctttctgatcaaagagtgcattgagaggcggnnnnnnnnnnnnnnnnnnnnnnnnnnggcatgacgagggcaaaggagttgatgaataaagacgcgacgaggtggacaacacctaaattgccgatcttttctttgcaaggggagtaggggacctgcttgggcctnnnnnagggtagtagacagcccagcacnnnnncctggttggtgtgccacgaccacaatgggcgcgccagccatggctttgtaggaaacacaagggcgctagaggagatccgatgggatgactcagaataaagatagtggagggaccagaccgtatgcagtatgtgcaacaactaggcactggcatgcttatgctcaagtaatctgataacttgaatgttgtgtatccgacaaactgcttctgtgaagagagaaatgcaggtagacgannnnnnnnnnnnnnnnnnnnnnnnnnnnnnnnnnnnnnnnnnnnnngaattcggcacgagctcgtgccgaattcggcacgaggtaacttctacgcctacgagacgctgaagcggctctaccgtcgcgcgaccgggcggcgtcccggcgcggacgtgggccccgtggcgacgctgctcatcgggtccgcggcgggcgccatcgccagctcggccacgttcccgctagaggtggcccgcaagcagatgcaggtgggcgctgtgggcgggaggcaggtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtgcaagaagatcctcgtcgacaaggaggatgaggaggaggaggacgaacccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtttgtctcagatgaaaaaaactccatttttttgagtccaagttaatcaatgttccatttgcctcaaaaaaaaaaaaaaagaaaaaaaaaactcgagggggggcccggtaccc

SEQ ID NO: 11771 - DNA, 3019 bp, Zea mays
tctctcagcaatattatatttggcacctacgctcaagtacatagacagtgtgcacggctcggtgcccctggaaagcccgcccgacacgagggctgccaaatcgacagctccgcgcccttggaaatcctagtcacttgttcacaattgaccaatctacccttgaagcacacggtggatggtactgccacatttggcttataggggcatagaggacaatgaatgcaactggagcgggaaggagagctttaatttgtaagtactcggtgaacacggcacctgatgatgatgatgatggacagcgaggaattgttataaaaggcgcccgtccctcccatggctcaagaacaagggaatcgaagccattccctcttcaagaggggatcatcagattgggcttattattccttattactccaggtaattcttagtttgttgcccttccaaacctttacatctcatataagaatgattattacatgcaagattatgttgacatgcgtcgtcatggtattttttttaggcaaggatcggagttgctctgaattgactgaaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccagcggggcgcgacccgcgggagcccgatcccaaggtcgtccgggcggccgacaactgcgacatcgcgcgccagcttggcgccgccgttcccgggcagcaggccgcctgggaggcggaggaagaggcagcgaagaggaggaagcagaagggcggcggcagcaagaagcagcagcagctgggcgatctgagcctgaggaaggtcagggtcaagatcgccaacccgcacctgcggcgcctggttagcggcgccatcgccggcgccgtgtccaggacgtttgtggcgccgctggagacgatccggacgcacttgatggtcggcagcatcggcgtcgactccatggccggggtgttccagtggatcatgcagaacgaagggtggaccggcctgttccgcggcaacgccgtcaacgtcctgcgcgtcgctccgagcaaggctatcgaggtacaacccacccatgttctcagaatgttctagaagccatggtggtcgtgctgtgcatcgtcagtgagtactatgccttcctctcatgttttgtttacatggcggtggtggtgcacagcatttcacctatgacacggccaagaagttcctaacccccaagggcgacgagccgcccaagatcccgatccccactccgctggttgccggagctctagccggattcgcctcaaccttgtgcacctaccccatggagctgatcaagaccagggtcaccatcgaggtgagcgacaacaaacacaacagttcgcgaagtttttcaacggtctcactactgacaacacatacatgcatgcacgcgtaccccatggagctgatcaagaccagggtcaccatcgagaaggacgtatacgacaacgtcgcgcacgcgttcgtgaagatcctacgcgacgagggcccgtcggagctgtaccgtgggctgacacccagcctgatcggcgtggtgccgtacgcggcctgtaacttctacgcctacgagacgctgaagcggctctaccgtcgcgcgaccgggcggcgtcccggcgcggacgtgggccccgtggcgacgctgctcatcgggtccgcggcgggcgccatcgccagctcggccacgttcccgctagaggtggcccgcaagcagatgcaggtgggcgctgtgggcgggaggcaggtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtgcaagaagatcctcgtcgacaaggaggaggatgaggaggaggaggacgaagccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtttgtctcagatgaaaaaaaatacaatattttgagtccaagttaatcaatgttccatttgcctatccggagctcaatttgttaggttgcatgttccatgtaattactatatttgcctatttcaattttcaagctcttttcgttgtgtttaaaaaaaaaaaaaaaaaaaacgtacgggggccccccccccttttatctgtttttggtataataagcatgtctgtgttcggtcctatactcctatttgggacagctagcgggtggggaccaggtatggattcggatcgaatacgaatgaaaacgaatccgaatgtcactatttaccatattttaattcgaatacaaatacagatactatcggatacgaatacaaaacgaatagttcgaattcggattcatattcggatacttacttgatttggaacatagcatcatagcatatatgaatttattttatcgatggatttatagttgataaaaatcatattacaagcaaattataaacaatagtacatatacattatttaattaaaacttagttgaatatcatattttaaataaattatttatacctagtatatttatattttagtctctaaatataatcttttcgtatattaagtaaatttgtattttggactctaaaaactcgaataatctaatgtattcaaaattatactttttaaatattaattaaaatgtatcattgtatatcactagtaatgtaagattaacacaatcatttatttatgatatgaatattttttaacattttaaatggtgtatatcagttttagtacattttaaag

SEQ ID NO: 11772 - DNA, 1816 bp, Zea mays
ccccgcgtccgccccgcccccgcccacccgccgggaagggaatcgaagccattccctcttcaagaggggatcatcagattgggcttattattccttattactccaggcaaggatcggagttgctctgaattgactgaaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccagcggggcgcgacccgcgggagcccgatcccaaggtcgtccgggcggccgacaactgcgacatcgcgcgccagcttggcgccgccgttcccgggcagcaggccgcctgggaggcggaggaagaggcagcgaagaggaggaagcagaagggcggcggcagcaagaagcagcagcagctgggcgatctgagcctgaggaaggtcagggtcaagatcgccaacccgcacctgcggcgcctggttagcggcgccatcgccggcgccgtgtccaggacgtttgtggcgccgctggagacgatccggacgcacttgatggtcggcagcatcggcgtcgactccatggccggggtgttccagtggatcatgcagaacgaagggtggaccggcctgttccgcggcaacgccgtcaacgtcctgcgcgtcgctccgagcaaggctatcgagcatttcacctatgacacggccaagaagttcctaacccccaagggcgacgagccgcccaagatcccgatccccactccgctggttgccggagctctagccggattcgcctcaaccttgtgcacctaccccatggagctgatcaagaccagggtcaccatcgagaaggacgtatacgacaacgtcgcgcacgcgttcgtgaagatcctacgcgacgagggcccgtcggagctgtaccgtgggctgacacccagcctgatcggcgtggtgccgtacgcggcctgtaacttctacgcctacgagacgctgaagcggctctaccgtcgcgcgaccgggcggcgtcccggcgcggacgtgggccccgtggcgacgctgctcatcgggtccgcggcgggcgccatcgccagctcggccacgttcccgctagaggtggcccgcaagcagatgcaggtgggcgctgtgggcgggaggcaggtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtgcaagaagatcctcgtcgacaaggaggaggatgaggaggaggaggacgaagccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtttgtctcagatgaaaaaaaatacaatattttgagtccaagttaatcaatgttccatttgcctatccggagctcaatttgttaggttgcatgttccatgtaattactatatttgcctatttcaattttcaagctcttttcgttgtgtttagtaaactgtggtgtgaccacttacggtcacaataaccatttttatctgtttttggtataataagcatgtctgtgttcggtccacgagggggggccccccaccca

SEQ ID NO: 11773 - DNA, 2055 bp, Zea mays
cgacaagaaagaagagtactatctcagctactggattgggaaggatagcttggtggacgatcaagtgtcggcatctcaaataatcaatacaatgtggaattcattgaaaggacggccagttctgggccgtatataccaagggaaggagccaccacaatttgttgctcttttccagcccatggttatcttgaagggtggaatcggatctggatacaagaagctcatagaagaaaaaggtgctatgggtgagacttatactactgaaggcatagctctaattcgagtatctgagacatctatctacaacaacaagactcttcaagtagatgcggtagcaacgtctttaagctcaacggagtctttcgtactgcaatctggaaatgctatgtttacatggtttggcaattctagcacatatgagcaacagcagtgggcagcaaaagttgctgaatttttgaagcctggcgttgcagtgaagcactgcaaggaggggacagagagttctgctttctggtttgctcttggagggaaacagagttatacaaataaaaacactcctcaggatattattactagagagcctcacttgtatgcattctcattcaagaacgggagactggaggttactgagatcttcaacttttctcaagatgatttgttaactgaagacatgatggtacttgacacacatggtgaagttttcatttggattggtcagtatgtggaatcaaaagagaaacagaaggcatttgacattggccagaaatacgtggagcatgcaaattctattgaagatctttctccacacgtaccactatataaagtcatggaagggaatgagccatgcttcttcaagacgtacttttcttgggataacacaaaatctttggttcatggaaattccttccagaagaaactctcgctgctttttggattgcgttctgagggtgcacctaggagctctggtaatggtgggccaactcagagggcatctgcattagcagctctatcatccgcattcaatccatcatctcaacaaaggctgtctaatgagaggcctaaaagcacaggcgatggacccacgcaacgtgcctcagcactggctgccttatctaatgcattcaacccatccttaaaacccaaaacatcacctccatctcgctcaggtcgaggttctcaaagagcagctgctgtagctgctctatcctctgtgctgactgctgagcaatctggatcttcagaatttctacgatccaaagctagcaacacagcatataagactgatgtcgaccggattgtcataactccagctggcccatcaggcccatcttctcctcagtctgaagctggggagtccaatgtgtttcaccaggaaaaagatgctgcagcagatggggcaccgcctgacactgatggagcagtggctgaggccggagaggaagaaacaacggaaaatgttggtgaagcgacatttagctatgaccgcttgatatccaaatccaccgatccagttcgtgggatagattacaaacgcagagaggcatacttatcagatagtgaattccaaactgtttttggcatgaccaaggatgcattctaccgacagccaaattggaagcaagaactacagaagcgaaaagcagatcttttctaaagagaacaagccttgttaccagtggtctgctacagtatgcaatcctcttgtcgtgaatggtcggtcccatgagagttggtgtattaatatattgttggtcgtttctgaggacggtctactggtggctttgcacggttgtttcttttttggcaaccaattttataggtcaattcttttatttgtatatggcctgggttgtgctgcttgcgaggtcctaagatgcttctttgttcttctttgtgaatgtccatatgtgtatatcgttttcttctcgccagtttgttacgtatgggcatatcctggtaggttgtcaattgtattgtcattcagatgtattgcacacgaaatacttgtgctgtctgtttgttgttgatggttggcaaaaaaaaaaaaaaaaaaaa

SEQ ID NO: 11774 - DNA, 2463 bp, Zea mays
ctcgagccgtgaaatatatgtatgggttggacgggtaacgcaaatggaggatagaaaatctgccactaaagcagttgatgaattcctcattaatcaaaagcgtccaaagacaacgagggtaactcaagtgattcaaggttatgagagtcatgctttcaagtccaagtttgaatcgtggccagtgggtaatgctgctgggaaccctggcacagaggaagggcggggaaaagttgccgctttattgaagcaacaacgcgttgatcccaagggagctgcaaaaagcaccactccagtaaatgaggaagttcctcctttgcttgatggcggtgggaagcttgaggtatggtgcgttgatgggaacactaagactgccctgccaaaagaggacatcggaaagttttacagtggagactgttatatcattctcttccccccacgcgtgggcgacaagaaagaagagtactatctcagctactggattgggaaggatagcttggtggacgatcaagtgtcggcatctcaaataatcaatacaatgtggaattcattgaaaggacggccagttctgggccgtatataccaagggaaggagccaccacaatttgttgctcttttccagcccatggttatcttgaagggtggaatcggatctggatacaagaagctcatagaagaaaaaggtgctatgggtgagacttatactactgaaggcatagctctaattcgagtatctgagacatctatctacaacaacaagactcttcaagtagatgcggtagcaacgtctttaagctcaacggagtctttcgtactgcaatctggaaatgctatgtttacatggtttggcaattctagcacatatgagcaacagcagtgggcagcaaaagttgctgaatttttgaagcctggcgttgcagtgaagcactgcaaggaggggacagagagttctgctttctggtttgctcttggagggaaacagagttacacaaataaaaacactcctcaggatattattactagagagcctcacttgtatgcattctcattcaagaacgggagactggaggttactgagatcttcaacttttctcaagatgatttgttaactgaagacatgatggtacttgacacacatggtgaagttttcatttggattggtcagtatgtggaatcaaaagagaaacagaaggcatttgacattggccagaaatacgtggagcatgcaaattctattgaagatctttctccacatgtaccactatataaagtcatggaagggaatgagccatgcttcttcaagacgtacttttcttgggataacacaaaatctttggttcatggaaattccttccagaagaaactctcgctgctttttggattgcgttctgagggtgcacctaggagctctggtaatggtgggccaactcagagggcatctgcattagcagctctatcatccgcattcaatccatcatctcaacaaaggctgtctaatgagaggcccaaaaccacaggcgatggacccacgcaaccgtgcctcagcactggctgccttatctaatgcattcaacccatccttaaaacccaaaacatcacctccatctcgctcaggtcctctgtgctgactgctgagcaatctggatcttcagaatttctagcacccgacccttgcctcgcacctcctaagactgatgtcgaccggattgtcataactccagctggcccatcaggcccatcttctcctcagtctgaagctggggagtccaatgtgtttcaccaggaaaaagatgctgcagcagatggggcaccgcctgacactgatggagcagtggctgaggccggagaggaagaaacaacggaaaatgttggtgaagcgacatttagctatgaccgcttgatatccaaatccaccgatccagttcgtgggatagattacaaacgcagagaggcatacttatcagatagtgaattccaaactgtttttggcatgaccaaggatgcattctaccgacagccaaattggaagcaagaactacagaagcgaaaagcagatcttttctaaagagaacaagccttgttaccagtggtctgctacagtatgcaatcctcttgtcgtgaatggtcggtcccatgagagttggtgtattaatatattgttggtcgtttctgaggacggtctactggtggctttgcacggttgtttcttttttggcaaccaattttataggtcaattcttttatttgtatatggcctgggttgtgctgcttgcgaggtcctaagatgcttctttgttcttctttgtgaatgtccatatgtgtatatcattttctactcgccagtttgttacgtacgggcatttcctggcaggttcgtcattgcattgtcatctatatgtcttgcacacgaaatatttgtgctgtccgttttgctgttaatggttggcagttgtttgggatttgaac

SEQ ID NO: 11775 - DNA, 2727 bp, Zea mays
cccacgcgtccgaaccgtgagtgatgatgatgttgtacttgaaactacagcaccaaggctgtacagcatcaatgatggccaattgaagctggaagaaacagctcttacaaaagccgtgcttgaaaataccagatgtttcttacttgactgtggggctgaaatatatgtatgggttggccgggtaacacaaatggaggatagaaaatctgccactaaagcagttgaggaatttcttattaatcaaaagcgtccaaagacaacgagggtaactcaagtgattcaaggttatgagagtcatgctttcaagtccaagtttgaatcatggccagtgggtaatgctactgggagccctggcgcagaggaagggcggggaaaagttgcagctttattgaagcaacaaggtgttgatctcaaaggagctgcaaaaagcaccaccccagtaaatgaggaagttcctcctttgcttgaaggcggtggaaagcttgaggtatggtgtgttgatggcaacgctaagactgctctgccaaaagaggatattggaaagttttacagtggagactgttatatcattctctatacgtatcattcgggcgacaagaaagaagaatactatctcagctactggattgggaaggatagcttggtggacgatcaagtgtcggcatctcaaataactaatacagtgtggaattcattgaaaggacggccagttctgggtcgtatataccaagggaaggagccaccacagtttgttgcacttttccagcccatgattatcttgaagggtggaattggatctggatacaagaagctcatagaagaaaagggtgcgacgggtgagacttatactactgaaggcatagctctaattcgagtatctgggacatctatccacaacaacaagactcttcaagtcgatacggtggcaacatctttaagctcaatggagtgtttcatactgcaatctggaaatgctatgtttacatggtttggcaattctagcacatatgagcaacagcagtgggcagcaaaagttgctgaatttttgaagcctggcgttgcagtgaagcactgcaaggaggggacagagagttcaggtttctggtttgctcttggaggaaaacagagttatacaaataaaaatgctcctcaggatattattactagagagcctcacttgtatgcattctcattcaagaacgggagactggaggtaactgagatcttcaacttttcccaagatgatttgttaactgaagacatgatgatacttgacacacatggtgaggttttcatttggattggtcagtgcgtggaatcaaaagagaaacagaaggcatttgatattggccagaaatacgtggagcatgcaaattctattgatgatctttctccatatgcaccactatataaagttatggaagggaatgagccatgcttcttcaagacatatttctcttgggataacacaaaatctttggttcatggaaattccttccagaagaaactctcactgctttttggattgcgttctgagggtgcatctaggagctctggtaatggtggaccaactcaaagggcatctgcattagcagctctatcatctgcattcaatccatcgtctcaacaaaggctctctaatgagaggcctaaaagcacaggcgatggacccactcaacgcgcctcagcactggctgccctatctaatgcattcaattcatccttaaaacccaaaacaccacctccatctcgctcaggtcaaggttcccaaagagcagctgccgtagctgcactatcctctgtgctgactgctgagcaatctggatcttcagaaaatctacgagccaaagctagcagcacaggagataagactgatgtcgataggcctgtcataactccagctggaccatctggtccatcttctcctcagtctgaagctggggagtccaatgtgtttcgccaggaaaaagatgctgcagtagatggggcaccatctgacactgatggagcagtggctgagacccgagaggaagaaacgacagagaatgttggtgaagcgacatttagctatgaccgcttgatatctaaatctaccgatccagtccgtgggatagattacaaacgcagagaggcatacttatctgatagtgagttccaaagtgtttttggcatgaccaaggatgcattctaccgacagccaaattggaagcaagaactacagaagcgaaaagcagatctcttctaaagagaacacgccttgtctcaagcgcctgctagaaaatgcgaccctctcgtcgtgaatggtcggtcccatgagagtaagtctcaatatattgctggttatttctgaggacgggctactggtggctttgctcggttgttttttttttgcaaccaattttataggccgattcttttatttgtacatggcctgggttgtgctgcttgcgaggtcctaagatgctcatagctttgtgttgtgactgtccatatgtgtatatcgttttttttcatcagtttgttacgtatgggcatatcctggtaggttgtcaattgtattgtcattcagatgtattgcacacgaaatacttgtgctgtctgtttgttgttgatggttggcagttgttttgtttgggatttgaaacacttgattggatttctcaaaaaaaaaaaaaaaaaaaaaaaaaacgccaaaaaaaaaaaaactcgaggaagggccgcggtacc

SEQ ID NO: 11776 - DNA, 3826 bp, Zea mays
  misc_feature (591)..(591): n is a, c, g, or t
gatccccctgctgtagctgctctatcctctgtgctgactgctgagcaatctggatcttcagaatttctacgatccaaagctagcaacacagcatataagactggtagagctgcaccttccttttcaatttatcattcattaaagaatagcttggcaaatgtagggggcgaaggttcttactttctttggattctcaaatatgtattcttttccagtttatcattatttaggcattttgggttctctgatctgtattcctcgtttctctgaaatgtttttgtattgtctttgcaaattttagccctagaagtctatagtcatgtttatttgattttgttggtacacctttgccttttttatagttatgactaatgggatgcacatagatgaaggccactaccactttgctggcccatttatcgcttcaaagtttgacaccttggatcaatgcagatgtcgaccggattgtcataactccagctggcccatcaggcccatcttctcctcagtctgaagctggggagtccaatgtgtttcaccaggaaaaagatgctgcagcagatggggcaccgcctgacactgatggagcantggctgaggccggagaggaagaaacaacggaaaatgttggtgaagcgacatttagctatgaccgcttgatatccaaatccaccgatccagttcgtgggatagattacaaacgcagagaggtttgtgcctgcacccgtccccccagcatccttgaagtggtgaattttctctagtgagtagttatggagttttttttcttggttccttgtacccggaagtaaccacagcctttcgcctgcagctaaatcacttgcttctcttgtattgatgcatttggttccattggttctctttagacgactccttatcacatttgtccacacatatattcttttgttgctcgtttggccaagtatattcatgttgggagttaggcttacattgaaccttgctgggccaatcttgctgatccagttcgtgggattgattacaaacgcagagaggcatacttatcagatagtgaattccaaactgtttttggcatgaccaaggatgcattctaccgacagccaaattggaagcaagaactacagaagcgaaaagcagatcttttctaaagagaacaagccttgttaccagtggtctgctacagtatgcaatcctcttgtcgtgaatggtcggtcccatgagagttggtgtattaatatattgttggtcgtttctgaggacggtctactggtggctttgcacggttgtttcttttttggcaaccaattttataggtcaattcttttatttgtatatggcctgggttgtgctgcttgcgaggtcctaagatgcttctttgttcttctttgtgaatgtccatatgtgtatatcattttctactcgccagtttgttacgtacgggcatttcctggcaggttcgtcattgcattgtcatctatatgtcttgcacacgaaatatttgtgctgtccgttttgctgttaatggttggcagttgtttgggatttgaacacttggctgaattccatcattttcgtgtggctgttggcgcatgcttgtcatttctaaatagaaaattagatttgtctagtgtctggatcagcagttgtagaaagtggaattagaccagattatgctcattgttatctcatgttttttatcacaaacaaacacgatcattctactggtaagcggttatttcatgtaccgcctggagccctggacacggcattcctgcccaccggcagtccggcatcagctcgagcacgtgcaagtgcgaggagacggccgggccaaaggccggggcggcggcgcgggaaccaggcggaggcggcagtactcatagcagaaccatacgaaaaagaagaaaaatccttcggattgtaatagaattttggattggggtttaaagtcgggtctataatacactatagtttagtttcctctgtcccaatttataattcgtttcactttttaatcttaagtttaatcactcgtcttattcaaaaagttgtgagaaagatttcattgtggttttatttattatcaaatatactttacaacatagattaacttttttttttcatttttttatgaatttttttaaataagatgagtggttaaacttaaggttaaaaaagtcaacgaagtatattttaaaactgagggggtagtatttatagtagacagatataagaacattgtatccaaaaacgaggtggagtgagataaacatagctgtatcagttctccgacgaacaggcaaacagcagctgcaatccccaactggcatcagatcaagtccactgtcttcttccatgccagtgcaaggctgcaagccccccgcgcccagccaatcgattaacataaaagataaaaaccaaactaagcaagcaaattggctcaaagatttaccaacgtagaaatctccagaggatcacaacaacccgataagcgtgcgtgatcagcagctgctggtgcagaatatgatgaaggcacatctactctctaccagcaactgatcatcaggtgaggtgacctagaggccgaggcactgcattgctggtgacgcaggtggaaaatggctggcggcagagaaggccaacggtaacgtccgagatctcctgagttgtagtttcatatctgaaatccaagatgaatatgctgctccaaatctaattcttttgagttgagtttgttccaaacagtctctaaataagttggatcttaccctgagttaagagcatatccaacagctcttaattgatttagctatcaatatcttagattagtacctctctgacaatatttgagatgtaaacaaagactattctccaacagccttttaaagatcccctgaataagaagttaactcccgtcttgcatggtgcacgcaattgaaatggcgcatgctcagctgcacctatggatgacaatccaaatgtttctttgggctcaattttaattaaaaaacgaatagaaataaagtctgaccctaatccttgaactgcacccgcgcatgcaccacaccaacgccgtccacctcgcatcgggcgcatgcagcaactaaaacggcgcacatctctttcctaacatgcatgggaaatggaaaaaaaaaatagataggggcgaccatggttggcctcaaatctgtacgtggaggctttggtttaagagcgtccaataatttagagcacggatactgagtttttatacttttatactcttaaactattgttttgggaatagtaattagaagcagctggagttgctcccaataaaaagtctaatgcggactacataacaatgaacgtgacactttggtaccaaatttaattaattaactgttttttggcaaaagtgtaacgtgacagtatggttgttgataccgcgtcttcactaccaggtaagtgtcggatctcagcaattagcatgcgtgcgatcctggcaattagctggccgtcgtacggccgcgttaggcggaagacatgcacgtccgggaaattaggtgcatggctaattgtgttcttttttttgtcggtgcaaaaatgtcaaacgctgtcatatcatgcatgcatcgtcccgtgcacgcaattatacatctaggctttagtttggccgcaaattagcccagggaagatttccctccacgtagttgagaacccaagtcctgtcatttctcaggataataatctcaagaaatatcatttgaataagatatttagttatttaggacttgtcggggatcataattaggggtaccctcaagacgcctaattctcaggggta

SEQ ID NO: 11777 - DNA, 1573 bp, Zea mays
cccttgcaagtcttggtctggaccgtggacggcttccagaacccagactccctgcacgcgcctacataagaaaaaagatccgtggccccagcacccgcggccgagtcagagccccagtcccagagggagggggaaatggcgagcggggacggggacggcggggacgggaagaagcagagcagacggcagctgtgggcggcgtgcctcccgcggccggggtgcttcacggtgtccgccgccgacgagggcccgtcggctcacggcgccggccagggggagagcaagcccaagcccacgcatctggtcgtcacggtcaatgggatcgtcggaagtgcagaaaattggcgttttgcggcaaagcacttcatcaggaaacaccctgaagacgtggttgttcactgcagtgggtgcaactcagcagctcgaacctttgatggagttgatgtgatggggagaagattggcagacgaggtggcttctattgttgacagtagaccagagctttgcaagatttcctttgttgcgcattcattgggtggactaattgcaagatatgctattgcattattatatgagagcgagacacaaaaagattctcatgaaaagtttgagaaccatgctgttgactattctagtaaccagcacagcatagggaaaattgctggtttggagcctattaacttcatcacttttgcaacaccacacctcggtacaagatcacacaaacagataccacttcttcgtggttccaacaaattagaaaagatggcgtatcgtttgtcttggattgctgggagaagtggaaaacatctcttcctgaaagatacggaagatgagaaaccaccacttcttctacagatggttactgattatggtggtctccatttcatgtcagctctccgctctttcaagcggcgtgttgcttactccaatgtttgtaatgactttatcgttggctggaggacatcatcaattcgtcgtcaacacgagcttcctgagccccgaagttttataaacaacaatagatatccacacattgtatatgtggaagggccaaaaattgaggatgttgattttttggatgcgatgatttacgaggcaaaaacgactagtgaaatggaagaggtgatgctcaaaggtctgaatagagtttcatgggaaagggtagatgttagcttcaagaaaagtagacaaaggattttcgctcatagcactattcaggtcaagacctatttcttgaactccgatggagctgacgtgatcaaccacatgatcgaccattttgtttattaagatgggtgtactaagttggtaccaagttctctttgtcgatcgattctcggccaaagaggaacatgtgggaaatgttcttgttctgaagacaggattagagttatactgaaggagtagaacccactgtaaagtgtaaaggggtatcttgtctctacccttcttgctaattttgggccgtttagtttcttttcttcccttttcataattcagaatctcagttgttttgtacccatatactggaccagaatttgttctccaaatacaaagatatttgctgcgt

SEQ ID NO: 11778 - DNA, 1647 bp, Zea mays
tgggacctcgagcccgccgcgggctcttagtgctaaagctaccccttccggccacttccgcaattgcgaacctccgtcgcggcgcggccgaaccggcgaaggcgccctcctctcgttccctcccgaaaccccggcatgggaaacaagaagtcgaagcggagcaggagcaagaagaacaaaaccaacgccgaccaggccctggccctagactacgtccgcgcctgggtgctccccgtgccgccacccctgaagccctcggcggccgacgtcgacggcttcctgccggtccaggctacacgccggggcgatgtgctgtttgagctccactcccactcaaaccacagcgacgggttcctctccccttccgcactcgtcgagcgcgcccatcgcaacggggtgaaagttcttgccctaacagatcatgacaccatggctggcataccagaagctgtgtcagcagcctccaagtttggcatgagaataattcctggagttgaaatcagtgcgctatataatccaagggaagttgctggtgcgggtgagactgttcatatccttgcatactatggtatgtgtggtccgtcaaggtgtgatgagttggacggcatgctattgaacattagagatgggcgatacttacgtgcaaagaacatgctggaaaagctaactacactgaaggtgccaataaagtgggagcatgtgaataaaattgctggtgacggagtggcacctggccgattgcatatagctagggctatggttgaaatgggttatgtagagaatttaagacaagcattcaacaaatacctcggcgatgatggccctgcatatgccagaggaagtgaaccatttgctgagactgttgtgcagttaattagtcgcactgggggtttttctgcacttgctcatccttggtcactgaagaacccagatgcaataatcaggtctttaaaaggagctggtcttaatggtatggaggtctacagaagtgatggagaagttaatggatttagcgaactagctgagaagtatggacttctgaaacttggaggttcagatttccatggaagaggtggaaaagatgaatctgatgttggaacagttaagctcgctattacaactttgtgctgttttttgaagatggctaggtctatctggtcttctgctatgaaagacatcctgcttaagtttgcagaggaaccgtctgctgcaaatctaggaaacatgctcaagtttggacgtcttaccaaatttgctggtttttctccaataaacaatggtattcatgttgttgatttctgcttatcttcttggtcaagcaatgatgatatcgaagatgttgagcttgaagaggtaagattgaagcttgctcattatgcagaataaagataacctcaactacatggtcatcttgagcaatgttttcacacttgttcaaattacagtatatgctgttgcaatgttcacttcttttgcggcccagtataactaatgttgaaattagatatgctcaatctgacagctttgacattttattcaagaacatatatttctctactatgataactgaaatggcgtgcatagaatcagagcacatcagcatattaatataccgtttcttatcgtgaggaatcaaacaacaacccc

SEQ ID NO: 11779 - DNA, 3508 bp, Zea mays
  misc_feature (531)..(531): n is a, c, g, or t
ctcatccaacctcaagcttttactggagttcgcagtgctgctgcagcagcagcacacgcagcttcgtagcatcaggccagggcgtgggactcggaagagacgccaccatcggaggagctctctcctcgctgaacatcatttgagatggcagaggcagcactccttgctctctcgaagatggggtcctatttgggaggagaagcggctaccttcattgcaaccaaattttctaatttgatcgagctaccaaatactgtgaggcgtattcggagggaacttctgatgatgaacatctttatacgtaagacaggtgcatcctatctcagtgacgagctcctcaaggcttggatcacagaagtgagaatactggcctaccgtgtcgagaacataatggacaacttttcataccactctcttcaattcaagcaagaccctaaagggaaaaggttggcgaatggattaagctacggtctagtgtttagtgggattgctgctgatctagctcagatagagaaggaaatagagcatgtnttcgaagttgaagaatctctggttgaactcagtccatgagcttcttcatactcaagttagcagtgctgaacagcaattccctcaatacagtttgccccaaattctaaaagatgaaaacctggtggggttaaaggaagaaagagagcagttaaaggaatggttgattcccaatgcacctgtcaacatgacaaatataccagctctcaaggtggtaactttgtcgggtatgggtgggatgggaaagaccaccctgctcactagtgtgtatgataagctgaaagatatcttcgaaatccatgcttggctcactgtctcacagacatacagaagtgtcgatactttgctgaaggagctactaaagattgttagtgcctctgagcacacaactcttgttaacaatgactatcagaaggaagtgattgtaccagttgatattgatataagagacaagaaacagctgaaaccagatgtcatcgacaagatgggcatcttagacttgaagagtactttaaaagcagtcctgaaacataagagatatatagttgtgttagatgatgtatggaatcgttgtgttcacgatggaataagcgatgtgtttgaagattgtgggaaggaaagtcgcattgtcatcacaacaaggaaacaagatgtagctgcacttgccacaccaggttaccagctcaacctaaacccattagatatcaaagatgctctccagcttttctgtacaaaagcttttcccaacaaaaaccactttgattggacatcagtacttcttgaacatgctaaagatatgatgaagagatatgaaggtcttccattggaaaagtgcccactcgagcttcaagagcttgctactcatattgtaaggaaatgtgaggacttctcagtgtcaaagtgtccatctgagcttcaggatcttgcaacttataccgtaaacaaatttaagggattctcactatcagcatgcccatcagagcttcagaatcttgctactgatattgtaaaccattgtgaggatttacctctggtgaagtgtccatcagaacttcaggagattgctattgacattgtaaagaaatgtaggggtttgccgctggctattgtatcagtaggcagtaggttgtcttcaagaaagcaaatagtgccagtttggaggcagatgtgcaatgaacttccttgtgagctggaaaaagatgaccaggttcgaggaattctaaatcttagctactatgacttgccaagtgatcttcgaaactgcttcctgtactgcagcctgtttccggaagattaccacttctcaaaggacgatcttgtgcgactgtgggttgctgaaggatttgttgaaaagaaaggggacaacactcctgaggaggtagcagagggctatcttactgagctgatccaccgtaatatgctgcaacttgtggaaaatgatgagcttggcagggtgaacacatgcaaaatgcatgacattttaagagagttggcccttcacatctctaaagccgaaatgtttggtacagtaaatgattttggtgcaatggtgcagatggacacagatgttcgtcgcatatcttcatatggatggaagaagatgaaaaaaaataaatccaagttgaaatttccgcacctccgaaccctgatggcaagtgataccattgtggactatgtaccatcaatactatctgaatccaagtaccttactgtccttgagctccagaattctgatttccaggcactgcctacatctataggaaatctctttaatctgaaatacattggcctaagaaatacaagaataacgtcactgccagactccattaagaatctctccaatcttcaaactcttgatgtcaaatcaactagtataaaagctctgccacctggtatagtgaacctcactaagctaaggcaccttcttgctgacaaatttgctgataagaaccagtcagagtttcggtactttgtcggagtggacgctccagaagggctttcgaaccttgaagagttacagactcttgagactgtgcaagcaagcatggacttaccggaacaacttgataaccttttgcaactaaggagcctgtgggtagataacatcacttctgcccactgtgcagggctttttgctaccttatcaactatgccacttctttccagtttgcttctatctgcagctgatgaaaaggagacacttctcttgaaccatttcaatccaacttgcacgaagctccacaagctaattgtgagaggattgtggtctctaacaggttgtccgatacttcagaaccatggcaggtatctcaagtatcttgccctaagcagatgccattttgtaggagacccgctggtggttctagcatctactgtaccgaacatcacatatctgagacttaacaatatacctagtccacctactttggaccttctggaaggatccttcccacaactgaagacgctagttttgaagaacatgaatgatgtcagccttctgaaaattagtagcggtgcacttccagtcatagaatgtctatatatcacatcactgcccaaattgcagacagtccctcgaggcatcaaatccttgagctccttgaaaaagctctggcttctgggtctccacagtaacttcaaggctcgatgggacatggagggaatgcagaaggatctacagcatgttctggagatacgtacctaacagcagaagctttgtttttgtgtttgtcaaacgtgattgctctttctgtagtaaaagtgtcctagaatgcaactgtatccacttcaaaatccatcaagtttgcagttagacattagggattggtgcatttgtggatcatttgtcagatgattgtttccgaaataataattccgaaaacatggtttactatctttgccatcagtatgcaatctagacttgccaaagtcgatgttctttaatacttgttatatctaagtcgtcggttcatttaagaac

SEQ ID NO: 11780 - DNA, 1905 bp, Zea mays
cttttctactccaatctccacagtccacaccctccgggcgccggcctccactcctccattcttgtcccggaaccatgtcgatgcttctctcgcgaaggttctcctgcgccctcgcccgcgccccgtcgctcgtacggggccggccccttcctccctgcgccgcccgcaccacccctccggctcccagctctccgccccgccgcctcatgtcgtcctcctctgccgggtggcagcactcctcgcaccgtcccccgccgccgccgccgcctcctcctcatcccggtgctgacaaggaccagctgttcagggggctggaggcggcgctgggcaccgcgttcagctccgagccgctggcgccgccaccgcagcctatgatcctcgtcatcagcgggcccagcggtgtcggcaaggacgccgtcatcaagaggctgcaggaggagagggaagggatccatttcgttgtcaccgcgacaagcagggcgatgaggccaggtgaagttgaagggaaagactattactttgtcagtaaggaggaatttctgacgatgattgagagggaggagttgctcgagtatgctcttgtttatggggagtacaaggggatccccaaacagcagattcgtgactacatggctaaaggctgtgacattgttctgagagtggacattcaaggagcagcgacgttaagacagatacttggtgaatctgcggttttcatatttttagttgctgagagtgaagaggcacttgttaaaaggctaatccaccgtaaaacagaaacatcagatatgcttcttgtcagagttgcaacagccagggaggaggtgaaacacatgaagaatttcgactatgtggttgtaaacgctcaagggaaacttgaggaggctgttaaacaagtggaatctatcattgatgctgagaagtctaaaattcacaagcggcatgtcaatatctaagctaaggatcatgtgatttatgcctagtgtcttcatctctataaaggaaaattatctgtccaagtctactgaagcgtgatgaaatgactcaggtttcagtagccagaaagttcaatggattgctgagttacaagaatatggcatgttctgtttaagaaatttccctcaccacaaccggggcagcacaatctctgggatatatacacgactctcttgttatttgtctctttttttccctttgattttttagctctgcctggaggaatctggaaggctgtaccaaactagttctgggtgaatcttaagtgatgttctatccttctcaatttcgtactgaccagtgttgctgggcatgcacaagcaatcggtgcccccaaatagcaaaattgccagtttggctgcaaaatataaattgcattgtttttttccagtggcagaatagatgttactggaattcttcctcttgctcagtgtgcccttactgaagtccatatctgttctgagcttttgttcttgtgtgctggtgcttgtgatttgcaacgttaatatattaaaatactgtagaccaattttgaatgtagacaacgttagtttggaagatgtgattttggcactatacatgataaagatcaagtagtacctaaaaaagtagtacctaccttatccatatggtcactcaaaacattgtttttgtgttgcagactcactgttttcatagagtggagattgacatattgtattggatttgtggtcatataaggccatgtctagcaggttatccataatatggttaaaacattgtttttactgtagactgcactattcgtagagttgagattgaaataagagataagatgagagataggttgggtgagctacttgaggtagtctaaaaagaggtcaagttcgaaatgatgatcaggcgtggacccagaataaaataggagtg

SEQ ID NO: 11781 - DNA, 2486 bp, Zea mays
gcacgagaccattacctagaacatcctaatcgaaaagttccccctaacgcgtgcgctccttcgccgactgggcgaccgccgccgccggcctcgcccaggtctccgtccggccctacgacaggttccatcgggcccttagccggcgacaagcaccaccagagactgattaggagttcgaggagcaaatcaattcgtaccaaatataaccaagcttacatggctaagccatgtgattcatcacatcatggagttgtggacaatagctccaatggatcccaggctaggcgtgaggaagctgggaaacttggtccatcgtggtatttcagtagaagggaaatagaggaaaactctccatccaggagggatggcatcgatttgaagaaagagtctagcattcggaagttatattgcaagtttctacaagagttgggcatggcgcttaaaatgccccaagtgacgattgccacagcaatggtattctgtcatcgtttttaccttcgtcaatcccttgcaaaaaatgatagacgaataatcgcaactgtttgtatattcttggctggaaaagttgaagaaacacctaaacctttgaaggatgtcatcgtggtttcttacgggattattaataagaatgatcctaaggctagtcagagaatcaagcaacagaaggaaatctatgataaacaaaaagaacttattttacttggagagcgagttgtacttgtaacacttgggtttgaccttaatattaaccatgcctataagcccttggttgaagcaataaggagattcaatattgataaaagaagtccacttcctcaggttgcctggaattttgtaaatgatgggctgcgtacttcgctttgcctgcagtttgagcctcatcatattgcagctggtgctatctatttggctgctaaatttctcaaagtgaatctcccatctgatggtgataagatttggtggcaggattttgatgtcacgccacgacaacttgaagaggttagcagtcaattgctggagttgtatgagcaaaaccgtacaacgcaggcacaatcatcacagggaagtgaagcggaggggagctctgctggtgtgtgtaatcaacgttcaactgtaaagtctgaagcgaactccaaggaaccatctgctcatggtcatcttcaggcatccagaccgccaaatttgcagcactcgtcctcaacaggtgcttcaggtcaccatgacgatgggcagtcaaattcagacaagcatatttctggccacaaaatgcttcaaaatgacaattttaaccatggtggtagcagagaaaagaacaaaagtggaaccaaaactggtactgttatggacaaattgcacaatgacaaaaagttctcgcctggacatcattattccaaggccagccatgagtctcataatccagtggaagaacatcaaccacatggatcagatgataattccaatgaaacaagagatggtgttggtggcaatgaagctcctgttgtgtcaacatccagaatggatgcgatgaataaaattgacaaggataaggtaaaagcagctttggagaagcgaaggaaatcgaaaggtggttttgccacgaaggtaaatgtgattgatgatgatgatctacttgagagagagctagaacaaggtgttgagttggctgttgagtttgagaagattaatcaagataagaagcagaactcgtccgatggtagcatgcatccaccagaccttgaaaacgctgacgaattaatggagaatggccaccatgtcaagcagagtctaccaacgacagctgaagacatgggctgtccgatggacagtaaagaacgacatcctccagcacttcataagcaaaatgatgtttctgagcacaagtcacagcagcttgatgacacattgaaacaccaaaagagctgtgatcatcctcaacctgtaggaagccctgagcaggatggaaaagactacaagaggcctaagcttgacggataggtttatatatatgattttggatgggttttctggaagctgacaagcaatttggtgccggattcattgtatgatgacgtatacatgttgatgagcacgtgtcttcttcgctggtgcctgaagaagtgaagatgccgcgccacaaaattgctgtgctgcggagagcaccaagatgatgcgccccacaactgattgcagcttacagtttgaggaaagtcgggcagcaattattgttaggttccaacaaacattggaatataatatatatatgaacgaaacatgctgtcgcgcttctggtatcagctgcattcgtttcttgtatgtaatgttctggttaaagcgatggaaaggttttatcaaggtcgcaaatattaatgcagctttccatttctgggtttacatatttttcaaattaaacggtttacttttttatgtccgaaaaaaaaaaaaaaaaggaaaaaaaaaaaaaaggggggcccccccattaggggcct

SEQ ID NO: 11782 - DNA, 5465 bp, Zea mays
ctgcagataagcttccaagagttcaagaacaagttactagaacctggtttagttgatcgcattgttgtttcaaataaatcagtagcgaaggtctacatcaggagttcacctcatccaaagagccaaggccaagatagtgatatccatattactaccactgatgctccaggcaagcctgctcccagcagatgcaagtattacttcaatattggtagtgttgatttgtttgaagagaagttagaggaagcccaggaagctttgggaatagatccacatgattttgtcccagtaacttatgttgctgaagtaaattggttccaagaagttatgaggtttgccccaacagcattgattattggtctattatatttcacgggaaaaaggatgcagagtggtttcaatattggaggtggtgctggcaaaggaagaggaggtattttcaacatttggaaaagctacagtgatgaagatggacaagaactccaaaaataaggtttgttattacttttcttatgttactcaatgtttgacttggttctatatttgatggatgataaaaataatctggcccaacacccaaatgattttgtgcacaggctaattcttgacctctgatgactccaattgcttaattttgttgtagcttcatttgcccttttcttaagaaacaaagcatactacatgaaattcgaagatttgtcttttcatcaatgtctacttttctgctggtccaggtgttttttaaggatgtagccggttgtgacgaagcaaaacaagaaataatggagtttgtgcatttccttaaaaaccctaagaagtatgaagatttgggagctaaaatacccaaaggtgctctacttgtaggccctcctgggacagggaagactttgctcgccaaagctacagcaggagagtctggtgtgccatttttgtctatttctggttcagatttcatggaaatgtttgttggtgttggaccgtccagggtacggaacttgttccaagaagctaggcagtgtgctcctagtattgtattcattgacgaaatcgatgctattggtcgtgcaagaggacgtggaggtttttcaggttcaaatgatgaacgtgagtcgacctcggtccccctgcttgtagagatggatggatttggaacaacttctggtgttgttgttcttgctgggacaaatagacctgacatcctggataaggcattattaaggccaggaagatttgatcgccagatagcaattgacaaaccagatataaagggccgtgatcaaatattccgcatatatcttaaaaagcttaagttggacaacaaaccatcattttattctcaaaggctagctgccttgacacctgggttcgcaggagctgacattgccaatgtttgtaatgaagctgctttaattgctgcgagaagtgaggaaactcagattaccatgcagcattttgagtccgcaattgataggattatcggtggtttggagaagaaaaatagggtaagagaatatcatagtagtataacctatgaagctgatttgtgagatttatttcggtgccttattgggatcctaattaagttacttgacagcctttttctatgtaatgtcattctttttgcacatgcaactattattccttatgtggcctctgagaacgttaacccttttgcaggtcattagcaaactggagcgccgtactgttgcttaccatgaatctggacatgcagttgctggatggttcttggaacatgctgagcctcttctaaaagttacaattgttcctcgtggaacagctgctttaggctttgcacaatacgtcccaaatgaaaatcttttgatgacaaaagagcagctttttgatatgacatgcatgacattaggtggccgtgctgcagaggaggtacattttcttctttcatatcttatttttgctaatgttttatgataaatagtcaggcttcacgaatgtttctattatactgttaaatctgtactaaccaattcaagtcattatctcttctctactcctataaagcatcagttttcctggattcaccatcgtcatttctgcaaaaagtccttatacttttttataatctaacctgcggtcccaacatctttatcttcaagtttccaccgtcgcgcgtcacgtccgaagcacgtagatctatttttctcacccacatatcgactaacaatcagataagataagccttatctcttgcctgagtaaccaagcaacatccacaagcactcccttctccttttgttttcgtcgtttattaatccccaacttttcgtctctttcctagtctccaattccctcacctagattcttctgcatcctgctgtctctgactcgccaatcaccgctgccgcggtgacctatttttctccctcacgtcttgcctaacaactagataaaatagtcttatctcttgcatgtcgtgcatctccgctgccatgtgatacgtggctgaacagccgagggggaggaggcaccgccgccgccgttactgttggtaaagaatttgtgagatattaaggtcgctgataatatatgtattgtttgtttttatatggtcattgtgcgctaacattttatcaatatttatgtgccgtcacaacgtacagtattgtagatgtttgaatagagtgaatcagctgttagtttgaacaagggatgacagtgaggcgggtttgggtcggggacctgcaggtcgtcgccctgtcgggtctggggttgggtcctatactttccccgcagggcttcaggttcgaggggccgaattattgcaggttcggggtgggtttcaataccaaccggcgggtttcccacgggccccgaactacatacagcgacaggctgacagtaacccagcccaccagcactcatcagcccatcacctaccccagccggccaacccccaaatcggtaaaaatccaaggggccaagacgccatcacggcaataccccaatcccagtgccgcctcccctgcaggcctgctgcctcactggtcatccacggcactcggcctctgcatctagccgttgggcggctcacctgaaccctgatgagcgcactgcacacacagaacccaacggcggcgagcacatgtaggaccggacgcctgcctgaaccgccacgcccctagcgctgccaggacagcgaggtgccgctcaagagcttgactaccaatgtttcctactttccttgtctacagttgaactgtttgctcaggttgtttgagtgatctacaggtcgtttgatctattgtttccttgtcatccattttgagcagcgaactttggacttgcagtttctgttcgtgcacattttctgtttgtgagcagcgaactttggatttttttgttattttggttgggtttcgagtccccggtgagtttgggttcagggttcatatttcacccgatcacgggttcgggccgggttgaaatttcgggtgcgggtgtgtggatgatgcacctgctctgatcccgacccactgccattcctagtttgaacttcccacattcgacaaggacattaattatagcctgcttcattgatattatcgccacttaaattacgatcaggtcatgtgaatatggtcatagttgtcaatttagtagaaaaatcataattggcttggtaaaatcaggatactgcatcatgtaaacttttgattgcattttaagtggaccagaagacgctaatattttccattatcccctttgcctatgtgagaaacatgtcgataccattacatttatcaatttggttgccatctaaatattatatataatctcaaggtattacttcgtagaaataataatcagttccctgtgttccaatgtcatatgttggggtacccgtttatttcacagtattctcaccagaaaccttttgatgacaaaagagcagctttttgatatgacatgcatgacattaggtggccgtgctgcagaggaggttttgattggcaaaatctcaactggtgctcagaatgacctggagaaagttaccaaaatgacatatgcacaggtcgccgtgtatggttttagtgaaaaggttgggcttctgtccttcccccagaaagatggtggtttcgaaatgagcaagccttacagtaatcagacagcatccatcatcgacgatgaggtccgggaatgggttggcaaggcctacaagaaaacagttgaattgataacagagcacaaggagcaagttgcacagatcgcagaattgctgctcgagaaggaagtcctacaccaggacgatctaaccagggtactaggagaacgtccattcaaggcactggagccaaccaactacgacctctttaagaaaggtttcgaggatggtggtgacaacagccaagcaccagcagagaacgccgagctgcctgatgattcatctcccccagttggtgacgttgtacccacgtagtgtttctctcctcaacgtcagagctgtacattgagcgctcattctcgatagattcttgtttgttggttgcatcataaaaaagatctgtataaattcgcgcccaagctgattatgccactgtggaaatgcatttggatttccgtagtgtcagtccggtcgatagggtgccttgggttcttcatggcacgagcaaatgttctgattcttgtattcgaatgttttgaaatattctgtctgacgggactgcggagttggcgcgagaagtgtgcttgttcagttctatctgaaggcttagctgtctgtagctgtagctggtaacaacagtggctaaaatggtacctctgaaatttgtgtgacagtcacaagcctttttctccgttgaatttttatcaggtagtcggcgcgattactttgtttgacaagcacaaactaaatgtcttggtttttagtaggcttgggcagcccagaaaccaaagtaaccgaaaccaaatgaatcaatagtaattttggtttcatttttccgaaagtcgaagtaaccgaagtaatttcggttgtagacctaagaaaactgaattaacctaatagactaatagaagtttaggcttaacccagtataggaatcctaaaccctaaatatataataagcacacaacctcccaaaacaatctatctccaaccataaatcctctatccggtcatctacgcgtttatgctaaactctaaaattgtgttggttttttcttcttctaaactttggttggttcggttaaaaccgaaattctcagtttcgcatgttctaaatgcatatttcggttctagtttttagtaaccaaattctctaaaaaaccatggcaatttgaaagcttaggcacctggtactgctatgtattgtaagcttcacaaatgcattactagtcctacctacaccatggcaatttgaaggctgcccactaggccactaccaggaccgtctgttcggtcctcaagaaggcatcgtcgccgtgcggag

SEQ ID NO: 11783 - DNA, 3198 bp, Zea mays
attgggacctcgagccggcgggactttaccttcgcacccattcccgtgagcgccgccggcccgcccgagcccaaaaccagaccactggcgcgctgctattttccccacacggaccctcgccgccgcggcgatccctctcctccacttcctcatcacaacattcaagaacagaccggggccttgcgcaaaagaacaaaaaaaactcagaacacacacacacacctctatcgccccgacctcgacgcgacccctctcgcttggatccggacggcccggtccctccgccctcccatgcgcacggcgccgccgccgccgccgcagccgacatgacgctcgcctccctcgcccgcgccctcggccggtccgcgcgctcctcccgcccgcgccagggtttccagctcgggggcctccggcagccgcccgcgccaccgctaccgccgcccgtccacggcggtgagggtggggcggcaggatttgttcgcagctacctgactgcggcctcgtcggcagctcttgggaagccatccgcgggcaagaccgtggattggagatatgtcctcgccagcccacatttccgacgcctcttctcggacgggtccaagaagaactacgagaactattaccccaagggtaagaaggaggtgcctaaaggagatggtacaaacaagtctgaatctaagcaggaatccaatacagatgaaggatggaattttcaggataatgctatgaaacacatgcagaatttccttgcgcctttattgattcttggcctgatgctatcatccatgtcatctagctctgcagaccagaaggagataagcttccaagagttcaagaacaagttactagaacctggtttagttgatcgcattgttgtttcaaataaatcagtagcgaaggtctacatcaggaattcacctcatccaaagagccaaggccaagatagtgatatccatattactaccactgatgctccaggcaagcctgctcccagcagatgcaagtattacttcaatattggtagtgttgatttgtttgaagagaagttagaggaagcccaggaagctttgggaatagatccacatgattttgtcccagtaacttatgttgctgaagtaaattggttccaagaagttatgaggtttgccccaacagcattgattattggtctattatatttcacgggaaaaaggatgcagagtggtttcaatattggaggtggtgctggcaaaggaagaggaggtattttcaacattggaaaagctacagtgatgacagtgatgaagacggacaagaactccaaaaataaggtgttttttaaggatgtagccggttgtgacgaagcaaaacaagaaataatggagtttgtgcatttccttaaaaaccctaagaagtatgaagatttgggagctaaaatacccaaaggtgctctacttgtaggccctcctgggacagggaagactttgctcgccaaagctacagcaggagagtctggtgtgccatttttgtctatttctggttcagatttcatggaaatgtttgttggtgttggaccgtccagggtacggaacttgttccaagaagctaggcagtgtgctcctagtattgtattcattgacgaaatcgatgctattggtcgtgcaagaggacgtggaggtttttcaggttcaaatgatgaacgtgagagtactttgaaccagctgcttgtagagatggatggatttggaacaacttctggtgttgttgttcttgctgggacaaatagacctgacatcctggataaggcattattaaggccaggaagatttgatcgccagatagcaattgacaaaccagatataaagggccgtgatcaaatattccgcatatatcttaaaaagcttaagttggacaacaaaccatcattttattcgcaaaggctagctgccttgacacctgggttcgcaggagctgacattgccaatgtttgtaatgaagctgctttaattgctgcgagaagtgaggaaactcagattaccatgcagcattttgagtccgcaattgataggattatcggtggtttggagaagaaaaatagggtcattagcaaactggagcgccgtactgttgcttaccatgaatctggacatgcagttgctggatggttcttggaacatgctgagcctcttctaaaagttacaattgttcctcgtggaacagctgctttaggctttgcacaatacgtcccaaatgaaaatcttttgatgacaaaagagcagctttttgatatgacatgcatgacattaggtggccgtgctgcagaggaggttttgattggcaaaatctcaactggtgctcagaatgacctggagaaagttaccaaaatgacatatgcacaggtcgccgtgtatggttttagtgaaaaggttgggcttctgtccttcccccagaaagatggtggtttcgaattgagcaagccttacagtaatcagacagcatccatcatcgacgatgaggtccgggaatgggttggcaaggcctacaagaaaacagttgaattgataacagagcacaaggagcaagttgcacagatcgcagaattgctgctcgagaaggaagtcctacaccaggacgatctaaccagggtactaggagaacgtccattcaaggcactggagccaaccaactacgacctctttaagaaaggtttcgaggatggtggtgacaacagccaagcaccagcagagaacgccgagctgcctgatgattcatctcccccagttggtgacgttgtacccacgtagtgtttctctcctcaacgtcagagctgtacattgagcgctcattctcgatagattcttgtttgttggttgcatcataaaaaagatctgtataaattcgcgcccaagctgattatgccactgtggaaatgcatttggatttccgtagtgtcagtccggtcgatagggtgccttgggttcttcatggcacgagcaaatgttctgattcttgtattcgaatgttttgaaatattctgtctgacgggactgcggagttggcgcgagaagtgtgcttgttcagttgttctatctgaaggcttagctgtctgtagctgtagctggtaacaacagtggctaaaatggtacctctgaaatcctttgtgacagtaacaagcccctttttcctttgaattttaaacaatacgaaaaaaatagaatg

SEQ ID NO: 11784 - DNA, 2965 bp, Zea mays
ctcgaggccggccgggccggggatccctctcctccacttcctcatcacaacattcaagaacagaccggggccttgcgcaaaggaacaaaaaaaatctcagaacacacacacacacacacacctctatcgccccgacctcgacgcgacccctctcgcttggatccggacggcccggtccctccgccctcccatgcgcacggcgccgccgccgccgacatgacgctcgcctccctcgcccgcgccctcggccggtccgcgcgctcctcccgcccgcgccagggtttccagctcgggggcctccggcagccgcccgcgccaccgctaccgccgcctgtccacggcggtgagggtggggcggcaggatttgttcgcagctacctgactgcggtctcgtcggcagctcttcggaagccatccgcgggcaagaccgtggattggagatatgtcctcgccagcccacatttccgacgcctcttctcggacgggtccaagaagaactacgagaactattaccccaagggtaagaaggaggtgcctaaaggagatggtacaaacaagtctgaatctaagcaggaatccaatacagatgaaggatggaattttcaggataatgctatgaaacacatgcagaatttccttgcgcctttattgattcttggcctgatgctatcatccatgtcatctagctctgcagaccagaaggagataagcttccaagagttcaagaacaagttactagaacctggtttagttgatcgcattgttgtttcaaataaatcagtagcgaaggtctacatcaggaattcacctcatccaaagagccaaggccaagatagtgatatccatattactaccactgatgctccaggcaagcctgctcccagcagatgcaagtattacttcaatattggtagtgttgatttgtttgaagagaagttagaggaagcccaggaagctttgggaatagatccacatgattttgtcccagtaacttatgttgctgaagtaaattggttccaagaagttatgaggtttgccccaacagcattgattattggtctattatatttcacgggaaaaaggatgcagagtggtttcaatattggaggtggtgctggcaaaggaagaggaggtattttcaacattggaaaagctacagtgatgaagatggacaagaactccaaaaataaggtgttttttaaggatgtagccggttgtgacgaagcaaaacaagaaataatggagtttgtgcatttccttaaaaaccctaagaagtatgaagatttgggagctaaaatacccaaaggtgctctacttgtaggccctcctgggacagggaagactttgctcgccaaagctacagcaggagagtctggtgtgccatttttgtctatttctggttcagatttcatggaaatgtttgttggtgttggaccgtccagggtacggaacttgttccaagaagctaggcagtgtgctcctagtattgtattcattgacgaaatcgatgctattggtcgtgcaagaggacgtggaggtttttcaggttcaaatgatgaacgtgagagtactttgaaccagctgcttgtagagatggatggatttggaacaacttctggtgttgttgttcttgctgggacaaatagacctgacatcctggataaggcattattaaggccaggaagatttgatcgccagatagcaattgacaaaccagatataaagggccgtgatcaaatattccgcatatatcttaaaaagcttaagttggacaacaaaccatcattttattcgcaaaggctagctgccttgacacctgggttcgcaggagctgacattgccaatgtttgtaatgaagctgctttaattgctgcgagaagtgaggaaactcagattaccatgcagcattttgagtccgcaattgataggattatcggtggtttggagaagaaaaatagggtcattagcaaactggagcgccgtactgttgcttaccatgaatctggacatgcagttgctggatggttcttggaacatgctgagcctcttctaaaagttacaattgttcctcgtggaacagctgctttaggctttgcacaatacgtcccaaatgaaaatcttttgatgacaaaagagcagctttttgatatgacatgcatgacattaggtggccgtgctgcagaggaggttttgattggcaaaatctcaactggtgctcagaatgacctggagaaagttaccaaaatgacatatgcacaggtcgccgtgtatggttttagtgaaaaggttgggcttctgtccttcccccagaaagatggtggtttcgaattgagcaagccttacagtaatcagacagcatccatcatcgacgatgaggtccgggaatgggttggcaaggcctacaagaaaacagttgaattgataacagagcacaaggagcaagttgcacagatcgcagaattgctgctcgagaaggaagtcctacaccaggacgatctaaccagggtactaggagaacgtccattcaaggcactggaccaaccaactacgacctctttaagaaaggtttcgaggatggtggtgacaacagccaagcaccagcagagaacgccgagctgcctgatgattcatctcccccagttggtgacgttgtacccacgtagtgtttctctcctcaacgtcagagctgtacattgagcgctcattctcgatagattcttgtttgttggttgcatcataaaaaagatctgtataaattcgcgcccaagctgattatgccactgtggaaatgcatttggatttccgtagtgtcagtccggtcgatagggtgccttgggttcttcatggcacgagcaaatgttctgattcttgtattcgaatgttttgaaatattctgtctgacgggactgcggagttggcgcgagaaaaaaaaaaaaaaaagaaaaaaaaaaaaaaaaaagcggcc

SEQ ID NO: 11785 - DNA, 2020 bp, Zea mays
atatatttctatatgcttgattgtggatgttttttttcccaaaaggattcttgggttcttgtacttataggaccaattgtttattgagcttgtgtatagtgggtctaatccgacttggtgtagtgtgaaaacactatataatgtagttttatggtgttgttgagtttgattgactgttgggttacaacccaacttatcaatgtagtatttccatgggtgcaatgctttgcgcctcactttttttaggctagtgtggctacttgctaacttgatcttagtataaaattggtttgtctctatagagcagaggcaacgttgtaatgtctatgaaatctttagactggtagaactcgagtgaatttgtgacatgacgtagattgataagtccaaccatgtctacctgataggttttcttattatgtgcaaccttatttttaacaataaatagggtggtttcaagtggattttatgtcgtgcatgttttccttctatggcttgtttcaatagccataaaggctatgcatattttttttagttgttgcaggctagtcatgtgggcgatattgacaacccgttttatatatttttttatttgccaacattgtatggcagtttgattttttctatgagcagtttctctatgcatgcttgttgaataattatttggaccgctttatcttaaacgaagtcaatgcttaactgggagttgcttatgtttgttagtcatcgatctctttaatgatggggttgttgcatcggattgagatttttcttatatgaatgatggtttgatagatcatgtatgtctactactttgaatgcatcctgtgatatcacgaggtacaaattgttcaagtgcagtaatagtaggttttgttgtatgtgaggttaatcaaggtagtttggttatgtggattgtcttattgacgtccaattactcctgttgagcatagtatcgtgttattattttagtattgaaagtaatatttatgaagcttttgcatgagtctgtgtcaagaagtacattagtttttcttgttgttatccctccattgctttatgagtattgcaaattttatctcttttgagaggaggaaaagacgttacatgacatgagcaccatttgcttcacgtcaacagaatagttgtggagagctctaatagttggattctagtgtaataacaaccatgttttatagtgctagagacgggtatgtcaggtgtttcatacattgtcgatacatggatgtttgaccttagtggcattaacaaacgaggttgttgaattcgttgattgttgtgcttagtgttctaacctattaggtaaagtgttgcttaaaggctttggggagttgcatccccatttggtagtggaaaatcctagtgtgggtcgcacctgccaatgccttgggttttattttatattgtttttttattaggggtaagggtgttgttttgttttgttttgggagtcattttaaattagttggaggctgaatcaggcttcacttatctagaatgttttgtagtaggtctcttcgtctttgtataggatgctcaatcacccagtttggtctaaacatttgagagttatgggtttcctatagcagctttaattttgtacggaagtatagacattgaatacggtaaattttgggttttgttggattatgaaagttttagtaatttcatgattgtcgaggaccataattatgggtaccctcaagactccaaattctcagctggtaacccccatcagcacaaagctgcaaaggcctgatgggtgcgattaagtcagggatcggtccattcgagggactcgatcacgcctcgctcgagcctagcctcaggcaagggcagccgaccccggaggatctccgcctcgcccgaggtccccctccagcgacgaacatacttccggctcgcccgaggccctgtcttcgccaagaagcaaccctgaccaaatcgccgcgccaaccgaccaaatcgcaggagcatttaatgcaaaggtggcctgaca

SEQ ID NO: 11786 - DNA, 1459 bp, Zea mays
acgcagggtggctaggagttgagtcgtgcagaagagacaaaggtcctcacttggctaagctagacacgtacgagtgcaggaaacaagataagtcgcggtttgcgacggcgagaagcgccggatgagtgtccactgtccacaagtccagattccaattccagtccgatcgtgagctcagctcagctccgctagtcctctccccgcacgcaccaccaccagcagcagtccagcaccatgggcggcgccctgctcctcacgctgctcctcgcggccgtgcccctctccttgggcggcggcggcggcgcgcacccgggctactccgacgacgacgagagcgcctgcacggtggacgcgggcgcggagctgctgcggcggatggaggagcgcgggcccgacaggcgcatcatcgacatcacgcacgcggtcgtgccggacctgccggcgttcgccacgggggcggtcgcggggcccatgctgcgcctcagggagtccatggcggacgggtccgagtacaacctgtcggagctgcggatggagtgccacaccggcacgcacgtcgacgcgcctggccacatcaaccaggcccacttcgccgccggcctcgacgtcgacacgctcgacctccacgtcctcaacggacctgcattgctagttgatgtgccaagaaacacaaatataacagctgaagcgatggaattcctaaacatcccgagaggggttcgccgagttctgttcagaacactgaacactgacaggaagttgatgtggaggaagggaggtgacatgagctacgttgggtttacagaggatggcgcgcagtggttagtcgacaacaccgacataaagctagttggagttgacggtctgtcagtggcatcatttgatcacctgatctctgcccacgtggtctttttcaaaaccccggatataatccctgttgagagcctgaatctggacgacatcgaggcggggatatacatgctgcactgtctacctctcaggctggtcggagccgagggtgcaccgaccagatgcatcctcatcaagtgatcgttcctcggccggcctgctcttgctgccttgctggaggtggcgacactggaccatgccagctgagctggtgctccgtcgtgggtcgcgtggccaatatttggctcgcatgcagtcgtcgatctatatggaacagaacactgcatgcctatgtagatacgcttgtatggacaataaaggaaccgcagtacttctgtcgatgaaatacttttgggtgagccggtaatctaaaacaccaggcctacaggttaagctggaggccctggaaggctgaggctagcggctggggatggatccagatttttattcgaatgctatttttttggtcatatttctttgattgtaaacaaataacatatatgattttctatatctctactaaaaaaaaaaaaaaaaaaaaaaagcggcc

SEQ ID NO: 11787 - DNA, 1760 bp, Zea mays
  misc_feature (94)..(94): n is a, c, g, or t
aaaagaaaaagagaaagacacaaacaatgaacaagtctcatggtcatgggccagcaaaccagcgtcgtgatgcgcgtgcagctgcaggaaaaantaaaaataaaaagacaaaatcagtcggcccaatagccatggaagaattgctctcctgaggtgtgctctgctgcttggtgtttttcctcctcccgttcacctcgccgtcgacggggccaggcggccgaacacatccttgacgaccgccgccgccctactcgcagcttcctgggtttcatcggatcctctgctagcgacgagcaccccctacaccaggccgttacttgggcgccggtgccatgcccggcgggtcttcgggtccagatggtgaagtggatgcaggatttgcgaagctccagggagaggatttcgagtattacatgcaaacgtactccatcatgctgggacgcaacagcaagaaatcaacagtggatgtggatctctcgagcctcggtgggggtatgaacatctcccgccaccacgcccggatattctacgacttccagcgccgcaggttcgcgctcgatgtcattggcaagaacgggtgccttgtcgagggcgtcctgcaccttccagggaacccccctgtcaagcttgactcgcaggatctgctgcagattggggacaagaagttctacttcctactgccaacacggtccatcttcgcttcggctgctgctgctcggcatgctcctattattccacagcagcttcctcctccaccgtatgcacatgcacgggcaggccgccctcgtttgtccgagtttcatgaccgctccttcgaaggtgattatgggcgggaggttgatgagattgggaatggtatcagtgaaactgggatgaggggaaagctggtaaagaggaacaagaagtcttctggcgacttggatatctatggtgggcatagaatcaatgtggaaccaatagggacgctaggtgaagacagtagatcagaaataagatcaaggggtgacagggatattgacaaccaacaagcccttcaagcagaagagaaggatgttgtgtcatctgtggccacagtgttatctgatctctgtggccctggagaatggatgcccatggcaaaactccacaacgagcttcttgagcagttcggcaacgtgtggcaccccagcagggtccggaagtacctgacacaggacgactggtcgccgacggagaccaagggcaggccttggttcggccttctggcgcttctcaggaagtacccggagcactttgtcatcaacacgaggtccaagggcaggatgacctcggagttcgtctcgctggtctccttgctctcctagagggacggagagggggtggtgttgtgtccagtactccagtccgtgtccagaagggtcggaggtgtactggctctcgtttgcttgccccttgctgtgtttcagcagctgttatatggacccaccatgttgtgctgtagtatctcgtgtggttgaggcagctgcactggtccgtgaccgtctctgtagtgtcggcagcagtgtatggaaagcatgcgttttaagttttaacctatgctagcaattcagcagcagctcggtgattaccgtatccagcatgtatatccagtgccatacttgtaactgctgtgcggtgccctctttgcagcttcccgactctcgtgaactacgtgagtacaaacgtctcaaaagatgtcacggccactctatataattaaaaaaaaaaaaaaaaaagcggcc

SEQ ID NO: 11788 - DNA, 1458 bp, Zea mays
  misc_feature (1453)..(1453): n is a, c, g, or t
gtgggctcgccgtcgacggggccaggcggccgaacacatccttgacgaccgccgccgccctactcgcagcttcctgggtttcatcggatcctctgctagcgacgagcaccccctacaccaggccgttacttgggcgccggtgccatgcccggcgggtcttcgggtccagatggtgaagtggatgcaggatttgcgaagctccagggagaggatttcgagtattacatgcaaacgtactccatcatgctgggacgcaacagcaagaaatcaacagtggatgtggatctctcgagcctcggtgggggtatgaacatctcccgccaccacgcccggatattctacgacttccagcgccgcaggttcgcgctcgatgtcattggcaagaacgggtgccttgtcgagggcgtcctgcaccttccagggaacccccctgtcaagcttgactcgcaggatctgctgcagattggggacaagaagttctacttcctactgccaacacggtccatcttcgcttcggctgctgctcctcggcatgctcctattattccacagcagcttccccctccaccgtatgcacatgcacgggcaggccgccctcgtttgtccgagtttcatgaccgctccttcgaaggtgattatgggcgggaggttgatgagattgggaatggtatcagtgaaactgggatgaggggaaagctggtaaagaggaacaagaagtcttctggcgacttggatatctatggtgggcatagaatcaatgtggaaccaatagggacgctaggtgaagacagtagatcagaaataagatcaaggggtgacagggatattgacaaccaacaagcccttcaagcagaagataaggatgttgtgtcatctgtggccacagtgttatctgatctctgtggccctggagaatggatgcccatggcaaaactccacaacgagcttcttgagcagttcggcaatgtgtggcaccccagcagggtccggaagtacctgacacaggacgactggtcgccgacggagacgaagggcaggccttggttcggccttctggcgcttctcaggaagtacccggagcactttgtcatcaacacgaggtccaagggcaggatgacctcggagttcgtctcgctggtctccttgctctcctagagggacggagagggcgtgttgtgtccagtccgtgtccagaagggtcggaggtgtactggctctcgtttgcttgccccttgctgtgtttcagcagctgttatatggacccaccctgttgtgctgtagtatctcgtgtggtcgaggcagctgcactggtccgtgaccgtctctgtagtgtcggcagcagtgtatggaaagcatgcgttttaagttttaacctatgctagcaattcagcagcagctcggtgattaccgtatccagcatgtatatccaatgccatacttgtaaaaagactangaaaa

SEQ ID NO: 11789 - DNA, 1264 bp, Zea mays
ccggcatttaatcccgcgttccattccgaacagcgagcacaaccaccgctgctgcgatctcgccgtctccctcctccacgccgtctcggtctccctcccatggccggctacccgcctcccggctccggctacccctacggtcccggcgggggctacggcgccccgccgccgccctacggctcctcgcccgcgccctccgccccgccgtacggcgagaagccgcccaaggaaggcaagacctcgacctcctccgcgcccccctactacggcgcgcctcccccatcctacggcgcgccgcccccctcccagccctacggcggcgggggcgggggcgggggcgggtacgggtacggcgcctcgcagccgccgccctacggcggcgccccgcagcagcagcccccgcgcggccgcccggccccgcctgcgttcggcagcccgttcgcgtcgctggtgccctccgcgttcccgcccggcaccgaccccaacgtcgtggcctgcttccaggcggccgaccgcgacggcagcggcatgatcgacgacaaggagctgcagtccgcgctgtccgggtacaaccagagcttcagcctccgcaccgtccacctcctcatgtacctcttcaccaacaccaacgtccgcaagatcggacccaaggaatttacttctgtgttttacagtcttcagaactggagagcaatatttgagaggtttgatcgtgatcgaagtggcaggatcgacatgtcagaactgcgcgatgctcttctcagtctcggatattctgtgtctccaactgtcctcgatctgcttgtgtctaaatttgacaagactgggggcaagagcaaagcaatcgaatatgacaacttcattgaatgctgcctcactgttaaggggctgactgagaagttcaaggagaaggacaccgcctactctgggtcggcgactttcacctacgaggccttcatgctgaccgtgctgcctttcctcattgcgtagtggcagtccactccgccgctcaaaacaagctttataagcttttccaatagtactgtaatattatgcctgctgtaaagagatttatgttcgcagagttgtttttagacgagttgttttgattctggatttaacttgtgttgtgaatcataaagttactctgaaatggagaatgtacctgttggttgaacaaaaaaaaaaaaaaaaagccaaaaaaataaaaaaaaaaaaaaaaaataaaaaaaaaaaaaaaaaaaaaaaaaaaaaaaaaataatg

SEQ ID NO: 11790 - DNA, 6975 bp, Zea mays
  misc_feature (2671)..(2671): n is a, c, g, or t
  misc_feature (4240)..(4240): n is a, c, g, or t
  misc_feature (4278)..(4278): n is a, c, g, or t
ccctgatgggacgaaaatagcagacattttctgttcgcgagaggaatacagagcgtgcatgcatttcgcagagagagtcagagagagagagagtcagagagaagagacaaaacgcgtggcgtggaggcacgacgacgatggccgtacgtcgtacagctgctcccgtctgcaatcgcacgctgacgccgtcgtcaagagacacgcacggacacggtccttggccacgacgcgcatgctgccgtcgcgacgcgtccccagagtttgacacgctccctctccctccccacaggcggagccgctccagttcgccacgtcatcataaaaaggcaaggaccagcccagccagccaacccaaggaaacctgcccgttgctttgctccccccttcggcatctctacctgcgtgcgtcaccggcatttaatcccgcgtcccattccgaacagcgagcacaaccaccgctgctgcgatctcgccgtctccttcctccacgccgtctcggtctccctcccatggccggctacccgcctcccggctccggctacccctacggtcccggcgggggctacggcgccccgccgccgccctacggctcctcgcccgcgccctccgccccgccgtacggcgagaagccgcccaaggaaggcaagacctcgacctcctccgcgcccccctactacggcgcgcctcccccatcctacggcgcgccgcccccctcccagccctacggcggcgggggcgggggcgggggcgggtacgggtacggcgcctcgcagccgccgccctacggcggcgccccgcagcagcagcccccgtacgggggcggggccccggcagggttcggcagcccgttcgcgtcgctggtgccctccgcgttcccgcccggcaccgaccccaacgtcgtggcctgcttccaggcggccgaccgcgacggcagcggcatgatcgacgacaaggagctgcagtccgcgctgtccgggtacaaccagagcttcagcctccgcaccgtccacctcctcatgtacctcttcaccaacaccaacgtccgcaagatcggtgagtgcgccagacgtcgacgaccgacctcaccctgagacctccttccttcccctcgactgtcgtaaaattgcaatttctttctgttgttcttgttcgatctgtcgcgcagcacggatcgatctatcgagacagagcgttagttcctaaaaccaatcatggtgttctccaggtcgccaaaaagaactgcacgcggcagcaggccagcagcaaatgcttcctccaacttcttttagctttttctaaaaagtaacttctaaaatgttaaaaaaaagtcccatagcaaacttgttggcggtaccatctccggctacctaccgagctgcggcgctggcatctggcaagaagccagacgaactgggacttggatttagggccaaatattgatttgatcaactagacccatttctttatgcgcagggtccaagatgatcatgtagagtagtaggctgtagatgacttgcgtgcatatgggattaagttccagtactgaccatgcgctgtacatactgcaaggaacgtggagttcttgttggcagcctttattgtagaccatgaaccttcttttatagtgtgtcaacaggtcgagtactgctagtaggccatgtcgctccctagccatttgcctgtaaatgctggccgcctggcacatagtttggcaaccaaggaggccccatggattcagtcagctctagatgtgtttatttagaaattatttactatctgccacaggcataccaactggtctgttctttgttctgtactgacaaactagcaatttgatcattccttaacgaagcagatagtttagttaaattttacactctgatcgagtggccaatattgaatcgatcaagtgcatccatttctctatgcgcaaaatccaagatggtcatgcagatgacttcatggttataaggttatttttttagtaccgatgatgtgctcaaaacatattgtactgtaagtaacatgaagttcccctatggaacttctctgtagcgtttgaacaaatgaagtattgctagtaggctatctcactctcaagactttcgatgtaacagtggcacatagtttggtaatggtaatgatgccttttgggcaatcctgtttgctggagtttggatccagctgggtactgattctgtgtgatttgatattcttaacttgatcttcgtagtcaaaacaatttgtgcaagattttcatataccattttattcaagccatgagacgaatgtttcttcattcgtgtgaccttaaaaggccagtgctaacttgtgttccttttcctctccctttttctgactagtacgaagcacacctatatcagattcagtatttcctttctatgtcctgtacagtctgcttttcttgataaaaatatgctaatttctgtttctgccctttcaggacccaaggaatttacttctgtgttttacagtcttcagaactggagagtaagacgacctgcaactcactgctcccttttccacttcacttgtatgtatgcaaaattgaccaacgaattattgcagtgaagtgatgttttttgctgtatttttcaggcaatatttgagaggtttgatcgtgatcgaagtggcaggatcgacatgtcanaactgcgcgatgctcttctcagtctcggatattctgtgtctccaactgtcctcgatctgcttgtgtctaaatttgccaagactgggggcaagagcaaagcaatcgaatatgacaacttcattgagtaaggacctcccttcaatctaactgctgctcgtttcttaacaatgtttgctgccccttatcagtaaggaaattattgtattttcgcagtgttgttgtcatggatgttcataactggcctgatatcatcagcctatgagtaataaagttattttatagctcgcgtggcggtcgcgtgggctgatatgtcaatgaactgccctgctaagttcagctatggtttctgattgcaagactattgacatgtctaaaactgattttttttatgtcctatctgcattcagtttgccctgtacctcaactactgaccgtgttttcttttttctttctttacctatgcagatgctgcctcactgttaaggtaactaataacgcctgcactgtagtgtgcaaactcgaccatttcaaactttctctttgcgtctgatcttgcaaatgcagttacgaacgatcttacctgtggtcattgttttttggatcacttcgcaggggctgacagagaagttcaaggagaaggacaccgcctactctgggtcggcgactttcacctacgaggccttcatgctgaccgtgctgcctttcctcattgcgtagtggcagtccactccgccgctcaaaacaagctttataagcttttccaatagtactgtaatattatgcctgctgtaaagagatttatgttcgcagagttgtttttagacgagttgttttgattctggatttaacttgtgttgtgaatcataaagttgctctgaaatggagaatgtacctgttggttgaacagatgctttgtggttgtggtatgtggttggtattggtggctctagggatggcaatgggtaagctatctactggacacacaaaaccatattcatatctagagatataatgcctcatatccatattcactatccatcatagatatacctatacgccctatacgcattaacattataatggacataatcatttagaccacgaaagtaattaccacatataaaatgttaaaactacataccttatcgatattaaaagatgttaaaataacatattaagatactaaatgatatattaccttagtgctagcatgataaatttatcgaatccaacataattttatcacaaggttaacaacatttagcattaaataacaacaccattataagctcatgcatgagcctcttaatttgaacccacatatcatatgttagcgagtttcctatcaagtagcgggtatgaacaagagaaaatatactatatccagtgggacataacaaatgacctaataaaatactcatgtgtatcaaaatttggtatataatgagaccatagagttggccaagaacttcgtttccttaaggccatggctcgtggaaataatggtgccttgcattgcgttcattcatatatagaacaatcagcaaacaggaagatcgtgtaattgcnggacaatatatatatatatatatatatatatatatatntttttttttttttttatgcaggacagggctatatatatatatatatatatagaacaatctgctaaagctgagcctagaccgtggttcattacttattccaaacaagacgcaaaaatcggatgcaacttcttttctccatgcatcccctcttcttcagctaaatgtcgtcaggaccgctggggagcggggcgtagccgttgggactcgcaggagctccgttcgatttggcaactggtatgcacttgaggacggcaccgacgaccaagctgaccgacccgaggccgacgctgagcagccaaagccgccagtcgagtgggacggtgctggcaaaggtgccgagcagctctacgatcaccacttggaacaggaccgtcgcggctatgatcgcgatgaagatccagttggtgaccatgccgcggaacacgttgatcttctccatttctctgctgtttatttcgtttgaacacctgagacagacagacagacaggcaacatgattttcgagcccgtcagatcgtatgcttatgcgctgaccagaacaaacattttgtctgtgaagaagcatttggatcatgatccattaccacccctaccagtaaccaaagtgtgtcgataatgatgcgctcacctggcagaacacgaaggagttgaatatgagagtattgacaacagatttggaatccgcgcccttgatgttcagaaactgttccccgccaaacatgagggctccgagcacaaccaactggtacaaactttgcccaatgatatttctccacatgaccttggtgatgaagctttcccctcgcccgacaggtggtctcttcatcatgtcatcgtttggaggctccgttgctagagctagagctcctaatgtatccataatcatattcacccacaacagttgcaccgctgtgagcggagcgctccctgttgtgatacgaggagagccaaacatattgttatttcgataggggggatattaggaatttactaagactatctcccgcagtttacccatcccggcatatccatattcaaactatattctgcaaacaatgcaatctacagtgcagaacagtgtttttgggtaaaacgacccatggcaatacttgggcattggagaaaggaaacactactacagatgatgatgcgcgcacctgtaatgcatgctgagacgaagttgatgaccaaagcaacaatgttgacagtcagctggaactgcacgaacttttggatgtttatgtaaaccgcacgaccccacctcgcgacatttattatagttgtgaaattgtcatcaagcactatcacatcagcactctccttggcaacctggaaatatgtcagtttatataattatctttcaagggacatggtgagttgctgaaggaaaaggctcttgtaagtgaaaatttccaaactatttgaatcatgtaatgacctaagattaagatctaaaaattactaggtaggttattttgaccaactctcgaatcatagagtcacaacctatgtatccctgtcattcatgaaccaatgcgacataataatccagtacctctgttcctgctatgcccatagcaaggccgatatctgcttcatgcaacgctggagcatcattcgtgccgtcacctgtcacagcaaccacctcgcgaaacatacctcgcaagttcgtcacaagggtatgcttgtccaacggtaaagaacgagccatgacctgccgatgttgaaagacgatcaaaattgagagagagaaaaaaaagaaatcttaatagatattagcggttgagggaagtgaaatgaacccgaatcttaggtattatgtccctcatctcttctgggctcttgctgcggaattctggcccttctattgctaggtcaccatcagttagtatcccacactctttggctatagctttggctgtattgatgttgtcaccggtcaccattctcacgacgatgccagcagacgtacaggcctccacagcgtccttgactcctgggcgcaagggatccttgatgccaaaaatgcagattagagtgaaaccacttgttgggctatctgcatcgtcgtcgtcgtcctcgagaccatccacatccttatacgccaagcacagtgtcctcaaagcatctgaagcaaaggagttgatagtatccaagacgatctttctctgagcttctgacaaggggacgctgttcccatcgccatctatcatcatgtcgcacatctccacaacgatctccgacgcgcctttggtgaaccagcggtacgagccgccatcgtgcaacgagaccagcaccgccatcttcttcttaaccgaattgaacggctcgaccttgaccttggtgcaggtcctatcctcagcaccaagaccttccagtttcaagccaaactcaaacattgccctctctgtcggagttcccaagacagtctgcttgccatccttctcattgactacctctgcgctggtgttctcaaaaattccttgcagaagcaggctcaatgtggctggagaaacggcagaagccagatcttccaaactactgctatcggtaaccgattttgagacctcggatgcccatatcttgtcgaccaccatatggttagtagtcaaagttcccgttttatccgtgcagatggttccggcagatcccatagtctcacacgctgaaaggtgccggacaagtgccttcgagccg

SEQ ID NO: 11791 - DNA, 2905 bp, Zea mays
gcacggcgcatgcctgcgcgagcgcagccggcagccgcgcccaaggtcctagcggcggcggccggcggcgccgcccgctcgccgcagccccagccccagccgccgccgtgcctgtccgttgggcttggcggcggctagcgtcgtagccgacggaccaaggggaaagaatcgaacatgtgctgctgggccagatggcagtgggccggaggggagtgtttggttctttgaactcttctttcttcttctcttaacaaagcgagacagtttttatttaactctgtctgaccggagcagggcaaaccgccaaccgggaacacagtacaatggtgggggcctgaccacccagtcacccacccacggacccacccgactcttccccagtgattctcttctacgcttactaggctatacttgacttcgtgtgtttccattccacagaggaagggatggccgggagcagcgtccgcggcggcagcaactgcccaccgctgttcgtgacggagaaaccaacgcggatggcgaggtacgcttaccggctgttcgcgagcacggtcctcgcgggggttcttctggtatggctgtacagagcaacgcacgtgccgccgatgagcagcggcgcccggtggtgggcgtggcttgggctctccgcggcggagctctggttcggcttctactgggtgctgacgctgtccgtgcggtggagccccgtcttccgccgcgccttcccggaccagctcttgcgaaggtacaaggaagagcagcttcctggggtggacatatttgtgtgtacagcagaccccactgttgagccgccaatgcttgtcatctccactgtcctatctgttatggcttatgactacccgaaggagaagttgaacatatatttgtctgatgatgctggttccatcataacattgtatgctctatatgaagcatcagagtttgcaaagcactggcttccattttgcaataagtaccaagtggagcccaggtcaccagctgcctactttggtacagaagctagccctccagatgcatgtgaccgtaaagagtggttttctttgaaggagatgcacaaagatttggcagctcgagtgaattcagttgttaattcagggaagatccctgaagtttcaaaatgcaagcttatgggcttctccaggtggagcgagaatgcaagttttagagatcacccttcaatagttcagattttaattgatggaaacaaaaggaaagcaactgatgttgatggaaaagtgttgcccacactggtttatatggctcgtgagaagagacctcaagaacatcatcacttcaaagctggatcactgaatgctttgataagggtatcatcagtgataagcaaccccccaggccggccgggtgtggactgtgatatgtactccaacaattcagggtctatcagagatgcattgtgcttcttccaagacgaacagctaggtcaagatattgcttttgttcagtatcctcagaactttgaaaatgtggtgcaaaatgacatctatggcaatcccatcaacaccgtcaatgagttggaccatccttgcttggatggatggggtggaatgtgttactatggcacaggatgcttccatcggagagaggctctatgtgggcgaatatacagtccagactacaaggaagattggactagggtggcgaggaaaactgaagatgtcattgacttggaaggaatggctgagtcacttgtgacttgcacatatgagcacaacaccctttggggagtcgagaagggagttatatatggttgcccactggaggatgtcattacaggattgcagatccagtgccgtgggtggagatcagtttaccacaacccgccaagaaaggggtttttaggcatggcccctacctcactaggacagattctggttcagcacaagagatggacagaagggttcctccagatctccctctcaaagtacagcccgtttctgctaggtcacaggaagatcagcctgggccttcaaatgggttactccgtctgcgggttctgggctgctaacagcttccccaccctttactatgtcactatcccttcactttgcttcctcaatggcatctcattgttccctgagataaccagtccctggtttgtaccgtttgcatacgttgctgtggctgcatactcctgcagcttggtggagtccctgcaatgtggcgacactgctgtcgagtggtggaacgcgcaaaggatgtggcttttcagaagaatcacctcatacctcttggcagccatcgacacaatccgcagaatgcttggcgtcaccgagtcggggttcaccctgacggcgaaggtgaccgatccgcgggccctagagaggtacaagaaggggatgatggagtttgggtccttctccgtgatgtttgcgatcattacaaccgttgcactgcttaacctggcgtgcatgatgctcggggtggcaaaggttctgttgcgtaaaggagcggtgagtctgggagctatgtttgtgcaggccgttctatgtgcgctgatagtagcgatcaattttccagtgtatgaagcaatgttcgtccgcaaggacagtggcagattaccagcttctgtcagtgtcgtttcgctctgcattgtattaccattctgtatacttccaaccaagttgtagatgtggagctggtgaaagatgatatatatatttgaaacccgatggtgaaagttataagaactgtactgatataatatatttccaagagaattaaaaaaatatataacatgttcatttacagatctgaaaatgtcgcagcattttgtttgtcaaggtggtggcgcataactttgtccagtcactgcaatctgagaattcgttgtcctggtttggccataacattgcagggggaggga

SEQ ID NO: 11792 - DNA, 2539 bp, Zea mays
cgctggacacttccatcaatctctttcccccttcccttggattcgtttcagctactgaaactgaacgcgggcagtggcaggcaggatcagccgagccgagttccttttccgccaccgtcccttccccctctgcccctcgttcctcgtcttctctatttgcttggctttgcttgcttttggttcaacttccacaccattcattcatttcttggatttctttggtggcgtccgcaagtcaagtcccttcccccttccgcccctcgtcaaagcaagcaagcaaaagtggtgcggtgccatcagagtaagcaagctccccattttccctattcctatactactactagtagctgcagcagcatccaccggatggccatgtccagcgacaccgccgccacgacggggacatgcaccaagcccaaccccaaccaccgcctcccactctcaatagcctgattgattcatggcctccgcccccaccaccgcctcttctccgctaccggcgtcctcgcggcccactgccacaccgcccgacaccgctgccacgcccccgcccctcacctctcccgcacccgccgctcctccaccctcctcccactcccactcccactcccagccgtcgcctgggcctcctcaacacacagcctcgccgccgccgcgggcggctgctgctcctccaaggccgccgctgctctcgccccctccaacgtccccgacgccgtctgccgctccgacgccctcgccatctccgccagcgtccccggcccctgcaccacctccttttagcgctcctccgccgtcagcacgaccactgcctacgcctgccatcgcagtcgacccggccaggggcaagaacccaagttggaacaagtcgtccagcccgggtgcgccgtccaggagcccatccgccccctttggcggccttggtaatggtgttgtagccatcgccgctgcggtggtcgccctgctccttcttagcctcctagtcacagcagtttggttcaaccgcaagcgcaagaggaagcagatgagtggttacagagctggtctcatgtcgcctttttcttcgcagcaaccttcgggtgaatctgcaaatgtaggatggtcagctgatccttctgtccacaccaactatagcgccgggagccccaggctgaaacaatgcttgtctgatatcagcatgggcaactccaggttcttctcatatgatgagctgtatcagatcactgatggtttctcagctcagaggctgctaggggaaggaggctttgggtcggtgtacaagggccgcctgccagattataaagatgtcgccgttaaacgactaaaggatggcggcggacaaggggagcgcgagttccaggccgaagtggagataattagtcgcgtgcaccaccgccatttggtttctcttgtgggatactgcatttccaatgaccaaaggttacttgtatacgactttgtttctaataacacgctgcattatcatcttcacggacacggaatgcctgtgttagaatggtccgcacgggttaaaattgctgcaggtgctgctcgtggaattgcttacctacacgaagattgccatccgaggataattcatcgagacatcaagtcctcaaacattttgttggataacaatttcgaagcaaaggttgctgactttggtcttgcgaggctggctttggatgctgtaacccatgtgacaacccgtgttatgggaacatttgggtacatggctccagagtatgcatcgagtggcaaactgactgagagatcagatgtgttctcttttggtgtagttttgttagagcttattactggccggaaacctgttgatgcatcaagaccaatgggtgacgagagcctcgtcgagtgggctcggccattgctctctcgagccctggacacaggcgatttggaagggttggttgaccccaggctcgagatgaagttggacgaggtggagatgttccgcatggtcgaggccgctgcagcctgcatccggcactcggcgtcaaggaggcccaggatgagccaggttgtgcgggttctcgagagctcagcggacatcgacctgaccaatggtgttcagcctgggcaaagccagctcttcaacgtggccaacgcggcggagatacggatgttccgccggatggtagccggcgcgcaagacgacgacagctctgacttgacacagtacgattggagcaggggtagcgacgctgccccgggctccaggatcttgtaacgatgaccacattgtggtttctgaattctgactctgcctgcagtacttgttctgtagggagagggatggaattcagttcaaagtttgttccctgaccggccgggtcttattctttaggaaaaaacaaagtgatgtgttgtgttgtgtgtagagaagattgcactcctaggtttggtgtgaaggaagaggtttgcagttcattcagatttttaggcagtcaaggacaaggacgtggaaattgaagcaattgttgttacttgaatgaaacacgtgacatgcaaggttcaccac

SEQ ID NO: 11793 - DNA, 1495 bp, Zea mays
attggtacctcgagccggcgggcgggaatcgtgatcatccctttgttgcgaagatgacaagtatagtaagctgtaagcaccccgccctgcaaaaatcttgcacacgcaaaccgcagccaagcaagcgttcccctccctgtgatcgcgatggggtccaccgagaagcaggagccggaggcgtcgccggagatcatcttccggtcgaagctcccggacatcgccatcaccaacaccctcccgctgcaccgctactgcttcgagcggctccccgaggtgggcgagaggccctgcctcatcgacggcggcacgggcgccgtgctcacgtacgccgaggtggaccgcctgacccggcgcctggccgcggcgctccggcgcgcgccgctggggctcgggcgcggctcggtggccatgaacctcatgctgaactcggcggagttcgtgctctccttcttcgccgcgtcgcgcgtgggcgccgcggtcaccaccgccaacccgatgtcgacgccgcacgagatcgccgggcagatcgcggcctccggcgccaccgttgtgttcaccgagtccatggccgcggacaagctccccgccatgggcgacaagctcacggtcgtcctcatcgacgcgcgccgcgacgggtgcctccacttctgggatgacgtcatggccagcgtccccgacgaggaggccggcggcggcgagcaagacttggacttcgaccccgacgacgtggtggcgctgccctactcgtccggcacgacggggctgcccaagggcgtgatgctgacgcaccgcagcctgagcacgagcgtggcgcagcaggtggacggcgacaaccccaacatcggcctgaccgccgccgacgtggtcctgtgctcgctccccatgttccacatctactcgctcaacaccatcctgatgtgcgggctgcgcgtgggcgccgccatcgtggtggtgcgccgcttcgacctgcgcaggatgatggagctggtggagcgccaccggatcaccgtcgccccgctggtgccgcccatcgtggtcgccgtggccaagagcgacgaggcggcggcgcacgacctgtcgtccgtccggatggtgctctccggcgccgcgcccatggggaaggacatcgaggacgcgttcgtggccaagctccccggcgccgtgctcggacaggtcattttcagaggtacgtactggttcagattctggagacttctacagaaggaggaatcacatcaacaaatcctcgatgtctgtcaagcgttggaagtggtggcgatggaagtctttgcaaatcatggatggcgctcaaatgcaagaattgaggatgcctagagttacctacattctagtgattttgcttctttaagttagtttcattatctatgcaacgtttctcggatgtaataattgtcttgtgtgggctgtacgcattaccatgctaaagccggaactcttgtttccataatcaaaaaaaaaaaagttcggttgtctc

SEQ ID NO: 11794 - DNA, 2000 bp, Zea mays
cttgtgtggtgatgcttgtgactcgtgttttaaattgctgtaaaagttctcgcacttgacgtgaagatcagccttctgttaatagaaattgtttcattcaggaagcatcttgtggaaactttttttttgtaaaacgacccttatttatttctaacattgatcaataagattttaagatcagctttccgctaatagaaattgtttaattaaggaagcatcttgtgggtatcatatttttggtaaaagaaattcttctctttgtttctaacattgacccattggtcttatatgcaaagaaatcttgacaaaagctattgagcaacatggttttcttttccaaattggaggttttgagactgtaaccagatttaagatgtgtctacaacatggttgttgccttctttttgtcctttattttgaatttgacagtggtgctgatatatcatgcttgcacaagtacctgctgtactcctttgtattcacattatgaaatgatgggcaagaagttacacttcccaacatgtacttctattcataaattgtattgttttttctagtgatgtttggaaatggatgtctgcatatcataattgcacagttgtacttgagtacaatgttttctcttttttttggaagattcaagtcggtggactgataagtacaatagaaacaacaatatcttctgtttagtgtgacaaaacaaatgtatcaacatatagaattgcttgaagtgataactgtacgtgagttccaatgtagagtattatgctatctctgttccatgctttatcacagtagtcagttagagctgtgttatatttttcagacttatgttcattatatgtttgcttgtttaggtatctgactatgcaagagaccttgaagagatgcagatgatatccaaggaggattatctcgtgtctcttaggagaaagagcagtgccttctacagggggttaccaaaatatcgtgggcttcttaggcaacttcataattccagatgggatacatctttgggactcggtaatgactacatgagccttagttgtggcaaggatatcatgttggatgggaaatttgcaggaagctttggtctagagaggaaaattgatcttacaaattacatccggtggtggctaccaaagaagacaaggcagtcagatacatctaaaacagaagaaattgctgatgaaattcgagctattgaaagttcaatgcaacagactgaaccctataagttgccttctcttggcttcagttctccatcaaagccctcttcaatgggcttatcagcatgcagcatattatctcagtctgatgcctttaaaagcttcttggagaagtctacaaaattatctgaagaatgtagtcttagcaaagaaattgttgaaggaaagactgttgcctcggtacctgctactggatatgatacaggggcaattaatattaacatgaatgagttgctagtacaaagatctacttactcaatggcccctgttatgcctacaccaatgaagagtacctggagccctgctgatccttccgtggatccacttttttggagcaactttgttttgccatcgagtcaacctgttacaatggcgacaataacaacaacaacgtttgcaaagaatgaggtaagttcaagtgatccattccagagccaagagtgactgcacgagcttactgaagcaggatattttagattggtcaaagacagcatcccgtgcgtcaactagattctttttgtcaagcttttgatgtcgcaacttgtgagcaatactccttgtttatccatacttcataggacatgaatagaaggtatgacaagtgcaagcatagttatgtaatatacagtggctagttgccagaaaatgagatttagttgtgtagagctgtttgtacatattgagatggttgtttcagttcaatctcaacaggtttgaggaaaatatccaacgaaatgatacagttttaatgctaaattagttattttgtac

SEQ ID NO: 11795 - DNA, 1647 bp, Zea mays
aaaacggtcacccgttctacgcttggcttggctgcgctgcgcacaccgaacccctcgccgtcgcggctcgcctcggctccgccccgaccgaccgatcgatccggccggcggtgggcgccatggcctcccccaaccccgaggccgcggggctgcaggccgtggctgtggcgggggcaggggagggcggctcgtcctcgtcgctcagcgccgttgcgggagcggctgcgttgtccggggagctggtgcccaggagggcgttggcgctgcgcaaggagcgcgtgtgcacggccaaggagcgcatcagccgcatgcctccctgtgcggcggggaagcggagctccatctaccgcggggtcacccggcataggtggacaggtcgatatgaggctcacctttgggacaaaagcacgtggaatcagaatcagaacaaaaagggcaaacaggtatatctaggtgcatatgatgatgaagaggctgcagcaagggcctatgaccttgctgcattaaaatactggggagctggaacacaaataaatttcccagtatctgactatgcaagagaccttgaagagatgcagatgatatccaaggaggattatctcgtgtctcttaggagaaagagcagtgccttctacagggggttaccaaaatatcgtgggcttcttaggcaacttcataattccagatgggatacatctttgggactcggcaatgactacatgagccttagttgtggcaaggatatcatgttggatgggaaatttgcaggaagctttggtctagagaggaaaattgatcttacaaattacatccggtggtggctaccaaagaagacaaggcagtcagatacatctaaaacagaagaaattgctgatgaaattcgagctattgaaagttcaatgcaacagactgaaccctataagttgccttctcttggcttcagttctccatcaaagccctcttcaatgggcttatcagcatgcagcatattatctcagtctgatgcctttaaaagcttcttggagaagtctacaaaattatctgaagaatgtagtcttagcaaagaaattgttgaaggaaagactgttgcctcggtacctgctactggatatgatacaggggcaattaatattaacatgaatgagttgctagtacaaagatctacttactcaatggcccctgttatgcctacaccaatgaagagtacctggagccctgctgatccttccgtggatccacttttttggagcaactttgttttgccatcgagtcaacctgttacaatggcgacaataacaacaacaacgtttgcaaagaatgaggtaagttcaagtgatccattccagagccaagagtgactgcacgagcttactgaagcaggatattttagattggtcaaagacagcatcccgtgcgtcaactagattctttttgtcaagcttttgatgtcgcaacttgtgagcaatactccttgtttatccatacttcataggacatgaatagaaggtatgacaagtgcaagcatagttatgtaatatacagtggctagttgccagaaaatgagatttagttgtgtagagctgtttgtacatattgagatggttgtttcagttcaatctcaacaggtttgaggaaaatatccaacgg

SEQ ID NO: 11796 - DNA, 1597 bp, Zea mays
cgagcggccgcccgggtgctcgtccttcctgctgccgctctacccgaagccaccacgccgcggcggcgacgactggccgcagaattccacgttattcccgcacccgctcgccggcaacctcttcccggaagggctatactacaccgctatctccttgggcagtcctccaaggccttattttcttgacgtcgacactgggagccacacaacatgggtccagtgcgacgcgccgccatgcgcgagctgtgcaaagggagctcaccctttatataggcccgcaaggacggcggatgcacttcctgccagcgacccactttgtgaaggagcccagcatgagaacccaaaccagtgcgactatgagatcagctatgccgacggaagctcctccatgggcgtttatgtaagggacagtatgcaattcgtcggtaaagatggtgaaagggagaatgcagacattgtgtttgggtgcgggtacgaccagcagggagttcttttgaacgcactagaaaccaccgatggagttctcggcctgaccaacaaggcactgagccttcctacacagctagccagccgaggtatcatttccaatgcgttcggccactgcatgtcgacagatcccagcggtgctggtggttacttgtttcttggcgacgattacattcccaggtggggaatgacttgggtccctatccgcgatggtccagcagatgatgtacgcagagcccaagtcaagcagataaaccatggggatcagcagctcaatgcgcgagggaagttgactcaagtggtctttgacactgggtccacatacacatatttcccagacgaggcgcttacaagattgatatcttcgctgaaggaggctgcatcatccccaagattcgtacaagatgactcggacaaaacacttcctttctgcatgaaatctgattttccagtgaggtctgtggaggatgtgaagcattttttcaagcccttgagtctgcaattcgggaaacggtttttcttctccaggaccttcaacatccgccccgaagattacttggtcatcagtgacaagggcaatgtctgcctcggcgtgctcaatgggacaacgatcggttacgattcagaagtaatagtcggagatgtttctcttcgtgggaaattggttgcttacgacaatgataagaatgaggtcgggtgggttgatttcgactgcaccaaccctcgcaaacgaagcaggattccttccttcctgcgacgagcgttgcgcaaccaacttctgtaaatactggctactgtgaaactggctatgcttgttcttacagacgtgctattccgcgtctgaattctgaaactgccatggaaccctcctataatcgtcgctgtaatcgtgtggagggatgtaactacgaggtagtaaaaaagcggttacaggacaggaaatagtggaaaggtagataagcatagatagtatatagtcaaaagaggtcatgtttgctatgttgtagagatctctcactttttaagactaaagtggggaagcataatccatagcagttcatttaaccataaaaaaaaaaaaaatataaaaaagggcgcccgcgctctagag

SEQ ID NO: 11797 - DNA, 1490 bp, Zea mays
gttctcaatccaatctcactttttgttcccacaataaacaatagaggtttcaatttccatacaccacatcgttcacatctatcaaatatgccatatagaaaaataaatagtattatgaaagactgtacattacagtgcatacaacggttaataatgatgccgcagtaagaacaagaatgaatttacattaaattggtatattctcggatcacactcggtttaatacaaagcacaaggtttcgggtgtaacgaactttgggtgacactgacacccaaactggccacgggaggcagaagcccaggcttaacctttgtgactcagtatgatgcccaagaaaacgaaacagatacgtatggtcagtagtcgtgagcaactactggggatgtggttgtcagccactattgctgttgctgcgacactggctcatgctgcggggtggcgggggagtctggagcgatggcaaactggagggcgcggcccctggccgactgtaggatgaaggccacctctgcagccgccagtgcagcctcttcctgtctttgtcgacggcgatgcaaaatactgaatatccatgccatgatgtagcacggcagcagaaacccagcagctcgaagcagaaaaagcgagaatatggtagaagcgtcatcatcgtttccttcgttgtctgacatagacaatgcatgccttagaagcaacagtgccattaaaataagcgcagctgaacggcagaatgcagcaccactagcatctgtactagcgtaaccatcatactctgcctcaagaagacgatgttgggcagctgctacagcaagaatccttgggtctcgcaaatccataaccaaatcaccatcaatgtctatggttgtctcatctggctgaacacgaggtggcgcagtgtaacctggcttgtattcctcatgacaaatttcacaagtagtgtctcctttctcgttgcaccagcgttgcacgcaagctctgtgagcatacttgagactgccgctgcaagcacacggtttctcgaggttcttcacgctatcttcctcctggcatatgcggcactccgcggcctggattagcggctcctcctccccatcaccctcctcctcctcctcctcctggaccaagtcaacagctgctgacaaagatgcagcagccggagccgaaccatttgcatcctcagacagcttcttggaacccccgtcatccttggattttgctaagccgttcacgtcaaccaccacatggtcgtcaccagccatcccaaatccctcctccctctgcagcgcttgttgccgcctctgcacgcaggaaccgatctcctcaccgacggcgacttcagcggcggccctccctctcttccccttcccgtcgggtcgtcgcacggcttggagactacaaattccgagctttttttttggttccttctctctccttccagctctggttttttttcccccccccggcctcgaggctacagccacccccggcc

SEQ ID NO: 11798 - DNA, 1546 bp, Zea mays
agcgttgttaaaaccagtgccattagccatcctagccttcaccctcgcggagaagaagaaagaaaccacctcacctcaagaacagctagctgcaaggataaaaaaaaacaaagctgctgatctatatataataattaggctttgcagtgtcttgttttggagagcaaaggatcatcgtcaagtgatggccaagtcaggggcgctagaacttgctcggagcaccggagggtcgcttagcaaggaccaagtcaaatccgccgttgatcagtatgtcaaataccacgacctccatggaggcaaacaagaatcaaggaagtcaaattacaccgatttggcaaacaagtactatgatcttgtcactggcttttacgaatatggatggggcgactcattccatcttgctggcggatatccgggtgagacttcccgtgaagccattaagcggcaccagcattttttggcactacaattggggctcaagaagggtatgaaggttttggatgtgggatgtggaattgggggacctttaatagaaatcgccagattcagctcaacatcgataactggactgaacaacaatgactaccacatctcaaggggcaaggagctcattttttcagcaggtttgagtgagcaatgctgcttcttgaagggggacttcatggacatgccaatatctgataacacctttgatgcggcctatgcaatacaggctacatgtcatgcaccagatgcacaaggcgtctatagtgaggtctaccgtgtgctgaaacctgggcagtattttgcactggatgaatggtgcttgaccgaccgatttgatcccaacaacgccaagcatttggccatcaaggctgagattgagctcggtgatggcctacctgacatccgtaccactcgccaatgtgtccaagctatgaaagatgcaggatttgaggtcgtttttgcaaaggatcttgctcaagtttttccttgcccgtggtaccgggtgatggatcccacctacttttcatgggctcacttccaatgcacacgcccaggacggatcgtcacccgtgcaattgtcaatacactagagttcctccgtattgccccagcaggcagcatgggagcctacaacgtcctgatgagtgcctctgatggccttctaaaaggtggccgggaaggtatcttcacagcgaccttcttcgtcctgggccgcaagcctctcaaggaagttgatatagtaagcctctcaagaaagttgatatagtgaacggcggcgtcctttgagctgcaagattagtatggggctgtactcataagagctatgaatcatggccaacgtgttctgtgccgaggtgtgtttactggattgtcttatgggttatggcccttgcgctgtgtgctggcctgctgggtcatgttcccgcagtagcctgtatctgcttgtcagcttgtgtgctgtgtactatgcactatctgaataaaaatgcagttttacgcattgttattaaaaaaaaaaaaaaaaaaaaaaaaaaaaaaaaaacaaaaaaaaaaaaaaaaa

SEQ ID NO: 11799 - DNA, 1284 bp, Zea mays
  misc_feature (59)..(59): n is a, c, g, or t
  misc_feature (72)..(72): n is a, c, g, or t
  misc_feature (107)..(107): n is a, c, g, or t
  misc_feature (117)..(117): n is a, c, g, or t
  misc_feature (122)..(122): n is a, c, g, or t
  misc_feature (302)..(302): n is a, c, g, or t
ttttttttttttttagaccagaatgatttcattaattggaaattctcggatcacatcgnttttaatcaaagncaaggtttcgggtgtaagacttttgggtgacactncaccccaaantgccnaggaggcagaagcccaggcttacctttgtgactcagtatgatgcccaagaaaacgaaacagatacgtatggtcagtagtcgtgagcaaactactgggaatgtggttgtcagccactattgctgttgctgcgacactggctcatgctgcggggtgcgggggagtctggagcgatggcaaantggagggcgcggcccctggccgactgtaggatgaaggccacctctgcagccgccagtgcagcctcttcctgtctttgtcgacggcgatgcaaaatactgaatatccatgccatgatgtagcacggcagcagaaacccagcagctcgaagcagaaaaagcgagaatatggtagaagcgtcatcatcgtttccttcgttgtctgacatagacaatgcatgccttagaagcaacagtgccattaaaataagcgcagctgaacggcagaatgcagcaccactagcatctgtactagcgtaaccatcatactctgcctcaagaagacgatgttgggcagctgctacagcgagaattcttgggtctcgcaaatccataatcaaatcaccgtcaatgtctatggttgtctcatctggctgaacacgaggtggcgcagtgtaacctggcttgtattcctcacgacaaatttcacaagtagtgtctcctttctcattgcaccagcgttgcacgcaagctctgtgagcatacttgagactgccgctgcaagcacacggtttctcgaggttcttcacgctatcttcctcctggcatatgcggcactccgcggcctggattagcggctcctcctcctcctcctggaccaagtcaacagctgctgacaaagatgcagcagctggagccgaaccatttgcatcctcagacagcttcttggaacccccgtcatccttggattttgctaagccgttcacgtcaaccaccacatggtcgtcaccggccatcccaaatccctcctccctctgcagcgctcgttgccgcctctgcacgcaggaaccgatctcctcaccgacggcgacttcagcggcggccctccctctcttccccttcccgtcgggtcgtcgcacggcttggagactacaaattccgagcttttttttttggttccttctctctccttccagctctggtttttggcccggccggcctcgag

SEQ ID NO: 11800 - DNA, 1099 bp, Zea mays
aattcggcacgaggattttacgactctcgtgttgtgggtaaatattgtgaaaagcgggatcctacacttgctgttgttgcttacagtcggcgccagggggccgtggggcggggtggcgtcactaacaagaattcgttattcaagctgcaagctaggtatgtggttgagagaatggatggtgatctgtgggataaagttcttcagcccgagaatgaatatagaaggcaactcattgaccaagtggtttcgactgcattacctgagagcaagagccctgagcaagtgtctgctgctgttaaggctttcatgactgctgacctgccacatgaactgattgagcttcttgaaaagattgttcttcagaattctgctttcagtggaaatttcaatctgcagaacctgctcatcttgactgctatcaaggcagatccatccagagtcatggactatgtcaacagacttgataactttgatgggcctgctgttggagaagttgctgttgaagcacaactgtatgaggaggcttttgctatattcaagaagttcaacttaaatgtgcaggctgtcgatgttctcttggacaacatccggagcatagaaagagctgaggaatttgctttccgtgttgaagaagatgctgtttggagccaggttgccaaagcccagttacgtgaaggtctggtcagtgaagcaattgagtccttcattcgtgcagatgatgctgcacacttccttgatgtcatccgtgcagccgaggaagctaatgtgtacaatgatttagtgaagtaccttctgatggtaaggcaaaaggcacgggaacccaaagtcgatggagaactcatttttgcatatgctaagattgacaggctcagtgatattgaggaattcattcttatgccaaacgttgccaaccttcaaaatgttggtgaccgtctgtatgacgaagaactatatgaagctgcaaaaatcatctatgctttcatctcaaactgggctaagctggctgttaccctggttaagctgaagcagtttcaaggtgctgtgggatgctgctcgcaggctaacagtgccaaaacatggaaggaggtctgctttgctt

SEQ ID NO: 11801 - DNA, 808 bp, Zea mays
  misc_feature (779)..(779): n is a, c, g, or t
gctaagcctgacccgcccggggctagctatactacatatatatacatataacaagcctgatttcctaattaagccttggacggatccaatattttagctagctagcaagcaaagcaagccttgaacttttgagcggcggctagcgcaatgggaggcgtggcgtcggagctggtgggagccagcagggagaggcagagcaggaagaggaagcagttccacacggtggagctcaaggtcaggatggactgcgacggctgcgagctcaaggtcaggaacacccttgcccgcatgagaggggtggagtcggtggagatcaaccggaagcagcagaaggtgacggtgaaggggttcgtggaggcgcagcgggtgctgaggcgcgcccagtccacggggaagcgcgtcgagctgtggccctacgtgccctacaccaacctctacgtcgcgccgccggtgtacgacaagagggcgccgccgggccacgtccgcagggtcgacgcactcatcgcgcccgccgccggccaggaagagcacctcgccacgctcttcagcgacgataaccccaacgcctgctcccttatgtgattcctcatgctagagccgcccgcctgctccccggccttattatgcgatgctagctgcttgcttcatccacgctgtacctctactagcgatgtcatgctccgtagttacgcagtaatataataatctgtatcttttaattaattaaaccacagtacgtaaatgactttcagatcgaaacgactcccccttttctatanaatacgcagggtatatatctttgggcagc

SEQ ID NO: 11802 - DNA, 9345 bp, Zea mays
cagcttttcaaggtccactagagtgttatactatcatagtgtcacgtagcatgaccacggtgtatccatcttccaccaggaaacaataaatagcaaaaagccaaattatatagctcagaaattttcaaaagcaattaagaaaaaatccaactgtttagttcatgtcaatatcgtaagagactagtacactaaaaataatagacaacttaatccattcatgttattatccctacaccattaacacttaacaaggaacttggttaaaaaacagtatctggatttcgttagcacactcacagaggatcaattgaattgtctacggttccgggcctgcagttagacaaaattaatctataatgcttcataatcaaacaataccacaaagggattatttggttagatttatcaaataattcacaaatcactaattggtcataagagagtcatgcagtaggcaagctaaacctataggatatctgatcaaaatagatcaatttggagttgacatgcctaagttccaagaaaactcacttatccgacggaagacaaacaaataacacatacaaacaggatacaggcaaatcttatctgccaattccagacatagcataaccaaggcacgatagaaacattgtacttctgaacacagataaatacagaggtgcattagaacagaggatacagcaagtggaagaatactgtactgctaactagacctccatcttttgatagagatattggtcttaaggtgtccaaatgaatttctggtctaaaattgatactaaagatgattgcaaaataatttgtgatactccacatcatctaaatgtttgagatgttagattaccatatcaggagttcaggagtcaggaccatacatgacctctctttttaatcttgcgaaagtcaggatcaaaaggggcaaagagatcccaccaggccacaacaactttaatgatggctgaggacaacatgcaatgacctcgttgcaagaaaaatatagtagattataaatgtctaactagataattaaacaatcaccacaaaggacaatagtataagtactagttggttaaactattgaaagattatgacaaccatgtctttaggtaatttacaatcaaagtaatcctcacaataacacaaaagatgttctctagttggccgccattatcataattgatacactgttatttccaatttactatatttgacatcttttaagaacgaaaacatctgatcatatcggagttctgaactaagcacataactagactgcctatcatggttttcaaagcggtatggctatacaaagcgttggactgccgcttggacgcctaggcgagataggcgagcaaggcgttgggccaccgcctggacgcctaggcgacgcctttaaaacagtgctgccaatcacaaaggtatgagaacacatttcatcctgatctgagtatcaattcaatcagctacaatgatattctagtgtaagatggtattggtaatacaaccttgttaccttgccaaatcaccaatgaacccaaaacacagttcaatagtaaaagggaagcagcaataaagaattgtggttgtagccaatttattaacaaacaggatatcggtatggagctggttcatttaaaaggaagatactacattttaccaattggttcggcttgctgttgttttttttcattggaatagaaatgtctcgaacaatcatattttaatctcccctctcccgtgtacaatcaccaaaactaagcataatccaacatccaaaagcaccaaaatatctttagttcgaagtctacttgcctattagcagtgcatttttattccttttgatactgaaaactaagtatccttccggcagaggtctgaacttaaaatcatctaataaacaccgcagcaactgacgcgacagacactcccagagcgcaagagatggccatcacccgtgtccggagcagcatgaggttaacgttcttcgtagcctggaggcacaacgtgagcacctgcagcctcgcgttggcctccatcttctggaagaaggcgatgggcttgatggcgcggcgtagcaccagggcgaccgcgaaggggaacgcgaacgccgccactccctgcactgccgcggcggatccgacaccgagaggcggagcaccgtaagatatccacgcgccggcggcgaggtgcgctcctccgaggagcgcgagcgagccgctgaggcgctgcacggtgcggcggagcgcgtcgagctcccgccgcgtctcgtcggccagcggcgacgtatcgcgctccaccgtggggccctcgatctcctggtgccgcatctcatccggcgacgcgggcgcggatggggcgccttggctgggctctgatgtcgtggaggaggggttggggctggggtttgagggcgcggagaagaagcggcggccgggattcaggaggatgaaggggtcgcggccatgggtgaatgttttaggtatggggaagtgcgcggcggcgacagccgttgggctcaggaggcggtgggagaggcgcgagagcgccatcggaggcggagcctgcaacaacgctgcaagcctgacgaggaaaggtcgcggcggcggcggctcgcctgtttcggatttctgaaaagttgtctcccgtttccccagtcaagagtcaaggcgtaatctgggaatacgtttgctcccctcgtatgcggtaagacgttgaactcggagtaaagttttgctagcacactgcatacgtggcatcacaaggaaaacgctgtactagggtagggacacgctcgccggcaggttcgggctgcctcccgccacaatccagcggctgccgcacggctcggcctcggtcctacagctacaagaaccatctcccccccccgcccgggcccgtcactcactcactccccccattcctacctttcttctcctccacctcgtcaggcaccctcaaaccctcgccgcaagaaagaagaggtcaatcaaatcgaaccaaaacctcccgaccccacaaggccaagctcatttccatggtggtgtacacgcaggaacatgtgtaccggcacccgtgggaccgggtgacagcggcggcgtggcgcaagttcacggatccggcctcctgtacggcgctctcccacgtcgcagacgttcacaccctacaccgccgcctcgactccgacacgggccgcctccaggccgcgcgctccatcaccgtgcggtccccgccgctccctttcgtcctgcgccgactcctcccgtccgccgcggcgtccccaaacggcgccgcgctctgccactgcgtcgagacctcgctcgtggacgcccagcgccgcgccatggacgtcgtcgtgcgcaacgtcagcctccggggcctcatcgaggtcgaggagcgcgcctcctacagaccacatccggaccggcccgacgactggacgcagttcaggcaggagaccacgatccggtgccgcccgctcgcggccctcgccgccgtcgctgagaaggtcgagacccggtgcgccgagaggtttctgcagaatagcgccaaggggagggaggtcgtcgagcggatctgccggtacctcgaggccgagtccgccggcgccgcgccctccgtaacctgatctcgtttgcacatctttgcttgatccgaacggatccaagggttcctcgatctgtgctgtgtgcgcccggataaatcgaaccccgcctgctaggcgcttgcttttcttcattttttgtgtgtgaaatgatgagctgaattcggaatagaataaagcttctggtcatacttgtttcttctgttgtaagtatgtggaaccgctttaacctccctgattttgatcatgagccttgccaaattctaatttgctaataaatttaaatgctatgaaatcactgatgtttgttgtgttattttgattgactgaatggttgctcatgctttgattgactagatttagtggtgttctcattcacagaaaagggtgaggtcattgatctgttgttctttaagctggtagcagattgtccccttggttgattggtaagaatagtatgacatcgtgaagtaaaatactttccatatctagtctattctagcaatgtgtcattcttgaagctgggcaggtagtgtttaatggtagataccccatagctttttgtcgtacacttcgctaatacttttatctgtggaaccattttgataatctccccttccaactctttgtgcttgctcttgcaaatttgagatattacataagttatacatatcggtgctttaatctattcaaggcatgtccagataaatcagaaagtgaaccgatgtgtcattcttgaagctgggcacagtatttctgtctcctttgtacatttggtttattggtaagaatggcatgacatatattgtggatagcattgctttctgatattacaagtctatactctatagttgtaatatatatatgagcttctccatggttttctaagtcatgtatctactaattatcataagcttatccttttcttgcttactggagcggtggatccttggggttatgaacttagatattgtaggctgcttgtgcttgtactgttgtggatgagtagttaggttccatgacttcgattagtctgctcagttggcataaattgagaattgatggaagccactaagctagtcatagctcaagtaactataataacaccacctccaactaatctattatgtgatgctcttaatttcgaacaaatttcatttgctttgtgttttcaatcatgtgaagtctttagtaagtatggaatgtccctcacggcatggattccactttgatgctgtgtcttgcaaccacatttgtacatcgtagaccaagctactgcatccctgcaagtatgatgtatccttacctgaattggattcttgctgtatattttactctgaagatactttttaaatgttcttattcaccatctttcagagcatagttctttaatctttactattccctccattccaaatcataaggtttctttgctgtgcacttaggtatatactatgtctaaatacataatgctgcacttcctgtgcttttcagctatatctgttgctgcatgctgcttaaaatttgaaccgttgaaatctgctgcatagaatctgaactgtgcatgcagcagcagctgcacctgcacctgcagcacaaaatgtgcagccgatcaggctgggttcagaagccaaagcgtcttatattttggaaaggaagtatggagtacgaagtaacaatgtggttgtgggcaactgctagttcagaagtctggaatggtttaggctaatgttattcatttggtaggaagttgtgaaacaaaacgtgctggcttcttaccactgtagtcaactggtggttctcacttgtttgttccctctgaacttcatggccgcaacatctttcagactatgaaatctgtgtggtctatgcttgttcagaatttctcttagtaggcatatttgaccgtggctacaaattttcacgagggcgtggtccgaaattcagaacgctgcttcattatcacatggactgcggtttgttttcgcactgacatgatttgacattgttattaacatttgtgaactggttttgtgcgataaacagctgtaaaataaagtaatttctgtggttgtaaattgtactaccttctcgaatatctgtcgcccgccgttagttcatatttgtcaatgctgcctttggcttgggcggagggaggctccccgcttcctggtgtctgcagatgtaatcagggtattgcctgatgctctctggtatccgccgatgtgatcatgagcttatcaatcaccttttattttctgattctgaaaacttgatacttgaagccgatatattattcagtagtcgttttgtctgtcgaatgttatcagtccctgcaaggatcacaccacgctgcgctctctgactgttttggcttcggcggagttgcggttcggttagtcagtttgcatagttcctcgttgcagatgatcgtagtttacaaaattctggtcgtgttcgtgttagttgttgtgccgctcttgctcggttgatggcaagatggcagctatatgtggaactgaactgccctgtcaaatcaaagccaaactgaatcaccaccaacaagcagctgaagccaacgtctcaactgggactgggacagcctaccctttactgataatagcacgcaagtcaagtagtcaccataactttttttttgagaatcaagtagtcaacataattgttgggactaggagtctctctaggagactaggagaggcgattcggataaataaatgactaaaaataggagtagagggcctacctagatgggcctaattattacacatgggctggccatgtatgtgcgcggggtggcccggaacattaggtagccctaactcgcgccgctataaaatggcgactctggcgatcagggtttatctcgactccgcaacctccctctagcccgagcgaagaagaaaggagggtgctctgccggcggcggagcggagatgtccgagaggaggcgcggcgccggcgccggcaccggcacccgcaaggatgaggtggtgacccgcgagtacaccatcaacctccacaagcgcctccacggatggtactaccaccaactttctcttccatttcccaagcttattagatccacgtgttggggagcatagtgttgttctatagccgcgtcgggcttacacatcagatgctggtgcggagggttgcggcctgtgagcactatgtgggcttgcgaatggtcgatacacctgatcggatgcattatcttttaccagctagactacagtcgggatcacctgaccgagcgggaatagcgtgtagttgatcttgctcttgtatctgatcccacattcatctcgcgtttgtcttgttgtttgcctttgtgagtggtggcagtagttgcattttgttctgtgggcgccgttcgattaggtgctactcgggtatagtcaggtgcctgccttatttcattggctgaacacagttacatgcccggtatatacaatctgctcatcgttacacgtattgcctcataatgctactatgtgttccatttgggcagtatattttcctcccataatacacattgtatttgtagttgcatcgtatttttttgaaggtgtttctctgatacagtaatatcttttgtattgtccggttatagtcaggtatctgtcttatacaatctcgtggttgatacagttacatgaccggtacacagatgtcgctcatcgttacacatgttgcctcgacatgctgtcatgtgttccatttgagtgctacatgcacattgcagaagtacaatatcatgatgttccattctgttaaatctcttttgaacacgcaaaattatattgtatacagcactaaccatgcttcagttgatcttgtcagtttagtcaacactaattaatctacaattgtatgcagcaccttcaagaagaaggcaccgaatgccatcaaggagatcaggaagttcgcccagaagaccatgggtaccaccgatgtccggatcgatgtgaagctcaacaagcacgtctggagcagcggtatccggagtgtgccgaggcgagtccgtgtcaggattgcccgcaagaggaacgacgaggaagacgccaaggaggggcagtactctctggtcacagtagctgagatccctccggagggtctcaaaggtttgggaactaaggttgttgaggatgaggattaagtcgaagggttcaatcatctagcacttaaatgcataccatgagagcaagtttgataatgctgcttcagcttgttatctatgccggatgacgtgtgatagaagtttcgagacgttgctcctttcaagttttgaaattttgactatatgccatgccaagtctgtgttatctttacacattccgagcatctgtatttattatgctgagacagactcatcaatttttgcttgtacaacctgatatgactgatgtagccatgtgttttaagattttttgacgcatgaaagatcacttgtagccctgtctgtcacagctgccagtttgttcttgacagatcacttgtaagccctgtttgtcgcagcagctgctttttagagaagcaacttatcagagaagctggtgaaaaacattttagactatctgcagtggttcatcctaaatttctcaccctataatcacttttttgcgtcacaatattaacattttatcccctactttttttatctcctgtaatggtttcccctaaaatctctccctatatcccactacaactataaaatattaaatacgcgaacaatgtttagagtagcttgtggactgatgctggctgtggcgtactgacgttgcgttggcttctcccgcatagggagcctggcaatattattatctaatcctattcatcatctattaccatttttttcaattattaaatatgtgaacaatgtttagagtagcttgcggattgacgctagctgtggcgtactgacgttggcttcccccgcgtagggagcctggcagagagcgccgctgcggccatagcgggcgccctgtaggcaccatgcatgctacagggcaaggggagggagcctcgcgcggcaacccgtgtgactagccttatatgctttcagtttgttctatagagcatctaaactgataagttatcataaaaagcattcttgtttgatacaacttctgtttgtgaagttgaagataagatgtgccaaaccaaaccattattcgatacgagcaaatagtaatggcataacaggacacatgccaccccttttagcagttacagtagtacccctttatctgaagatagagtttgtggctcgcttgatttatggtcagctcgttatagttctttttacgagttgagcggatatcctagcttggctcggtgcgagtcagctcacaagctatcacatttcagcaaaataaaactatgtacttatcatttatgtaataattgatgaatatgttatatgtatgtgtgctgtctatgatctataaattaaaataatgattgatgaactgcgtttatatgttaaattggtctatatgaatataattgtggttaaattaatataattatatgtgtaaattttgaatttgatgagtgatgagttgtgttaatttggtggtacattaacgttgtatgtgaaattatgagtataattactattttctattgtttaattaatttgaattacctaaaaattgattattatatacttccttcactcttcaaatactaaatgtttaaggggtttcatttggatg

SEQ ID NO: 11803 - DNA, 969 bp, Zea mays
  misc_feature (12)..(12): n is a, c, g, or t
  misc_feature (34)..(34): n is a, c, g, or t
  misc_feature (105)..(105): n is a, c, g, or t
  misc_feature (108)..(108): n is a, c, g, or t
  misc_feature (125)..(125): n is a, c, g, or t
  misc_feature (136)..(136): n is a, c, g, or t
  misc_feature (149)..(149): n is a, c, g, or t
  misc_feature (180)..(180): n is a, c, g, or t
  misc_feature (190)..(190): n is a, c, g, or t
  misc_feature (211)..(211): n is a, c, g, or t
  misc_feature (233)..(233): n is a, c, g, or t
  misc_feature (252)..(252): n is a, c, g, or t
  misc_feature (260)..(260): n is a, c, g, or t
  misc_feature (281)..(281): n is a, c, g, or t
  misc_feature (304)..(304): n is a, c, g, or t
  misc_feature (329)..(329): n is a, c, g, or t
  misc_feature (340)..(340): n is a, c, g, or t
  misc_feature (350)..(350): n is a, c, g, or t
  misc_feature (352)..(352): n is a, c, g, or t
  misc_feature (356)..(356): n is a, c, g, or t
  misc_feature (358)..(358): n is a, c, g, or t
  misc_feature (367)..(367): n is a, c, g, or t
  misc_feature (401)..(401): n is a, c, g, or t
  misc_feature (410)..(410): n is a, c, g, or t
  misc_feature (942)..(942): n is a, c, g, or t
ccaacgtgcganacatagcagcacagaacaacangcggaaagcctgagcgaaggaagtgcatgaccctaacgtctggggcacagagcaaaacttgaagaccacanacnggagattgacaaccganccagtactaanaacagactcagcnctagtctccctgccggcggaaagagcatccntccgttagcntcgcctttcctcccgtgggcnggcagaaaacagtttggcagcntgggcacacaacaacagtntgggagtngcttaaaaccgtggttattcngaagcatccctggcacttgacanccatgaagaaggagttgggggactngacgaggcgcntcttcttgtncnttancntctcgagcnctgccggcgggttgagaaggtcgatgtcgttctngagaaccancttgcctcgggcggcggcggaggagaattccttttaaacggcggcggtggtggtgctaaagaattgtggttgtagccaatttattaacaaacaggatatcggtatggagctggttcatttaaaaggaagatactacattttaccaattggttctacaagctgaagattaatatcattgtaatagaaatgtctcgaacaatcatattttaatctcccctctcccgtgtacaatcaccaaaactaagcataatccaacatccaaaagcaccaaaatatctttagttcgaagtctacttgcctattagcagtgcatttttattccttttgatactgaaaactaagtatccttccggcagaggtctgaacttaaaatcatctaataaacaccgcagcaactgacgcgacagacactcccagagcgcaagagatggccatcacccgtgtccggagcagcatgaggttaacgttcttcgtagcctggaggcacagcgtgagcacctgcagcctcgcgttggcctccatcttctggaanaaggcgatgggcttgatggcgcggcgt

SEQ ID NO: 11804 - DNA, 1390 bp, Zea mays
ttgcgttccgcgccgccgaacgaagaaccgaatgcccagtcctgaatcacgtcttcacccgtgctcgtgcgctgcgcccatcccttccgcctccacgctccccacgtgcaccgtgcaccgtgcacagcaccacacagccaggtccccatggcggcggcggcggcggttgcgtctgcgacgacggcggaagacgaagcgcgcctgctgcgcctggaggagcaggcggagcacggcggcggcggcgcctgggaatacctctgcctcgcccgccggctccgcgcccgccgccccgctcacgtcctccgcgtcggcctcgccctcctcaacaacgcctccgcgcgctccggccttgcctcagaacagtggacgctctacgagcaggtggccacggcggccatggattgccagcgtctcgatgtggcaaaggactgtattggagtcctttcaaaacaatttcctgggagcacacgggttgcccggctagaagctcgtctgtttgaagcaaaaggtgaatgggctgaagctgaaagagcctacgcgctaatcctggaaaacaatccatttgaccagattgtccacaagaggaaaattgctatcgcaaaagcacaaggtggtatgtcgatagtgattgattatctcaataagtatctggaattgtttatggctgatcatgatgcttggagagaacttgctgaaacatacagttccttacaaatgtacaagcaagctgccttttgttatgaggagctaatattagcccaaccaactattccactatatcatatagcctacgctgaggttctgtacactatgggtggcttggaaaatctccaaacagctaagaagtattatgcatcaacaatccagttaactggaggcaagaatacaagagccctctttggtgtatgtctgtgtacttcggcaatcaatcagttgacgaaaggaaggaataaagaggaagaggactcggagctgcagagcttggctgcagaggtactgctgaagaattacaagcagcaggctccatcaaaggcgccccttatcagcagcatgttgaagaacatgaaactcagctgataccaaccagctccacacattcagagtggcctgatttgatagatagttaagttaaattgatgtggcttaatatatgcttgtttttttatatataaaaaaattgtggcaccaacattgtgcaaggcttaaaagtagatgctcccaaggccatgggttgtacaacacctgcttgcttacctcgaaatatgcatggcttcttcagtggatgttctactatatagatcaacaaacccccgattgtacttgagcacaaacaaaattttgacccagtcgctggtgaagttgtacgtggtgattttcattggtacctgac

SEQ ID NO: 11805 - DNA, 1476 bp, Zea mays
gcacgagaccattacctagaacatcctaatcgaaacttggcctcaatccctgaagtgcctgccaccacgccgcgccgcgcccgcgatacaacgacttcctgcagtcctgcgctgcgcccctcctttccgcctccacgctgccgacgtccaccacacagcacggtcgagtcacccgatccctccatggcggcggcggtggcggcggtcgcggctgccacgacggcggaggacgaggcgcgcctgctgcgtctggaggagcaggcggagcacggcggcggcggcgcctgggactacctctgcctcgcccgccggctccgcgcccgccgccccgcccacgtcctccgcgtcggcctcgctctcctcaacaacgcctccgctcgctccggtctcgcctcagaacagtggacgctctacgagcaggtggccacggcggccatggattgccagcgtctcgatgtggcaaaggactgtattggagtcctttcaaagcaatttcctggcagcacccgggttgcccggctagaagctcttctgtttgaagcgaaaagtgaatgggctgaagctgaaagagcttacacgcaaatcctggaaatcaatccatttgaccagattgtccacaagaggaaaattgctattgcaaaagcacaaggcaatatgtcgctagcgattggttatctcaataagtatctggaattatttatggcagatcatgatgcctggagagaacttgctgaaacatatgtttccttacaaatgtacaagcaagctgccttttgttatgaggagctaatattatcccaaccaactattccactctatcatatagcctatgctgaggttctgtacactatgggtggcttggaaaatcttcagacagctaagaagtactatgcatcaacaatccagttgactggaggcaagaatacaagagccctctttggtgtatgtctgtgtacttcggcaatcaatcagttgaccaaaggaaggaataaagaggaagagggctcggagctgcagagattggctgcagaagtactgctgaataattacaagcagcaggctccatcaaaggcgccccttatcagcagcttgttgaagaacatgaaactcagctgataccaactagctctacacattcagaatgtcctgattcgatagatagttaagttaaattgatgtggcataatgcttgtttttttttgtggcactggcaccaacattgtgcaatggttaaaaagtaggtgctcccaaggccatgggttgtgtacactacacctgtttgcttgccgagaaatatgcatgacttctttttcattggatgttctattatagatcacaataaaccccggccattgtacttcagcacaaacaaaactttgaatcagtcgctggtgaagttgtacctgttgattttgattggtatctgactgttgtagccttgtagatgaatccctgactcggagcatttttttcttt

SEQ ID NO: 11806 - DNA, 3984 bp, Zea mays
cgccgagccgtgcatgatcttcacggcgagctcgaatcatcacgcccgatcaccggcggcgaggtgcactacatcttgtgatctttcacagttactgttcactcggaatactctattaaacctgcctcaccgagcaagtttaggagcatttttcttcgatttccatacggtgaactaccaattcgactataccaatgttgttcccctatttaccagctccaactttgtcataaggatcttgatcagttactccccggattaagcacaatttggctccaaagtcgataagaaaccactgatagtctggtttcagtgcaagacccgactgacagcccaacttctaggcaatttaccccactttctatatagttcttgggctaagtcacttgatcaaacttagactactatagtagctctacaactttgttgtggtgactcataacaaactcctcatagatcaagagatacagaggcttaaagttggcttgttgacactgttttcagagttcaaaaacaaggatgctcttggatctttttgcaatttactccaagtttcaccacaaaacttgaaaaccctcaaacatgaaagttgcttaacttttgttattctatcatcttgatgtatacacttttggctaaaagagcatagaacttgaaatcaccctataaagcactacttagggttttagggttccagattagggttttgagtgttctagggtacatgtagcacttaagctctccaagctaatatttcttgagcatttgtaccaacttgtcaagatcatcctttagtactcatctcacaaggccatatgtctctaatccttaaagagagatattctaacctagggtcaagaatcccttttaccaagtcagattatcacacaagcatcacgtcacttttttgttttgaaattttaacctagtggatgcatcataggtgtattatacataatgtaatttcaatgcatatgatgtcatgccaaagttttagttctcgtaaaactagacgtgttacatattttgttctttattaaaataaaatttattatattttatatatataaaccgtagcaatgcacgggtatatgactattagttaactaactattagacgaagactgtttgaaacctctggctaataggttgattgaacgaactagtttttcataggtcttttttgttgtcatcttttttcattaaaaaaaggttccacgctccaaacgtgtcccgtaaaaataaagatgcatacaaaattctcgaataatgatataaattgaactaaattagaaagataaacaggaaccttcaaggggagcgacggggtcggacgcgcctcaagtgaaaaggactgcacgttgaaatgataaaagagtaatactgtcttttgccaagggtctatttgttttatattataatttgtctagattacaataatccaacttaaataatctaagctcaaaacaaacacaattttataaggaattattcaccattatcactctttaaaaaatgtttcatttattttttcttgttatcatgtgtaacacatgactaaaatcaataatcaaaattttaataaaccagattgtcaaacaactacatccaaattatttaatccagaatatataatctaatttattaaattttatatataatcgaaacaaacagctccaagttttagctgattctagttaccctaccctaactaatagactaattgttagtttgcctatacctaacaattagctaattaaggctatattgtttagaatctctacgactaattttagctgctaacaattatttttagacgttctaaaaaccgtgtccttgtgaataagtatgtgtctccatctggaggtttattcgaatttagaagaatgtgaaaagaaaatcaaaaccagccgtcaaggttattagcttatttgtttggttttaatctgtatcgacttttaataatatagccgatacttctataatgttctacatctatagattgtagcagcagttttaacaactttaactgcttcacagccaaatacctcaattgtcgcgacgaccaccgccaccatgcatcttgcctggcgattagctgtattctccacctccagaaacggtggcgcattactcgcgaggtacgggtgttcccctcaagtaacgtcgagatggggcaacgtattctacatcacattcgccaattctatatgatactctttaataaggcattttcagcaggtttgcagaatttttggtgtcctgtttattgctgagcaaagataagcaacgacttattaaggataagattatctttggtagactctttatcccactttctatcttacttattttataaagttaactttaaaaataatgtaatatacagtgcaaaataatactttatacaactgtatactttatttacacgaccagctgaagatggcataaaggaagaaactaggtgatacctatgctgagaaatacatactcgaaattgctgttgtcggtacagatatgtagcgactttttgttgggtcattttattcagctacaaagtacgaactagctaggcgtgtttaatttgtccatgaaaccccagctaaaaaagacaggcaccgcgcaaaatgggaaattgcgggcccagatatgaactatgctgttgatatgacttaaagtctagatttcgacgtctgaacaaacgaaatggatcaaaagctaagctgcagctgcagcccctgtaagaattccatataatatgctacacagctgaaaagtaattaggaacaacaagaacagtttcttctgtcaatgaaatttcttgcttagtaatcaaggaacgaaatcaagcagcaaataaactttttgtacaaacataaaaattgttccagctaattttaaatttaaccaagtttataaaaaaatagtaattaacacttatcatactaaataaacattattagaaaaccatataatataagacttggagggtaggaattttttttttttttttagtcctctaaaatctgttcttgttaaccatgtaaaactttgctcagaatacagtaaaaaaagagcgatatgcatgtgaggggtcactcacagacaaaataaattacaccaaaaataaaataacactacttcacaaacttaagtaatatattctatatataacacgtttctagcacttataaaatagcaaaacgaagcaccttaattaactcgcctatcggctgcaggtagccaggtactctctacagaacacgaagaagaacgagcaagggcagatggaaaagcaccgcgactgtgactgtccaccgggcgtccatggcaggtgaggacgccgacgtcgtcgaccccgtgatcgggttggtgcgctggtagtaccacgggaaccacgggaggacggggttcggcggcggcggggctggcccagaggggaatccactgtacggtggggagaagcccgcgggcatcgctcccggcggggtcagctggaagctccctggcggaggtggcggatagctgccgccgaggccgccgccgcctccagtggacggttgcggtggcgggtagccgttgatggctcctgcagcggatggcggcggcaggcacgggtatgggcagtccggcgtgtctgccgacgccgtgccgctgatcagcacggtgattaggaaggagaggatggggggcagctggaagcgtctagacatggctgtgcacaaggagggagagagcaagagaccgaatgaggtggtggccgcccgagtaataggtgtccgaaattgatagtaggagtcggtggtcacaccgtacccgtggccttcgcgtattggcacatttggcgctaatgagtaatggacgggtgtgttgagcatgaacaaatgaaccaatcattcacttccaatcagagagttcgagcgaccttgtacaaattgtggtttgcgctgcgccaactaaaggactatgtattactataccact

SEQ ID NO: 11807 - DNA, 1817 bp, Zea mays
gggaccttgaggcggcggggaatgaacgagtattttgagtcaactcacaagggtagttcaaagtccagaattccagactcgcgttcgcacgccgcctttcgcgctgccttagcgccttagcctgctagggctcgtcgattcatcgccggctcgacttctgatctcgcgggcagagcagcgcgccggcgcgatggcttcggatccggatgtgtccggcggcgagcaggcggagccgcccgacgatgtggacgaccccgacgtcgacgaggtcgaccccaccggccgctacttcaggtacaaggaggtcgtgggatcaggggccttcaagacagtctacaaaggtttcgacgtggtcgaaggcatcgaggtggcatgggctaaagtggagataaacggccggaccatgggatcccccaaggagctccagcggctcaagacggagatccagctgctgcggtcgctccatcacaagcacattctcaagctctacacctcatgggtcgacaacaagaagagggcggtcaatataatcactgagcttttcacgtccggcaacttgagagagtaccgtacgaagcacaagaaagttgacatgaaggcaatgaggcgatgggccaaacaaatactgacagggctagcctatctgcacagtcagaagccaccaatcatacacagggacttgaagtgtgacaacattttcatcaatgggaaccatgggaaagttaagattggagacttcggtttggcaatggtaatgcagcagaggaaaacacagagtatacaaggcaccttagagttcatggcaccagagctgtttggtgaaaactacaacgagttggtggatatatactctttcggcatgtgcatgcttgagatggtgactggtgagtgcccttacagtgaatgtcagggctttgttcagatatacaagaagatatctgaaggtgtaaaaccagttgctctctccaaggtcaaagatgcagaagtaaggagtttcatagagagctgcctagcttcagctgctgatagattgccagcaagtgagctcttgaagagcccttttctcatgaaagatgacatcatcatcaatgataaaacctctaatcctgtgcaagaacctatagcattcccgccaaatttggatctggatcttgaagccacaccaatttttgtatctttgctaccaaatggaaccgttgataatgggaagggatctttcagcctagtgcttcgaaggggtggattcgtactagaaggagatatgagtggtagcaaccctgttaatttattactaaggattcctgtccccaatgataaatgtaagaacattgagttcgcgtttgacctggagaatgatacaagtctcttggtggctacagagatggtgcaagagcttgaactaccttcttggagcatgcctattgtggcaaagctggtagatgcgttcctgctcaaaactgttcgtggttggaggccgtgtgttcaggtcggtcagatgattcaggcagtgcaaaacactgcatccgtgaatggaaaaagcatctgaatcaatgtttgtagctgatgcattattctgcaccttatgtaaatatatcatgctcgaatgcaacgccaggccttgctgactaagcacatcttcttttatctgatgctggttaaagtttgggcatgattcctaatttgaatagtggtatatttcgtataatttttggttcgtattgtaagaaagaggttcagagataagagaaattaagaatgctgtaacagccatccttgcttttttcagtttttatttcaaagccttaccatgtgtctcc

SEQ ID NO: 11808 - DNA, 1484 bp, Zea mays
tccggggttccattccgattccaacgcaccattcttttttatcgctttcggccagcctctcggtcgaaccaaaaaactgcccacggctagctgccacgcgctttctcggagagatcgacaagctgcaccctcatatcattcatcgatggcgagccttgggctggtcctgcttgtcgccgtcgtcgtgtccgcggcgctcatgccaccgtccgccgtcgcgcagcagctgacgccggactactacgccagcacctgccccaacctcgaggccatcgtccggcgctccgtccagcagtccatggtgcagtcccagatcgccgcgcccgccgcgctcaggctcttcttccacgactgcgccgtcatgggctgcgacgcgtcgatcatgatcgtgaactcgaacggcgacgacgagtggcggaacaccgccaaccagtcgctcaagccggaagggttccaggccattctcagcgccaaggccgccgtggacagcaaccagcagtgccagtacaaggtgtcgtgcgcggacatcatggccctcgtcgccagagaagccgtcttcctgagtggcgggccgtactaccaggtggagctcggccggttcgacggcagggtgtcgactagggacagcgtccggctgccgagtgtcaacttcaccctggaccagctcaacgccttcttctccggcctcggcttctcccagaacgaaatggtcgccctcttaggcgcgcacaccctcggcgcggcggactgccctttcttccagtacaggatcggcgacccgagcatggacccgagcctcgcgtcccagctgcgcggcacctgcggctccaaccccagcggtggcttcgcgttcttcgacccctcgccggtgaggttcgacaacgccttctaccggaacctgcaaggaggcagggggctcctgggcaccgaccaggtgctgtacagcgatcagagatcacgcagcgcggtcgactcctacgcgtccaaccagggcgccttcttcaccgacttcgtggcggcgatcaccaagctcgggaggatcggggccaagacggcggctactggtgagatacgccgcgtctgcaacttcccaaactagcgagcgagtatctgagcttagtttattggcaacgactgctatgcatgcaagcagtccttctttataagcatgcaagcaaactatctgttccattagattacgatccaaccacagatataaccatgatttgttagaggagttttttataaagattattgagctggtggtgaaaaggtttaagtgttaaatgtgacctacggttagattacgatctaatgaaccagatggtttgcttgaacgcttgcaaaaaaagactgtttgcataaccgtcgttgcctttagtagccttactggccggccgttttcacgtcagaatatttaacagtgtacactacatctacacgtaattcagggcggcgactctgtacaatcaaagtttatatac

SEQ ID NO: 11809 - DNA, 2242 bp, Zea mays
tgttacttcaaacttaaatgttcatgtaaataaaggcttatggtgcatcctttaatttaatgatatgcataattatttagttgaatagaaactttactattactttttctaaaataattcttggtttttacaattcagtcctcaatttttaatactcaagtataattggggatatctgaatttactattttatctcttcatatatttattttattattataaaaaaatatatacagattttggtccttacataaatgaactaattcgtcgcacaatgctgtacaaagagatcataggctatagtccagacaagcgccatcctacaccaggtcaaaaaaaaatgtatgcacgactccaaacagttttcttgggatccaatctaaacaaaagtcacacttttggagactagacaattttcctaggatccaatctaaacagcgcttgcaaggaatccaaaaccacttttcacgttgacaagccaaaattgcgagaacttattgtttctcgtagctttctcacaagtttaatttaataaattattacaataccgttaatgaaactgttttttttgctgaatattatatgtagatagaagagattcagctccgctagaaaaggagcccgactgaaataaacccaagttgacccttcagagctagctagattgacatcggacccactagctagcttcttgcctcgagtggctcaacgaaagagaagagctcagctcccccatgaccatgacctgagcaaaaatggtccctctccggcccgggtgaacggaccaaattaaaacccaaacaaaggcaccaacaactgaagaaggcagccataaaaaggtgagacacctcccagcgtacaatcaatcaatcctgctggctggggtaccagtaccatactgcccctgctccatttgatgacctgaccctgaccctgaccctgaccctactataatacaagcgcagcagccactgagtcctgagagcgcgcaacagcagctaagctagcactagcaggcggccgggcaggtcggcatggagcctcacatggagagcgcgctgcggcagggcctgtcggaggcggagcagcgggagctggagggcgtggtgcgcgcgcaccacacgttcccggggcgcgcgccggggacgtgcacgtcgctggtgacgcagcgcgtggacgcgccgctggccgccgtgtggcccatcgtgcgcggcttcggcagcccgcagcggtacaagcacttcatcaagtcgtgcgacctcaaggccggcgacggcgccaccgtgggcagcgtccgcgaggtcaccgtcgtctcgggcctcccggcctccaccagcaccgagcgcctcgagatcctcgacgaccaccgccacatcctcagcttccgcgtcgtcggcggcgaccaccgcctccgcaactaccgctccgtcacctccgtcaccgagttccagccgggcccctactgcgtcgtcctcgagtcctacgtcgtcgacgtccccgacggcaacaccgaggaggacacgcgcatgttcaccgacaccgtcgtcaagctcaacctccagaagctcgccgccatcgccacctcttcatcggccaattaattcctcctcctccccctccggtgccggtggtgccacggatcatcgtcactagctagcgcgcgctaatccattgcgtccaaggcatgccctgttcgttccgttgctactgcaaattgcctgcaatggtgacgatgcttcttgcttgctttttcatctctccatccgtccatcgtttctagctctttggaacgaacaagaagctagctagctagctagagagagagaaaaaaaatgttgtccaacagtttgctataaacgaccttttccttttatttcatcgtaactaattcagcctttcggtattgcaaatctgctgcgtcggtgacatcgaaaggggttgcaagttggtgttattttatatatatcctggttttcttcttctttgtaaataaatatacacgtacgtcgtctctgctgttatccttatccctgcagtgtcataataccgcgcgcgccagtctattttgtgttttgtcaatcaagtcccggtagttggtacccatacttttatgacatctatttctttgttcggttcttttgtactactatactcttcttcgatcaggtttctttgaggaaaaagaaaaaggcaaaatagatggcgcgcgcgcacgcacacagagcgtgttcatgtgcttcag

SEQ ID NO: 11810 - DNA, 2321 bp, Zea mays
tgcaggcagtgattaatcactcgctctctcgctcgctccccgtccctgcccactcactcactcaccttcgccgggaaaaaaaggaggaaaggaaataaaatactccaagccaagagagcggcaggccgcaggggcaccccccacacccacaggccatccttcaccagcacacactcatctcccacacctagcctagccttgctttgtcctcctccgtctcgctctcgctctccgtctccattcccacccaccaccaaacaccaggcccaaaggaccccccgccttcccaactaagagcaccagcgcagcggggagccggccgcagggcagcaagatccgagcagcaggagtggcaagcagcatttgtagccacagctcgctcactcaattgcagctagccgcggttgcggttggactggatcggcggcagggcagggcagggcagggcgcgcggcggtggtggtagttgcagaagtgacggtcaagttttcctcgctccttgcttcggccgagactccgcctgacgctactaccaacatctccacctgaatccatctctatctacctcgcacgaacgaacagagacaggggaggggagggggggaattgaagtgtaacccaaggaaaggaaccatgatggtgtggcaggcggaggaggaggattgatccatccgtcaacccatcagacccgtccatccatcggtggtggtggtggtggctgctgttactcgctatcaccatctgctgctgcctgctttagtcttttgcttcacttctcttctttctatccttcctccccctgtctgtttgtctgtcttattgccctccctgttcttgttgctgcttgcattgagaaaagagagagagagagacagagagagatagaaagtggttgctagttgtatggtcgtccggtgggcgcgatgaccatggagcacggcgaggattgctgcgtcaaggtggcggtccacgcgcgccccctcatcggcgacgagaagctgcagggctgtaaggactgcgtcgccgtcgtgccgggcaagccgcaggttcagatcggcagccactccttcaccttcgaccatgtctacggcagcacaggcacgccgtcggcggccatgttcgacgagtgcgtggcgccgctggtcgacggcctcttccagggctacaacgctacggtgctggcatacggccagaccggatcagggaagacgtacaccatgggcactgcctgcaaggaggggtcgcatatcgggatcatcccacgagccatggctgcgctgtttgacaaaattgagaacctgaaaacccaagtggagttccagttacgagtatcgttcatcgagattctgaaagaagaggtgagggatctacttgaccccactgctggtaccgtgggcaaagcagagaatggcaatggccacgcaaaactgtctgtgccagggaaaccccctgtgcagatccgagaggcgtcgaatggagtcataacgctagctggatccactgaggtgcatgtcaccactcagaaggaaatggccgcatgcctcgaacaaggttccctcagtcgcgcaactggaagtaccaacatgaacaaccagtcaagtcgttcccatgccatcttcacaatcacattggagcagatgcgcaaaatagaccccatcatgactgcagatggaatgcctattgaagagatgaatgaagactatctctgtgccaaactacacttagtagatcttgctggatcagaacgggctaagagaactggttcagatggcctgcgcttcaaggaaggtgttcacatcaaccgaggacttctcgctctcggcaatgtcataagtgctcttggagatgaggccaaaaaaagaaaagaaggtgctcacgttccttatcgggacagcaagctcacccgtcttttgcaggactccctaggtggaaatagtaagactgtcatgatagcttgcataagtccagcagatattaatgctgaagagacattaaacactttgaaatatgctaaccgggcacgtaatatccaaaacaagccgattgtcaatagaaatcctatcgctgatgagatgaaaagaatgcgccagcaggttgaatatttgcaggcagagcttgtttcggctcgaggaggagccacatcagatgatgttcagggtctcagagagaggatttcatggctcgaacaaacgaatgaagacctctgcagagaactatatgatagtcgcaaccggtctcaaaatgatccatgtgaacctgaaatacaaaggactttaaacggctttaccaaaagcgaagggctcaaaagaagcttgcaaagt

SEQ ID NO: 11811 - DNA, 1086 bp, Zea mays
attggggcccccgcgggccgggccggtgtctcaaacacacgagagctcctcttgtcttgctcagcaatcatatcgcacgagatactattgactccaagtacagaccagtccagtactgttgtacggcctggttccgtggaacagagatgggcaagcaaaagattgtgctcaagttgcccctggatgacgagaggaagaggaggaaggccttcaaggcagctgtgggaatgaacggtgtgacgtccgccacgatggagggcgacaagatcaccgtcgtcggcgatggagtcgaccccatcacgctcacaaccatccttcggcgcagcctcggctacgcggagctgctcagcgtcagctccggcgacgacaagaagaagggcgacgggtacggctacgggagcgccggtggcatgatgtacggtggcggcggatacggtggtggcaaagagggcaaggagagcaaagagagcagcggcggcaagagcagtggcggcggtgggggctacggcggccattaccaggcgatgccgtcggtctcgtaccctgccgcctaccagcagtacaacgccatgccgccctaccccgccgcctactcctatcctgcagcatacccgcagcaagaacaggaccctggatgcagcatcatgtgaaaaaacatcctacaagttaatctgaggagttggttgaaggtggccgaacacatggagattagattaacatggttgggttcgtccggacaagatgatccatgctgccttgagctgtgcaacagaggatgatgatccaggatgtgatgggcattatcatccgtgtaattatgtacagggttggccagcaaagttgacggattgatctgttggagttggaggtgttggtggaatgggaggcagagctgttccgcaagattatgattcaagtgcagactaagtagcagcaccgatgtttcctttttgtttctttcgtttttggtaaagttgtagtgtttgttgaagaaaaggattgcaataaaattagtgtttatacactaaaaaaaaaaaatggacgaaaaaaaaaaaaaaaacccaaaaaaaaaaaaaaaaagcggcc

SEQ ID NO: 11812 - DNA, 946 bp, Zea mays
ccgggagaaacgcctactcgcttctcccgtcgtcttccccgctcctacgacctgcgtttgtcgatgctctctccatggcaccctctcctctcccccgttgcacctcctgccatggagctacggtcaccgctgaactcacataactgctcccttacctcctccattagaccaccgccaccgcgctccttggcgcgggcgccccccacgctttccgccaccgcagcggccgtctcgtcgctgtccgccacctcagcggccatctcgtcgccttcctgtccaaagaagaaggttctcgtgcccatcgccatgggtacggaggagatggaggcggtcatcatcgccggtgtccttcggcgggcttccgctgatgtgacgcttgcctctgtggaggacggcctcgaggtggaggcgtcctgcggctcccgcatcatcgcggacacgcacattgcctcctgcgctgaccaagtgttcgatcttgtggctctcccaggaggaatgcctgggtcagtgcgattgagagacagtgacatccttcagaggatcacagttagacaggctgaggagaaaagattgtatggtgctatatgtgctgcaccggcggttgttctagtgccgtggggtctccacaggagaaaaaagatcacctgtcacccatcttttataggagatctccctgcattccgggcagttgaatcaaatgttcaggtttctggagagcttactacaagtcgtgggccagggacaacatttcagttcgctttatcatttgttgagcaattgtttggggcttcgtgcagctgaagatatggacaagattttgatggcacagactcatgacggtcttgaaaggagtgcagaagtcaatgagcttgagtggtcttgtgatcgcaatcctgatgtccttattccaattgcaaatgggtgtgaagagatggaaatcataatt

SEQ ID NO: 11813 - DNA, 1340 bp, Zea mays
tgggaccctcgaagccgccaccaaaccacatttgatggccacatcacccctgagctgcttctccgcgcgtcccagacccagatctccgggcaccgccgtctggttgcttccggccgccgttctcctcctcctcctcaaccggtggtcgcacatggcctcttacccttctgtctcccctcgtggctccggctcggtgcaggtcgggcgcgccgagctttactcgaagatggcgcgtgacctcgacgagcgcggcgcggcgttcctgaagggcggcgagacgtcgcagtcgctcacgctctcggacctcttcgacaccgcagatgacggcgccgtcgtacccaggctcaaggccgccgacccgccagtgcgcgcgaatgtgctctatatggaccccaagttcgccgctgtgatctcgaaagctgtaaaggacgtgtttcttccttattttgaccaagctatctggttccaaaatacgagcatgtatcacttcagcatgtttcatgcctcccatcacttggagcccattgtagcaactgaggatgagattgaagccgaagtggaggcagtaaaaggtgtcaccaagaatttgtgtccgcttaaaattgtattggacagagtggttttgacctcaaccggtgtgcttcttggcctgtggcaggttgaatctggtactgatcctgcagaaatccgctcaagattgagagaagctcttcctcgtgcacctcaaaagcaactgtatgaccctgttctgcttcacacctcgtttgcacgaattctgggacatcccaggctccctaaagagcaaagtgcatcatcgtttgataatgtcaagttcttccatgagctagttgctcaaattaatgagaagatctgtggctttcaggcgacgatatcagagctatggtatgtcgaagagtacgatgttcttgcattggcactgaatggaaagatgaaggtgcggaggctccaccttggctgcaatcgtcagggcatctgaagctagagaggtcatggaaacgggaaaggattaggagatgcacagccaccaaacagacttttttcgcttgcatgtctcgccgaaagggccaccttggtactgcccagctgagcgagatgtgctacaatctgcctttacataccgagaactgacaagttatattgacctagactatcttcagcagattatctatcatcatttctatattcaaatttcactttacgaacattagtctatagtacagaataaactgttggacacagactaatgtttatgtaggaacagtatgcatgttttaacaatatataatacaattatttgagcacgaaaaaaaaaaaaaaaa

SEQ ID NO: 11814 - DNA, 3659 bp, Zea mays
ttgaagttttcactgacatatctatatgtgatatctttgagattgaagccgaagtggaggcagtaaaaggtgtcaccaagaatttttgtccgcttaaaattgtattggacagagtggttttgacctcaaccggtgtgcttcttggcctgtggcaggttttgatctcaagagaccctgttctgtatgatttttttctgattgatattaagctcatgtaaccttagtatgcaatcctctaccctgagttcctgagaagtattcaaactgaaatataggtaatggtatttggtgtgtttaggttgaatctggtactgatcctgcagaaatccgctcaagattgagagaagctcttcctcgtgcacctcaaaaacaactggtatgagcagctcaagatttgatatgactgttaacatctgcctaacttgactttaattccaacgccaagaggtagcattatcttgataaagaaacatcaacaaaacatctgccgaacaaattaattttggtatctggctaaatttattgttcaaatatagtggtgcagtacgcggttattgtacagatggctatttacataatatcttgcagatttcaattaatctgtcacctgacctgattttttttctgacagtatgaccctgttctgcttcacacctcgtttgcacgaattctgggacatcccaagctccctaaagaggtatctcaattctatctttccatcaatgttaaggcgtgttttattttttgacagttaaacttgcaagctttgatcaagaatatgttaaattatactgtatttgttagtgtactaaatttgtgttcaatcttcaaagtatttttaggatggtgttgattttgcaacaattgacaatatattgttatttaagagaaagtagaggtacagatataattttaaatactaccaccttccaaaatatgctttacattgacggcatatatagtatttggtcgctagaagatgtttacattcaaactaatgtgcagctaagttcttaagtaaaaccacataataaacccacagactaggattcagagtctgttcagaaacctctgtggctctgtgcagtactgcagaggcattataaagttactgatatggaaggctgccctcccattctagcccacatgccagtgacacttaatgcctctgcagtacttcaagggatacgagtctgttcagaactgctgaggcttatagataatgtttcctctttattttgcaacttaaggatgcataatcaaatgtaaattttaaacacttcatcttttttttttgagggcaactttcttcatctaattttatctacatgatagtgcatggaagtacagtaatcatagagcagataatgcagtcgtaccttttggatgtttgctttggtacacccttcaattgtctatcatttaatctcgtgtgacactacattttctgtaccttgtatcaaagtgcatcatcgtttgataatgtcaagttcttccatgagctagttgctcaaattaatgagaagatctgtggctttcaggtagacttcttgttgctcgtatccatgaattggttgggtgcaaacatagcatgcacaattacctgtttatcatcactgtttcaggcgacgatatcagagctatggtatgtcgaagagtacgatgttcttgcattggcactgaatggaaagatgaaggtgcggaggctccaccttggctgcaatcgtcacggcaactgaagctagagaggtcatggaaacgggaaaggattaggagatgcacagccaccaaacagacttttttcgcttgcatgtctcgccgaaagggccaccttggttctgccgagctgaacgagatgtgctacagtctgcctttacataccgagaactgacaagttatattgactaagattatctccattagcttacctattctcgtactcatattcaaacttcactgtgttttagataaactatgggtatactgttagacctggtctaatgtttatgtgggaatagtatgcatgttttaatcgtatgtaatacaattatttgagctcaagcactattataagaactattatagtgttgtttggttcagacgttgttaagtaaatggtaatagaatcccttactgatggtaatggttactagttataattgggttagatagtagtatctagtactattagaaagagcttaatcaaacaaaaataagaaaatcttggtatctattatcccgtataatcttgtataatctatttgctatacatttcagcttaatcatacacaaatattggtgtcgattatcccgtataatctatttgctttacatttcagcgaaccaaacaccactaagtctttgtacactatgtaatacaatgcaacttatgttcatgttctgttttcattcctcccccattagaaacagtagcttacaattatataataacactagacatgctcatcgacgaatgaactaaatttctaacatggtgtcgacttctgcagtgacatcaaaggttagtaatacctttctgtgaggctaaaatacaacatcacattgtcctttcgaatcgggtaaatactggcttgccaataaggcaaggaggaaatcacaaaacggcaaaaaaaaccaggaatacaaaagggagagaatatgaagacaaaagaaacgaaatagaaactaatttacacgttgctaatctagtatctattgcccagcgagcttcacaacctccgacggacttccaagcttagccacctctgatgggccttctaattttctcaaaccatcttcacagtaattactaatgtcaaagttggtgactgcatgaacaccccgaagctcgatcgctgcgatgtcataagcttctgctgcctcttcttcagtttcaaaggtcccaaggtaaatgtctttggtgtctctactctcaccaatcctaccaattcttgcttgccatttaccatccttccgtctggttacaccccggtatgatgaagtacctcttgagaaacaactgctttgtctccttatgtaggccacaaattcatcttgggacatggtcttcataacctcaatttctttctcataatcagaaatattgaagttcagtttggtgtttggccctgtgccccaatatttaagggcagccaaatcatgtgcctttgcagcctgctcttcatcgacatagctgcctaagtacacgtgcttgcccttgcgcttgcggccttcgacctggctggtgttgtcccaaaggtgcgcctcgtacttgccgctccacttgagcctggtgacgccgtggaagcgcgacgaccgcggggcagcgtacttgcgcatggcctccgccaccagcttccctcccccgcctgcgctggcggccccggccggcctcctctcctcgccgccgccgacgacggcgagctgcttgtcgagcgcggcgatctcgccgcccgcctccgctgcggcggcgggttcgccggagacggcgggcggtaccggggcgtccccgtgtcgctcctcctgcgggagatgggtgggacccgccggggattgagggtggacggtggccatcgccgtgggtcggtcgcgctgtctttcgcgaatcttcaagtgctcgcgtcacgatttcgcaaaccctagttctggtccctagcggt

SEQ ID NO: 11815 - DNA, 2494 bp, Zea mays
  misc_feature (2480)..(2480): n is a, c, g, or t
tgattccttaaaccaaacaccccctatatggatggactcgtccggcaattttttataccatatatatcacaacgtctgaaaaaatggttatttaaatatagccacattttattctggatttctcgctagtcaaaaaaggtaaaaatagtgaatgactctctaaaatgtaaataagatatagaaaacttgttagggattggaaagatatgaacatggtttttatgtaaatgactgaaatttagaaagacaattggagtgttgcttgcttgtctctagagattcattagttgtacatattctaaaatagtacgtatttatccgcatcagaaaattaaactggttttctctaatatttctaatggtccatgcatcgtccagttacctcatccaagaacggtgccacgctaccactggtccaccgtcacggcccgtgctctccggtcatgtccaaagagaagccttcgcacgccgaaacgctcggccgagaccaactacgtgccgccaacatccacgcgaagctttcttctcctcgaaacagtagcgccaaagagctccagcagtcgggcgtgactatcccgactagctccggctactccctgggcaccccagagtacgtgatcaccgtcagcctgggcacgcccgccgtgacccaggtcatgagcatcgacacaggcagcgacgtctcgtgggtgcagtgcgctccgtgtgctgcgcagtcgtgctcctcgcagaaggacaagctgttcgatccggccaagtccgcgacgtactccgccttctcctgcagctctgcccagtgcgcgcagctcggcggcgagggcaatggctgcttgaactcgcagtgccagtacatcgtcaagtacgtcgaccactccaacaccacggggacgtacggctccgacactctcggcctcaccacgtccgacgccgtcaagaacttccagttcgggtgcagccaccgcgcaaacggcttcgtgggccagctggacggcctcatggggctcggtggcgacacggagtccctcgtgtcgcagacggctgcgacctacggcaaggcgttctcctactgcctcccgccgccgtcgagctccgctggagggttcctcaccctcggcgcagctgctggtggcacgtcctcgtcgcgctactcacgcacgccgctggtgagattcaacgttcccacgttctacggcgtgttcctccaggccatcaccgtggccgggaccaagctcaacgtgccggcctcggtcttctccggcgcgtccgtcgtcgactccggcaccgtcatcacgcagctgccgccgacggcgtaccaggcgctacggacggcgttcaagaaagagatgaaggcgtacccgtcggcggccccggttagcatcctggacacctgcttcgacttcagcggcatcaacacgatcagggtgccggtggtgacactgactttctcccgcggcgccgtcatggacctcgacgtttccggcatattctacgctggctgcctcgcgttcactgccacggcccaagatggcgacaccggaatcttggggaacgtgcagcagcgtacgttcgagatgctattcgatgtcggagggagcacccttggattccgccctggcgcttgctaaatttctattaataatttcaagggaatacgggaaattttcgtcccaaaaagtaacgtatttgatggaaatccatccgaataagcatgaaccatgaatgaacatttagatgatgtctatcaacaacacggctttcgaaattttaatcaagactataaacagatttaatagtctctggtgcagcataagtgacctagtattttgttcaaatgtctacaagattatgtgtattcgtactgtatttcagaaaaacacgcacacatcttgtcgtgtacaattgagagtatatatgtcactacatgacggttgagttttaaggacccttattaggctgttggttgctaaaaattgtgaactaatagttggttgctaaatacatttttgtgtcatgtgggtcaactgatgacgtgaacatttgcccgtcgacttgaatctggttccaatggtggacgtgatcggcccgcatacgagacttgcaacacaatgaggtggcgagactgaggctgcctggagcgccttgcgccaaattttcaacacaatggtccatggcctgggaatttgacgcgacaccggttaccaaatttttcggtattgtgaaatttctcatgttttattcgataacctgagacatcttgtgccaaattattagtcctaaaattctcaactctagatatattccaaatgctgaattcgtcaaaataatagattatgtcccaacatttttcaagataactgtttaaagtgtcatctaaacattgatattcttctaaaatctgctagacaactagctgagaatcaccaaatgacctcacatgctttactctcatacaatctagaagttccaagccgaataagagngtcggtgttgggac

SEQ ID NO: 11816 - DNA, 1419 bp, Zea mays
ctttgatgaccgaagatatgcatgaagaaaggctccatgcagctgaagcttttggcaatgccattggtctatctggaccagctggaaagggatatattatgttccgatatgtctgcttttaaagctgcaaacccagatgctgtctttgaagattttattcggtggcattcacctggtgaatggttgagcgaggacaaaacagatggtaatgcaggctggcctcccaaaggaaagctttctcaccgtatgtcccaacatgggaatgtgtggcgcaaaatctggaatgatgctctgccattgcctgtttctgaacagaagtctttgcttgaccctgttcgggaaggagaaaaggtgcttcattaccttgaaactttaaggccacagcagctccttgaacaaatggtgtgtacagctttcaaatcatcagctgatatcctgaataagaccatgtatggtggcttcaaggaaatgaagacaaaaatggatcgactatatgtcaccatggcgtcaacactgaaatcttttctagggaattctgatgtcaatgatttggttggaggcctgaaacggctttgtccagtcccccagcgccgcccacgcgtccggattcttgctgcttccatcaatcggaagcttattgatgctccacgactagctcaagcaatattttacgactactacaacttctaccttccaaaaatgggaactagcctggaaagcatttgctatgagaaggagttcacaactaaggaaaaggtcgggatgtatgagagagatgctgtgtcgaacctgtttcctccccctactgctaatcagtcttggaggaaagttttgagcatgggaaatcttctgaacggccatgaaccgatgcaaagggaaatcatattctcagtccaggagagaataagcaacggtcattattcgagcccaaccccattatgtaccaacaatgagaagatccagacacataggatgtatatatctgggacatctaatgacctttgggttgcattgtctgtaacgtcctgggattgagctgcacgatgtatgagaggagcaattggtgttttaattagcttagaatcccgttggtgcagataaactatcattgtatttttttttttgttggatgtaccagaagtccagaaggggccaccaggacatggctagtgacgcactgaggacaagcatccatttttgacatcagatcaaagtattgattatttacgtcttgtagcagtcagaactcagaaatgctaatatattcttggcttcctctagagaaatggttgtagacaagctctatttggctgacgtttttggtctgttaggtggtgggctggtgagttgcaacacacacactggggttgatgtacgtaaacatcttgtatgacttttgcaatgagctaggctttgtcc

SEQ ID NO: 11817 - DNA, 1556 bp, Zea mays
ccacgcgtccgcagagattcgaagaagacacaaataaaatctcgccaaattcatgaactctccagtctctactcttttctcctggcaacgatttccaaacgcacgcaaacgctgtcacagtttgtcacggcagcggcaacggcaagtcggcaacgttgccgcggcacgtctcctccctctcttttcctgttcgggtagtcgggtgtaccgccattcgtgatcgaaccagactcgagagggagaggaggagggagtccgaggggagagacccaattaactgcagggattggtcgggttcggctccgccttcggagagtcccaagagatgggtggcgcggcggcgggtaccaagtggatccaccacatccagcgcctcagcgcggccaaggtgtcggcggaggcggtggagcggggccagagccgcgtcatcgacgcctccctcaccctaattcgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcatacgggaggccatttggtgtggaagcacaaactctagcacagaggaaggcaaagaattgaatgatcctcgggtgctaactgatgttggagatgtccccattcacgagatccgtgactgtggtgtcgaagatgacagattaatgcatgtaattagtgagtctgtcaaaacagtgatggaggaggagcctcttcgaccgttggtgttaggaggcgatcattcaatatcttatccagtggttagagctgtgtctgaaaagcttggaggacctgttgacatacttcatcttgatgcacatccagatatctatgattgttttgaagggaacacttattcgcatgcctcgtcatttgccagaataatggaaggtggttatgccaggagactgctacaggttggattgagatcaatcaccaaagaagggcgtgaacaagggaagagatttggtgtggaacagtatgagatgcgaaccttctcaaaggaccgagagaagcttgagaatctgaaacttggggaaggcgtaaagggtgtgtatgtctcagttgatgtggactgccttgacccagcgtttgctcctggggtctctcacatcgaacctggaggcctctccttccgcaatgtcctcaacatcctccagaatttgcagggtgacgttgtcgccgctgatgtggtggagttcaacccacagcgtgacacggtagatgggatgacagccatggtcgccgcgaagctggttcgggagctcactgctaagatctccaagtgaaacggtcaggattgcaccactcttcttgaagcaaagcgaaagggtgggttttgatgtcccggtggttattggtcatggtttctatgtatcgagcaccaaattgttcgacatgtgacaggtttatatgttaattaggttgcaataacaccataatggtttatttaaaaaaaaaaaaaaaaaaaaaaaaaaaaaaaaaaaaaaagcggcc

SEQ ID NO: 11818 - DNA, 2139 bp, Zea mays
gtttcgagtttcggatacccattgccatccttacacggaccggggggtttgccgggcagccggcgccgccgtcacgccatccgcgcaggccgcggcccctctcacgcctagcagccgctgtagctgcagcaggcccgcccgcccagtgacacgctatttattctactatattagtattaccaggccatccgcgccccattagcaactgcgcgcacctcctgacctccactccagccgtctcctccctccgcgtccggctcccggttccgttccgcttccgcgatggggcagcaagagggccacagcaacccccaccccgacgaggcggcgctcccgacgaccaccgccgcaccgtcgccgtcgccgtcgccgtcgccgtcgccgtcctcgtccaggctctacacggcgtggctggtggcgtcgtggtacgcgtccaacatcggcgtgctgctgctcaacaagtacctgctctccgtgtacggcttccgcttcccgctgctgctgaccgcgtgccacatgtccgcctgcgccgtcctctccacgctcgcccagcacgcctcgccccgcccccgcagcagctcctccccgcgctcccaccgccagctcgctcgcgtcgcgctcctcggcgccgtcttctgcgcgtccgtcgtcgccgggaacgtctcgctccgccacctccccgtctccttcaaccaggccgtcggcgccaccacgcctttcttcaccgcgctcctcgcctacgccgtcgccgcccgccgcgaggcctgcgccacctacgccgcgctcgtccccgtcgtcgccggcgtcgccatcgccaccggggtgaggacgctaggctagtagcaacgcggcggatggggattagagttcctgtcgacactgcctcccgataaatttaccttttttttcgcaatgcagggcgagccgagcttccacctcttcggattcgtcatgtgcgtggccgccacggtggggcgcgcgctcaagaccgtgctgcagggcatcctgctatcgtccgaggagtgagcacgagcaatttccgttcccccttcgctccccattgtcgctccactagccgctggaaacattcccatcccgcgcagggagaagatggactccatggacctcctccgctacatggcgccggtggccgtgctgctgctggtaccggcgacgctggccatggagcgggacgcgttcggcgtggtggcgggcctcgcgcgggaggaccccagcttcctctggctcctgctctgcaactcctgcctcgcctacttcgtcaacctcaccaacttcctcgtcacaaagcacaccagcccgctcactctccaggtacgacgccggcctccacatgccggccgccgtcctgtgacgtacgcaccgatgccctttgacatccctcatcccccccgcccttcgcacgcaggtcctcgggaacgccaaaggcgcagtcgcagtcgtcgtctccatcctcatcttcaggaaccccgtcacggtcgtgggcatgctgggctacggggtcacggtcgctggcgtcgtcttgtacggcgaggccaagaagaggagcaagtgaagcgacggacaggctcctgtacctgtacatttgctgtccggccttggaatgcaacgccggcggtgatagctagggagaagacaagcaagcaaagcgacagctggggtggtttgttcgtcgcatcgtttcagaaggaggtgaaccatacaatacaagaactcgtgtcgtagcacagagagagagagtgtgtgtcgtttagcatttgaacgagcttgccgtccaaagcctacgattttaatccggcctggagaagaagaaaaaaaacgaagctagctaattatcaaaccaacacctagcatctgaacatatgtgcagcaatccaactgggtttccatattttaatgttgtcgatgaattggtccttcctaaacaacatttccgtttgaacatttacgaagagccaaagccaacggactgcattgttcactgaaatgttttttatagtgtacactttcatccacctttttccttaattactaaattaacggcgtcaccacaagttaagagtgagatgctaaaagagatgccatgaattatcacattgttttatgtataaatgtagtgcc

SEQ ID NO: 11819 - DNA, 813 bp, Zea mays
cgggttctcagctcctacacgcctccgggctcccgtgcagggaggcgggagtttcctaacacccacgacgaaccccccaggacggcggtccagcgccagacgcctaccgagcccctctttacaacaaccgtcgtttggtggttgctccatggtggtttgggtgaccctacctggttggtccgttactaccggtggtactggtgcctctttgtaactatggcttatactatgtacttgctccattaccaccagtggtggtgtgacctccttaccactttagacacgactagctagttagtccgttgctgctggtggtagtggtgcccgcctactactctggaccgtagtaactggttggtccgttcctcccggtagtttttgcttactactagctagttagtccgttgctggtggtggtacccgcctactactctggaccgtactaactggttggtccgttcctcccagtagtggtagtctctgcttactaccttgggtagctacacctggtggtgctggtggtgtaaagtcgtggggtgtaaccacccgtacaacccttgccagtagtgccgctttagtcattggtggttcttccacctttgtcgcccttgcctcgtaactagtatcggtaagtggttcgaagcgctttggtcctccggtttggggacacgcaatcctcacaatagttgtctcttgcatttttcctcctttcctagcgcttctaggtgtctacggtatttccccgttgatattgctactacaggtactccctcaaccttctacgccttcttaccccgcggggttagtaacggt

SEQ ID NO: 11820 - DNA, 990 bp, Zea mays
atggaatcctcgggtccgtccggccacgcaagcggcggcaccaccattcatctacgaatccatggggggcctcgggcccggcgcccgctaacggatcggagtcggagtccttcttgtgcttctcctgctctgctggtgccgctgccatgggtttccccagcacccccaacctgaagctggagcctcgccctcgcacgcggaggctcctgcgctgcgccctcagctctgagcctgtgcctcccatgactgtttccatcactggagccacaggtttcattggacgcagattggttcacaagcttctatcggatgatcacaaggtttgcatcttaacaaggtctgcctccaaggctgcgtcagtttttcctgcttccacctatcctggactcacaatagcccagcaaggggattgggaggcatgcgtcagaggctccactgctgttgtcaacctggcaggcatgcccataagcactagatggtcacccgagattaagcaggaaatcaaacagagccgggtcaatgttacatcaaaggtggtgaagtacatcaaccatgctggaaacgctgatactcgaccctcagtgtttgtgagcgcaacagccattggctattatggtaccagcgaaatccatagctttgatgaatcaagtccctcgggcaatgactacctagctgaggtgtgcagagaatgggaggccacggcatgccaagtaaaccaggaggatgttaggcttgtacttctccggattggggttgttcttggcaaggacggcggtgctctagcaaagatgatacccctttttatgatgtttgctggtggtcctctggggacgggacgccaatggttttcttggattcatctggatgacctagtcaacctcatctatgaatctctaacgaaccctacatacaaaggtgtaatcaatggaactgcacctaatcctgtgcgtttgtctgagctatgcgaacgtctggggcgaatcgttgggc

SEQ ID NO: 11821 - DNA, 2148 bp, Zea mays
caaatgatgaagctgcaatgattggtgatgcaattgcggcacaaactacatatgatcgggagaatccaaaaatagtagtgggatcgacatttgttgataaggatgcctttatgctacttatcaaacaatatgctataataaatgaattcgaaacatttgtggtgcacagtgatagaagtcgatatagggcaaaatgtgcagatacatcgtgtgattggaaaattcatgccaagaaacttcttggttgtcctacgttcatggttaagtctatttcggagcaccacacatgtgccagcacaagcaaggtgttagggaaagaggctacaaaaggttggatagccaataaggcatctgagatattgaagtccaaccctaccattggagcaaagaagctgcaggttcagcttgagcaacaatatccgatcaactccccgtgccgccccgcgcggccgggaatgcaatgtgcaaagaaagaactccatggcacttgggacaacagttttaaaatgttgtggagttttaaagctcaactagaagaaacatgcccaggaagcatagttgagattgattgcaagaagataaaaggacgtatgcatttcaataggatgtttgtggcaattagagcatgtgtgaatggctttcttgtgggttgtaggccttatcttggtgttgactctactcacctcacaggtaagtacagtggacagctagcagcagcaactgcaattgatgggcataattggatgtatcccgtagcttatgggatttttgacaaggagaacgactctaattggatttggtttatgatgcaattgaagatagctattggtacaccacatggattgacaatccacaccgatgcttgcaaaggtttggcaaatgcagtcctcagggtcttccaaggtgcagctgagcatagagagtgttttagacacctcatgaagaatttcagaaaaaagtaccagggtgatgtgttaaagtacatgtggccttgtgcttgggcatgcacacctcgtaggcaccaggtcttatgggaaaaaattagagaaagtagtcctgaagctattgtgtactttagaaacgaaccataaacagatatggtcatgagctaagttcagtgcagattgcatgggtgattatgtgaataacaacatatcggagtgctttaacaactggattaaggactacaaaagctttctggtggatattctcatggatgctataaggggcaagatcatggaaaagatagcaacaaggcaaaaggtagctgcaaggctaaccggacgagtacttcctagtgttatcaatgagctgaacattaagagcagatccttgaaatatacaatcacaggaagtggtggtcttaaggccgaagtatctggattaactagggacaacacaccttggagacatggagtggatcttgacaagaaaacatgctcatgtggccaatggaagatttcaggcaagccttgcacccatgttatagctttcataacttcacgaagacaagttagaattgaagactatgtccatgagtactactcagttgaacgtttcaaagctacttattagtttgatattaacccgatggttgataaggctcagtggcccgtggttgatcctgggtttgtgatggttcctccgaagttagagaggcctgcgggtaggccgagagtacgtcgaatcagaagtagtggtgaggctgggaaaagaggcccttaccaatgcaagagatgctttcagtttggtcatattgaaaagacttgtcgtgagccccctgctgaattgggggatgagctcccatcaccgcctaaaacacaaaagagaaacggtgatgctgtcccgcacacaccaaaaaggtccaacacggcacaaacaactgcatcaactcctccttcgacaggtccaataacaagaagcatggcagcttcaccttctacttctacaggtgaaggtcctgtcactagaggaatgacaaacatatcacctgggggcattgcaagaagagttatcattagttagtaggtgtaatggagatggctgacttgatgttatgctgaaatggagatggctgacttgatgctaaaaacctactctaatgttttgtgctaaaaaaaaaaaaaaaccttctgttgtgttcatgac

SEQ ID NO: 11822 - DNA, 1068 bp, Zea mays
aacagtgaaccaaacaaaagcctcgagccagtgtggtgtggggtcgcgtgctctcttctatcctgctctgctagtgccaggattccgccctatccatcccatcaacctcagctaaggtccccagcggcggcgaggcgatggcggcgcctgtgacggtgtacggaccgatgctctcaccagctgtggcccgcgtggcggcctgcctcctggagaaggacgtgccgttccagatcgagccggtggacatgtccaagggcgagcacaagtcgccgtccttcctcaagctccagcccttcggacaggtccctgccttcaaggaccacctcacaaccgtctttgagtcaagggctatttgccgttacatatgcgaccagtatgcggactctggtaatcaggccctcttcggcaagaaagaagacggcgcggttggccgcgctgccattgaacagtggatagagtctgaaggccagagctttaacccaccgagcttggctattatcttccagctcgcatttgcaccgatgatgggccggaccactgacctggctgtggttgagcagaatgaagcgaagcttgcgaaggtgcttgatgtgtatgaccaacggctgggggagagccagtattttgctggtgatgatttctccctggccgaccttgtgcacttgcccaatgcagatttccttgtgaacagaaccagcaaggctggcttgatcaccgagagaaagaatcttgctagatggtgggatgatgtctcgtcccgacctgcatggaaaaaggtcactgagatgcagagcacgccgaggccctcttagagctttttttttgggtttctttgagcagcttctgatggcaattagttgcattctccttgttttgtcatcaagtccttgtctgtaccgtttcctgttctcttatttatcggtcttaattcttgatctatgtatggtttggatctgttcttctggtcctttagtttatataagtacctacaattcttcaaaaaaaaaaaaaaaaaaaaaccggccaaaaaaaaaaaaaaaaaactcgagactagttctctcctcgtgc

SEQ ID NO: 11823 - DNA, 817 bp, Zea mays
aaatattggaccaaggaacaggcccatgaactcgctaaagcgcaggaggcccggctctgttctgatatatcgctccgccgctagggttttcagggatcccgcctcacaccgccgcaaggactcgcgacggacggagcaacggaggaagcaactacgcggcagccatggtgaacgttccgaaaaccaagaagacctactgtaagaacaaggaatgcaggaagcacaccctgcacaaggttacccagtacaagaaaggtaaggatagcctttcagctcaagggaagcgacgttatgaccgcaaacagtctggatatggtggtcagacaaagcctgttttccacaagaaggcaaaaacaacaaagaagattgtgctgaagctgcagtgccagagctgcaagcactactctcaacacccgatcaagaggtgcaagcactttgagatcggtggtgacaagaaaggcaagggaacctctctgttctaagcgtatcataaacttgctcagggtctcaagtatctgtcagaatttaccattacaaacaccctgtgcttagcttctgcatatgttcttttgtcacatctttttggtacgttgtagtttgtatgagaccaagctattgtttcgtgttattattatatttcatgaaattgtcaacatgaccgtttgcttgactgtaaacatagttctgagctttgggcaaacagtagtttaatttatcgtatccatcttgagactgttgtttgttcgaaatataatggtggaatgtcgccgcgttgcgcggcgtacgtttgttcgaaagtcttacaatgttacgcgtt

SEQ ID NO: 11824 - DNA, 866 bp, Zea mays
  misc_feature (854)..(854): n is a, c, g, or t
  misc_feature (856)..(856): n is a, c, g, or t
gggtacctcgaggccggccgggagcttccctagaacacagtggtgttctgatatatcgctccgccgctagggttttcagggatcccgcctcacaccgccgcaaggactcgcgacggacggagcaacggaggaagcaactacgcggcagccatggtgaacgttccgaaaaccaagaagacctactgtaagaacaaggaatgcaggaagcacaccctgcacaaggttacccagtacaagaaaggtaaggatagcctttcagctcaagggaagcgacgttatgaccgcaaacagtctggatatggtggtcagacaaagcctgttttccacaagaaggcaaaaacaacaaagaagattgtgctgaagctgcagtgccagagctgcaagcactactctcaacacccgatcaagaggtgcaagcactttgagatcggtggtgacaagaaaggcaagggaacctctctgttctaagcgtatcataaacttgctcagggtctcaagtatctgtcagaatttaccattacaaacaccctgtgcttagcttctgcatatgttcttttgtcacatctttttggtacgttgtagtttgtatgagaccaagctattgtttcgtgttattattatatttcatgaaattgtcaacatgaccgtttgcttgactgtaaacatagttctgagctttgggcaaacagtagtttaatttatcgtatccatcttgagactgttgtttgttcgaaatataatggtggaatgacgtcgttataagcgcaaaaaaaaaaaaaaaaaaagcttatcacttatcatccccatccgcacctctctccatctccctgctcctcgcctccttcttgatcagncnagccagggat

SEQ ID NO: 11825 - DNA, 1843 bp, Zea mays
ctggctttccccccgggaattggaattggactcaaaagtttcggcggccttctccatgaacacggtggcttcgctgcctttggcgccgcgcctgctcattaagccctccctcgcctgcttctccagaaaggacgtcggccgctatggcgggatcaaggtgtacgccgtgctcagggaagacggggccgagttcgcccggaacaacaacctggaggccctgttccaagtggacgaccccgggccgcgggcccccgtcaagaagttcctggacgtgaacgaggctctggaggtggtccgcttcgacatccagtactgcgactggagggcgcgccaggatctcctcaccatcatgcttctccacagcaaggtggtggaggtcctcaaccctctggcgagggagttcaagtccatcgggaccttgaggaaagagctcgccgagctacagcaggagctggaaaaagctcacaatcaggtccatctctcggaagccagagtctcatcggcgctcgacaagctagcgcatatggagaccctggtgagcgcaccatccacagccgagccgcccacttcttcctccctggctgcaactgcaagcagcaccgcccgtgtccgagccaagaacaaacagccacgtcggaggcttgacgtgtccggcccagtgaagccttacaaccccagcctcaagaacttctggtacccagtcgccttctctgctgcctccttcaggatttacggtccacgcagagatagtgatggagctaccagttgaacatggactcctcctggacaatctcctggaccttgctcatgctcctttcacacacacgtccacctttgccaagggctggagtgtgccaagtttggtcaagttcctgacacccgcgtctgggctccaagggtactgggacccgtacccgatcgacatggagttccggccaccgtgcatggtcctatcgaccattggcatctccaagcccgggaagctacaagggaagagcacgaggcagtgctccacgcacctccaccagctccacgtctgcctgccctcctcccggaacaagaccaggctgctgtaccggatgtcgctggacttcgcgccgtggctcaagcacgtgccgctcatgcacctgctgtggtcgcatttcgcagagaaggtgttgaacgaggacctacggctcgttcttggccagcaagagcggatgatcgacggcgccaacgtctggaactggccggtgtcgtacgacaaactcgggatccggtaccggctgtggagggacgccgtcgagaggggcgccgacgaccggttgccgttcagcagcacccaagctgagagtttgtcgtagcgaccggtacgggacgggtacctcttcctcgtcgcatttctccgcaagacgacgaacggacagaaggaaaacgtccactgggccggcgcacacgacagccgcggcccatctccatttcagcctctagcaattccttctccgcatccctgtgctctggcgtcttcagtctcctgacataggcgtacgtgcgtctctctctctctgcgcggttcatcgttcacttcgggctgctgcgcactgaaggattctggaagggtgaaggttgacggccggagacgatgatgggcagcatcgtggtctctctggtgtccacatgcatgtacactactagcgacggcatcgtgggatgcaattgtaatctgagattgatctcttctttttttttcaccctttctgtgtaaagattcagcaaattgttgcgttactcttccaaagcatgtataatcaactacggagacgtgttcatatatataaatattgctacagttcatctgaaaaac

SEQ ID NO: 11826 - DNA, 1503 bp, Zea mays
aaaaaccacccaaaaccccagcgcacccaacccaagagcgaaaatggatccgcaccagttcgccccctcccagcagtcggcgctgaccatggaatcggcggagagcacggccgccgccgccgccgcgcgcgcacccaacggcgctgcccgggctatcgtcgaggacgacgacgaggacgacgacgtccccgaggtggccgcctgcatatcgacgatgctcgaccgcgggggtagcgtggagagccaccgcctcttcctggcgcgccgcaccgcgctggagatgctccgcgaccgcgggtacgccgttccggaggaagagctcgcccggaccctcccggagttccgcgcctggtgggaatacaggccagagctcgaacgcctcgccttctccactaccctcgcctccgacccgtccagcaaggtgaaagttgtgttctgtccacctggacctgtcaaaatcgcagctatccggctgatatataccgaagtcaaagatgagaacttgtccagactgattctgatactgcagggcaaaataatgtctacaaccagagaatccatcaaggagatctttcgatttaaagttgacacattccagatcacggaattactggtgaacatcactaagcatgtcctcaagcccaagcatgaagtgttgactgcagaggggaaagctaagctcctgaaggagtacaatgtggtggattcacagttgcctcgcatgctggagaatgatgctgttgctcgctattacgggctaggcaagggaactgttgttaaggttatatacgacagcgagcttaccgggaaccatgtgacgtaccgatgcattacctgaggggcccatgtgtttcggtggatgaagtctcgtaagcagtctgtaaaaaattacctctaagaggggcaggtgacactgttctgctaggcctttgtaagcacccaattgtgcaggatgaagcttgctgtaagctattggtaaaatcatcttgcgccattgccgtaccttaagtgcttggtgttaatcttggaaacagtgagacaactaatcctgtagtgagttatctcaaaaaaaaaaaaaaaaacacaaaaaagggggggggggggaaaaaaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaaagaaccaaattttacttccccggccttgaaaattaaaattttttttatggggcccccaaaataaaattaatgggccgggttttaaaaacgtggaaatggaaaaacccttgggttacccaaattaaatccctttaaaaaaaatccccttttcccaagttgggtaaaaacaaaaaggcccccccccaatcccctttccaaaaatttgcccaccttaattggaaatgggacccccccttttacggcccattaaaccccggggggtggggggtttcccccaaggg

SEQ ID NO: 11827 - DNA, 3303 bp, Zea mays
  misc_feature (2530)..(2530): n is a, c, g, or t
  misc_feature (2635)..(2635): n is a, c, g, or t
cgctcttatactaggattactttcactcccgatgctcaacattaggaatacgatcttagagcatctccactagttcctaaaaaagtccctaaaattaatttagggtgttattaaccaaaatcatgctctaaaaatttcttaaataaagttcacaaatataccaactttctaaatgttttttatttagtcgccagatttaggaagatgtttggaactcccaataacctatttctcttgtcaatcgcaccgtaaagtcacttgtgtaccatcaagttcacactcgtgtacaattgatgcactttgaataatttgagttgcggaaagagtaattttatcatcctcgtttgataagtctaaagatgacctatccaaaaaatttagagaaaaacattcatatgaatggaaatagtaatcaagagaagaagaataattattgaactttgtcatgcaaatgaaactaaatttgaaattgcaaataataattagaaaagtcgagttagtataatttaaaagtatttaacaacctaagaattgagaactattagaggatagaattgtttttgtttccaacatatatttatcaacttgctaagggctagtctaggaaccccatttccccaagggattttcattttcctaagataaattagttcatttacccttgagaaaataggaatctctttgaaaaatggtgtttcctaactagccctaaatctaaatttagtcagtattttttttaaaccaacgaagatacttttaaggcacctcattttcagctttgtcatgtgcacctcttattttgtcccttcgtaaaaatataaaaaagaactttacacaataataaaaaaagaactttacacataaatctgtctaaaaaatatttaagggttagtttgggaaccccattttttaaagatatttttatttttctcaagagaaaattacctaatatcatttgataaaatagaaatccttttgaaaaatagggttcccagctagacctacagaaaaaaaactctaaaatagttgttggtaaaccagcaggtgagcagtcgaacatcgtggccgcctctgctcagcccagatctccgatggccaccgcacccgccgccccgccgccggcctccgcggacgacgagatcatctacgagtccatgccctgcatccgcgtctacaaggaccgcgtggagcgctacttcggcaccgagttcgtcgccgcctcgacgaacgactccaccggcgtggcctccagggacgtcgtcatctcccccaacgtctccgcgcgcctctacctcccgcgcctggacgacgggaacgccaagctccccatcttcgtctactaccacggcggcggcttctgcatcggctccgccttcaaccccatcttccacgactacttcaactgcctcgtggccctcgccgacatcctcgtcgtctccgtcgagtaccgcctcgccccggagcaccccgtccccgccgcctacgccgactcctgggaagcgctcgcctgggtcatctctcacctcggccccgccggcgacggcgcccgggacccgtggatcgcgagccacgccgacttctcccgcctcttcctgggcggcgagagcgcgggctccaacatcgcgcaccacatggcgatgcgcgctgccgcggaggggctggcccacggcgcccggatccggggactcgtcatgatccacccctacttcctgggcacggacaaggtgccctccgacgacctcagcccggaggtgcgcgagagcctggggtccctgtggcgcttcatgtgcccgaccaccacgggggaggacgacccgctcatcaaccccttcgttgacggcgccccgccgctagcgtccctgccgtgcggccgcgtgctcgtgtgcatcggcgagggcgacgtcctccgcgaccgcggccgcgcctactacgaccggctcagggccagcgggtggcccggcaaggcagagatttggcaggcgcccggcaagggacacacgttccacctcctggatccgtgctgcgacgaggccatcgcgcaggataaagtcatcagctacttcctcagccactgactcgcctcgcgtcctcgccggtggtggtggcgttgttgggcttggatcaaaattagcttctttcatgctggcgctacactacataccttacttctagtacatatcaggttcagagttgtatccgtattctttgaaattggatctcagaatggagctttgcccattgttagtaggcaatggtgttgatgtattgcacctggtaatttggggacgatgatacagtcatagtgtcatacatatgaaattatacttgtttgtcacacagaatttgttgaaacaaatgttccatcttttactactcactagtatagctgaagtgaaaatcgtgcccccattatttgtaccagccattgcttatgaaaccacttctcagtttgcgtacaagtgtcagctgggcggcccaatacaaaatttggaaacatcagttgcatcttttactagtagaactgaaaatnacgccttcattatttgcggcagttattgctcatggaatcatttctcgattttgagagaactcaaaataaaaactaagaaaagtatgattttttttcgaatcagcngggctcgattgctaagacacccctacaaagaaatcaacgaagaactacaaagaaatcaacgaagaaataattggaaagttcagctgttcctttgcacaattttttaggatttagggataattatgactatacccttctctgaccttacaattataattgtattcctcatttttcagttttgtgattttattcctatgttttgaaaacgaagccattgtttgtccccctaacaccataagtgaaaattagaattagtgattaaaaataaaaaataagaggtaaaatcaaaattacacgattaacactaaaaatttcaatattattttcaaggttaattgtgattatatccttctctcaacttataattatgattttatctgttgtttttattttttaatcactaattctgatttcactaatggtgttaagagggaggggcaaacgataactttgttttcaaaacagagagataaaatcacaaagtttaaaaataaagggtaaaatcgcaattgcaatgccgtgaaagggtataatcacaattacactcctttttatatgcttgctattttgctctttttctagcctctcctgcttcccatgttagcctacgttgataggataatgacgaaggctgaaagtcaatggctttgtaacccgccaaagatgcc

SEQ ID NO: 11828 - DNA, 1081 bp, Zea mays
ccccttgattattgctgaaacaccaaaggtgcaggctctttttgacctaaaaaaagctaaaaaaactgtcaaggagctaacaccctcgctggatctgattaacaagtccaaacagttggccatccaggcaacagaggatgcaaagactcaaatcaagcagcttgaaggtggcagcacaagtgaaggtctaggaacagatggtgctctgaagcaggaactggaaagtgcaagggagcagtatgctgttgctttggcagaccttgatgcagcaaaacaagagcttagaaagctcaagaaggattttgaaacatctttggatatgaggttgtctgctgcccagcaggaagaggaatcactgcatacaactgaagccaacatagaaaaagctaaccaacttcgtagtgagattgccgaaattcaagaatcccttatgcatgttaaggcagctaccgtgcaagcacacgaagaagaggcacaaatccttgctgagaaggatgttgctaggaccacgtataaacaagctttggaagaaacacagaagaaacttttgtctttgaggaatgattttgaccctgctgcctacgatagtctgaaacaaaaactagaacaaaccaattctgagatcgcatctatgcaaaaaaagatagaagaggctcgggctcgggatttagagtctgttgccgttgtcagcacagagttggatgatgctaaggaaatgttgcaaaaagtagcagaggaggaaagttctcttcgaagtttggtggaatcactgaaagtggaattggaagctgtaaaacaggagcacaaccagctcaaagagaaggacacagaaactgaatccattgtcggagatttacatgtcaagcttcagaaatgtaaatctgtgctggaggctgctgtggctgctgaatcaaaagctacgtcagcttctgatgacctgatgctggcccttcagcaactgtccgcggagtcaaacaatgcattgcaagaagctgagataatgcagaagagtgcggcggagctaagagaggaagccaaaaaggctcgggctgaactagcagaagccgaacaaaagttgcag

SEQ ID NO: 11829 - DNA, 1796 bp, Zea mays
gggtacctcgaggccggccgggaactgtgttcatccggtcctcccccgctcgtgagttgtgaaccggacccatcccaaatcccaattccttgtcgagctcctcgaaactaccaccgccccctcgtttttttcacagcttcacccgacgaacacggcaccacgagccccgcacggccgcaacccacccagatttagactctcccaccgcggctgcatatctctcccccacccgcactccggtcgtcccattaccctctggcattggttgtcgatttcttcgttcgtgcttgcttgcgtaaaatatttaaataaatgaaggcaaatatgggcacaaaagctcgtccaccatctgctgatgcagaaaaaggggagattggcgaaatagatacaagggctccaattcaatctgttaaagctgcagtgagtttatttggtgaggtccgcttttcatctgacaaatcagctgaaagaaagcccaaggctcctcaaacagagagggttttagccaaggagacagagttgcacatggcccagaaagagttgaataaatacaaggaacagctcagtaatgctgagacaacgagagtacaggctctctctgagctagagaaagctaaaaaaactgttgaggagctaacagccaagctggatctgattaacaagtccaaacagttggccatccaggcaacagaggatgcaaagactcaaatcaagcagcttgaaggtggcagcacaagtgaaggtctaggaacagatggtgctctgaagcaggaactggaaagtgcaagggagcagtatgctgttgctttggcagaccttgatgcagcaaaacaagagcttagaaagctcaagaaggattttgaaacatctttggatatgaggttgtctgctgcccagcaggaagaggaatcactgcatacaactgaagccaacatagaaaaagctaaccaacttcgtagtgagattgccgaaattcaagaatcccttatgcatgttaaggcagctaccgtgcaagcacacgaagaagaggcacaaatccttgctgagaaggatgttgctaggaccacgtataaacaagctttggaagaaacacagaagaaacttttgtctttgaggaatgattttgaccctgctgcctacgatagtctgaaacaaaaactagaacaaaccaattctgagatcgcatctatgcaaaaaaaaatagaagaggctcgggctcgggatttagagtctgttgccgttgtcagcacagagttggatgatgctaaggaaatgttgcaaaaagtagcagaggagaaaagttctcttcgaagtttggtggaatcactgaaagtggaattggaagctgtaaaacaggagcacaatcagctcaaagagaaggatacagaaaccgaatctattgtcggagatttacatgtcaagcttcagaaatgtaaatctgagctggaggctgctgtggctgctgaatcaaaagctatgtcagcttctgatgacctaatgctggcccttcagcaactgtcctcggagtcaaagaatgctttgcaagaagctgaaatgatggagaagagtgcagcagagctaagagaggaaggcgaaaaagctcgggttgaactagcagaagccgaacaaaagatgcaattggctttaaaggaagcagaagaggctaaagcagctgaagcaagagcccttgatcagatcaagcaactctcggatagagcaagtgctgctagatcctcaacatccgagtctggagcaattatcacaatttctaaagaggagtgtgtatctctcagccg

SEQ ID NO: 11830 - DNA, 2773 bp, Zea mays
  misc_feature (1333)..(1333): n is a, c, g, or t
agaattagttgtccagtttcctcttggaacaatattaaaaaccgactcagattaaaggttagagataaagcagaataagattgcatccgtccagtttatttagagtcagagtcggctgggttgttgtaaccaagtaggattcttcttgtaaaatcttcttgtaataggcggttcttgcttgtataaatatacaaccctagatgtcaaggcaagcaatttaatatttggtgcgatgtttctttcatgtcatctattaggtaatgccccaatcaagaacaagtcgacatcaagctcatcaacgaccagatctcatggcgtcattcaactctgcaatactgacgcctctcttagccaatgccctaattaaggaaaatgttagaatatgctatataggctacgaccttatatgtccaggattctcttgggctagattagaaaccgactcagattagaggttagagataaaacagaacaggactgcatgcatctagttcatttagagtcagagtcgattgggatgtcctaaccgagtatgattcttcttgtaataggtggttcctgtctgattaaatatacatgcccatcgaccctagatgtcaagacaagcaatttaataattccggtgccgtgtttctttcacacatgtcctatcaactttaggactccatgtaacttgaacgaatatgtgccgttttctcgatatatgattctgatgctttgcaatttttggaattatgtttaccagagggttttagccaaggagacagagctgcacttagcccagaaaccgcgcgtccgcggccgcgtgcggctgaataatgctgagacaacgaaagtgcaggctctctctgagctagagaaagctaaaaaaactgtcgaggagctaacaaccaagctggatgtggttaacaagtccaaacagttggccattcaggcaacagaggatgcaaagactcgaaccaagcagcttgaaggtggcagcacaaatgaatgtctaggaacagatggtcctctgaggcaggaactcgaaagtgcaagggagcagcatgctatcgctttggcagaacttgatgcagcaaaacaggagcttagaaagctcaagaaggattttgaaacatctttggatatgaggttgtgtgctgcccagcaggaagacgaatcactccttgcgaccgcggcccgccgggaagaagcgtaccaacttcttggtgagattgcggaaattcaagaatcgcttatgcatgttaaggcagctacggtgcaagcacacgaagaagaggcacaaatccttgctgagaaggatgttgctagggccacgtataaacaagctttnggaagaaacacagaagaaattgttgtctttgaggaatgattttgaccctgctgcttatgatagtctgaaagaaaaactagaacaaaccaattctgaggtcgcatctatgcaaaaaaagatagaagatgctcgggctcaggatttagagtctgttgctgttgtcagcacagagttggatgatgctaaggaaatgttgcaaaaagtagcagaggaggaaagttctcttcgaagtttggtggaatcactgaaagtggaattggaagctgtaaaacaggagcacaaccagctcaaagagaaagacacagaaactgaatccattgtcggagatttacatgtcaagcttcagaaatgtaaatctgtgctggaggctgctgtggctgctgaatcaaaagctacgtcagcttctgatgacctgatgctggcccttcagcaactgtccgcggagtcaaacaatgcattgcaagaagctgagataatgcagaagagtgcggcggagctaagagaggaagccaaaaaggctcgggctgaactagcagaagccgaacaaaagttgcagttgacgttaaaggaagcagaagaggctaaagcagctgaagcaatggcccttgaccggatcaagcagctctcggacagagcaagtgccgctagagcatcaacttcagagtccggagcaaatatcgcaatttcaaaagaggagttcgaatctctaagccgaaaggtcgaggagtcagagaagttgagtgagatgaaagtcgctgctgccatggctcaagtggaagccatcagagccagcgagaacgaggcgatcaagaaactagaagctgctcgcaaggagatggaggacatggagttggcaacagaagaggccctaaagagggcagagatggccgaggcagccaaaaaggccgtggaaggtgagctcaagagatggcacgagaaagaacagaagaaaaccgcagaggccgcacagccttctgcgggggcagaagaactgggaagtgctgcgtcgccccctgtacgtcagacttctgccggaaaagcttccgagaagaacgaggggcatcagaggagcagtaaagcgctgctgaagaggagcttcatgctgccaaacatcgccagcatgttccataagaagaaaagccatccttccagttctccctcgcaccttcctggggaaaaatctgtgtgatctatccgaatccgaagctcctgtttgcgaactgaaatttccaaacttgaacgcttgcttttacactatattctgtataaaaatccgtctactcccttgcgccttgtagtaaatttcggacataattttaagattgcttgtaccccatatttttctgccctttcaggacttccggatgagtgcattgtacttcagcaacaacagtatctaagtcatgttcttgcaagcttccagaatagtggaagctcccc

SEQ ID NO: 11831 - DNA, 2635 bp, Zea mays
  misc_feature (374)..(374): n is a, c, g, or t
  misc_feature (1009)..(1009): n is a, c, g, or t
tagtgtgttttgaataattttagtctctagaaccaaacatggtagggactaaattttagtttcctaactaaactttagttcttggactaaaggaaccaaacgaggccttagtccataaattgctaaagggtgggactaaaacatggactaaactgttttagtctttagtcccttaaggagtcattaaaagggactagactatatgaattccactttttactcctcctttatttcagttgcactaacgagggatatttcagtcctcttatgatttatttaatatattttgaatatttttagtccttataaccaaataaggtagagactaagttttagtcttctaaactttattccatagattagaggctaaggtnttgttcgtttgtgtcggattgcacccggaatcgttccagctagtcaaagtttatataaattagagaaacaatttggttaggaatcgttccgacccaccaatccggcacaaacgaacaagcctaaggggccgttcgtttgtttcggaatggaggcctagaacaaattctaaccggtttggttctctaatttatataagttttgatcagctggattgattcctggtccattcctggacaaacgaacaaggcctaagtgaggcagcaaaccaaacgtttactaaaaatgcaagtggccaagatttggctgtgccgtcagcctttgcagttctaaaattgaccatgtgatcgaaaatccaagcagaaagttgtacctttaccctggagggggctgatgcgtcgcttcatttttctgctcttctgccgtctagtcctttgtactgaccggcgctccggtcggctcctcgcgcttgcgggttccccgtccccaccccacgccgggggcaagagatggagaacgcggtggtgctccgggagtggtttgaccgcgtcgacgccggccgcaccggcaacatcaccgctgcccagctccaggttcgctcccctcttcgccatagccttcacccgccgatccgttntaccgttagaggtgctgagtgctgatcgctaacgcgctccaaccggctgggttcccaccatcaccagggcgcgctcgctgtcggcaacctcaacttccccatctccgtcgtgcagcagatgattaggtcgtcttttcaccccttgccttctgttatgttccctacttccctctgtttttccgggtttttttttttttacttcgcggctagcaacgataacggccttttggtgcaggatgtatgacttcgatcggaatggcaccatgaacttcgaaggttaggcgcaccattattgctaagagcaactccaaactctatatacttcttaattgccaggaatagaggttttggtgggaaaaaatatccttaaacaacttctttaaatagttatccaaatataaccatcttccattccatatttcttgctaaccaaagatagaaaacgagaatggttaaaagctgagagtaaaaagatatagaatgtgattttatgcaaatgactctccaaacgataatttagagaaggaaattttgaaaaacttttggagatgctctaagtgaatgaagagagctggtggagctctagtctttcattgtgacttatccagttatgacctatgagttattctagactcttatatctgcgttcccttcgcagagtttctggctcttaacaaattcctacagaaggtatgtatgtggcttctctaatttggatctgttgcgcatttaggaattaggattagatgattagtggattactcactcagacaagcatcttctgcaacaggcaatttttctgtttcataatcaactgggtctgatatgtctcataccaactaatggccgtgagaatgttatttaggcttatataagttatacagaagatatttcgttatgataatgcacaaaagttatggtgtgcaatgaaaggtatatttgagagtaatagaaatagactcattgtgctgcatccttaactgtaagtttcttgtgtgcgactcatcgtaatcgcaggtgtttcctgtttccaatttgcaggtgcaaaatgtgttttccaccctggataggggtcgtggatttctaagtcttgaggaggtgtaccaggcattaatcaaacttggtttctcgttggattcaccagccttctatactgtttgtgagagctttgacaagagcaagaagggcatgattcaattggatgagtttatatcactctgcatttttgttcagtcagctcgtaacctgttcaattcgttcgatacaagcaagcaaggaagagtgactttagattttaaccaattcgtgtactgcacggcaaactgcaggatataatgtggttgtacatgggcgcccaaacaaaaaggttagcagtgtgaagtgctaaccgttcgccaatcaaacttcgtttctgaaccggcagctgggtattgcaattcactgttcgccatctaaggcttgttgtaccatcattttgcctgaatgtattcttggtcacctattggtcaatccgtgtccagttttctgacatcctgggctgtatatacagaataagacttggcaatttgtggctgtatttatataaaacatttcaagtaatccagacatccaaaaaaaaaaaaaaaa

SEQ ID NO: 11832 - DNA, 983 bp, Zea mays
tcgaggccggccgggccgggaatatgccaacgtttactagacgcgcccctgaatttctgctcttctgccgtctagtcctttgtactgaccggcgctccggtcggctcctcgcgcttgcgggttccccgtccccaccccacgccgggggcaagagatggagaacgcggtggtgctccgggagtggtttgaccgcgtcgacgccggccgcaccggcaacatcaccgctgcccagctccagggcgcgctcgctgtcggcaacctcaacttccccatctccgtcgtgcagcagatgattaggatgtatgacttcgatcggaatggcaccatgaacttcgaagagtttctggctcttaacaaattcctacagaaggtgcaaaatgtgttttccaccctggataggggtcgtggatttctaagtcttgaggaggtgtaccaggcattaatcaaacttggtttctcgttggattcaccagccttctatactgtttgtgagagctttgacaagagcaagaagggcatgattcaattggatgagtttatatcactctgcatttttgttcagtcagctcgtaacctgttcaattcgttcgatacaagcaagcaaggaagagtgactttagattttaaccaattcgtgtactgcacggcaaactgcaggatataatgtggttgtacatggacgcccaaacaaaaaggttagcagtgtgaagtgggaaccgttcgccaatcaaacttcgttactgaaccggcagctgggtattacaattcactgttcgccatctaaggcttgttgtatcatcattttgcctgaatatattcttggtcacctattggtcaatccgtctccagttttcttacatcctgggctgtatatacagagtaagacatggcaatttgtggctgtatatacagaataagacttggcaatttgtggctgtatttatataaaatatttcaagtaatccagacattcactcctttcc

SEQ ID NO: 11833 - DNA, 608 bp, Zea mays
gtccccgcggtggggcgcccgagaccgaccgcgcggtcggcgggagcttcccacacgtaattgcgtctttacaacggcgatctgcacgagacgcgtgccgagcccctcgttacaagaaccatcgtttggtagtaacatcaccttactttggacgaccctctccagttggtgcgttactaccggtggtagtagtgcttccttactatcaaccgtttggctaacagtagctgttcggcctgccagtggtgatagtggtgcttgcatactactctggatcacactgactggttggtccgttcctactagtggtacctgcttactactttgggtaacactagctagtctgactctagttgcaccgagtggtaccaccagtggtggtacttgcgtgcttgtacggccaacactatctctttagctcgtcccgactggtggtagtggtgcttgcttattactttggacaacgttagctggtcagtctatagttgctcccagtggtaccggtggtggtggtggttgcgtaccagcatgggtaaccctacctgtttgggtcgtacctaccagtagtggtacctgcttattactttggacaacgttagcttgttaga

SEQ ID NO: 11834 - DNA, 6701 bp, Zea mays
  misc_feature (195)..(195): n is a, c, g, or t
  misc_feature (4112)..(4112): n is a, c, g, or t
gatgatgcaagctgaaattattgcttgttacaacacaacaagctaggctatttggcttaaaaattttgtggtgggccttaaatttgtagacaccatttcaaaaccacttacttttaggatattaggttgtgaattgtgatactattttctggtaacgaaaaattaactaaggggtcaaaacatttagacctcaantattatgttgtgaaggatagaactcagaatcatactattaaatttgaggacataggtactaagttgatgtttatatagcaacttactaaaggcttaccatataacctttctatacaacatccattaagcatgggcttagtggagagtatataattatgggtaatagggccatataaataactcctaataagtatatctggtagcgttcggtttgaagcgcctcactgcgcggccagtattaggacttgttcggttagaaatggattgatgggcattggacctatatatacaaatttaagtaggagaaggtttaattccttcgatccatcttaatccgaacaagcccttactatttaaaatgaccctctcaatcctctccattacacttgctcctagtgcttgtttgggagaagatgattgagaggagtagaggactagaatccctcaataatgagggattatgctcaatactcttcattactttacacctttggatgttatagtatacatataggttgagggggattagaatgtaaattgtaatttatacgccgagtattcaaacatagtctaagatgttggaaggtttaggaagatccgtccccgtccaggtgagtgccggtagcgtccagaaccagaaggtcaccgctacccgacaactcgttcttcacccgcagaggatattgcatcaactcgtcctccggtggtaaattattgaagtcatctgctacacctacgaatattgcatcatcaccagaggctgctatggctgcacacaactctggcctgacatcaagaacttcggcattatgtataggttatgatcatgcgttagattaagttttatttcaagggtcttctcatgtcctcggcatacatgaacatggaaagcatgcaccttgagcgatcgacatacaagtgtgaagtcattgtcaaaagattaggtagcttaacccaaccgatctccatgtgaagaagagaaatcagatgccaccccgccagcaccggacacaatcagattcacctcactttggcctacactatatatcatatgaaaagatatggcacctaaaaaaccaaatgcatggaccgacgcaaagcgataatgcatgggtgcgtttccgatgcatatctcccttggtcgtccgcgaatctgtaaataaaatatgtggagtttcatcagagccacccgttcgagatcgaatgtttgggactagttttgcgagagaataatctgtgtaggcgaaaaagacactgcatagcttagtgtggagtaagatttactcaaggggttgatcagttaagctgctggtggcagggaaatggatgcgacgacgacgatgagatcatatgacgacaaaatctatggtctccctgaacgctgatgaacaggcgacaggagatccatcaatgctacataaaagtcctgtttgttatgatggaaaacttgttgttgtcgaaacttcgttctcgaaaccttgtatcattggttgttggtggcatgaacagacagatagagcccccgatccgaactagctagcatgaacaattaatcgccgctcctattcgtcgaaagcgtttcatttcctcatagagtcataggtaaagcggatcgatatattctttcccacgcagccggtggaagcctattgcccaccataccaaccccgcgttgcggttatatagggccgtatttcccccgcgtctccgcgtcagtggaagcgatcgacaccattcaagctaaagctgctttcttgggaaacgcttgatcgcaacagctcgatcaatggcttcttcctggggttctcggttgccgctcgcagtagtgctgctgctcgtggcctgcttctcctccacggcagccgccacaagctacaccgtcggcgacgggtccggctggacaaccggcgtcgactacacatcttgggccgcctccaaaaacttcaaagtcggggacaatctcggtacgtatatgcgtgctgtcgtcttgcttcatgcatgtgcatgcatacgcaggcacatgtcgtcacgcacgcgttctggtttcgtcctttggctcacgcgatcgagtttaatttgtttgtccgatatgtgggtcgcagtgttcaactacgcgaaagggctgcacacggtggtggaggtgagcgcggccgagtacatggcgtgcacggccgccaacccgctgggctccgacagcagcggcgcgaccaccgtggccctcaggacgccaggcacccactacttcgtgtgcagcatcacggggcactgcggcgccgggatgaagctggcggtgaccgtcggcggctccaactcccctgctgccacgccgcggacgtcgtccccgacccctaccacgccgtacacgacgccggccaccaccacgccgtacacgacgccgacgtgctctggcggcggcggcaccacggcgaccccgggcatgactccgttcacgtcataccccagcgcggccggccttgggtcggcggcgttggctggatttagtctggtttggtgtgtgggcgtccggctagcgctgctctaggcaaagggcggccatggaccgtggtcgaccagggtatgtaacagtgtaacgtatgtgtttgttctttggtccggatcgagctagctggggtatagtatacttgaaaaaaaaaaaaaaccaagctggtgactggtgtctcgactccactctaaatcgccgtgcaaccaaaccgtgcaaatcactttccttgaaccagtcgaattgccccgcatgtgcaaaccaaacaggcagtaaattaggcagagggaagcccacgtgtgagattaatttagcccatctgcacataaattaggcctatgaaggcccatgtcatattagcaggtttcgtggcattcgcgggcgcggctgagccgtgtaatcgagccgagctgaagctgatgactccgacaccgggagcttccgttaggcgggcgtctgcgcagtgacgtctgggacagcggcttccgttaagcggccgtctgcgcattgacgtctgggacagcggcttccgtcaggcggtcgtctgcgtaacgccgtctggtcgtctgcaaataagtttacaacgttgaaaataagttcagccgtacaatccacttatcttcaactaaatcaagtataacaactttaattgccccttcacggtggtgtattattcttgactggaagcaactatatttctactagaaaaaaagttacatgagaaaacaaatgttttaaatagaaaaataaaatgttctacgagacataatttctagagaaactggtgttttttgctcggcctctggtgttagttgccttgggccatagtcttttttttttgttccttcagctagctgaattatcctgcaactaatagcaaaggatgtgatgagttggacgataagagaccggctaaatcctgtagccattttgttcgtacccagccagcatcactcgccttccactaaaattgacacatcgctgacgacaccaaatggcaagtgctttgccttggtgcctgactctaggcctctagctcacagctcagtcacccgttgttccgttaagtccacggggacaagatcacaagaggcctctgaactctaaacccaaactcttgttctagttaactcctaaacacttatgagtcatttgatgagttctaactcctaaacacttttagtctctggaatcaaatacgtaagtaggaactgaagttttggtggtgcctactgtcatgttcatctcttgtttgatcggcgaacacatcgatggatatgtctccatctcagaggcattggtgtcttcttctcaatccctgtccagagaatcggacctaccagcctactctacgtacgatgaaatgcctctgctctcaggttttaggtggttgcacctgcacgtacaggtgtagaanagtagggagaatctgactgcttgccttgccggtgcctccgtgttgtgttgaaagccctatctgaacatgaaaccatactgcacggcggtgcgagtctggcgaattatggcgagtgtcccgtggaaacagcttgacttccacagcttgagtaggttctgacggcgagtttacaacggcgtactacgagaatcccaggcggtgccggtgccaaatcaggtcgcaccgccacaaccccgtccgcgtctcggccgacgaggaagcgtcgagcgtccatgtgctgatgagtgcatgcgacgacgacaactggacagcgccacatcggagtaagcacggaactgccgtactccacagccaggtcgctagccaccatgccgccggcgccccagcccaggtcgggaaccccgctgctcatctcgcgccccgcgcgcgtggcgtgcacggcggcgatgcaaaagcgaccaccgcgttaataaataaaaacggattgtttacgctggtcccctcgcctcaccataaccccaaaaatattcgagttcacgcttgacattgccgactttggcgcggattaccaagttcgcattctgcactcggcacgtcgatgtcgatacggatgttctgcgtttttatggtaaatatgagtatacgtattcatatctaacttaaatatagatattaaataaatatatttattttaatttttaaaaaaatcgagaggaccaggaggaggaggagtgtgcaggattcgccctactctccagttatcttcgttggtttatttccgctgcataaaaaactatgctttctacgtctgaacttcgattgatgtaataactttaaatactattttaaatcgtggtattatgctttactttattctttgtgcctcaccttcgagtgaacaagtgatacttaatccttgttgagtggttttatcggacgagaccaacgggctgacagattatttcaatttaagtgtgccattgactttaaagcgagacttggacacttaagcaaataatcttgtcggttctgccacagttgttcattatatgctaaaaaccaaaatatcatatattattcatatccattaagtataaattaatctataatcatctaaatcatataactacgactaattaagtatataaataaaaaattaatataacgttgatatgcaacgttatttaaaagttatgtggggttgttataactatagtaaaaatataaatcttagatttaattaatttaagtaaagataattatatcactctgtattttatttatatatttataatttatttttagttaattaaattcagtaattaatatatatctctttttatgtttaattatttaaatattgattaaatcattttttatggttgtctttatcaatggtgctatatagatatattttaaattccatcattcgtactaattatattgtactaaaaaactatagataatcaaaaaagataaatattactttgaatcaagtaattatcgagatattcattttatattagtatccaataacatttgtatcccgatttaaattaaaattacaaatactaaatagtgatttaaattaaaataccagttttcaaccagtttttatgagatcgttttgataaaattgtctaaaatcagggtagacatataatcgatcaaatcattccgatattaagaattcgttattttctggatcctaaatactatggactatttttcacgtgtaatttctacgatacttttagtgaaactcgtcaataaaaaaaaagatgaaacaaactgtcctttttatttctacgtccacggctggtgccaaatgtgtgttttttttgcctgccctatttgaaagttcgagcaaagtttcatggaagtcgtaccgaagccggcatcgtgcaccgagcttgcttgcttgccgtcgaaaccatgccaggaagtttcatgtctcctggaaatcttgaaaacagaaacagcaattgggaccaactgcggagctttaggactcggtctagctcggacagaagcaaaggccccattttccgccgccgtgaaaccaaccggtcagaagtcaacctgattcagacgaccggattctacagaaaacatcagacgacccatcttcaggagaccacgactgggcgcattcccgccgttttcgcagctgcttcgcgacatgcgcgagctcctgctcctccaccgtgcgcttgtggctgatggagatgggatctctgtgtttgcagtaacgtcaagatggatgcctgtttgctctgcaaatagtgagggtgaggttaggaagacataccgacaatggtttagcatgcagtgctttaaaatcagttcgatcttttctgaatgagggcattaattttagcttgtcttcgtcgtctcaatgtccaaagcctaagggagacataccgaaaatggtttagtggtgtgaaatgagagtcagaggcgtgaaatgagaagtggtaaaggtaatttggagagtgagatgtgtgaataaacacaaacgcctccattatttataggtcggattctttttttagatttttgatttttttattctaaatttctttagac

SEQ ID NO: 11835 - DNA, 978 bp, Zea mays
attacccaccataccaaccccgcgttgcggttatatagggccgtatttcccccgcgtctccgcgtcagtggaagcgatcgacaccattcaagctaaagctgctttcttgggaaacgcttcatcgccacagctcgatcgatggcttcttcctggggttctcggttgccgctcgcagtagtgctgctgctcgtggcactgctcctcctccacggcagccgccacaagctacaccgtcggcgacgggtccggctggacaaccggcgtcgactacacatcttgggccgcctccaaaaacttcaaagtcggggacaatctcgtgttcaactacgcgaaagggctgcacacggtggtggaggtgagcgcggccgagtacatggcgtgcacggccgccaactcgctgggctccgacagcagcggcgcgaccaccgtggccctcaggacgccaggcacccactacttcgtgtgcagcatcacggggcactgcggcgccgggatgaagctggcggtgaccctcggcggctccaactcccctgctgccacgccgcggacgtcgtccccgacccctaccacgccgtacacgacgccggccaccaccacgccgtacacgacgccgacgtgctctggcggcggcggcaccacggcgaccccgggcatgactccgttcacgtcataccccagcgcggccggccttgggtcggcggcgttggctggatttagtctggtttggtgtgtgagtgtccggctagcgctgctctaggcaaagggcggccatggaccgtggtcgaccagggtatgtaacagtgtaacgtatgtgtttgttctttgttccggatcgagctagctggggtatagtatacttggacgaaggaagctgccaagctggtgactggtgtctcgactccactctaaatcgccgtgcaaccaaaccgtgcaagtcactttccttgaaccaatcgaattgccccgcatgtgcaaccc

SEQ ID NO: 11836 - DNA, 1132 bp, Zea mays
  misc_feature (15)..(15): n is a, c, g, or t
  misc_feature (30)..(30): n is a, c, g, or t
  misc_feature (35)..(35): n is a, c, g, or t
  misc_feature (37)..(37): n is a, c, g, or t
  misc_feature (39)..(39): n is a, c, g, or t
  misc_feature (50)..(50): n is a, c, g, or t
  misc_feature (161)..(161): n is a, c, g, or t
  misc_feature (1078)..(1079): n is a, c, g, or t
  misc_feature (1085)..(1085): n is a, c, g, or t
atcctcgggacggcnccttacatagtactnctcgncncnccctgccgcgncgcctcgccgggccctgccgcgtcgcctccagaaacgacgccagcgcgccacccgcctccgccgcgcctgacgaacgcagagtaggactgtgcaggtagagaggaggaggngccggcgagacggggatgcgagaaaagaagcggaaccagaagcgagtgctcgcgcgccgaaccgaggtaccgcgcccaggcgagggcaaggactacctgccgctggaaggaggccccggtaagaagctccggaaggtgcagcagcctgaagagcccgaaaacacagccacagtcgtctacattgggcatatcccccatggttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcaccttgcaagttgcacttgttgagccagagaaagttcatcctaaattatggaaaggggtgcgaaggggatttatacctgttgatcgagtagcaattgaacggaagagacacaacaaggataagactgtagcagagcacaaaaagatggttgaaggaattgtaaagcgggatggaaagcgtcgcaaaagaatcaaggcagctggtattgactatgagtgtccagctcttatagggagcattcaaccatcagcgaaaaagatcaagttcgatgaggcatagtattttattctaatgggctgttggatccttagtagacgaggcggtggaatggttgagcaatatattcaccttttgaggagacggcagacaactatgtatttcacttttgaatttctctatgttttatgaatgacaccgacacagatgttacaacttaagtatgaaaatgcaatgggcgatgtgttcttaatttgcccttggaaggttccaaaaaaaaaaaaaaaaaaaaaaaaaaaaaaaaaaaaaaaaaaaaaggaaaannaaaaanaaaaaaaaaaaaaaaaaaaaaaaaaaaaaaaaaaaaaaaaagggggg

SEQ ID NO: 11837 - DNA, 1137 bp, Zea mays
actcctatagggcgattgggggtcccgaggccggccgggaaaccctaacccctcctttcgtttgcccatcctcgtgacggctcctcgccagtcgcctcgtctctccctgccgcgtcgcctccagttccgcctccgccgcgcctcccgcctccgccgcgcctgacgaacgcagtataggactgtgcaggtagagaggaggagggtccggcgagatggggatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctgaagagcccgaaaacacagccacaatcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcaccttgcaagttgcacttgttgagccagagaaagttcatcctaaattatggaaaggggtgcgaaggggatttatacctgttgatcgagtagcaattgaacggaagagacacaacaaggataagactgtagcagagcacaaaaagatggttgaaggaattgtaaagcgggatggaaagcgtcgcaaaagaatcaaggcagctggtattgactatgagtgtccagctcttatagggagcattcaaccatcagcgaaaaagatcaagttcgatgaggcatagtattttattctaatgggctgttggatcctgttggatccttagtagacgaggcggtggaatggttgagcaatatattcaccttttgaggagacggcagacaactatgtatttcacttttgaatttctctatgttttatgaatgacaccgacacagatgttacaacttaagtatgaaaatgcaatgggcgatgtgttcttaatttgcccttggaaggttccataaaaaaaaaaaaaaaaaaaaaaactcaagactagtctcctcgtgcaaaaaaaaaaa

SEQ ID NO: 11838 - DNA, 1163 bp, Zea mays
  misc_feature (1118)..(1118): n is a, c, g, or t
  misc_feature (1120)..(1120): n is a, c, g, or t
  misc_feature (1127)..(1127): n is a, c, g, or t
  misc_feature (1132)..(1132): n is a, c, g, or t
gggtacctcgtggccgccctcgaggccgggccgggaacccctctccttcgtttgcccatcctcgtgacggctcctcgccagtcgcctcgtctctccctgccgcgtcgcctcgcctctccctgccgcgtcgcctccagttccgacgccagcgcgcctcccgcctccgccgcgcctgacgaacgcagtgtaggactgtgcaggtagagaggaggagggtccggcgagatggggatgcgagataagaagcggaaccagaagcgagtgctcgcgcgccgtaccgcggtaccgcgcccaggcgagggcaaggacttcctgccgctggaaggaggccccggtaagaagctccggaaggtgcagcagcctgaagagcccgaaaacacagccacagtcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcaccttgcaagttgcacttgttgagccggagaaagttcatcctaaattatggaaaggggtgcgaaggggatttatacctgttgatcgagtagcaattgaacggaagagacacaacaaggataagactgtagcagagcacaaaaagatggttgaaggaattgtaaagcgggatggaaagcgtcgcaaaagaatcaaggcagctggtattgactatgagtgtccagctcttatagggagcattcaaccatcagcgaaaaagatcaagttcgatgaggcatagtattttactctaatttactctaatgggttgttggatccttagtagacgaggcggtggaatggttgagcaatatattcaccttttgaggagacggcagacaactatgtatttcacttttgaatttctctatgttttatgaatgacaccgacacagatgttacaacttaagtatgaaaatgcaatgagctgtgttcttcatttgcccttggaaggttccatataacattgtgttcttaattcaaaananaaaaaanaaaanataaaaaattaataaaaaaaaaaaaaaaata

SEQ ID NO: 11839 - DNA, 1167 bp, Zea mays
aaaccctaacccctctctttcgttgcccatcctcgtgacggctcctcgccagtcgcctcgtctctccctgccgcgtcgcctccagttccgacgccagcgcgcctcccgcctccgccgcgcctgacgaacgcagggtaggactgtgcaggtagagaggaggagggtccggcgagatggggatgcgagataagaagcggaaccagaagcgagtgctcgcgcgccgtaccgcggtaccgcgcccaggcgagggcaaggacttcctgccgctggaaggaggccccggtaagaagctgcggaaggtgcagcagcctgaagagcccgaaaacacagccacagtcgtctacattgggcatgtcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggttgtagcagatgagatgaataactatctcttgtttgagcgcaccttgcaagttgcacttgttgagccggagaaagttcatcctaaattatggaaaggggtgcgaaggggatttatacctgttgatcgagtagcaattgaacggaagagacacaacaaggataagactgtagcagagcacaaaaagatggttgaaggaattgtaaagcgggatggaaagcgtcgcaaaagaatcaaggcagctggtattgactatgagtgtccagctcagatagggagcattcaaccatcagcgaaaaagatcaagttcgatgaggcatagtattttactctaatttactctaatgggttgttggatccttagtagacgaggcggtggaatggttgagcaatatattcaccttttgaggagacggcagacaactatgtatttcacttttgaatttctctatgttttatgaatgacgccgacacagatgttacaacttaagtatgaaaatgcaatgagctgtgttcttcatttgccctaaaaaaaaaaaaaaaaaaaaaaaaaaaaacaaaaaaagacaaaaaaataaaaaaaaaaaaaaaaaaaaaaaaaaaaaaaaggaaaaaaaaaaaaaaaaaaaaaaaaaaaaggtccctgcccggggggccgttaaggggca

SEQ ID NO: 11840 - DNA, 1429 bp, Zea mays
aaacggtcaaatcatccccgtctctctcttgaaaaaaaatctcccggaaccaatcacaatcacaaacgcaggcgcagggaggcgagtgcgggcatggccaggaggggagcggcggcgaagggaacctggaggccgaggaggaaaccctcgcgcgcgcaagcggatgtcgacggcgacgcggtacaccgcggcgccgaaggcgggcgccctccgccaaagggacacacaactgccaccggcagcggcgggtttttctgctgctacctgctccggtccctctgcccgcgcagcaagggccgcacctacatcggcttcacggtgaacccgcgccgccggatccggcaacacaacggcgagatcgtcagcggcgcgtggcggacccggcgcggccggccctgggagatggtgctctgcatctacggcttcccctccaacgtcgccgccctccagttcgagtgggcgtggcagcacccgacggagtccctcgccgtgcgcaaggccgccgccgagttcaagtcgctcggcggcatcggcaacaaggtcaagcttgcgtacaccatgctcaacctcccctcatgggaaagtctgaacctgacggtgaacttcttctcctcgaagaacaccaagttcaccaccggctgcccgtcgctgccgagccagatgaaggctgtcgtgtgcggtatggaggatctgcagtgccagcccgacggcccgtcatccgaggaggatgacaatgacatccgcgacgagtcccaagataatggggaagaaccgcctgactcgcctatccgagatggattttcatattctgactactgtttccagcaaccgtcctctgatcaagcgcagccgatggacgagcaaaccataagtgcaggttctggtgtcgaggatgactttgttgacgagttcgcttcttcgatggaaaggagcgaaatccttggcacaagaagaggactgaacggaccaagaacatcgcctctatgttccttgggcgcgtgcagcaacgatgacggattggaagaagaggcaggactgatgtctccattattgatgcccaatgctagctcagatgctggtgacggccgccatatcctcaacggaaaccacgtggtggacttggttaccccgactccactaggccggctccggagaagagactgtatttccagcatctgtccaaagatcattgatctgacgtcctcgcctattgtcattcagttgtagtgtcttgtattagactgacttcatcaggtcctctaaacgatcatgtactctaaattatagaggacaccatcatcctctacttcatccagcagtattctttaaactgtcctctaaatttagaggacactgctagatcatcgatatatatagtttctctattctctcctgaaaaaaaaaaaaaaaattaaacaactagtttagc

SEQ ID NO: 11841 - DNA, 2577 bp, Zea mays
ctgcagcgaggttatggaccgttcggccctgtgctgcggatcgtccgcactcctgaagagggcaccttcaaacggtacatgcctagtgattgatgaccaaattggagactccgctggggacttggtgcaacacctcactataagttacaccatgacatccgatgttgttcaatctcctaaaagatctgtatgtgacgatcaaattaaaagtatgaataagtatatagagaaaatgaggtgtacgcctgattttgtcacctaaattgggcacagtaacaatcgcaccaaaaacatcagcaacaaatggtttttttagtcccagccatattatggcaccgtaacaatcgcaccaaaaacatcagcaacaaatgattggagagctcttttttttactggtggacataagttcgcagtctatgggtatagtagtgatgtttgtgcgtcggatgtgcggccgacgatcctgagcgtcaccgtcgcacgtgccgtggttggctttgacatgtccatccacacttgccctgaggttacgtcttatattcgtgtccaagatagaagtccatggctgcgcacgcctggatgcttctcaccttacacgtcctcatcgaccttccatctatatctcgccttctgtgcgtgtagtgttactcattagagatagatctactacccgaacagtttacctgagtatagtgccatgtcgacggcaccccacttcgtgctggtgccgctcctggcgcagggccacatgatccccacgatggacctggcgcgcctcatagccagccagggcgcgcgtgtcacggtggtgctgacgcccgtgaacgccgcgcgccacagggccgtcctggagcacgacacgcgtgcggggctcgccatcgacttcgccgagctcgcgttcccggggcctgcggtcggcctccccgagggctgcgagagcttcgacatgctggcagacatctccctcttcgccacgttctacgaggcgctgtggatgctccccgagccgctcgaggcgtacctccgctcgctgccccgtctcccggactgccttctctgcgactcgtgcagctcgtggaccgccaccgtcgcgcggcggctcggcgtcctgcggctcgtggtccacttcccctccgcgttctacatcctcgcggcgcacagcctcgcgaagcacggcgcgtacgaccgcgccgcggacgacttcgagccgctcgaggtgccggcggagttccccgtgcgcgccgtggtgaacagggcgacgtcgctggggctcctccagtggaccgggttcgagaggttccggcgcgacacgctcgacgccgaagccaccgccgacggcatactgttcaacacctgcgctgccttggagcgcgccttcgtggagcgcttcgcggcggagctcggcaagaggatctgggcggtggggccagtatgcctcgtcgactccaacgctgcccgcgcgacggctgagagaggcgaccgcgccgcggtggacgccgagcaggttgtgtcctggctcgacgcgcggccggcggcgtccgtgctctacgtcagcttcggcagcatcgcgcgcctgctcccgccgcaggtcgccgagctcgccgtcgcactggaggcgtcgcgatggccgttcgtctggtcggccaaagagacggccggcctggacgccgggtttgaggagcgcgtgaaaggccggggcctcgtcgtccgcggatgggctccgcagatggccatcctgtcgcaccctgccgtgggcggcttcctcacaaacgccgggtggaactcgatcctggagagtctctgctacggcgtgccgatgctcacttggccgcacttcgtcgaccagttcctgaacgaggcgctggtcgtggacgtgctcggcgtcggcgtccgctcgggcgccaaggtgccggccacgcatgagatgcacgtaacgatagaggtgcaggtcggaagggtcgacatcgagaggaccgtgtcagagctcatggaccaaggctcgtcgtcggcgatgcgcgcgagggctaaggagctcgctgcagaggtgagagccgcaatggcgaagggcggttcgtcggacgccgacgtgaaggacattgttcgccacgtcattgaggtggccaagaataagagggagcacgcacgagggcaccattcttgatggaagactccaatggtaatcgctaaggacaaacacaaccagcgcgcgcggaaacaagaagctctcgaggagtagacaacagaggcctaacatgcgaagaggacatgctgctgttgtatatatttctccacctttcatccgaatcaatcaaacaatatagatgcctgttaacgacggacccaaatacgtacccgcctttttaccctgcagaagttggatttttttttgtaaaatctatatgcatgttataccagttgattgctgacaagtcacggctaaacctgaaccatgatagactactagtcaaacaggcttcagttgtgcttgaaccggtggatcttgggatcaaacccaaacatacaacgagttggtctataggtgtacatttgggtcgggtttaatggctggcacgaagc

SEQ ID NO: 11842 - DNA, 2422 bp, Zea mays
gcgatttcacctattttttactgtaacatcctgccgtgggagtcacgatcatcggctccgcctcctccgagggaagtacagatcccttcaccgctgctcgaatagatcgtctgcagtcgcgtgactcgactttaccccgctgctccgcttccctctctcgtgctcgccgccccacagctcgaagccgacgaggtggcctcagcacacgcgcgcgcagccatggcagcattatcagcgaagaccatacaaaatgcattcttggcacaacacacacggaataggcatggtgcaagatatcccagtgatttttgttctctcaatacccgcagcatgcattccgtccaggaatgtagattggcagtggctgattcttcagccaaatggttaaataccacatcgacactatggactagcttcaacaaacaagcagacattagctgcaatgctgctcaaggtggcactgttgtgtgttcatctgagaaagttgagtttctgaagcttcaaaatggcagtgatattcgtggtgttgctgttgctggggttgaaggtgagcctgtcaacctcacggaagatgtcactaaagctatagctgcagcttttgctgcatggctgttaaacaagaaaccagatggctggagacgtttaagaatctctgttggacatgattctcgaggcccgccgcgtaaattgcagaatgcagtcactcatggaatcactactgctggacacgatatcctacagtttggattggcttcaacgcctgcaatgttcaacagtacacttacagaagatgagagaagtcatttacctgttgatggagccataatgataacagcaagccatctcccctacaatcggaatggtctcaagttttttacaagtgatggtgggctaaataaagctgatatcaaagatatcctggagcgtgcttccaaaatatatgaggaatctgcacataataacctgaaagaacagggggaagcttcgaagggagttgtcactaatgtggactacatgtcaatttatgcttctgatcttgtacaagcagttcgtaaatctgctggagacaaagaaaaaccattggaggaactgcatatagtcgttgatgcagggaatggtgctggtggtttttttgtggataaggtactcaaaccattaggagctgttaccactggaagtcaattccttgagcctgatggtttgtttcccaatcacattcccaaccctgaggacaaaaccgcaatgaagtttattacacaagcagttcttgataacaaggcagacttaggcatcatatttgatactgatgttgacaggtctgcggctgttgattccaggggtcgtgagttgaatcgtaaccgattgattgctttgatggctgccatagttcttgaggaacatccaggaactacagttgtgacagatagtgtgacttcagatggattgactgtatttattgaaaataaacttggagggaagcatcaccgtttcaaacgagggtacaagaatgtaatagacgaggctattcgtctgaactctattggtgaggagtcacatttggccatggaaacaagtgggcatggagcgctgaaagagaaccactggcttgatgatggagcataccttatggtcaaacttttgaataaacttgctgctgctagaacactgggttcaagtattggtagtaaagttttgactgatttggttgagggccttgaagaagctgatgtgacagttgaaataaggttaaagattgatcagaatcatgcagatttgaaaggagggtccttccgtgactatggagaatccgtcttgagacatttagagaatgcaatcagcaaagacccaaatctccataaagccccggtgaaccatgagggcgtaagggtttcaggatatggtgggtggttcttgctgaggctctctctgcatgatcctgttcttcccctaaacattgaggcacagagtaacgatgatgcgattaagctggggcttgcggttcttgctgctgtgaatgaatttccagcactggatgtgacggcactgaacaaattcgtgcaccagtgaatataagggacggacattggcatcataatgtgatcagcttcgcatggtgccgtgttcgccccggtcgaacatgttctacatgtgtggcacgagtatcgtacagaaatataccagtttattacttgcacaggcttgttagtctggaaggacaagggagattccagtgttgagatgattcttgtgtgtgtttataccagctatcaaagtaagaatatgcgtgcgtactgttgaggctgatctttacttgagaataaggtttgagttacccgaatattttttgtaaaaggatcaggaggcttgctgtgatgtgaggccacgaatttgccaataagtacctctcgatttttcttccgcg

SEQ ID NO: 11843 - DNA, 880 bp, Zea mays
cccacgcgtccgcactcatacactccagtagctagtagtagtcgacccatctgcatctgtctgtgggctcgcccccggccggccacctttccggccgatccatcatctagagctagctagctcatcatcagtctttcgcgtgtgtgtatgtatatggtggtgaccagagcagctagctagctaggagcagggtggttgttctatagttcgttcctatggttatggtggcggcggcggcggtactgctcgctctggccgccgtggcgacggaggtggccgcggcagggacgacgtacacggtgggcgcgccggacgggctgtgggacatgcagaccgactacgcgcagtgggtgaagagcaagaccttccgccccggcgacaccatcacgttcacgtactcgccggagctgcacgacgtggtggaggtgacgagggccggctacgatgcctgctccagcgccaacaacatctccgccttccgcaccggcaacgacgccgtgcccctcaccgccgtcggcacccgctacttcctctgcggcctcacgggccactgcggcaacggcatgaagatccgcgtcgacgtcgtcgccgccgcggcctcgccgtccgcgccgggccccgccgctgccgccgcggcgccgccgacgacctcgtcgccctgcaacgtcggagtcgtcgccgcctcgctactactgcttctgctgcacgccgtcgtcagctactagcttcgccacgcgtcgcttgagttttgttatgtttcagctgtgtgttcgtccattccatatatatcctcatatatatacacacacaactgttcttttttcgcgcataattacgcgcaggacaagagcgcatcaactgcattaaaaaaaaaaaaaaa

SEQ ID NO: 11844 - DNA, 633 bp, Zea mays
  misc_feature (633)..(633): n is a, c, g, or t
gtctgatgtcttgtcatcacaaactcactacacgatcggctatagcgagctaacagaagctctatcaagtactgtgtaggccatggccggagccctcgtcttcgtcgctgttctcctcgccgcaagcgtcggcgctacgacggctaccacgctgaccatccacaacctctgcccccacccggtgtggccgctggtgaccccgagctcgggcttcccctccatctccaccaacaccgcgcggctgggccccaacgcgctgctctccctctccttcccgcccaccttctgggccggccgcgtcgccgcgcgcacgggctgcgacgccgccgcgtccggctgctggacggggaccacgccgcccgccaccgtcgtgcaggtcaccgtccacgacggcgggaacctggaccaggccacctacagcgtgtctctcgtcgacggcttcaacgtgcccatggtggtcagcccgcaggccgtcggcggcgggcagtgcccggcgctcgggtgccccatcaatctcaactgcgactgccctccccagaaccgcaccgcccggggcgccgcgtgccgcggcccgcccgagtactacaagaacgggtgccgctcacaggacacggcccacgacgtcgagcccgn

SEQ ID NO: 11845 - DNA, 1776 bp, Zea mays
  misc_feature (1548)..(1548): n is a, c, g, or t
  misc_feature (1568)..(1569): n is a, c, g, or t
  misc_feature (1665)..(1665): n is a, c, g, or t
  misc_feature (1736)..(1736): n is a, c, g, or t
  misc_feature (1740)..(1740): n is a, c, g, or t
ctcggggcccgcccggccggcaaaacaatcccaacctttagcaccaggcaaaccaaacactaggccaacgcaattctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctggccgtggacgggcacccggtcctgctggacgtgccggccaacatccgtctcaccccggcgtcgacgctcgtgcccgccgcggacgtccccgcagcgggcggcggcagcttcctcggcttcgacgcggcggcggccgagagccggcacgtggtgcccgtcggaaagctccgtgacattcggttcatgagcatcttccgtttcaaggtgtggtggacgacgcactgggtgggggacagcggcagggacgtggagaacgagacgcagatgatggtgctcgaccgctccgccggcgagcccgtcggcggcggccgaccctacgtgctgctgctccccatcatcgagggctcgttccgggcctgcctcgaggccgggaaggtggaagactacgtggacctgtgcgtggagagcggctcgtcggcggtgcgcggcgccgcgttccggagctcgctgtacctgcacgcgggcgacgacccgttcgagctcgtcgcggacgccgtcagggtggtccgcgcgcacctgggcacgttccggaccatggaggagaagacgccgccgccgatcgtggacaagttcgggtggtgcacgtgggacgccttctacctcaaggtgcacccggagggcgtctgggagggcgtgcgccgcctggcggagggcggctgcccgccggggctggtgctcatcgacgacggctggcagtccatctgccacgacgaggacgacccgaacagcggcgaggagggcatgaaccgcacctccgccggcgagcagatgccctgccgcctcatcaagttccggccctcccgcccggccggggagtacaagcagggcgggatgggcgcgttcgtgcgggagatgaaggcggcgttccccaccgtggagcaggtgtacgtgtggcacgcgctgtgcgggtactggggcggcctccgccccggcgcgcccggcctgccgcccgccaaggtggtggcgcccaagctctcccccggcctgcagcgcaccatggaggacctcgccgtcgacaagatcgtcaacaacggtgtcggcctcgtcgaccccaagcgcgcgcacgagctctacgatggtttgcactcccacctccaggcctccggcatcgacggcgtcaaggtcgacgtcattcacttgctggagatgctgtccgaggagtacggcggccgtgtcgagctggccaaggcctacttcgccgggctgacggcgtcggtgcggcggcacttcggcggcaacggcgtgatcgcgagcatggagcactgcaacgacttcatgctgctgggcnacggaggccggtggcgctgnngccgcgtgggcgacgacttctggtgcacggacccctccggcgaccccaacggcaccttctggctgcaggggtgccacatggtgcactgcgcctacnactccgctgtggatgggcaacttcatccacccggactggaacatgttccagtccacgcacccctgcgccgncttncacgccgcgtccgcgccatctccggggggccatcta

SEQ ID NO: 11846 - DNA, 1886 bp, Zea mays
agcgcgcattaccctcctaaagggaatcaagaaggagctcgtgggccgcttttttttttttttttttcaaagaaaagttcatgacatttatatttgcagctacaaggttcttaaggaacatatttctgaaataaaggtatcagtgtgacttatacgagaaggacggaagcagattgattgaacccatgagatgaacaggaaatcttgaaggcctgctcccaatggctgtggactgcaatctccggcttcacagccaacaatgtttcctctggaacctccagggatgaaaggttctctgtctgatatgttctcaggtttaaatgtgcctcctttggaaacaattcgagcttcttgggatgaagagtccaactgcatttatcaagcgaaaaactgaatgaacaaaaacatccatcctccaaggaaaagaagcagggccctgcatcaacttcattatccatgtatttcaacgggagcatagtgatggataagttaggagcacgatcattatcagtagtagtgacactgatacaataagcattgatggatccattgccctctgacaagccaaggaataaagagccatgtggggtggcgcggccaacgaatggcagctccttggtgtcaactttgtgccactcgactgaattggtgtcaaatgcatatgtgccccatagttgattgaatgataccagtatgtaggtgtcgaccaccacataagacgtgatgagtacaactggcagcatggtataaccaaatggggtaatcttccaaggaaagcaaggtggatgcggtagctcaatccaggagcatccctccaggtgggagcggtcgtcaacagtgacaactttggctctggaaagatcgagtacctcgaaccagggtgggaaatcggggtctgtgaaccagcagggagtcttgcacagggcataaatcttgtcccccactgttgtcaagacagggcaccactttgtagaattgagagtcggcccgtgaataaccttcttcgtcttggtgtcgaagatgacggtgtcacccggatcacccccgaccccaatgatccacgcgcggtgcactgaccgcagggacgtgaaggtcataccgccagcaacggtggccagacgggtaactcggtgcaggcgtttccgcttcacccgcgaaggaaaggaagtggcgacgtccatcttgtacacggagtagggcatggaattcctggaccaatcccagtggcatgccacaaggtaggcagatcgaacctggccttcatccaactcatcgccgacgatcctcatcgggtcgagatgttctgtttcttgcatcagcggatcactgtcaccgccacacacgatctccagatcccccatctgaatctgatccggatcttcgcttccttccagctccactaatggtttgacccttccatgactgtcgtccgtctctctcttcctgcggcccatccctccctaaggtctttgctgccgccgagaggccgccggaggaggtggtggttgttgccttgttgggcctgtggatgtgagcgtggaggcacagccgcacagctgctactagtcctccgcagtacggcacggcctcagtgcctcaccggtcggcggtcaccgcactgcacggctgcacctgctactgccagtgcttgcaagccaggagccgcgtggaagtggaactggagacacagctgggcagctggcaagttgcttgcaagccaggcagctaggagacaaccgcgagagggaccgtcgtctcgtcgtcgaccgagttccgaccgtccgagagggcgaggcggctgcggcttagcaggcagcagctgggcaggggcccccgcccaacgcgtggggcctccggcctttgtgcgttcaccttgggccgtgggc

SEQ ID NO: 11847 - DNA, 3275 bp, Zea mays
  misc_feature (3178)..(3178): n is a, c, g, or t
gtcgttgttatccattgccatagcaagattgatacaatagcacgatgctctcccaacccactacatatatgtactgctttacactgtgtatgctaagagcagctccaaaagagcactaaaaatttgttccccaaaatctcttattagcgtctattgaaaaataaaatccactaaaaatatgttatctcacagcagatcactaaaaacttgtcccgaaaaaaattaaaaagggacatgggccaacagacgttgtattgggccagtacgtacgcactattgctcttggttttgtgcatgtgcctccaccagcgttcagcaacagacaggaaaaaagcgcgtgccaggggagattgggggcacaactccgaggcgaatatttacgggagattgagttcgatatgcatggtcacgaaaaagattaggaagataaagaggagctgttagaggcatcatgagatgagttttcaccctaaaaatacttttgggattagtttccgtcacttgttggagttgctgtaacatttccggtggctcaaagtttcctaaacagaagagatgtggttctaaacaaaagtttgcacgtcgatcgcttgcttccacgcgtgcatcctcccctgtcctgatggcgactggcagggcaggccgccactgggcatccgcatatccctcacgcggtcacagttactccgggacccacatgtcatcacgtcaaccttcgccatgcccaaagcttagcctcgaagcgtctgtactgtgtgcgtcctctcctcgacctcaacccccaccccgccctacctacaaccctattaaattccgccttccgacccgtagacctgattgatccccgcatcgaatccggcggatcgggagcgggagagaccactcccaaatcgcgtcgcgtcgagagcgagagcggaagaggtgcgcgcgggggaaccgaccgaaccgactgatggagtcgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacggtacgggacctcgtcgccatcgatgcatcggctcttgtgttgtgatgtgctgtgcctgtgatgtcccgcactgatgtggttgctccccccagagcatgtggctggacagggccaccgtggccaagtgttacatgctgtccgccaggaagctgaccatcatttggggcgatacgccgcagtactggcgctggatccccctcaccgactccaggtctgtgaaatcaaacaaataacccctctggctctatttatccatccatccatccatccatcgtcggctctgatgcgaatgtgtggtgtgggctctacatccagtttgacggtatctctagtctagtctggatacacggccgggccaatagttgcgcgtctgtgcagatgtccagtggagattattgtttcgaagcagtctggtagtgttaatttgtactaaagaagaaccgtgcccctgttcatgcttcttccaacatgcacaattccaatgccgtgttttgttttttgtgtgccaggttctcagaatgcgcagaactccagcacgtttgctggctggaaatccgcggcaagataccctgcgacatgctgtcccggaacaccacttacgccgcctacatggtgttcaagatgtccgacgaatcctatgggctggactatccgctccaggaggctgaagttagcatcggggcaaccaggtccactcgtcaggtctgcctagggtacgtcgacgacgacgaggacggggaagaggtgcctcagaactaccggtcgttcggggcggtgggaaatgtatttagaccaaggatcgggaggcggaaccgtcgccagcctcctggagtgcacgtcctgcaccctcagacaagagccggcggctggatggagatggagatgggtgagttcaggaacgaggaaggtgaagatggcgaggtgtccgtcagcctcatggagaccaggggcggcaactggaagagaggtcttactgtgcagggcattgagatcagggtgaagaagtaaggatgtgaaggttgtggggatcgggctttgcgcatcaaaacaaataaaaggatcttagttagatttgtagtgcgtgttctactgcactgcagcacttgcgtatgtgtgtgtcttgcctatgcccagcaaaaaaaaaaaacaaaaagttcttcttgaggcaaaagaactgcagttttgtacacaatattgttgtgtcccagatcactcggtgctcgatgactggccatgtttgcttttgaaagtgtaaactaggtgtgcttgttacgatcacacaaatcaccaatggagaacaccaattctcgctacgccaaccgctccagttcagcgctcaccgtcagtttagcctaaggttccagcctggctcgttgtatggacgatgccgtagtttaccaggttattacaactgatgggccatgggccggataatgtgtacatcacatcactagaatggacgaccaaggaggcagtcgagcggggttgggacagggccacaggggcgtgggcgtccatagccaagacggcgacggaggagaaggcgatcaccacagacacggtatgatctcgtcggagttcactcaaaaatgttctgatgctctttaaacctttcttttacattgtttcttcgtgtgatctttgtgtgtggtttggtttcgttttatatcttggactcttgcacgttgttgtatatcttcaatgggtattctagtgtatttcttgacgtgttcgttatcttgagcaccactttttcttcgttcaatgttgcatcctttgaagtataaccaaatataattacaaaaattataagtctaaattacaccatgtcataccttatacataatgagctctttctttaacacttagttgagcatcttcaacatgtccaaaccattttctcctttatgatcaaagttgctcacactagtgtcngtataaactaaaccacacgtatatcaacataaacatatattacttcatataagatgtcactaccaaaaccaaacaaagttctttcacatgtggcgcc

SEQ ID NO: 11848 - DNA, 1307 bp, Zea mays
gtgcgtcctctcctcaacctcaacccccaccccgccctacctacaaccctattaaattccgccttccgacccgtagacctgattgatccccgcatcgaatccggcggatcgggagcgggagagaccactcccaaatcgcgtcgcgtcgcgtcgagagcgagagcggaagaggtgcgcgcgggggaaccgagccgactgatggagccgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacgagcatgtggctggacagggccaccgtcgccaagtgctacatgctgtccgccaggaagctgaccatcatatggggtgatacgccgcagtactggcactggatccccctcaccgactccaggttctcagaatgcgcagaactccagcacgtttgctggctggaaatccgcggcaagataccctgcgacatgctgtcccggaacaccacttacgccgcctacatggtgttcaagatgtccgacgaatcctatgggctggactatccgctccaggaggctgaagttagcatcggggcaaccaggtccactcgtcaggtctgcctagggtacgtcgacgacgacgaggacggggaagaggtgcctcagaactaccggtcgttcggggcggtgggaaatgtatttagaccaaggatcgggaggcggaaccgtcgccagcctcctggagtgcacgtcctgcaccctcagacaagagccggcggctggatggagatggagatgggtgagttcaggaacgaggaagctgaagatggcggaaggtgtccgtcagcctcatggagaccaggggcggcaactggaagagaggtcttactgtgcagggcattgagatcagggtcaagaagtaaggatgtgaaggctgtggggatcgggctttgcgcatcaaaacaaataaaaggatcttagttagatttgttgtgcgtgttctactgcactgcagcacttgcgtatgtgtgtgtcttgcctatgcccagcaaaaaaaaaaaacaaaaagttcttgaggctagcaaaacaactgcagttttgtacgcaatattgttgtgtcc

SEQ ID NO: 11849 - DNA, 1389 bp, Zea mays
cattgggtacctcgaggccggccgggctattaaattccgccttccgacccgtagacctgattgatccccgcatcgaatccggcggatcgggagcgggagagaccactcccaaatcgcgtcgcgtcgagagcgagagcggaagaggtgcgcgcgggggaaccgaccgaaccgactgatggagtcgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacgagcatgtggctggacagggccaccgtggccaagtgttacatgctgtccgccaggaagctgaccatcatttggggcaatacgccgcagtactggcgctggatccccctcaccgactccaggttctcagaatgcgcagaactccagcacgtttgctggctggaaatccgcggcaagataccctgcgacatgctgtcccggaacaccacttacgccgcctacatggtgttcaagatgtccgacgaatcctatgggctggactatccgctccaggaggctgaagttagcatcggggcaaccaggtccactcgtcaggtctgcctagggtacgtcgacgacgacgaggacgggggagaggtgcctcagaactaccggtcgttcggggcggtgggaaatgtatttagaccaagggtcgggaggcggaaccgtcgccagcctcctggagtgcacgtcctgcaccctcagacaagagccggcggctggatggagatggagatgggtgagttcaggaacgaggaaggtgaagatggcgaggtgtccgtcagcctcatggagaccaggggcggcaactggaagagaggtcttactgtgcagggcattgagatcagggtcaagaagtaaggatgtgaaggttgtggggatcgggctttgcgcatcaaaacaaataaaaggatcttagatagatttgtagtgcgtgttctactgcagcacttgcgtatgtgtgtgtcttgcctatgcccagcaaaaaaaaaaaaaaaagttcttgaggcaagcaaaagaactgcagttttgtacacaatattgttgtgtcccagatcactcggtgctcgccatgtttgcttttgaaagtgtaaactaggtgtgcttgttacgatcacacaaatcaccaatggagaacaccaattctcgcaaaaaaaaaaaaaaaa

SEQ ID NO: 11850 - DNA, 4911 bp, Zea mays
tacgcaaggaacagtctagtagtggtccgacccataaacccggtctgctaacatacaactcgtaacccgatagggtcgccaacataaacctggtctctagaaccctctgcgaccaagcccggtgggtgccacccttataaactcggtcccttgtgatctccgtggcaattacattgtgtgtggaaggaaactttgaaaaaggaaagctttggaaaagtaggagggtggaggagcagacaatattttgatgggatctatgcagtcggatgcagttggcttagtgtgacctggtcaagtgcacatgggtgcgtttgtgtaaaacgaggatgcgatcggatgtggtcaggtgaagcttcacctaaggtgatatatatcatctatactaatctattaagaacctgcttcatcatccgcggtgacactataggcccgccccacgcgccccacctcggcggtgtgccctctgggccccacgcccagtgatttctcagctactatcctgtggacccaagcgtctgtctagcacccgacctcggcccgcgtagctacatcagaccacatgtaccttagtgtttagaattaaacaataatttgctctagaaatttggggctaaccaccagaccacacgtacattagtgtttaaaaataaacaataattatatgtgaataaatatctcagtgcctatttatataatatataaaaaacatagcaaagcacgggcaactcgtatgagtcttgggcttccaacaactagagaaagccctagtccaatggcgcctttcggttcagctgcaatcccttaagtagactcagacctcaagccgtctataaaacctgcccgagattgcagagattaaggtttcaacgacggtcgtggctgcacgaggcgcgagtgggtttcagcgatgatggcgactgcatgagatgcgagtcagtatcagtaagcaacctaaggtgatgaatcgatcaatgcatcacctataacgtacggtccaaccgaactagctaaccaactgtccggttggaccaacccactacatcgcaaaacaggtccacaacccgcttattgggtccgagcgctgattcagttggatgacggtttccttatacacctcttattaggtcatgtttctgaccccattacttgcactttgtgtctctcgctctccgctcttgcgctctcttccgtctagggctttctcgatggttttgattaagataggagaaacaacaactagaacatcgatcagaacattcgtttcttccatgttactaaagatatcaaggaaaagataaaaaacaagttatttaaaaatgtaatatgcttaagtcattatattattaatataaactcagatattctactcataatcattaagtaatttaacacatttcaaatattggatcattatagtttcaataaaaaaacttaacaatgtcgcagcattaagccattctattgttttggaaaaagaatttcaacattaaatcatcatctaatatcatacacacatcgtaaaacatttttataaatttcaataaaaccccatctaagtcattcaatcagtttaaaaatacaacattaagtcattccactattgttgagttagaaattttacattaagccatcccaattggtcatatcaaaatatgttagttgtttataaactaacatttgcatgaagtcattccactatgtccaatatatataatcatattctaatataaaaatatatgaaccattttttatgtatttgcaactgaaggctctattttaattagatctaactcttaattgaatcacataaatggacgcagctacctgaacagttgcatgaagccggtggcagctcaaagttagtcgttctcgaatatttgtcattcgctaaattatttttaaactaaacgtggcaaataaaaaagaacgaataaattactaaattatcgatatataagaaaaaattatagaatacctaaaaagtaggagtaggtcgcaagtacagaatagctcagcaaagcccggatacgtccgagccaggccccctggcccagctgtggagccgccagccggggtcggggcgctgggctcgacgcgcgcacgcggtacgcggcgccttatataaacacacccccgcctctgggctctaacacaagcatgcaagtccatcagcttctcggcttatggtgccagaccgacgtgcctagtagcgtactatcttagcttcaagagaccgaccaggcaagatccattgatcgatggagctgcttcctctgctcacgtggctcctccttgcgcacgccctggcctgcctggcctggacggccgccgcgcggcgccggcagtctcggtgctacctcctggactacgtctgccacaagcccagcgacgaccgcaagctgtccacggagacggccggcaacgtgatccagcgcaacgcgcggctggggctcaccgactaccgcttcctcctccgcgtcatcgtccgctccggcatcggcgaggagacctacgccccgcgcaacatcctggagggccgcgaggactcgcccaccctggaggacgcggtggacgagatggacgccttcttcgacgaggccatcgccgagctcttcgcccggaccggcctcgcgccccgcgacgtggacgtgctcgtcttcaacgtctccatgctctccccggcgccgtcgctgtcgtccaggatcgtgcgccgctacggcctgcgcgaggacgtggcggcgtacaacctcacgggcatggggtgcagcgcgggcctgatcgcgctggacctggcccggaacgcgctccggacgcgtccccgggcgctggcgctggtggtgtcgtccgagtccatcgcgcccaactggtactccggcaccgacaagactatgatgctggccaactgcctgttccgcagcggcggctccgcggtgctggtgaccaacgacccggcgcggcgcgggcaggccaagatggagctcagctgcctggtgcgcgccaacatcggcgccagcgacgacgcgcacgcgtgcgcgctgcagcgcgaggacggcgagggccgcgtcgggatcagcctgagcaaggcgctccccaaggccgccgtgcgcgccttcgccgtcaacctgcgccgcctcgcgccgcgcgtgctccccgtgggcgagctcgcgcggttcgccgcgcgtctcctcgcccggaggctcttcacgacgtccccgcacctgcgtcagcagcacctatcgggcggcaagcagaagggcgacgcggcggcggccccaaagatcaacttcaaggccggggtggaccacttctgcctccaccccggcggcacggccgtcatcgaggcggtgaagaagagcctggacctggaggacgaggacgtggagccggcgcggatgacgctgcaccggtgggggaacacgtcggcgagcagcctgtggtacgtgctgtcttacatggaggccaaagggcggctcaaggtcggggacagggtgctcatggtcacgttcgggtcggggttcaagtgcaacagctgcgtgtgggaggtgaccggcgacatggccgacaagggggcgtgggccgactgcatcgacgcctacccgccggagaagctcgccaacccgtacttggacaagttcggttggatcaacgatgtcgacggcgataccctgatgctctaacggtacggtatacgatcgaggaccgctctccaccggcggaaatgacgacaacggcggaagcagtaaaaagcaggctagctgttgttcagaacgacaggccggtgatgctagcttgcagcctgcgtaggtgtatttatgcccttggttttactgggcctgtcgttctgaacaatatagccctatttatttaccacccaattatatatgtgtagccgatgcagcagtagcacaatatattcttcttcttcttctgaattgttttctatagcaaaaggaaaaaacatatatagcttttttagaacagaagatcgatcggatctccatgtatacagaaacgattgcaagaacaaacaatataatatcaagtgtacttttacccgcctgaaaaaaaaaaaaaaaaatactaccactttcatagcgatttcggggtgatggtgacttttgatatggttttctgtttgcccattaattggatcagagccgaacggaggacgacgggacgatccgggatgcaggcagcatcctgatgatgcatgccttatttatgcacaatgcttccgaattttatttgatgccgtgtttatgcacaatgcttgcaacctagctactactctactatagaactcctgcttcaattgaaccatgcatacaaagagacagagctgtaaccaagcttcttcaagtctcggaaccagttgcaataacagcgatgtcggcatggaggataggaggaccttttgcaagcacatgcccgcagaccgcacctagtgctagggtgtatgccatgcctactctaggacagctcgagacagagctgtaaccaagcctctattaaatctctaatggtgtgtttgcaagcctatattaaatctctaatggtgtgtttggtttgtggagtcactctatgcttcatgaggtgatgcattaagttcattctatcaattttggtggaatcaactcactcctaatgtatatactaattattagcttatgaggaattggatggtgatggatcaactcattctattccacaaaccaaataaaaaaatgaggaatgagaagaagatggatcatttcattcctcaaaccaaacacattctaaattactctgctcaagaatctagattttgttttctggtaacaaatgacagtggcgggcttaaaacttcatgtctatattgtttttgaagatttcatagcagcaaaagaggcgctccaataatttatactgcag

SEQ ID NO: 11851 - DNA, 1970 bp, Zea mays
ctcgaggccggccgggataagcatgcaagtaatatatcacgcattcagctcctctgcttacggtgccagaccgaccgagcaagatccattgatcgatatggagctgcttcctctgctcacgtggctcctccttgcgcacgccatggcctacctggcctggatggccgccgcgcgccgccggcagtcgcggtgctacctcctggactacgtgtgccacaagccccgcgaagaccgcaagctgtccacggaggcggccggcgccgtgatccagcgcaacgcgcggctggggctgacagactaccgcttcctcctccgcgtcatcgtccgctccggcatcggcgaggagacctacgccccgcgcaacatcctggagggccgcgaggactcgcccacgttgcgggacgcggtggacgagatggacgccttcttcgacgaggccatcgccgagctcttcgcccggaccgacgtcgcgccccgcgacgttgacgtgctcgtcttcaacgtctccatgctctccccggcgccgtccctgtcgtccaggatcgcgcgccgctacggcctgcgcgaggacgtggcggcgtacaacctcacggggatggggtgcagcgcggggctgatcgcgctggacctggcccggaacgcgctgcggacgcgcccccgcgcgctggcgctcgtggtgtcgtccgagtccatcgcgcccaactggtactccggcaccgacaagtccatgatgctggccaactgcctgttccgcagcggcggctccgcggtgctggtcactaacgacccggcccgccgcgggcgcgccaagatggagctcagctgcctcgtgcgcgccaacatcggcgccagcgacgacgcgcacacgtgcgcgcagcagcgcgaggacgccgagggccgcgtcgggatcagcctcagcaaggcgctccccaaggccgccgtgcgcgccttcgccgtcaacttgcgccgcctcgcgccgcgcgtgctccccgtcgccgagctcgcgcggttcgccgcgcgcctcctcgcccggaggctcttcccgcacctgcagcagcactcgtcgtccggcaagcacaagggcgacactgcggccccgcccaagatcaacttcaaggccggggtggaccacttctgcctccaccccggcggcacggccgtcatcgaggcggtgaagcagagcctgggcctggaggacgaggacgtggaggcggcgcggatgacgctgcaccggtggggtaacacgtcggcgagcagcctgtggtacgtgctgtcgtacatggaggccaagcgccggctcaaggtcggggacagggtgctcatggtcacgttcgggtccgggttcaagtgcaacagctgcgtctgggaggtcaccggcgacatggccgacgacaggggagcatgggccgactgcatccacgcctatccgccggagaggctcgccaacccctacatggacaacttcggatggatcaacaacgtcgacggcgacaccctcatgttctaacggtacagtacgctcacgatcgagcactatttcgtacagtcgtacaagtgatggtacatatacatgctactgcatggcggaaccggtcaaccggacatgacgacaacggaagcagcaggttgttcagaacgacagacaggtgatgcatacgtgttagctaatgcgtactgtacctacgacctacgtgtatctatttaccccccgaacaatcgaacatattctttcttttgattattttctaccgcaaatgaaaaatatagttttactttttttctagaacagaggaaccatgtattttatattgtctttgaccttatcttgtctgcctgttaaatgatgttgacatgttgtccctgtccattcataaatgtttgcaaaaaaatcaagtgtaatcccccctaactttaaggaagatgatattatcacttctatagtgatttcgaagtggagtttttatttattg

SEQ ID NO: 11852 - DNA, 1072 bp, Zea mays
gcccaggccttctcaacgtctatgtctgatactgcaccacagagccggctgaccagtgctctcagtccaagagttcctcctagcccaggggctagtagggatcagtctggcttttcaaggctccctgacagcaggacgttacactcgggcccttcccagcgaaagataaatggctactgatcgcttggcacacatattacatgtgcctcgatgatagcccccaggcatcatggcctcgatgaagcgcccagctgtatcttcatactcaactgtccctgcgtggagaagtccagttgttgctctgtccaatggtggtacgcgagggtctctaatctcattgatggcaagcaaaatgctcctctcccctaagtttctggtcagtggtttataactgacggttcgtttcctctcttgataacgagagatgtgaatttgtgaactgtttctgcttatgttcgccagccgctatttattgctggggaataattgcagctacctgtgcaccgtagttggttgcacttgcagacgctgcaaaatcgggattttatcgtgctagttttttttgggggggtccagaagaaactattgatactttgtagtcttgtttactttacggtgatattatgatttagaggatacgaccttccttcttggttgtctatttggtacaatcctcgtttggatcactgaaatttcgctggattccgactggaacagagaaattatgcttgaaaatcctgtgcaattggtgccatccaaatgggactctgaagacttgtttttcggttttttgtttggtatcgcgtaggcctgtaatgggttcagttcgacctgtttgtgaatacgctccacccctcaaatgtagtgacaggtagaagctggtcgaccctgaaggaaacaggagcaatctggatgattcattttgaattgcccaatttgcttttaaaaaaggaggtgaaactgggaagtctagattccagtagttgtggaagtaggcacgctggacgccgtagaaaaaccaaatttacagctagggcgggtgagaaacaaaaggccaggaagaggaggaaca

SEQ ID NO: 11853 - DNA, 6891 bp, Zea mays
atgaagtactaaatgaaatgagtgccatctcctctggacacctagggtctagccaggatggcaacaaaaaaccacagctaaaagtattttttcttgaagaggttactggagaacagcataagtttaactggtgttacatttacttaattgtctctgtcatttgtaggcctaaaggcgaatttgcaaaggttgagcagaaggttgaagctatgtccattaacccttctgttgaaagacatgagagttttgcagctggtcatagaggcccaaggaatggtgataagaaagatcataagtggaatactgacagggctgatgcatataggcttactcgtcgagaggacaacaggagggttgctagagatatggagaagccacaggagcaaccacgcccagagcctgagacctggcgtaagccggtggagcctccaaagctagaggttgcaacacctcgttttgggaaagcagcaaccgcgttggagctcgcccaggccttctcaacgtctatgtctgatactgcaccacagagccggttgaccagtgctcccagtccaagagttcctcctagcccaggggctagtagggatcagtctggcttttcaaggctcactgacagcaggacgttacactcgggcccttcccagcgaaagataaatggctactgatcgcttggcacacatattacatgtgccacgatgatagcccaggcatcatggcctcgatgaagcgcccagctgtatcttcatactcaactgtccctgcgtggagaagtccagttgttgctctgtccaatggtggtacgcgagggtctctaatctcattgctggcaagcaaaaggctcctctcccataagtttctggtcagtgatttataactgacggttcgtttcctctcttgataacgagagatgtgaatttgtgaactgtttctgcttatgttcgccagccactatttattgctggggaataattgcagctgcctgcgcaccgtagttggttgcacttgcagacgccgcaaaattgggattttatcgtgctagttttgttttttttttttgccagaagaaactattgatactttgtagtcttgtttactttacggtgatattatgattagaggataggaccttcgttcttggttgtctatttggtacaatcaaccggccgatcactgaaatttcgctggattacgactggaacagagaaattatgtttgaaaatcctgtgcaattggtgccatccaaatgggactctgaagacttgtttttcggttttttgtttggtatcgcgtaggcctgtaatgggttcagttcgacctgtttgtgaatacgctccgcccctcaaatctagtgacaggtagaagcgggtcgaccctgaaggaaacaggagcaatctggatgattcattttgaattgcccaatttgctttaaaaaaggaggtgaaactgggaagtctagattccagtagttgtggaagtagtcacgctggacgccgtagaaaaaccaagcggagcaaattttatagcaaaccttccagcgcaagtagcccatgttcgcagctagcttagcctctccgctccggcgtgatccatccatcaggtcgtatgtggccgagctgagtgggaaacaaaaaggccaggaaggggaggaacatctgctggctgctgcgtcgtttcacgttcgacctgacgagcggccggcacacacaaacgtgttcggttccctgttttgacacgacgacatccatccaaccgcccatcacgcgtaacaaatctaaaatagtactcccttcttatttatttatttgctatgttttagtaaaaaattaaactaccgtgcaacaaatgttcgagaacgaaagtattattttgatttatatcaaaatctatatataattttgtcatcgtaactagtgaataaatttacccgtaaataatggaacctatactttatgatgcgttcatctaaacgacagacgggggaggcgtttgtggagaccagcaagcagcagcagccttttttttccgacatgagtgatggctttgcgcttcgtggcctttgcaggcgaaattgattgcaggagaaaggggggaaaagagaggcagagggcctgttttgtcacggctaggcagtcagcatattccttcccttggtaagtcctgctgcgccactcttaatacgaacaccatcatgagagaagcaattggaagcgtggccagatcacccgcccgcatgtgcactgctcaatcctagtttaacctttgttttaccttctcaaaagagcatccaaaaagatccaggaagaaacaaataaaagtccagtcagccccccccaccaccccggcctggaaaggggctcgaatgcccatgggcccatggcccatgcctttctttctttcttttaagccctgcatgcatgcagatcagagctgcggctgcgggcctgcggccccgcccttgcccttgcccttgcccttgctttctaaacaaacacctgttacagtacagccagtggtgcatcgcgagctaggagcgagcccaaccgagccactctttcgagctcgcgagatgagctcccgagacgggtgatctacaaatcaattgtcccgctgatacctcacctgcctgccatgctccttggatgctcctgtggccgcctgcccgcctcgccttcatccgcttgtgcgggaaggccgggaacggaaaaaaaaacaaacagtgcagtgggacggcactagcgtctcgtgcattgcatgtacgttttggctttgagatcagctcacagctcagcaacagcagcaagcgtatcatattcatatcttccccacgccatgggcggcgaaccgaatccataggcataggacgcccaacagcggccaccgcgaattgttccgtggaccgctctatgtctctatccccggccggcggcagggtgggtggcgacgacagtacagtacagtagcgagcagcggagctacaggaaggcaggccggccacagaggacagtactgcatgagacaattgtccgggtgtttactgccaccctccgacgggcggggcgcgtgtccggatgcttcgaattcccgcggcgttccctgtcgcccgctcacaccctccgatcagcccgggcgacgggtgtttattgaacctcaacagctatttttattagctaactattagctttagagggtttttggtacggagcctcagtataacaatatataagtatgtcaaataaagtagtttgtggtctcatacatgcatctctggaagatgatgcatgaagctgtagttttatccctgttgccagctagttgtaataaatgagacaaacgcacttgccaattgccatgcgctgttttgtaaattggaccaggacgaatagtcttcttttttgcttttttgcttttagaagaaagatgatgcttgtttggctgtaaccaactcagataacaggtttgtctctatctacctacgttgattatattttaaaatgtcttctctggtctgaaacaacaggatgaccattaaagaggacatttttgttccttaaataaaaaaaacccaagcgaaaccaattgaagagagaatctgacgcaggggaatcagacagtctcgacgaccaactccaatctcaacagtcgacgcataaattaataatccaatttctgtctctacctatctactaccgtctctctctctcacacacacacacaatagtccactcttcttcaccattcaccaacaccaaagtcaccaacccaccccggtgttcctgtaactgtaagaaatccaaaacccacacaccccttcttctctctcccaccatctttttgttgcccatgcctttgctgcgggagaaggacagggactaccgcagccagcacaggcatagcacccgagtggccaggcatacgtgcaactgtgcaaagaggaggcagtggcagtgggagcctgggctgggaggagaaaaatcaggaaccagtcttacatattctccccaaagcttcccccctgcaagctccacagcacggcagagggcgcgagcaccaactttgcgtccattaactgctcagagcctcagagcatcaggtgcgcttcagcgtctagccatttggcggcttgggctttctgcgtgggtgccgcatcctctccctcccacctttgcttccattccatccccatcaccgcagccttttttttttgcctcgcatcatcgccatgttgctttaaagttcaaaacttgcggggttggggaggaacggagtcttaagatgagcggtgtcggtgtcgtccttaaggtggacgtcaacggcgaggagctcttcttcgttgataaggtgcggtgcggtgcggctccctcttagcttgtgttcacgttcttgcttcctcttcctcctccatggatgattatgccattttaaggtctcttcttgctctgctctcaactctggtgtgtttatgtttctctccatacacggcggcggcggcatgatgatgtcgatgcttttggttttggtgctgtactctttcccagattggcagcttgctgcccacagcctagcggccggctctctctatttttggactcactgttgtctagccgcttgtttcttgtggacaccttaccttagccttgggggatgagtgatgcttggcagcttgccatatcatatcctgctggaatcgaaccggcttctgattcttccttcttgtagtttaccttggcatcgtcttccccaattcggtcgcgtccaacccttcctctctggccttattccgacgttttcctcttgatttgtacccccgtcgcaggtttccgagacgtgtgcggcttgtcacactcacaccccgatggttggttccctgccagtctccgactgctagttcctatttcgcctcatggcttgaaaatccttgccttgtctgtcgtcccatcacttctagcctgccgttttgtgggtcaagacatcgatagcatgtttgtcacacgccaccctgatatttccactcattattatgctaacctgcaaccatgcttccacataatttgtgtcgacgaatcactcagattcatcaccctgcacttttttttgttcttgtttctgttcctctggaattttactgaccgcgctgtttctgagaggtggcgggaagggcagagcagcacgtcgcgactctttttctttacacacagtgatgtgaagctgtgtccgtttccccatcgctgtcatcaatgagctcgcaccatgcctggtccttccgttcatattaatggcgtaactgtaccgagcatttcccgcacccgctaacgttcttctccgtcctcccgctccattcctccactgctgggcgttaatggcgtaaacagctgcctatagctcatcttcttggccgttttctatgcgaggtttaatgcccgtttggtcactacgacttccccccaggcccccattgaagaagcttgctacactctgctccgcaaagagagagacctgatcttcttggcgtcggtgtttaatttggattcttgcaagtgggtggcgtctcgcgttcttgcgggcttgtgcttctttaatgcgctgacgcttcttgtcctgaattgccgttgcgttttttggatacgaattgccggacgttcttgcgcgtttctgcggtaggatcaggaggctggtggtcgccggcgcagcgtctgcgaggcggcatccgaggccgagggtaccactgcacggattccccggtggccccgaggcgttcgagctcgtcgcgaggttctgctacgctgacggcggacgcggcggggcggtgaccgcggccaacgcgtgcgcgctgcggtgcgcggcggagttcctggacatggcggcggccgcagacgcgcccgcgcccgaggccgcgtccacggccgcgccgagcctggtgcggatgacggagaaggcgctcgaggagatgccgcactggccgtggcacgccgtcgtggacgccgtgaagcagtgccagcgccgcctgctcccgctcgcggactccaccggcgcgttcgacgcggccgtggccgcgctggtgtcccagatggccgtgcccccgccggccggggacgccacgcccacgggctcctcgccggagagcacggcgttccgcttctcgtgcgacaccaagagcagcggcctaagcctgcgcggcgggtcctgcgtcagccgcacctggtggttcgaggacctcgtcgcgctcgcccccgccacggtggagcgcgtcgcctcggcgctcgtggccaggggcaccgaccacggcgtcgtcgcccggttcctcttctactacctcaagtgccgcatcgccggcgcgagcgccgacgacaagaaggcgatgctggaggcgtcggtcgccgtcatggccagcctcgaccggagcgcggtctccttcaagggcctcttcggcatcctgagggtggccgcgccgctgaggctagccgacgcgtgccaggaccggctcgtcgccatgatcggccgcaagctggaccacgcgacgctcgataacctgctcgtcccagcgccgccagggacggccagcctgtacgacgtgagtctggtgctcaggttcttggccgcgttcctccgcggcggcgccagcgacgagccggcgaagctgaagaaggtgggcgggctcacggacctgtacctggccgaggtcgctccggacccgtcccttcgcccggccaagttcctggatctcgctaccgcgctaccggctccggcgagggactgccacgacgcgctgtatcgcgccatcgacgtttatttccaggtaatttactagtactaactacgtaacattccattccgacaacgtcctaatttcgacagcatttcacatttacttcgcattaactctgcttagattag

SEQ ID NO: 11854 - DNA, 1270 bp, Zea mays
ataaaatttactattattttgacttccttttttacttttaatgccttaggccatccctctttggtggtgctcgcccccgtgaacaagttctcaaagaacgtggagtggatgttttggccagtgatcttgagcggatttcaccagttggcaggtctaaaggtgaatttgcaaaggtcgagcagaaggttgaagctttgtccattaacccttctcttgaaagagctgatggtttttcagctggtcatagaggcccaaggagtgttgataagaaggattacaggcgggatactgagaaggctgatgcatataggccttctcgtcgggaggataacaggagggtcgctagagatatggagaagccacaggagcaaccacgcccagagcctgagacatggcgtaagccagtggagcctccaaagccagaggttgcaacacctcgttttgggaaagcagcaaccgcgttggagcttgcgcaggccttctcaacgtccatgtctgatactgcaccacagaaccggttgaccagcgttcccagcccaagagttcctcttagcccaggggctagggatcagtctggcttctcaaggctcactgacagcaggacgttacgctccagcccttcccagcgaaagataaatggctactgatcgcttggcacacatattacacgtgtcacgatgacagttggcctcgatgaagcgccccgctgtatcttcatactcaactgcccctgcgtggagaagtccaattgttgctctgtcagatggtggcacgtgagtggtgataatctcattgatagcaaacaaaaggctcctcttccataagtttctggtcagtgatttatgactcagggttcatttttcctctcttgataacaaagatgtgaatttgtggactatttctgcttatgttcgccagccagccctgatttgttgctggggaataattgccacctgcgcatcttagttggatgtgctctgccgtgcttggttttatgatgttgccagatcggtgatcggtggtatgtagcctgcgtcataatgcaattttcaggccttctcttcataagctgcaaaattgggattttactgcgagaacaaactattggtcttgtacggttgaatcatgattaaaggatataactttcaatctcggttgtctagtttatataaaccgcgtttggatcactggattccaatttgaattttaaacaagttacgttgaaaatcttgtgtaattagtgtcacccaatgacccaattggggttctg

SEQ ID NO: 11855 - DNA, 1296 bp, Zea mays
cccacgcgtcccggccctcgtattccttcagggaacggcttccatagcgctgaagcgaggcgtgccgcattgggttgttcgagagctcctagtgttgccctactacatgatggagggcgatctccccacgcccgcgaacgctagggttgttgccgtggtcaccggcggcaacaaggggatcgggctggaggtgtgccggcagctggcctgcagcggcgtcaccgtcgtcttgacagccagggacgacgcgaggggcgcggcggccgtggagaacctcagaggcctggggctctccgatgtcctcttccaccgactggacgttaccgacgctccgagcatcgctcgactcgctggtttcctcgagacccgtttcgggaagctagacatcctggtaaataatgccgcgattggcggggttgagtatgttcatgaccaagattgtggctcagtaacgagcgaggaaaaggcaaagttgagcggcatggacatggatcagaggcttggatggctgtgggagaattgccgggagacctacgacgatgcaaagacaggcctacgaacaaactactacggcacaaagcaagtaatcgagactttactgcctctactgcaagcctcctccgatgggaggatcgttaacgtctcctcccacttcggccagctaaggcttttccgaaacgaggagctgaagcgggagctgaacgacattgacaacctcaccccggagaggctggatggcctgctggacatgttcttaaatgacttggaggccggcgaggtggagtcgtcgaacggctggccgatgtatttctcggcgtacaaggtggccaaggcggccatgaacgcgtactcgaggatcctggcgaggcggcaccccgagctgcgcgtcaactgcgtgcaccccggctatgtcaggaccgacatgaccatacactcggggctgttgacaccggaggaaggtggcagcagggtggccatggtggcgctgctgccgggaggcgggccaaccggcgcgttctttgaagattttcaacagtcgtcgttcgtgtgatgttgaacatgcagctgcatctcatatgtattctatagatattatttatgtgaaagatgctacagtacgctccccctgcgtttacattcagcgcacctctgaactcttaaacttcaagtcttcaacgacaaatctagacatgatgctgcaaaacatttttaatgtctcctctttcaaaacacgagtttcgtgcgtcatgcacgaagcacaaagagttttttttctcttcaaaaaaaaaaaaaaaa

SEQ ID NO: 11856 - DNA, 2656 bp, Zea mays
tgattaattgaacttaaaatactcgtcataccgtttactcttatctatataattagttttataatttaaatatatttaatatctttgactagtagttagtacggggctaaaatttagccccctcaacccaacacagcctgccctttccagttgtccattatcaaggatgggactgagctgcaatatcatgtcaaattaacaaagaggttgcaagccaataatggtttcactctctcactgtaaaatgtaaactttatcgggaatgtgaacgaatggtgaccaggcgttcaaggaaaatatggcagttggcctggccctgcccacgttcttcactgccatacacgtctgactatatgtctgagactgagagagagagaaagagagagaggaaaccctttcctccgctcaagcttgtgaacgtgggccctccttctgcagtgcagtgaggcgagcttgtcgccttgttgtcatccttcctcgtcagtagcactgtagcactgccaaatgccaatggctccagccctgtcatcgacataaatcactttatatggatccgcaattgcttcagagagctaccgcaaccagctattgagctactgcctctgaccaagtcccaagctgcgctgcgcctgctatgtcgtcgtcctcgcccgtatcggcggtctcatcagccactgcgccgcacgtcgtggacgactgcctcggcatcgtgcagcttcttagcgatggcaccgtgacgcgctccgcggactactccgacatccctctcctgggcgaggtgccgtccaacctgcccgtccagtggaaggacgtcgtctacgaccccgcgcacgcgctccgcctccgcatgtacaggcccaccgacaccgacggcggcaggacgaccaacaacaagctgccggtgctagtctacttccacggcggcggcttctgcatctgcagcttcgagatgccccacttccacgccggcgggctccgcctcgccgccgagctcccggcgctcgtgctctccgccgactaccgcctggggcccgagcaccgcctccccgcggcgcaccgcgacgccgaggccgtcctgtcctggctccgcgcccaggccgaggccgacccgtggcttgtcgagtcggctgacatgggcagggtgttcgtctgcggcgactcggccggcggcaacatcgcgcaccacatcgccgtccagtacggcacgggccacctcgccctcggccccgtcgtccggcttggcggctacatcatgctgtggccctacttcgccgccgaggagaggacggcgtccgagacggccggtcttgacgtcgaccaccagttcgttagcacggcgctgttggatcagatgtggcgcctggcgctgccggtcggcgcgaccagggaccacccagcagcgaacccgttcggaccggacagcgtcccgctggaggacgtcgccttccagccgctgctcgtcgtggacccagaccaggacgtgctgcacgaccgcacacaggactatgccgctaggttgacggccatggggaaactggtcgagctcgtcgtgttcagaggccagggccacgggttcttcgtcttcgacccgtgtggtgaagcttccgaccagctgatccacgtcattcggcgcttcgtactgttgcataagcatccatgtaatcttgttgatcttagtactaccatgtagttgcattagtgagtcatgtactcatgtgttcgtcagtcggacaagtttgtttcgtagaatcgcggacgagctggagagtgcacagcccgtgcagtgaccgcgtctagggatgtgtttccgccacggtgtgcatgtcatgcacgtcgcacgttcgtccttagaagtcggatcgtgcagctgtattccgtggcggggaaacgtggaactaccccagtgtatttggttcacgaaatgcatgtgtgagaggtgcgcgagacgcatctgaaaatcagtttgtctatgttcctcctctcacccatggtgatcgtgctctggggacactgcggcaccgttcgtcgagccacagattgtgctcgtcgtcgctcgctgtagatacttggtccaacagtctggtatcagaacccggtgtatatactacggtggaccggtgaggcggtgagtccaccaagggagccggcgaataagaaggtaattgttccacgtcgaccaccgtcgaacgccatgagcgacgcgtcaggttcaggcacagctgtgcgggaagattcgttgatgtggccaatgctgacacgcgacaattactgtgaatgggctatgttgatgcagtgcaatctcgaggctatagacatttgggggtgatcgacccaggtactagtcccaagagattgcaggatcggcgggcacaaaaccatgaaggaggcgtgggaggcggtgaaagtgatgaagatgggtgtcgatagggtgaaggaagtcaatgcacaaaggcttctacgataatttgagaataatagcgtcacatccggttttagaaggcaaaccgaatacgaacaatgtacgtgttaggatcagcaattcacgtacacgacagttacataaccgaacatcatcacacattgctcaaataataacataaaagagtattaatttatttacatcatgatgcccaagacatccacatagtcattaaca

SEQ ID NO: 11857 - DNA, 1503 bp, Zea mays
gtttaggagtgccgggcgcccgcgcgggcgccccgccctaatccatcgcagagcgccgccggcgggtagcgctactgctagaggagaggaagcggaaagggcggcggcggcgcttgtggtcagtcaaagatccaacctccggactcgcgatggggcggcggatcctcaacgatgctctgcgcacgatggtcaacgcagaccggcgggggaacgcgtcggcgcttctccgacccatctccggcgtcatggtctccttcctcaacatcatgaagtaccgagggtatatcaaaaaatttgaggtcattgatgagaatagagttgggaaaattagagtggagcttgatggacgtcttaaagattgcaaagctctcacctacaggcaagacctcaaagctaaggagatagaacgatacagagttaggatgctcccaacacgccagtggggctatgttgtgattactactccgaatggtgttttggatcatgaggaagcaatcaggcagaacgtgggtggtcaggtccttggttatttccattgactgacaagtagcgtcgctctcctagtcctgaatgaggcaacgggttatgcccatttggtattactgtactgttgttattaccgaacccattctgtttgcatcttgggagctgttttgttgtcgttcatggccatgcaagaaatgaaataacatgccaaatttacggctgaggtttgacaacactaggaatattgttaaacaggaacactgagtttcttgtgaggatgtcatgatagcttttctgagacctttccctgcagggagggttgagcacacattggtattttggtcagtgtctgaggctctgagatgtgtttcggatcttgtttgcagcactgcttgtaggactcctttgtttaggacaataatgttgatgggtctgtttgatgaatgacagatgtctgagcgaaaccaatgtcgctggttttgtagagtgttcaatttattggctgggaatgccatgtgaatgtgttgtctggatatgaacctgtcattctttgttatgctgtgcactgcgtgctggagatgtttgtttgctcctgggaatatgccccccagtcgtggtgctatccattacgacagatgttttcatgaattcgtgtagttaccatatagatgctgtggtccggattgatgcttggtaataaaataaatcaggtcttcgtacctgttttttcatagcagcttaagaaaaaaaataagcacagtgacatcaaccacaaactgaccattcataattttgtggttgtgggtatgatctagcaaccgaaagatttattccatttagtgtatgctaattatttgtcgccattatgccgtgctaagcagagtgtgcgtatgaccatgcaagataccgttttatattatagactatatcatttataaagtggagttaaaatagtggatgagataaataaggttgctggagatagctttaagggcaaacaagtttctgcttgggtgt

SEQ ID NO: 11858 - DNA, 1303 bp, Zea mays
aacaacgcacatgcggaagcggagacgctgacgcacctctgagcctggcggcgatttttctatataaccagcgccgctaattccgggtgcttcgctgtagagatgcggtaaaagcgaaagaagaatccgatccgcttctccacgccgaacccggtaaggccgccgccgcttctcgaatggcctcaacctcctcctcctcgcctcagccgccgccggcggcggcggcagcgtcgcccggggcagcttcctcgcccgaggatcgccgcgcaggtggaggccgcggcggcccgcccccggtcccgccctatgtcaaggcggcggcggggtccctgggcggcgtcatggaggcgtgctgcctgcagccgatcgacgtcgtcaagacgcggctgcagctcgaccgcacgggggcctaccggggcatcgcgcactgcggcgccaccgtggcccgcgccgagggcgtgcgcgcgctctggaaggggctcacgcccttcgccacgcacctcacgctcaagtacgcgctgcggctcggctcaaacgccgtgctgcagtctgcgttcaaggaccccaccacgggcaaggtctccgcgcacggccgcctcgcctccggctttggcgccggcgtcatcgaggcgctcctcattgttacccccttcgaggcaagattaaacatctctctgttcctgagtcgctctttaactatcttgccctggctgcggtgctgtgcatcctatagcttacactgatcgtccaagaaccgtttgccgtttagacaccaatcgtttatactttattagatgtttcctgttgaataaacaacttgcttcctttatctgaaagaaggtcccaacgtgagagagaggttacgtttagattaccaatgtaaaagcggcatctactgtatagataaagaatggttataattatttattcttgtgtcgaagtggtgttggatgcatttttgccagcttgggattaaagaaaagacagccatgttctttgcagcaaatttgaagtttactagtatgttaccctgatgcagtcaaacacatttgaccaagaagttgctgtcaatcacctgtttctcgtttagggttaacttgattatgactgagaatgaagtaatttgttttcttatcatagtcatgatgtttggttgttcaatggaaacactattttttaattatttttatggccctagttaacatacaccatagttttgacaaaagctgggtgatctacctaagcaaggaaaacaaaggccagatacaaagcggagcaatgcgatggtactaggatcgcattt

SEQ ID NO: 11859 - DNA, 2066 bp, Zea mays
gggtacctcgaggccggccgggccggccgatacgtgggccactcttcctcacatcgcctccctcgacgatggccgccgccaccgccgccgccgccacggcgtcggcttcgtgtcttctccggaggtctatatcctctgcattcctcgcgaagcgcgcggtccctagcattccgcgtacaactctctgctattcctcctccgcatccgccagactcaaaccaacgccgtccctgtctccgcctgtcacgtccgccaacgatggaggcggcgggatgaggtgggagtcagcgcgcaagaagagggtggtgctccgcatcggctacgtcggcactgattaccgagggcttcaaaagcagcaagagcttggcgtggattcgaccattgagtcagtcctggaatctgccatcttcaagtccgggggtattctcgagagtaattatggaaaactgcaaaagattgggtgggagaggagtagccgaactgataaaggggtacactcattggctacaatgatttcccttaagatggaaatccctgatagagcatgggaggatgatcctgatggtattgctcttgccagcttcattaactcaaatttgccggacaatgtgagggtttttagtatattgcctgcacaaaggagttttgatgtaaggagggagtgcttatatcgtgagtacttctatcttcttcctgctgaaattattggaattaaagatgactatagctctgaagaaatgcaagagcacttgtcagaattcaacaaaatactgaaaggttttgagggaaaccatccattccataattacactgcacgtgccaagtataggaaggttctcgcgggaagacacagaagggacaaaggagcaagcacggcgttgaagtccatgtcctctgacacgggcatggcagaaagctcttctgaagaaagcacttctccagatcacgatgaggacttgaatatttcatcaatctttgactctggtataccagaagacactcgtgtgaatggtattctgaagctttctgaggatcgggtgcagattcaagctaggtggctgcatgagcctgacgaaagcgatagattaaacgcttcacatttcagagatatcattacctgttcctgtggagagttgcaaacttcatcagggattcagttcgttgagttgaccgtatgcggggtatctttcatgctacatcagatccggaaaatggttggaaccgccgtggcggtgaagcgtgggctactaccaagagacatcatagagctgtccctcgcgaagttctccagaatcgttctaccgatagccccttcagaggtcctggtcctcaaggacaacagtttctgcacgaagagcaagggagggaggatcgttcgccccgggatccagtccatgaacaagtcggaagcaaccaggaagggggtcgaggagttctacagggcagcgcttctaccagaagtagcgaagttcctggacccctctctgccgccgtggaaggagtggctggagaacctggacaggttctcgggcataccgggttcgcagctggacgaagtcagggaggcgtatcgagcgtggagggatgattacgaccgagcgaagatggctagaaactaggagtgctggcagtgtcgcaaggtggatgaactacctagcagtgaacaatgatgatttatatatactagttcgcttgatgtttatatattgagattcatacaaaaaaaaaaaaaaaactcgagcccggtatgcagcccgtcacgcagtgcaagcagcgcgcgggcactgctgttgttgttgggttgatactagctcaggagcaagctagtgttctgtactcacgtcacgtggaggcattccaatggcgaggcacatgcacggacggacgcaccccgtgttggtttcacgtggaggatgatgctcgctgtcactgatgctacctagcttgtttttttcaaccgaacgtctcgtcagtgggcaggggcgggctgcgggcatgcatgcgggggcaatgactagtgcagagcccagtggcctccctaattgtcgcctcacgagcagcagcag

SEQ ID NO: 11860 - DNA, 1616 bp, Zea mays
  misc_feature (13)..(13): n is a, c, g, or t
  misc_feature (20)..(20): n is a, c, g, or t
  misc_feature (22)..(22): n is a, c, g, or t
cccagcgtccggnatccgangnatagtttatgatagaccttgttggttgctgcattacgcacatcatctgagctggttgtttcagagggatgggaaacatgttttgcgctccccgccccccgccgcccgaggagttcagtctcgtattgttgttgctgaaaatttacctggaggatcaaaagcatcagactctgatgaagattttctcagctgttgggaatgtgaaatctatacgtacctgttatccacaagatatttctccagcagcagctaacagaacatcaaggattgagatgatttttgctaataagcttcattcttttgtggagtattcagctgttgaagatgctgaaaaagcagttgctgaattcggtggtgggggaaactggagagaggggattagagttcgttcactgcttggatgtctgaaacatgggttaggtcaaggaagaaaaggtggggatgaggagtatgctgcagatgaagatggccctgacacaactgatcatccacgagactttggaacagatgttaccgcccaaatctcagaaacacatttcgatcaccaggccgaagatggcacccatgacaagggtggaatgaggcagcaggggagagggagaggccgtggaggtagaggcagaggccgtggtcagcattatggccacaacagccgagatggccaccatccaattggcactcccccgtcggagcatccagctgtgccgaagccgcccccgggcccccgcatgccggatggcacaaaagggttcaccatgggccgagggaagccgctcagcattaccattgatgctgcggctaaccctaccaccacggatgctgcttagccgcagcgtctatgctggtaccggcctattgccctgatcatcagtcttttgcaaaccgattgcagtggtcatttactcatgttctaaaccgtttactgtggcgtgttggttcattttgtctgggatttaaaaggaaaggagatggctggtactatgatacatgagtgtatactaacacccgaagtttagacatgtggacatgtactgtgatatgtagctcttaaattagaaagatgcatacttttgatgagaaagaggggtggttttatgatctgtctccaagggcttgtttgaatgcttgagctaatagttagttgactctaaaatttctagtgaaattagctggctaataaatagttggctaactattagctaatttggctaacaaatagttcaactattagccagactatttggatgtttttagttaattttagcagctagctattaacccttgcgttcaaacaggacccaaagcttcaaaaatcttataagcgtgtttaagttggaagcctaaccagcagcgtttgggtttagctaaattttttccaattccatccaatccatttataatgggaataaccgaacaagtccttacagagctctggaaatggcttctgagctttacacggttattattacacccacgctctgcccctcatcagtgctggtgctgtccctgctgcacggcccacccccacccgtgccgggagaaggctcaacgctggcgccactcccagctacgtgcgtccctctcggcggcagctc

SEQ ID NO: 11861 - DNA, 2098 bp, Zea mays
  misc_feature (16)..(21): n is a, c, g, or t
  misc_feature (27)..(28): n is a, c, g, or t
  misc_feature (30)..(30): n is a, c, g, or t
gcacgagaccattacnnnnnncatccnnancaaaaaccagcccgacccaccaccaccatcgccaccattaccctctcgcccctgcctctccggccgccagcccatcccgtccccgtcccatgccgcagcgcgcagcggccgcactgacacaccagtgagcgagcagagcgagagcgaggcctgatgcggcagcggcagcaaggcgaggagcaccgggagatattcgtccagtggagaccctgcgacaagaagaggtcttaggccctccgccgccacgcgcaccggcagacaaatccgcgcaggccttcttccgatccgcaaaggcgccgcctttttcgccgattccacaggccggagcccggggagaaaggcagacagacagaccggaagatgagcgcgtccgtgggccggacccgcgtggggcggtacgagctcggccggaccctcggcgaaggcaccttcgccaaggtcaagttcgcccggaacgtcgagaccggagagaatgtcgccatcaagatcctcgacaaggagaaggtcctcaagcacaagatgatcgcccagatcaagcgggagatctcgaccatgaagctcatcaggcaccccaacgtcatccggatgtatgaggtgatggccagcaagacaaagatatacatcgtcatggagctcgtcaccggtggcgaactcttcgacaaaatcgcctcgcgtggaaggctgaaagaggatgacgcaaggaagtacttccagcagctgatcaacgctgtcgattactgccatagccgaggcgtctaccaccgcgatctcaagcctgaaaatctcctgcttgatgctagcggcacgctcaaggtttcggattttggactgagcgcactatctcaacaagtccgagaggatggtctgctgcacacaacctgtggaactcccaactatgttgctcccgaggttataaacaataagggctatgatggagctaaggctgatctgtggtcatgtggagtgattctctttgtcctcatggcggggtacctcccatttgaagattcgaacctgatgtcgctctacaagaagatcttcaaagcggatttcagttgcccgtcctggttctccacaagcgcaaagaagctcatcaagaagatacttgaacctaatgctaacaatagaataactattgcagagctcattaacaacgagtggttcaagaaggggtatcagcctcccagatttgaaacagcagatgttaatctggatgacgtgaactccatcttcgatgaatccggggagccagcacagcttgttgttgagaggagagaagaaaggccatcagtgatgaacgctttcgagttaatctctacgtctcagggcctcaatctcgggacgctcttcgagaagcaaacgggttctgttaagcgagaaacaaggtttgcgtcaaggcttcctgcaaatgagatactgtcgaagatcgaagcagcagcgggacccatgggcttcaacgttcagaagcgcaactataagctgaagctgcaaggggagaaccctggaaggaaaggtcagctggccatcgcaacagaggttttcgaggtcacgccttccctgtacatggttgagctgcgcaagtccaacggcgacacccttgaattccacaagttctaccacaacatctcaaatggactgaaggacgtgatgtggaagccggagagcggcatcgtggaaggcgacgaggcgcggcaaaggaggtccccgtgatggggtctgcaaccaagttttagaagtagcgctgcagataactagtcatcagggagcctggcgggaactgagcctgtgactgcttcctgtttgtttggatgttttgtttttgtctaaggtgctttctgactaaagtatgctggataatgtgaatgaagaatgtgcagagttttcagcaaaaaaaaaaaaaaaaatgttctttaaaaaaaaaagtgttgcacgtggtggagagttgcccgttgctgacgaacttgctatcttgctagctagagcctagaggataaatatgaattcaaaatacgagtagaaatatcttaaagtctgataaattttgtagagaaaaatataaagatccaac

SEQ ID NO: 11862 - DNA, 1986 bp, Zea mays
  misc_feature (1964)..(1964): n is a, c, g, or t
  misc_feature (1985)..(1985): n is a, c, g, or t
ggccaacccgactcctcctcctcctcctcgcctatagatcccgggccccccgcccggccgggccggcgctaccagcccgacccaccaccaccatcgccaccattaccctctcgcccctgcctctccggccgccagctgatcccgtccccgtccccgtcccatgccgcagcgctcagcggccgcactgacacaccagtgagcgagcagagcgaggcctgatgcggcagcggcagcaaggcgaggagcaccgggagatattcgtccagtggagaccctgcgacaagaagaggtcttaggccctccgccgccacgcgcaccggcagacaaatccgcgcaggccttcttccgatccgcaaaaggcgccgcctttttcgccgattccacaggccggagcccggggagaaagacagacaaacagaccggaagatgagcgcgtccgtgggccggacccgtgtggggcggtacgagctcggccggaccctcggcgaaggcaccttcgccaaggtcaagttcgccaggaacgtcgagaccggagagaatgtcgccatcaagatcctcgacaaggagaaggtcctcaagcacaagatgatcgcccagatcaagcgagagatctcgaccatgaagctcatcaggcaccccaacgtcatccggatgtatgaggtgatggccagcaagacaaagatatacatcgtcatggagctcgtcaccggtggcgaactcttcgacaaaatcgcctcgcgtggaaggctgaaagaggatgacgcaaggaagtacttccagcagctgatcaacgctgtcgattactgccatagccgaggcgtctaccaccgcgatctcaagcctgaaaatctcctgcttgatgctagcggcacgctcaaggtttcggattttggactgagcgcactatctcaacaggtccgagaggatggtctgctgcacacaacctgtggaactcccaactatgttgctcccgaggttataaacaataagggctatgatggagctaaggctgatctgtggtcatgtggggtgattctctttgtcctcatggcggggtacctcccatttgaagattcgaacctgatgtcgctctacaagaagatcttcaaagcggatttcagttgcccgtcctggttctccacaagcgcaaagaagctcatcaagaagatacttgaacctaatgctaacaatagaaccgcccgggcagagctcattaacaacgagtggttcaagaaggggtatcagcctcccagatttgaaacagcagatgttaatctggatgacgtgaactccatcttcgatgaatccggggagccagcacagcttgttgttgagaggagagaagaaagaccatcagtgatgaacgctttcgagttaatctctacgtctcagggcctcaatctcgggacgctcttcgagaagcaaacgggttctgttaagcgagaaacaaggtttgcgtcaaggcttcctgcaaatgagatactgtcgaagatcgaagcagcagcaggacccatgggcttcaacgttcagaagcgcaactataagctgaagctgcaaggggagaaccctggaaggaaaggtcagctggccattgcaacagaggttttcgaggtcacgccttccctgtacatggttgagctgcgcaaatccaacggcgacacccttgaattccacaagttctaccacaacatctcaaatggactgaaggacgtgatgtggaagccggagagcggcatcgtggaaggcgacgaggcgcggcaaaggaggtccccgtgatggggtctgcaaccaagttttagaagtagcgctgcagataactagtcatcagggacagggagcctggtgggaactgagcctgtgactgcttcctgtttgtgttggatgtttttgttttttgtctaaggtgctttcagactaaagtatgctggataatgcgaacgaagaatgtgcagagttttcagcanaaaaaaaaaaaaaagggcggnc

SEQ ID NO: 11863 - DNA, 3261 bp, Zea mays
aaaattacaagccgtcggtttctccccattagccaggggtaaaacgggaaagacggagaacgaagaggaggggaggggggcgacgtcgccggcggtcggaggcgacggggatgagtcggaaggaggcggagccggcaggacaggatgggtcttcttcgtcggccactgatgggggaggaggaagtggcagtggccgggagctggcagatgcgctggcgcggcgacgtttgtaccgggaggtgacgctggcgctgcactcagggttgcgcgacgccaaggcggacttctccttcctccgcgcgcgtgggctccgcagcctgctcggattccttcgctccaccgcctccgcggccgacgacgcgctgctgctccttttccgccactcccaatccatccccgatctccaagttattcctgttctctttcagaattcgttgcatcaaccaaagcaagatcctgttgtgacattggatcatatatttggaacggaaccaatgaagattacaagcccccctacagattctgaaattgctcttgcacttagagtcttggaaggttgttgccttttatatagccgatgcacagctctggcccacaaatacaaggctgtgaaggtactcttgaatatattagccagccgaggtccaactgagcaaggagtttgcttggacacactgatatcgctgatgttggactcaccctccaatcagatggatttcgaagaatacagtggacttgaaaaggttgctgaacttttaaaggatgtgcaagtggaaaagcatataagattgaaatgtggggagttcctattgttgctcattggacatgtttttgtgaaggaaaactctcccatacatgaacaaatgaaaaatctgtttggtgagcagtgcgcatcacttatatgggcagcaagccggttcggctccaccttggatgcagagcaaaggcagacgaccttgcaaatacaagcaatgagagttgtcgaatccttggaaccctactaggactggtgcattcatctgtgtaacttacgggtgatgacaatttgatgtctctaatctgagctgcatgctccattttgttcatgcaagctttgttgtcattctcttctgtgtaaagccattcttatgctactctttttagtaagctttgttaaaaggattgtattagttccatttgagaacaatgcattagggagacactaggaaaacattaaaatatccattttgttgtggtagatttgagctgttgtacctgtgattcaaataaaagtggttagtccaaagtgctagtgaatgttattgatcccttaactgattaaactgaatacagtcggttcttgttcagtgcattggcacgcattgcattagttcttagcaccttttgaaatggtagtggtagagcttatcatatactcactctgttccattttatttttataattctcttgacttttttaccttaattttgatcgactcatcttattaaaaaaaacactattattataaatttttactatgatattgtttagcatgtaatatactttaattttggctttcaatttttaagttttttctgaaattttgaataagacaagtcaatcaaacttgatctgaaaaagtcaaatgaattataaattgaaatgagaggaagcataatttttagtttgtatgatacacttagctggtatgaatgtaatttcaacgtttgatttggttaaaagttccaaatgctacgtgtgtaattgaaacaaccttacaaatctcacaaagctgatatggctgtaccgttagaactaattcattctgatttgtatgaaattaatgatgagttaatcaaaagtggcaaaaggtatgtcgtaacatagatgagtgcactagatgcctctacgtgtatttattacaattaaaatataaagtattgctttactacgagatcttaaaacattaaaactgatgtagaaaatcaatttgagaagaaacggttacagtcgagagagtatttctcaaacgaacactaatgtaggatgtgcggctgacaactaggccctgcctatcagtctgatatttatcccttccccgttctcttcttccacccagtgtcgaacgccaacagggaaaaaacgacgcccagagcgccggccatccgcccatccctcccttcgcccgttcgctgggctccgatctctccgccgccccaagcccgacggcccccaccgtccgacctaaaccaataatacggcgaaatagctgccaccgcaactccttttccgacctgacgtgcatagcgccagggctaccgaagttcgcttccgattcgatctccacagctccgacccgaccgccgcatctccgctcttactcgaaggtggaggtctccttcagccgccttctacgtcatcgccactgccgcggtcggtggctgcctcgagcaccgtggcacctcacggaaccttacagccttacaggtatatcagtgctcgtggaggtggtggggtgtgctgttcaacctgggagaaggacaggcaagttcgagccgtgggaaccctagacagtagaggtagatggcgtgtgggaggtgatgaaacagcagaatacctgtctcagattgtagcatgcgttttagtgctaaaatagcaaagacagaccagatattttgctactgactagtatgcagcaagttcaagtctcgacttaagtgtttaaaagctaacttcttttaatgaaatccattagcagagaagtggaaattaggcatatactgaggttttgtagaaatacaaggaaatgacctatcttttcaactgaatgaaaaggaaaggaaatgacagacctaagctcctacatgagtagggtctagagaaggaataactgaggcaagcttacccctgcatttcataaagaggctgcatcgaacccagatatttggctcagtggaaaggcttctcaccattgcattaggcatttccttctacctttcgaatagaagcacaacaaaaaactccatatcgtgatatgcattaaatatacttgtgaacctaaaatcatatggtttgaagtttataagactaggagtttccatggtgtactattgtccatacccaaaatggattattgtagccaacattgctgtaaaagcagttgtcacatttcacttaatgttgacacttaactcgatatataagttttgctatcgcgtcacataatgactattgcgtcacatagtgacacaatgttcataaaaattcaaatatgttgtttg

SEQ ID NO: 11864 - DNA, 827 bp, Zea mays
cattgggtacctcgaggccggccgggagtgtcgaacgccgacagggaaaaaacgaacgcccagagcgccggccatccgaccatccctcccttcgcccgttcgctgggctccgatctatacgccgccccaagcccgacggcccccaccgtccgacctaaaccaataatacggcgaaattgctgccaccgcaactcctttccgacccgacgtgcatagcgccccggctaccgccgttcgcttccgactcgatctccacagctccgacccgaccgccgcatctccactcttactcgaaggtggaggtctccttcagccgccttctacgtcatcgcaactgccggggtcggtggctgcctcgagcaccgtggcacctcacggaaccttacagtttcgtggacttctgttgcgaacaaacatggagaaaagatatctgtgatctcaactgaaatatggagccagtcaaactagttgaggggtacaactttgatgaccatactacaagtgatgtccgtgtttgctttaaactgattgatgagcagccggaatggttttcctgccactcatctgttctttcccaaaacagcaagtatttttcagatcggcttggtcaaaatgatattcgttctaatagttgcgttgaaattgagtgcccaagagctcagtatgaccattatgtcaagatgttgaagttgatgtatcttcccggggaatcaattgtagattcatttgattctgttaaatcagctctgggtgttcttcgagcatcaaattcactcggatgcgagttggttaccaaaggatgtattgcatacattgaagctgtccca

SEQ ID NO: 11865 - DNA, 4043 bp, Zea mays
  misc_feature (829)..(829): n is a, c, g, or t
  misc_feature (1652)..(1652): n is a, c, g, or t
  misc_feature (3158)..(3158): n is a, c, g, or t
tggaccaattggttcgtcacactagctattgccacacgagcaaataattaggaatttttcgggcttttgcaaagggaaacctactacagtaaaatgtcaagcagtcatatttacattgacataatagttacatgcactatagtttcccacaacctaaccattatattctccacagttatgtagcactgatatgcataaaaaggatcaataagaaaataaaatgtgcaggtgcttctgtacaaactcatgattcttgaagtaaataacgcaatgaacattaactgcaatgatcacatgatactccatcagtcccaaatagtattcactttaactcttggtttttatgtctatattcaaatggatggtgatgaatctagacaccacaggtccaacgcctaggcgtcttgcccgcctacctcgcctaggcgtccaggcggtggtccaacgccttgtctcgtcttaccactttaaaaaccatgctagacacatatacaaaacacagacattaattattgtatgaatccattaaaaggctgaaacgaattttaatttgggacagagggagtactaagtgtcaacaaaaatcaggtaaaagctacagcatttctagaaatgtcaaatgtcactttcccagttagctaaaggttctttagttgcacaataatgaaacagaaaaggtttgtcctgagcgtgcaaagcattgaaaagttctgggggtgctagatttagaaaaggaccatttacatagcattttaagcttaataaggaaatattagaggtgcagcatatcaagaatcaactttgcagtaactattgaacaatgtaactnaaaaaatatggcatgcgacaatgaataaacttcttcacagatcaaacaaacatcacaaaatgttgccaagatgaaatgaagctgaaaaacatgatatattgataatttattgaagagaggccaaacatatgataagctgaatagcatgattcctaagagacacaaaccgtctgattggttgcctatccgagctgagccaggatgagcagcgtctggttgagctcatgcaagacatatttgtttggttgcttgtacagatttatgcagactggtgtagacgttgtttggttggttgagaagataaataggagattaattttttttgaaatatatgtagcatgtgtggtctagttttgttcggaaaaatatcagaaacacaaatataaaatcggttcagcgaataattcttttaattagaagatataataaaaatagcctaaaaggccttctcgatttgcgtgccagagcattcagctgcatacgaccagcctgcagtcctgcacgagcgcatacgcgcggccgaggcatctcccacgggcctggctgggggtcgtgttctgcatctgctcaggctgtacgcggacagatggaaaccaaacaatgtgtgctttaaatcaccacgggtgcagctgcacaaacggggaaacgaaccaatcacgcggaaaagaaaatcagagcatgcaaccttggtcattgggaaaacaaagtacaaagaggaaagcaaaagggtgggctgattcaaactgtgaacagctagaaattggtgcctaagtctgtgatttgataaaatatcagataaataaccatcagtacagctaatagntaaccatagcaatgaaacaaccagcaccacgagttgtgcaccttcattgaaaaacaaaatgggacttattgcataacaaagaatatgaactaatccaagtgttgtgccatctaacagattttagctttcaataaccagctatagaagtccacctaagattccaagtacacatgacatacaaaagtcagagaaaacagtaataatttcacatggctgagaactattttgcatggctgagcaactgatgagtgatgaatagttgaacaccctgccttaggcccttagtggcatgaaactgtactgatttcgcaatgataaaacaaacaatggtgccctggagtattattcccagtgttcgagcctattcctgttacattttccccaccagtggcaatctagcaaacagatgaaatatttcttagcatactccaactaccaaaatcgtattaagaattccagccccggagacaaaatttggcatacacacctcattatcagattcatatcagcaaacatctcacagaatttgtcccgtgttcaaatcctactcccatgatcagatctaacaacaggaacacccgtagcacacgacttcacggggcccaaaccgagatcacgaagtgagatacacaaaggaagggctgaaccttgagcgacgggcggtagagcgcgttccgccgcatccggcggacgcaaacgcccacctcccacttgaacgcccgcttccggctgtcgaggaagccatccacctcctctcgaaccgcctgcggcgtcgaccccttccggaacagacgccggtacagcgcctcctccacgtacttcttggtcgacctccgcgccacgtccttcatccgcgtcgccatctccgcctccgccctctcctcttcaccgccggcgtctcgggttttgagggttttggcggcggcgcggggagaagctctcgcctcactactccccagtcccactcgtgtgatcgcgttgggcttttctgggccttgatgggccgtgggctctgaaattacaagccgtcggtttctccccattagccaggggtaaaacgggaaagacggagaacgaagaggaggggggcgacgtcgccggcggtcggaggcgacggggatgagtcggaaggaggcggagccggcaggacaggatgggtcttcttcgtcggccactgatgggggaggaggaagtggcagtggccgggagctggcagatgcgctggcgcggcgacgtttgtaccgggaggtgacgctggcgctgcactcagggttgcgcgacgccaaggcggacttctccttcctccgcgcgcgtgggctccgcagcctgctcggattccttcgctccaccgcctccgcggccgacgacgcgctgctgctccttttccgccactcccaatccatccccgatctccaaggaaacgtcaggtcattgaaaaataacaggaattaaaccatttcttggtctctgtatcaaaggtagtggcaccttctaattattcctgtnctctttcaccaatttcggtgcatctgatgcgaaggatctttggttgtggctacgcaatggtattgtcattaggtgaaaccaatcccttatgcaatggtcaatggctgtttgaaatctgatgaataattcttgaatacatactaaagactttaacgttatctactcaatgaaatcggcactatatgtagtgccagcttgttaaaggcagtaagttaggagcagcgctgctgcacttgctagatcctaacataagtagtggcgattaaatcaatgaagcactctcaggctcattagttagagcccaagattctgcattaggtaatagatgcccccaaacagccttttgatatctatattatgccccttcaaatcacaagagcggaatccatatttactatgtagctcatgctggtagcttagaggtctagtctaggaagatacattgttagcctttttaattctttccatttgtcgctctctcgtgtgcttttactccttttccttaatataaatataggcagcactcttgctactttgttttaaaaaaataactagttagctgtttatccttccagacttcctgaattgcatttcatggttgtcaatgcaataacgactgcatttgccctgtcccattataatgctctcaagagaagaacaaacctggtaactgtatctgtgtgttagtattacttcctgtgtcataatataaaaggtgtaactgtattttgcagatgttctagagtacaaagtgcacctctctcggctcttattttgatgacatgtaacaatgtggcatttactgcacttgcgggcttctcagctctttatcggttggattcacatgcatgcatgtttacttttttcccctcaccagtattagta

SEQ ID NO: 11866 - DNA, 1742 bp, Zea mays
cattgggtacctcgaggccggccgggagacgcgaagcaaacatgccctcaagcttatgcccacgcgagtgagaagtgagaatctcctaggaaagagaaacaacgaagactcgaaacgagtacaccaacctttctttctctcctctcgcttctgcggcgaattttcttgtcccgtgccggccgccgtgtctaccctgcgccaccgccccttccaacgcctgccgtgaagacaaaaggtcttggttaagtttgaagatgtcgtgcttggcatgctgtggcggcgaagatactcaaagaacacctgataatggaggtccataccctggtggctacccaccaagggatgatgcttatcgcacagctgatccaactccgaggggtgctcaacctttgaaaatgcagccaatcactgtccccactattcctgtagaagaaattagggaggtcacagtggcttttggtgatgaagctttgattggtgaggggtcttttggcagagtatattttggtgtactaaaaaatggtaggagtgcagcgataaaaaagttagattcaagcaagcagccagagcaagagtttttggcacaggtatccatggtgtcaaggcttaagcatggcaatgtcgtagagttgcttggttactgtgttgatggaaacacccgcatccttgcatatgaatttgctactatgggttctcttcacgatatgcttcatggacgcaaaggtgtgaaaggagctcagcctggtccagtcctgtcctggacacaacgagtgaagattgctgttggagcagcaaaaggccttgagtatcttcatgagaaagcgcagcctcatattatacacagggacatcaagtccagtaatgttcttctatttgatgacgacgtatctaaaatagctgattttgatttgtcaaaccaagctccggatatggcagctcgacttcattcgaccagagttcttggaacatttggctatcatgcacctgagtatgcaatgactggacaacttagctctaagagtgacgtttacagttttggagttgttcttctggagctcctgactggaagaaagcctgtggatcatacattaccaagaggacagcaaagtcttgtgacatgggcaactccacggctttgtgaagataaagttaggcaatgcgttgattcaagacttggagtagaatatcctcctaaatccgttgcaaagtttgcagctgttgctgcactgtgtgtgcaatatgaagctgactttcgacccaacatgagcatcgtggtgaaggcgcttcagcccctgctgaatgcacgtgcatccaacaaccctggatgaatgaatgaatgactgccgttgcttttccctgacgagagtatctgaatcagacaacatgtagcattgaattcagataaatatagtgtttggcttaatacacttggccctagatgttcatcaggagataacctcttgcagtttctggatgttacctagtctttgtatccctaatggcatagactaaagggcctgctcgtttctgtcggaattcactaggaatcgttccagctgatcgaacctagtataaattagacaaataattcggctagtaatctctagtaatcgttctgggtgtctattccctaggaaccgaacaggccctaaactgtaacctattgttcggttgcgttccatctggtgttgtttacatccaccatccatgaagtcaagcagcatcctatttggggcccccgt

SEQ ID NO: 11867 - DNA, 1865 bp, Zea mays
tggtccctcgagggcccccccgggctctctctctctctctctctctctcccccctcttcacgccacaggccacaccacgccacaggtgtccggatcaacgagcaagcaaccggggccgagagagacgagatgaggcctgcctcttctccctccgtcacacgcgagacggagacgcgtctgaagctgaggcctgtataaaagcgccaaagatccctcgctctcttcccccccgtgcgctgtgtcccgtctctgcgagcaagttctgtcttcgtccatccatccgtccccgtctcactgcctgtggcccgtgggtagcggttgtcgatcagcttacccacgccggcgtgttctccctgacatggtcggccggatggagcggcagaccgcgtcgtcgtcagcgtcatgctcccccgccgccgccgccaccacctcctcctcgtcctgcggcggcaagaagcggcctgatatcctcaacatgatccggaatgcatcctgtcttaattcgtcgtctgctgataccggcaagggaaggagtaaattgtcgaccaacaaagttacacatggattccacctggtggaaggcaagtccggccatgacatggaagactaccatgtggcagagtacaagtatgtgaagaatcatgagcttggtctctttgccatttttgatggccatttaggagataaggtgccaagttacttgaaagctaacctttttagcaacataatgaaagagcctctcttctggtctagccctcaagaagcaataaagaatgcatactgctctacaaacaagtatattctagaaaataccaaacaacttggaccaggtggttcgacagcagttactgctattgtagttgatggtaaggacatgtggatagcaaatgtaggcgactctagagctgttgtgtgtgaaagaggctctgctaagcagctcactgttgaccatgagccccatgaaactaatgaaagacagaggattgaaaagcacggtggctttgtgacgacatttcctggtgatgttcctcgggtgaatggtcagctcgctgttgctagggcatttggtgaccaaagcctcaaggcccacttgagctctgaacctgatattagtcatgtaccaataaactcaagtatagagtttgtcatacttgccagtgatggattgtggaaggtaatgaagaaccaggaagccgtcgatctcgtgaagtcaatcaaggatcccaaggcagcagcgaagcgattgaccactgaagcgttggcaaggaagagcaaagatgacatctcttgcattgtcatccgtttccgctgctgacttaccccctcaacagcacttttttatttccgatccacgcctcatgatatggattgagacaatctgtctgtaatcatctgccttgccgattttttttctggtagaatctgctctacctaccgtagttgtggacagacctggaactaattaggacagtgaagacttgagagctggtaggtgagtgtgtgcagggtgtccattccattcgcctgtgcatatatacacccaggccccagcgtagactgtgcatccgttgaccgggacttgggggtcctgtcaggacctagtgcttgtgatgctaatggacctaatggtgcgaaggaacttgtcgatatctgatttgggcaatttagtttattacatcgctctcagttcgtagggtagatgcatctgatttcaatgaaacattttagtagttcaggccacctttataatgatggattcctccctatatccttcgttttgttctctgtgtcctgcgttttttctacgaatatgaactgttcctgtaaaatcactatatggttcttgtgaaatgcatgtttttcct

SEQ ID NO: 11868 - DNA, 2158 bp, Zea mays
aagaattccgatccacccacttcatcaccaaggccgtcgtctctccccacgccggccgaacggatggcggcggcgccgactgcggatgccatggacgtcgacgcgccggctaggacgctgactacctctccggccaccaagttgcgctcccctcacgacctcctcgcagagacacgcgcctccatcgagaaagtcgcagcccggatactcgccatcaagaaagacggcgcccccaagtcggagctccgcgagctcgtcactcagatgtctctgcacctcgtcacgctacgccaagtgaacagagagatactgatggaggaggacaaggtcaaggcggagacggaggccgcgaaggcgccggtggactccacgacgctgcagctgcataacctgttgtacgagaagaaccactacgtgaaggccataagagcgtgtcttgactttcagacgaagtatccggggatagagcttgtgcccgaggaggagttccagcgttccgcgcccgcagacatccttgagaagaccctcgctgccgacgcctcccacgacctcatgctcaagcgcctcaactttgagctcgtccagaggaaagagttatgcaagctacatgagaaattaggacaacagaggggcagcttgctggagacaattgctaatcagaaaaagtttctttcaagcctgccatcacatttgaaatcattgaagaaagcatcactgccagtgcagcaacagttggggatgcaacataccaagaaactaaagcagcaccatgctgctgagttacttcctactccgctttatatagcatacactcagttgctagggcagaaagaagcgtttggagagaatattgaagtagagatcgcgggaagcacaaaggatgcccaaatatttgctcaacaacaagccaagaaggaaaacagcactctttcaagtggcgacaacagaatggatgatgatgtgattgatgatgaagaagatgctcagagaagaagatcaagatccaaaaagaatgtggtgaaggaagctaataatccagcagtggcctatcaacttcacccacttaaaattatacttcatgtatatgatactgaagattctggtagcaaacgccgtaaactcatcaccctgaggtttgaatacttggcaaagttgaatgttgtttgtgtcggaattgaagattcagagggtctggacagtaatatcttgtccaacctatttccagatgacactggtttagatctgcctcaccagatggctaagatttatgttggggaggttccaaacttcagcgacaaggattcaaggccatacaagtgggcacaacatttaggtggtatcgactttttgcctgaagtgcctccatctgttggggatgattctagcagagcattaaacactgctgatttgtcatctgggcttgctctgtaccgtcagcagaaccgtgcacagactattttgcagaggatccgcttgcggaaagttgcacagatggctcttatgtgagtcactggtctatgttttttgctgtttgggacatcgatgaaaaaacccggatggtagattagcctgagagtgaccgtgtaatttgactgacgattttgagctaatgatgcttttgcttcattgcacatgtcattctgagttatggcaatactatgaatcatttaccaggcagaaattgtgaaacataccatttatatctgaaaaaaaaaaaaaaaatcttcatatgttctctacatattgattcaaagctaattattggcgaccttcattataatgttattcatgactgttatatacatggcctgtttgattggtagcatccctttgaagttttcgagtctctttgattacaggtggcaacttgattatttgacaaagctgaagtggcctcgaatagaacataagaatgcaccatgggcatcacgcaacccactgtgcagtctacatagttggtcattgacaagttatcctgagtcatctcgttctattttgatgctaagtggtgctgcaagcaatgttgacagtgatgtagagagatctgtgacaaactgggaagaaactgagagtatcagggaggatggggagcttccagttgttattcctgctgagaatgagccaaatggttctacaattttgcaacctgaggtgtcag

SEQ ID NO: 11869 - DNA, 1448 bp, Zea mays
atgactactccaagcgcgcaattaaccctcactaaagggaacaaaagctggagctccaccgcggtggcggccgctctagaactagtggatcccccgggctgcaggaattcgcacgagaccattacctagaacatcctaatcgaaaaccttttgccgatccagttgtgccgatcggtattttcccgcgtccaccaaaacccgttgccgccgtttttttcgtcgccgccacggaccaggatcgaccggtgccgatgaagccagcggaggacgcggatgcgccggcgccggagacggcggcagcgcagacggtctggtacgaccccatgacttcgccgcaggcgccggcgccgcagcagcaaccggcgatagaggctgcgatgcggggggcctcgccgtcggtgagctccaacgcgcggcctctcagggtgtacgccgacggcatctatgatctcttccacttcggccatgcgcgcgcgctcgaacaggccaagaagtcatttcccaacacctacttgctggtaggttgctgcagcgacgagatcacccacatgtacaaaggaaagaccgtcatgaccgaggacgagcgctacgaatcgcttcggcattgcaagtgggtcgacgaggtcataccggacgctccatgggtgatcaaccaggagttcatcgacaagcacgacatcgactacgtcgctcacgacgcgctcccatacgctgacacgagtggagctgccaatgatgtctatgaatttgtgaaagccatcgggaagttcaaggagacgaagcgcaccgagggcatctcgacgtcggacatcatcatgaggatcttgaaggactacaaccagtacatcatgcggaacctcacccgcgggtacagccgcaaagatctcggcgtcagctacgtcaaggagaagcagctgagagtcaacatggggatcagcaagctacgggagaaggtgaaggagcaccaggagaagttccacagcgcggcgaagatcgctgggaccaaccctgtggagtggatggagaacgcggaccgctggatcgttggcttccttgagaagttcgaggaaggctgccacatgatggaaactgccattaaaggtcggattcaggaggggttgaagcggcaaggcaggtcggagtcaaacctttctggagaggagtccgactcgtagttctgtgatctcctccaaatgaaactagacaaaaggagaactggagatcatttcccagtctgtgtaacagtatgagattggttaattagcatgttattgtaggatgccatggatcattgtttagttgtacctggagatcatgtagttttgaagaacaatcgtgtttctgtatgcgatcagttgctccttcattgagcatatctgcatatggcacctgctaggaagtaggaactgctgttcatttgatagaactgaagatacgaaaaaaaagac

SEQ ID NO: 11870 - DNA, 976 bp, Zea mays
cctttcacccctccagttccttcccctccccctctcacaactctaccattacctacaacatcctaatcgaaaacatttaagaaaatatacgatgaatttgaggattaacttttatgaatctttacaagctcaatgttataaacaagaatacatgtatagtgcattatatatcctatttattcgcaatcaaagaaaaacgaccaaaaaactgattaccgaataaataacgtttccgaccgttttcatccctatccagaaactacagttgtaaccttagcttcttgtatccaccatttgacaggaaaaataaattgtgtgttaagttatttagaacaaattatgctgcagcctatgatttttattttgtgtacttatttatttcttctacactaaaatagtgctacttttcagctacatccttgttcgctgcctttggtttccttctctatggagggaggttattcctgatgttgcagcgtttccctgttgagtcaaaaggccgccggaaaaaattgaatgaggttggctatgtgaccaccatttgctttggttgcttcttgatcagatgcataatgatgtgcttgagtgcttttaacaaagatgctgatcttgatgttctgaaccatccaatcctgaacttcttttactacctgctggccgagattgcaccctcatctttggtgctgttcatcttaaggaaactgccgccaaggcgtgggattgcacaataccatccaatccattagtttgtcttcaacaacatcctctatatcctttttttttacagtttcttctaaaaaaatcacttcattctctgtagcagcgtcctctatacttaaatacctatattagagacatattttgctctagattttgtatgtatgtatgtatttgttatactcaagtattttatacatattttagttttatttaaaaaaaaaaaaaaaaaaaaaaaaaaaaaaaaattaaaaaaaaa

SEQ ID NO: 11871 - DNA, 1343 bp, Zea mays
  misc_feature (1322)..(1322): n is a, c, g, or t
ccacgcgtccggaccgaaacgggacccaccagacgcaattccccaacacggcctctccgccgccccggcggcgttcgatcgattccaacttgggatttccgccttccaatcgctccgtttccttcgtattctagaatctagcatttggtttgattccgccgcttggtccggccccgaggaggaggcaagggagggagcggtggccgcgcggccatggcgggctcgtctacggcggcgatggacgcagccgcggcctggtgggacgacgtgaacaactccacgctgtggcaggaccgcaccttccacgccctcgccgcgctatacggcatcgtcgcagtcgtagccctagtccaactgataagaatcgagtgccgggttcctgagtatgggtggacaacgcagaaggtgttccatttcctaaacgtcattgtcaatggcgtgaggtcaaccgagtttgtactgcggcgggatgtgcaacttgtacaccctgagatacttcaacacgtgcttattgatttgccgggcctagcgttcttcacgacctacgctctgctagtgctcttctgggctgagatttactatcaggcacgtgcagtgtcgactgatgggctccggccagctttctacacaatcaatggaatgatctatgtcattcagatactactgtggctgctcatgtggtggaaaccagttcaagccgtggtaattttgtcaaagatgttctttgcagctacatccttgttcgctgcctttggtttccttctctatggagggaggttattcctgatgttgcagcgtttccctgttgagtcaaaaggccgccggaaaaaattgaatgaggttggctatgtgaccaccatttgctttggttgcttcttgatcagatgcataatgatgtgcttgagtgcttttaacaaagatgctgatcttgatgttctgaaccatccaatcctgaacttcttttactacctgctggccgagattgcaccctcatctttggtgctgttcatcttaaggaaactgccgccaaggcgtgggattgcacaataccatccaatccattagtttgtcttcaacaacatcctctatatcctttttttttacagtttcttctaaaaaaatcacttcattctctgtagcagcgtcctctatacttaaatacctatattagagacatattttgctctagattttgtatgtatgtatgtatttgttatactcaagtattttatacatattttagttttatttaaaaaaaaaaaaaaaaaaaaaaaaaaaaaaaataaaaaaaaaaaaaaaaaggcttatcgatacgccacccncccagagggggggcccggtac

SEQ ID NO: 11872 - DNA, 1709 bp, Zea mays
acgccaagcgcgcaattaaccctcactaaagggaacaaaagctggagctccaccgcggtggcggccgctctagaactagtggatcccccgggctgcaggaattcgcacgagaccattacctagaacatcctaatcgaaaaaccgggctgaggaggccatcggacgcacaaggacagcagagtgcaggaccggagcggagcgaccgagagtgtgtgggagagagatggcgtccagcgcctcgtctaccctgccgctgccaacgctctcgctcgccgtgatcctgctcgcgctgtgcgcccgcggcggcgaggccaggccgccaccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggtttcttcagcgccgccatcaagctgcccgccgactacgcggcgggcgtcgtcgtcgcgttctacctgtcgaacggcgacgtgtacgagaagacgcacgacgagctggacttcgagttcctgggcaacgtgcggggccgcgagtggcgggtgcagaccaacgtgtacggcaacggcagcaccgacgccggccgggaggagcgctacgacctcccattcgaccccaccgacgacttccaccactactccatcctctggaccagcgaccgcatcactttctacgtcgacgagaccccgatccaggaggtggtgcggacggcggccatgggcgcggcgttcccgtccaagcccatgtccctgtacgccacgatctgggacggctccgcgtgggccacgctgggcggccggtaccgcgtcaactacaagtacgcgccgttcgtggccgagttcgccgacctcgccatccagggcttcgccgtcgaccccgccgccgaccacgccgtggcgtcgtgcggcgcgggcctgggcctgggcctgggcccgggcccgctcgccgtgtccgcggagcagcgctcggccatggcggcgttccggcgcgcccacacctcctactcctactgccacgaccggcggcggtaccccgtcgcgctgtcggagtgcggggccggcgcggggctcctccccggccgcatgtttggccccgacgggatgaagcagcaccggcgccaccggggcgcggcgcgcggccaccgcggcggcgcccaggacgacgacgtcatgtgatcgccggtccctggcccctcgccacgtcgcggcggcggggcggggatggttgcacgctgtggattggattggattggattgggttgggggggttgggcggggattgtccgggatggaaaagctcgcctcattgtaccattcgcgccatggaagtaggtcgtgtttattgcctgtggtgggacccatgtccgtgccaacgccaattgccagccgcgtagccgttgatgaagaaaaagccattcgcttggccgctctttaccttgtagcgttaaagggtaaggtggtgtttgggaacaaagtttttctgcggttttggaagaatactgcagtattctcaaatactgcagtattatataaaaaaaaaaaaaaaaaaaaaagaataaaaaggcaaagcctaaaaaaacaaggaaaacaaaaaaagggggcggccgccgactagggagct

SEQ ID NO: 11873 - DNA, 5524 bp, Zea mays
  misc_feature (1285)..(1285): n is a, c, g, or t
  misc_feature (1388)..(1388): n is a, c, g, or t
cccggcaagcacttctagcccattatgatacggttagtcccggcccatctgaatggacccggcaagcacctctagcccattatgataaggtttagtccattacagcacaagcatagctgttggacagttaacactagttaatggcatgtggaaagattaaaataaaatggccatatgtatatgtctctacattcggcctacttctatgaatttgattcgtgtgcaatttgaaaccttttggatcccgaggatcaattctttctgctaatgaaagcttaaatgtatgcaataccagttccagttcttagccctgaagctgcacatactcatgacagcagccacaatctagtgatgctcatatccaacaaagttgggatgtagtgtgccatgtaaatcacgccatgtatcattacatttctttgaagttatgatggtagttgcttgttttttgtccataataacgtggtgtctgtttcaactctcttccaaatgtgacaataagctcttccgtattaaattctctacacttcacatgcaaagatattcttttctggaagcatattccaaaccgattcgctgtatatctcgaagccgcactgtccgccccttgggtcctacaaagcgggcgagttctgcaacagcaaatgaaattgacatgctcagtaatggccaagggtttgttagtactgacaaagtaaatagtcgtggacattcagtgtgtctgcatacgcccatgtttcccaagatagaagatggaatggtggaggtagtagaggcccacaaaatagtatcacaggtaatgaattaggcaattagctagcctgacttactttgtcaatttatgcttaatttgtgacttcttgatttggtatcgttatctgtttacagaataagaatgccagaaaagtggtagtaagcaaagaagcacagaatgtaatagggactgattcctcaacatccaactatgacagctttgattcaggaagttcttggagtggatcagaaggagatgatggtattgaaaccttttcagacgctgtggttttcagatactgtctagacagcacatatgaccggtcaaagtttcttagaggtgcatctcttactgttaacaaagatgacttggtaaaacttgcagaccgagtctcgttgtatagtggatgctcccaccacaggtaatttaactcttgtatctgataaatttttcctcactcgtattattgacagtaattctgcgatttatttttcccttctagaaaccaaatattaatgtcgaagagattgntcagagagggtgctgacacttggaacatgatctcaaagaacaatgaacgtgctctttggtcatctgccattccagagatcataacaaaatttacgaacattgnccattctgtgcgtaggggtttatcagagcaggtaggatatctttacatgacctcagtatgttaactatcagtcccagggttgtatactttttgtacggtgcaatgtttaattgcatagtattcactgtttcaggatcttgaggttttaagaggcattgctggttgtggtgaggacataggaagagatgaatttgataggctatggtgctggttatacctagtggttgtttcattatcgagagagagaattaaaaagctgtgggattgcacagcacctagatggatagagggcttgattacaacagaagaagctgagaatgcactaagaagttccagggaattgttaaaggaggcaggaacatttgttctcagatttcctatcacccgaagctggccacatccagatgctggaagcctagttgtcaattacattggctctgatagctcaattcatcataggctactctctcttgattccaggtgtgctgcgattagcatgttaccctatcctctgaatctattggcagcgaaatttctgaacctttctcttttctactgctaacagtgatgctagcgctgagaaactgcaagatttgctgctccaggaaccagaactatcacagttgggcaggtaaagcattatagactccaaatcacaggtgctattcctttcagtacttactaaatggtacatatattcaaatgcagggttgatcgggtctcaatcaccatccggagatgaccaaggcttcaaacggttaaacttacattcaaaagcaggatttaggatgctgccacgagaagagggtcaaaagcatccaagagcatagcccataacacccattgcctgttgttaccatgcacaggttgtaaattggttcccttcgtagttcgtacaaagaggatgttttgccgtactagtgaggtctagtctagttgcttcagaaaaccaacagtaacatcagctatcatgtgtgttgcaaaaagaaagaagctgtcatcatgtgcctcgagactggaggattttcagtggctaacatgttgcatataaagctgacagttgatttacggagtacaaattatttttgggttccttttcaatcctctcatttgggccgagagaaggatagtgtcgtcgtagcccatgtcaattttgaggtcaaaagcatcggtccgtccactatccaagccccgaattacgtcacattctccaaaatggctgcgggtcgcacccggcgctcgtccctccctgccgcaaccaacgccaccgcttcggcgcttacccatcagatcagacagacaaacaaggcaaacgagaccctagcgcagcatggcttggacggctgcgggcacagtttgctggcgcctcctccgcctcccctccgtccgctgccctctctcgtcccgggcccggtgttccgctgcgcagagcctagacgccgtggacaaggagtatgccgacctcaacctccggcctctgtaccccaacgtctgtcgtcacccttcttctcttcgtccctacccccggtgctattccaatcttaccactgattcatctatgtacgcagaggggccatcacatgcgcatacggtagcacgtgaacccgctcagctcatccttctcggtaaagcactcctaattcctcacccattttttcaagattaccaagcgagcacagtcactcgtattttccgttaatttgtgctctgttttgcggtgcgtaggagcccacggggccgccagagtggaaggaggtgttcgacgaccccttgcttcccctcatggtcgacatcggctgcggtgcgcaaatgatacttttatttaattttattttatactggcaatgggttgcttgaaggaggatgttctcagggaatcttgatgtccagggagtgggaggttcttgatttggcacgcgaagaattctggcaagagtcaaaactaccttgggctagaaatccgccaaaaggttttattggttttaggttttagcttgttaatttggtttctggattggatgatttttcctttttttaatgtataaatgcccggatctctgactttcagtttaagagaccctcgcgtccgatcagaacagttttagaaacaaagcactgggaacctcaagctcaagcagccccccgccccaaagcatgacacagcacacagactgcaccctcataacacggaacaaagataatgaactgcagaatcgcatgccatcatttcgctttcaaagacacttgctttgctgtttggaacaattctcgaagatgattcagtttcattctttcctgagtcccacattacatagattgccaggccgttgaaatattttggcataaaagatataagcgtatgccagtatcacacggtccattgcgcataatgcaattatcttgatgtggccagccccttaaatccaagttgtctgctgcagaattttgtcttgtataagtgtccaagcaaaccatttaaatgtgcctttgaactgcacccggtacttatgcattgttaaatttgtagtttggtgacactctacttgttttgtttctgtagttggtggagcgggcacagttctgggtgaatgaattggagcttatgtacgtgtaggttgcctggcatccgaatttggcacttgctctttcttatcagtgcagtaatgtagcatcacttgaaattattctctttcaacagctattttatgtttgcaaatgcaacgatgtcttttgagaaaatcatatcgtcataccctggtcccctgtcacttgtttcaatactggtgagtgtagctgggtgctacatcagttccttagttatatctgttggctcagtgataattaatctgatcagcactttgttatttcctgatgttatggaaatggaactgagatttcagatgtctattcgctggttttgtagtgtcctgatccacacttcaaaaagaggcatcacaaaagaagagttctgcagcaaccattggtcgattcaatcataaataatctctgtttaggcggacaggtatagcaattccatagtccaagcattgtctttctaatctcaaaggcacggacccgttacttccaaatgctgtaataatcgttgctctactcatactaatcctgcaggctctatgcgttgcacggtgatagttaattcaagataacctaatgcattaatgccatacattttaattttgagctaaggccattttttgttatgtacatcattctagtttttgatgctgtgatctcccttgtgtctatcatgtctacacatgtccttcatttcttcaagctaacttagtgtattgatactaggttttcatacaatctgatgtactggaagtagctgtagacatgagggaaaggtttgatgggtactctggtattttggcacatgttaattatgtcgatcaagatcttcagtgtgacaatgaaggatggcttctggacaacccaatgggaatccggacagagcgagaaatccatgcagagcttgaaggagcaacgatatacaggagggtgtaccaaaaggttagagatgcttctttctagctgtttatcagctacagaagttgtccgaggagtaaggtttccaagaatgttcattgcatgtatttcattaagagaagttgggaaaaaacaaagcatccaagtacaaagcctggcgaaccaaaacgaagagaagcccaagcagtaacacacctgatgtcttcctgcttgaaccatgccacaagttgcctttactacatcaagctgcattacatttctgacagtgcgcttgtgcacatctaatctttttttttcacctgatgcaatgagtcagattagccaatgcttttgatgaagatgacaactggcaaaagtgttcctttgttggtcaaattgtacttatggtgtttagcatcaggtgctgtcttcgttctgtccataattcaggtctggaattgctcaccatctatcggtatgcagagagtttgtagaggcaatccagatgaggcaatttgatgtgcgctaggattgttcaaactttggtccgctcaacgttcccttgacttggtagatatacaagaatggacaacgttttcttgacttggtaaagtttggtcattagtttgtgaaacagaatgctg

SEQ ID NO: 11874 - DNA, 1937 bp, Zea mays
aattcggcacgagggcaaagtcgcgccgccgtcgcctcgcacgcacgaacgccatcacttcggcgcttacccatcagacagacaaacaaggccaaaactccacgacgtcccccgctcggcagcagcaacagccgagaccctagcgcagcatggcttggacaactgcggccacagtgtgctggcgcctgctccacctcccctccgcccgctgccctctctcgtcccgggcccggtgttccgctgcgcagagcccagacgccgtggacaaggagtacgccgacctcaacctccggcctctgtaccccaacaggggccatcacatgcgcatacggcagcacgtgaacccgctcagctcatccttctcggagcccacggggccgccagagtggaaggaggtgttcgacgaccccttgcttcccctcatggtcgacatcggctgcgggagtgggaggttcttgatttggcacgcgaagaattctggcaagagtcagaactaccttgggctagaaatccgccaaaagttggtggagcgggcacagttctgggtgaatgaattggagcttatgaacgtctattttatgtttgcaaatgcaacagtgtcttttgagaaaatcatatcgtcataccctggtcccttgtcacttgtttcaatactgtgtcctgatccacacttcaaaaagaggcatcacaaaagaagagttctgcagcaaccattggtcgattcaatcataaataatctctgtttaggcggacaggttttcatacaatctgatgtactggaagtatctgtagacatgagggaaaggtttgatgggtactctggtattttggcacatgttaattatgttgatcaagatcttcagtgtgacaatgaaggatggcttctggacaacccaatgggaatccggacagagcgagaaatccatgcagagcttgaaggagcaacgatatacaggagggtgtaccaaaaggttagagatgcttctttctagctgtttatcagctacagaagttgtccaaggagtaaggtttccaagaatgttcattgcatgtattccattaagagaagttgggaaaaaaaacaaagcatccaagtacaaagcctggcgaaccaaaacaaagagaagcccaagcagtaacacctgatgtcttcctgcttgaaccatgccacaagttgcctttactacatcaagctgcattacatttctgacagtgcgcttgtgcacatctaatcttttttttcacctgatgcaatgagtcagattagccaatgcttttgatgaagatgacaactggcataagtgttcctttgttggtcagattgtacttatggtgtttagcatcgggtgctgtcttcgttctgtccagaattcaggtctggaattgctcaccatctatcggtatgcagactgtttgtagaggcaatccagatgaggcaatttgatgtgcgctaggattgttcaaactttggtccgctcaacgttcccttgacttggtagatatacaagaatggacaacgttttcttgacttggtaaagtttggtcattagtttgtgaaacagaatgctgcattgctcttggcatttgataagtgacaggtgaataagacgacaccgaggtgcatgtgggcactttttagtgtttgatgtttgctaagtcctctaccaacaggtcaatacatatgttaatcaatttgaataactcattaattgaaattttgttgctaatggtatcgaattaactcaccattgtattcggcttttcgctgagaaacagtttagtatcagaatcatttatcgaataatgtttcgtcgcaacacagtcatattgtactagtgatagctgacactgttgggttacccatgtattgccacgatgtctatatatcatgtgtaaagaatttgtaataagacacataaatatatgttctattgatt

SEQ ID NO: 11875 - DNA, 1686 bp, Zea mays
tcgaccgcccgcccgggcaggtacccgggaaaagaaattctccaggctttcccaagctctagaaaggaaacatattgtggagggaattgttattggcctcgccaatttggatgctgtgattcaaataatacgagaaacatcaaatcacactgcggcaacaagagctcttgtcaatgaatttgatctatctgagaaacaagctgaagcgctgttggatatcacactaaagaagcttacttcccttgagcggaagaaatttgtggatgaagctaaaaccatgtcagaggaaatttctaagttaaatgagcttctgtcaagcaagaaacttatcttccagcttatacaacaagaagccgccgatttgaaaagcaagttttctacaccgaggcgttctgtgatagatgattcaataagcagtgaagttgatgacatcgatattatccctaacgaggaaatgcttttgaagattcttagtgagaaaggctatgctaagcgaatgaaccccaacacattcagtttacaacatcggggaaccataggaaagtctgttggaaagatgcgaatgaatgacagcacgtcagatttcattgtttgccagacacatgaccatgttctttatttcagtgacaagggaattgtatactcagcacgtgcttataagataccagaatgtactagaactgctactgggactccgttggtacagttgctacctttatctgatggagagcggataacctccatcattcctgtgagtgaatttggtgagaaccaatatctagtgatgctcaccgttaatggctatatcaagaaagtaccccttaatgccttttcatcaatcagatctactggtatcatatcaattcaactggttcctggtgatgagcttaagtgggtccgtcattgtggcaatgatgacctggttgcattggcttcacagaaaggaagggtaatagtcaactcatgtgataagcttcgtgcccttggaaggaataccaggggtgtctgtgccatgaagttaaaagagggcgatatgatggcagccatggacataattccagcaacggtgcacaaaatgcccgaaagatgcaacagcaggctcagagattcgagtcctccatggttgcttttcatgcccgaaggcggtattgggaaacgggtgcccttaaatgctttccggcaatcaaatttcaatgctgtaggcttgcaaggctacaagcttccagcagattgtcgtttggccgctgtatttgttgctggtctttcgctcaccgaagacggtgaaagtgacgagcaggttgttttggttagccagagtggcactgcaaacagaatcaaagttaaagatatatccgtccagtctcgacgctcgaggggagtgattctgatgaggctggagcatgccggaaagatccagtcagcatcactgatatccgcagcggcagcagaagtaactgaagattagtcttgcacccaagatgcaagtagtttagtctgaatttaatccctggcgtacgctgcagcatgaaatttgtctgctttcctgtggctagtaagcgtcaggaatcatgtaaaatcctacgccaaggagtagtcggtagctgatcatttggtggatcagaaactaaatactcactctaatcagaaaccaatgttgtcctaaagggggggcccggtaccctgggt

SEQ ID NO: 11876 - DNA, 1248 bp, Zea mays
ttttttttttttttttctaacagtccctaataaaatattttgggaagaattttttagggaatttttggagttgccgtaagtccctgatcatttccacgaaggcttttctcaccggaaaaagatcggaattccggcgggaatatagcccgccgtacctcgaccccgcccggggcggctacaaaaacgctccgttgcctttcctttccccacttccccggctcctgcctcccgccgccgacaccaccaaaaaccctagcagctccaccccgccgccgccgccgccgccatggatgaccctcggatgttcccatcaggatccgacgaccgctccgacgccgaacgccggctgtacaacccgtaccaggacctcaacatgccctacagctaccggacgctctacgacctccccacttcgccggagttcctcttccaggaggaggccctggcgcaacgacgctcgtggggtgagaacctcactttctatacgggcgtcgggtacctctccggcgccgttggcggcgccgtcctgggcctccgcgacgccgccaggggcgctgagcccggggagaccgccaagatccgcgccaaccgcgtgctcaacgcctgcggcagctctggccgccgcgtcgggaatacgctgggcgtcattggcctcatgtacgccgggatcgagagcgccatggtcgcggcccgtgaccgcgacgactggatgaacagcgtcgccgctgggcttggcacgggcacgctcttccgcgccgccaacgggccgcgatccgccgccgtcgcaggcgccctcggtgggatcctagccgccgccgccgcggggggcaagcagctagccaagagatacgtgaatgtcatatgatcgtgttttttttgtggtagcaatgatgagcgaacaatgatatcgtctagtgctctagtagggaaggggtttgccttttctgaaaactagctgagggcttgttcggttctaccccaatccatatggattgaggggtcaaaatcacctccaatccatatcaatcccctccaatccatatggattgaaaataaccgaacaagccctgaatgggaaattttgagcttgcattggaattgcaatgcaacatcgtgcttcaagatgctttagttctgctttgtccttatatgttaagggctagatgaaggtatttttatctccttgtttggatgcacatgtattgtcgtcaatccatttcatgttctcaatcaaaaaaaaaaaaaaaa

SEQ ID NO: 11877 - DNA, 2097 bp, Zea mays
gattgtattgtttgtagagtgtagtttgaatatgggtatgagtatggtaagctgctggaaatggtctaagagatatcatggaggagaggatggacaagactgaggaagcaatgacccaccataccacttgggttgctctatagtgcatcaatttggtttagataggagagaaaaaggaacacatttttaggtgtaagtgcaaggcctcaaggggataaaacaggaaaaatcatagaaaaagcggacttatactccatctatcccataaaataaggcatatattttattgaaaaagtctttataatggaactttgaccatttattcttttctaaaatatgacatcaacaaatacaaattgagcatcatattaaagtattcttgaataccaattaaagtatataacatgcatatactaaaaatatatgttttttttttctgaattgctggtaaaagttttaaaatgttgagttttctaaaaacatgcacgtcttattttatgagatggagggagtatataacaagtgcagaactatatacatgatggtggtcctgagcaacatacatgctaatttccacgtgcttatcctctaattgataagacactaataagccatgaaaactacattcgcttagtaataatttatcaaacgacaagcctgttttagggctcagcccaagaccagagtactgttgttactgggccgggggtagatggcaaacccgtaattacaagcaaaaggccagggcagaaaaagaggcgaggaaagcacacacaggctcagcacagcacagcctctgccactcaccccaatccaccggatccccacccccacctcgctaccccgaccgatgaaggcgtcgatcaagttccgcgacgacgagcggccgctggtgcgcgccaaggtgccgatcgtcgtgctggggctgccgttccagtcggggctcgcggcgggaagggacctgcgggagctccgcttcgacgtgtccacggcgttcgcatcgggcccggcgctccggctctcgtaccgccccaacgacccggcgctccccttcgcgctcgccgtgcgcgcggggctcggcccgctggggtccccggcacgcgcgcctttcgcgctcgccgccgagttcaacctcgtcgcccacgacccctcctcgtcgcccgccttcttcctccgcctcaagccgcggctcggcgacttctcgctctcccacacgctgcgctcccccgcggcggcgccagcgccacggaaggccggggagccgagctccgacggccggcgggaggtgaagcctctggactacatgccgccgttcacgttcaccgggagcgggctcgcggccgacgtggcggcggcggggaccggcagcggggtcggcacgctgctgtccggcatgcggctcacgaccaggagcgtgctcccgctgtggggccgggcgagcctgcggttcaactggggcctgcgcgtgccgccggagctgctcgccgccgacggcaagggcgcttgcgcgcccgtcagcaagatgccgctgctggtcatgagcaaggtctgcatcgagcagtccccgcgctccgtcacgggcaccaaggccggcggccgagcacctgcacccgccctggcctccacggacgcggcgtcggacggcgacgcggcgttctcgctggtgaggcggcagctggagtcgctgagcgtggacaacatgctgctccggcgcgccgtggaggacctccgcgcggaggtccgcagcagcaacagcagggccgcgccgcccgctgcttctgctgcgggggcccgtggcttgggcagggtggcggcgaccgcgccacaaatgcaggcgcagacgcagacgcagccttaccacgtgacgaagccggaccaccgcgcccggggcgccgcgagggaggctgcggccacgccggacgacgtcagcgaggagctgaagaaggcgttggaggcccgcctgcgctgagcagtcagccttggctgccaggctgcgtcgcgtgcgagcccggcagctcaccggcaccgctcgagtgaaggtgaagtgctagtgtcgctgttaggcgttgtaatctgttggtgtcagcagcaatttgg

SEQ ID NO: 11878 - DNA, 1420 bp, Zea mays
aatccaccggatccccacccacacctcgctaccccgaccgatgaaggcgtcgatcaagttccgcgacgacgagcggccgctggtgcgcgccaaggtgccgatcgtcgtgctggggctgccgttccagtcggggctcgcggcgggaagggacctgcgggagctccgcttcgacgtgtccacggcgttcgcatcgggcccggcgctccggctctcgtaccgccccaacgacccggcgctccccttcgcgctcgccgtgcgcgcggggctcggcccgctggggtccccggcacgcgcgcccttcgcgctcgccgccgagttcaacctcgtcgcccacgacccctcctcgtcgcccgccttcttcctccgcctcaagccgcggctcggcgacttctcgctctcccacacgctgcgctcccctgcggcggcgccagcgccacggaaggccggggagccgagctccgacggccggcgggaggtgaagcctctggactacatgccgccgttcacgttcaccgggagcgggctcgcggccgacgtggcggcggcggggaccggcagcggggtcggcacgctgctgtccggcatgcggctcacgaccaggagcgtgctcccgctgtggggccgggcgagcctgcggttcaactggggcctgcgcgtgccgccggagctgctcgccgccgacggcaagggcgcttgcgcgcccgtcagcaagatgccgctgctggtcatgagcaaggtttgcatcgagcagtccccgcgctccgtcacgggcaccaaggccggcggccgagcacctgcacccgccctggcctccacggacgcggcgtcggacggcgacgcggcgttctcgctggtgaggcggcagctggagtcgctgagcgtggacaacatgctgctccggcgcgccgtggaggacctccgcgcggaggtccgcagcagcaacagcagggccgcgccgcccgctgcttctgctgcggggcgtggcttgggcagggtggcggcgaccgcgccacaaatgcagacgcagacgcagccttaccacgtgacgaagccggaccaccgaccccggggcgccgcgagggaggctgcggccgcgccggacgacgtcggcgaggagctgaagaaggcgttggaggcccgcctgcgctgagcagccagccttggctgccaggccgcgtcgcgtgcgagcccggcagctcaccggcaccgctcgagtgaaggtgaagtgctagtgtcgctgttaggcgttgtaatctgttggtgtcagcagcaatttggagctgctgatttgatcgctgagaagaaggggatcggacttgtcttgccagaaggggatcggatttgtcttgccattccattctgtgctggatcaaggacttgatcaactaagaagcgcaaaagaaccaactttattacagct

SEQ ID NO: 11879 - DNA, 1572 bp, Zea mays
acaccaagagcaggctcacgccgcaacctagcctgcacgcactctcagtctctcactgaccgcgaccagcgctcagccttctgctccggaagctagctctccggccagccaccccaccccgtccacccgacaatggcggccgccgtggccctcctcctgctctccgccctcggcggagcggcggcgcaggtgttccctccgtggaacggcacgttcccgatggggcccgggttcggaggcgggagcagcggcggcggcgcgggcgcgggcgcggggaccggcgtgccggcgatgttcgtgttcggggactcgctgacggacaacggcaacaacaacgacctgaactcgctcgccaaggctaactacccgccctacggcatcgacttcgccggcggccctaccggccgcttctccaacggctacaccatggtcgacgagatcgctcagctgctgggcctgccgctgctgccgtcgcacacggacgcggcgtcgagcggcggcggcgacgcggcgctgcacggcgtgaactacgcgtcggcggcggcggggatcctggacaacacggggcagaacttcgtggggcgcatcccgttcaaccagcagatcaagaacttcgagcagacgctggagcagctgcggcgccggacgacgacgacgaggccgggcgcgggcgcgggcgggctggcgcggagcatcttctacgtgggcatgggcagcaacgactacctcaacaactacctcatgcccaactacaacacccgcaacgagtacaacggcgaccagtactccacgctgctggtgcgccagtacgccaggcagctcgacgcgctctacggcctgggcgcccgcaggttcgtcatcgccggggtgggctccatggcctgcatccccaacatgcgcgcgcggagccccgtcaacatgtgctcgcccgacgtcgacgacctcatcatccctttcaacaccaaggtcaaggccatggtgaccagcctcaacgccaaccgcccggacgccaagttcatctacgtcgacaactacgccatgatctcccagatcctaagcaacccgtggtcctacgggttcagcgtggccgaccgcggctgctgcggcatcgggaggaaccggggcatgatcacctgcctgcccttcctgcgcccgtgcctcaaccgcaactcctacatcttctgggacgccttccacccgacggagagggtcaacgtgctcctcggcagggccgccttcagtggcggcaacgacgtcgtctaccccatgaacatccagcagctcgccgcatggcagccgtgactcggtgcaaagctgtcgatcgatcgatgcgtcgttttgtagcactacttactgctatagcgtgtgtggtcatgagtaggagggagctgagcggagttatggtacggtgcgtatcagcgaccagtatcctgctgtttggggtcaatgtcaacatcgtgtctcttgtttttggttcatcagttagttatctatcaatgtttgttcgcttattacctgtactgcatcacggagatcagtggagtcatatatttccaaaaaaaaaaaaaaaaa

SEQ ID NO: 11880 - DNA, 4141 bp, Zea mays
  misc_feature (358)..(358): n is a, c, g, or t
  misc_feature (4141)..(4141): n is a, c, g, or t
gttgcctccctacttttactcatagccacacgaggtccactccaatattcgttcgtactccaggatgagacccgtgaccaggtcgtcaaaatcacatactactgttcttgctaagatgcccatagactccttttataatataaagataaaagatgcccattggggtaagggataatgacacggtgaagtggagtggaagacgactcggtgatttattcagtaaagggctaaaggcttactaaagggaaataatgtggaccattaagtcatggacaagttccttcaaagtagtaagcactagcaatgtgattaagtcgtaaagatatctttgagtcatcattgcttccacactaatatnattccactatctatttctaacttcattctatatatatagtgtaattttcgtacagcctaaggcacgacgaactgcactttgacacggcttccggatgaagagcatcttgacaaaagttaacaaacgcaacgcatgcttaccgtggattctcaaatctcatgtgggccgggaaacaagatggttctagttgtccttagcttttgttaattaatagatagacatgcagctttgtaaccagagatgccaagtgcatgctacataacgcattatacagtttccagaaagagcctagaagcgcgatgatacacatgtgactttcaccttttttttgtttttgttgcttgcgaacgaacgatgctgtcggcgcacacgttaacggtggggaagccggttggatcttagcacatgtacatagaaaaaaaaaattgtaggcagaacttatgtacagtaaagctcgtagagcaccggctattgcagcattcccgttggccataacgataaatccaccaaatattaaacatgtgaacatgggcgacagatctgacctgtggattcgttattactgtatcgaacctacttggtaataaagtatacatacagcgcagtacgcagttcgctcttaactttgactctgatgagcatcattttttaatcgtgtctgataaaaaaatgctggtttacgcaaatggtagggtaaccgatttcacacagacaacaaattaaaccaccgtactggtctggtagacaattattctttctttcctgcctgtggtttggtcctctagctttcacaaacgcacaaacggtcccatcagttcacatcatctaaaaccaaagtggaactgtatacaggacaggaatacagtgtccacatctggacccgtctgcggtttttgccttgtgccgtgcgcgagcatcagagatagtttatgcgctagtgagtgcgtgtcatcaatctagttaaaaccacaaggagcggaaccagaattaataaaggtaccacaccaacctctcccccacctactcttacgcttgcgctgccaagctctccgaggtccaacaatggctgcgctgctctatctccatccctatctcgcggttcttccacttctgatctccccgatctgctctggcgcttcgccatggcgaaccatgaccaccggctcgcacatgagaggagaggaccacgacaaggtcaccctcctctcgcccgacgctaccttctcctgcggcttccacgaggtgggcacgaacgccctcaccttctccatctggtacacccccagcgccagcgccagcgccaccgagaggaccgtcgtctggacggcgaacccctactccgcagagcgaggccagcactctccggtgaacaagtacggctccagactgtcgctgaaccgcgacggcaacctggtcctcacggacaccaacgggtccacggtgtgggagaccaagacgtcgtcgggcaggcacacgacggccgccctcctcgacagcggcaacctcgtgatccgcgactccagcagcggcagcaacaaggtcgtgtggcagagcttccgctcgccgaccgacaccctgctccccgggcaggagctgaccaaggacacgaggttagtctccggctaccaccacctctacttcgacaacgacaacgtcctgaggatgctctacgacggcccggagatcaccagcatctactggccgagccccgactacaacgccctcaagaacggccgcaacaggttcaacagcaccagggtagcggtcctggacgacctgggtactttcgtatccagcgacgggttcaggatagaggcttcggattctggtccaggggtcaagaggaggatcacgattggctacgacggcaacttcaggatgtacagcttgaacgcgtcgacgggggcgtggcgcgtcacggggcaggctgtcatacagatgtgctatgtgcatggactgtgtgggaggaacgggctctgcgactacctgggtggcctcagatgcagatgccccccggactacgagatggtcgatccgacgaactggaacagaggatgcaagcccatgttcttgacgaccgacgacggaaaggagttcaccttcgttgagcagcctcacgctgactactacggcttcgacctgtcctccaacgagtccgtcccgttcgaagcctgccgggacatgtgcttgaacagcagcgcctgcttgtcgttcacgtacaagggcggggatggctggtgctacactaaaggcctactctacaacggccaggtgttcccgtacttccctggagacagctacatgaaggtaccaaagagtttcaacagctcggcggcctactcatcgatctccaaccagaaagaagccctcacctgtgggccggcgggttctgctgagctgatgctgggaccggcgagcatgtacggaacaaagaaggacaacatcaactggacatacctgtacgtcttcgctgcagtgctgggagctctggagatgcttgtcatcgcgacaggctggtacctgttcttcaacaagcacagcatacccaaatcgatggaggacgggtacaagctggtcacaaacccgttcaggcggttcacgtaccgtgagctggcggaagccactgggaagttcaaagaagagctcgggagaggaggcgccggggtcgtctacaggggagtgcttgaggacaagaaggtagtggcggtgaagaagcttacggatgttcgtcagggagaggaggagttctgggcagaagtgaccctgattggaaggatcaaccacataaacctggtcaggatgtgggggttctgctcggaggggaccaagaggctgttggtgtacgagtacgtggagaatgagtcgctggacaagtacctctttggcgagagaagcgccgaaagcctgcttggctggagccagagatacaagatcgcactgggcacggcgagaggcctcgcctacctacaccatgagtgcctcgagtgggtcgtccactgtgacgtgaagccggagaacatacttctgacccgggatttcgatgccaagatagcagactttgggctggccaagctcgcgaagcaagggagcactagtctgaacttcacccatatgagaggcaccatgggctacatggcgccggaatgggcgctcaactcgccgatcagcgcgaaggttgatgtgtacagctacggggtcgtgcttctggagatcgtgactgggatcagggcttcgagtggcatagtgctagatgagaggcagatagactttcggcagtttgtacaggaggctaagcatatcctgtctactgggagtgtcagtgatatcgttgatgatagattgcaaggccattttcacgcggaccaagcggttgcgatggtcaaaatagccttttcatgcctcgaggaaagacgcaagaggccaacgatggatgagattgtcaaggtgctcatgtcgtgtggtgatgacgatgactaccatcctgcttattcatattgacttgcaacagatgtgaaggtttcccaaaagaaaacagatgcaaagatttgagaggcagaggcaagtgtacctttgatcaatgatagaagctgaactgaactgactgatgaaatatattcgaaagcgtgccaaattgtgatatttgtgtagagtatgttggggtatctccatatctggtagattaaaattgagtaatgttgttttgctctatttctaagggaggtgtcttgccctataagtggaatactataatattctctccgttccaaaaaaaaaaaaaaaaan

SEQ ID NO: 11881 - DNA, 2198 bp, Zea mays
aattcggcacgaggcagacgcacgcaaagtcgcaaacacaccacacgccctcacaactcccatccatccgcttcttcgactccacatcgggagccgcaagcagaaccaatgacgacgacgacgaagcagctccggcgcgtgcgcacgctcggccgcggcgcgtcgggcgccgtggtgtggctgggctccgacgaggcctcgggcgagctggtggcggtcaagtcggcgcgcgccgccggggccgcggcgcagctgcagcgcgagggccgcgtcctccggggcctctcgtcgccgcacatcgtgccctgcctcggctcccgcgccgcggcgggcggcgagtaccagctcctgctggagttcgcgccgggcgggtcgctcgccgacgaggccgccaggagcggcgggggccgcctcgcggagcgcgccatcggcgcctacgccggggacgtggcgcgcgggctggcgtacctccacggccggtcgctcgtgcacggggacgtcaaggcccggaacgtggtcatcggcggcgacgggcgcgccaggctgaccgacttcgggtgcgcgaggccggccggcgggtcgacgcgccccgtcgggggcaccccggcgttcatggcgcccgaggtggcgcgcggccaggagcagggccccgccgccgacgtctgggcgctcgggtgcatggtcgtcgagctggccacgggccgcgcgccctggagcgacgtggagggcgacgacctcctcgccgcgctccaccggatcgggtacacggacgacgtgccggaggtgcccgcgtggctgtcgcccgaggccaaggacttcctggccggctgcttcgagcgccgcgccgccgcccggcccacggccgcgcagctcgcggcgcacccgttcgtcgtcgcctccgccgccgccgccgccgccatccgcggcccggcgaagcaggaggtggtcccgtcacccaagagcacgctgcacgacgcgttctgggactcggacgccgaggacgaagcggacgagatgtcgacgggcgcggcggccgagaggatcggggcattggcgtgcgccgcctccgcgctgcctgactgggacaccgaggaaggctggatcgacctccaggacgaccactcggccggaactgccgacgcaccgccggcgcccgtcgcggactacttcatcagctgggcggagccgtcagacgcagagctggaaccattcgtcgccgtcgccgccgccgcaggtctcccgcacgttgcaggagtggcattagctggcgccaccgccgttaacctgcagggcagttattattattacccgcctatgcatctaggcgtccgcggaaacgagattccacgcccgttgttggatcatcatggcgacgggttagaaaaggggcagggatcccaccgcgtttgtaacagagaaacagaaaaggtaacaatgaaacgaatttcgttaaaaagaagagctgctttccttctcgaccagcatcacgtgcgatcgctggacaaactggaatatcgtccacgtcacgaccgaatgctgcgtcgacggcaatctatatatcggagcaatagcgtccttggttacgacgttagcaaaggtaggcaggtccgttggcgccgtgcggtttgcattgccgttgctgcctgatcgaatgctatgctatcgcgacatgctcgtgctccgctgctcgctccaggctgcattgcattgcatgtctggagtggacatcactggatcgactaggatgtcaacgccgagatcctcgatcttcggtggggagatccgatgcgttgcagcagccttcccctttttcgtgacggacggatggccacctcgccgtcgccggcccctgatgcctcacgcgcgatgtgatgtgacgctgagacgagagacacagcacacatgatatcagcgcctcctttgatatatatacggagtggtttgttaggctgccacgtcgagacgagcgtggttttccttcgcttggatagctggatctcctctgctttaaatcactggcacgttctgtccggctcagttcgattaatatctattccgtagtccccgtttccctaatttatggcccgttaggcaggctgaactgagccgtccggggaacgtacgtacgtacgttcggcgtgacggatctggcacatgcgttcggttacgcaaattgggcatgtgcgcacatttcgtgc

SEQ ID NO: 11882 - DNA, 1663 bp, Zea mays
gttcgccgccgcacggtgcgacggctctgtttcgtttcctcgtactttaggccagtgctactaggttgcccgaggaacaatgtagtgtggaaatttctaatatattccaaattgtgcgggcccgcccgggccggggacagcccggtacgtacgtgcaagagacgagcgtagtaactgtgagcagctagcacatgcatggcgtcgtcgcagctggtcgtcgtgtgcctgtttgtagcgtcggcggtgactgtgacgatgaacggtggcgcgcaggcgcagccgattgtgccggcgatcatctcattcggcgactccaccgtcgacgtcggcaacaataactacctgccgggcgcggtgttcaaggccgactacgcgccgtacgggcagggcttcgcgcggcacaaggccaccggccgattctccgacggcaagatcgtcaccgacatcaccgccgaaacgctcggcttcgagagctacgcgccgccgtacctcagcccgcaggcgtcggggaagaacctgctcaccggcgccaacttcgcctccgcggcgtccagctactacgacgacacggcggccatgtatgacgcgatcacgctgacccagcagctcaagtactacaaggagtaccagtcgaagctggcggcggtggccgggcgcgctagggctcgcgccatccttggcgacgcgctctacgttgtcagcacgggcaccggcgacttcctccagaactactaccacaacgcctccctgtcccgccgctacgacgtcgaccagtacaccgacctcctcgtcggcatcttctccggcttcgccaacgagctgtacaggttgggggcgcggcggatcggcgtcacgtccatgccgccgctgggctgcctgccggcgtccatcaggctgtacggcgacggcaagggagcgtgcgtgccgaggctcaaccgcgacgccgagaccttcaacgccaagctgaacgccaccgtcagggcgctcaagcggcggcacgccgacctcaagctcgccatcctcgacatctacacgcccctccgcaaactcgcacaagaccccgcggcttacggcttcgccgacgctagagggacgtgctgccggacggggacggccaagacgagggtgtacctctgcaacccgacgacggccgggacgtgccggaacgccagcagctacgtgttcttcgacgccgtccacccgtctgaggctgccaacgtcttcatcgcggagtccacggtcgacgcgggcatcgagctggtcacctagctagtaggaataaaggagacgacacacatctgcagatctgctcacatgtttccggctccatcgaaacagaactacgtacagtgtctggaatattaatatatagccagtgaaattaaaaattgcaccgtcggccctgcccttttcgcaatgttgtggagcagtttcctgttccatctgtagccgctcaccagtttcctgttccatccaagaaaacaacagtacaccttgaattgcctgtgaaattgcaccatctatctccctaccattattgtaatatcgttgatcatatactatgcgtacgtacgttttcctatatatgcataatataaggtgttcggtttccagggactaaaaaaaaaaaaaaaaaaaaaaaactcgagaaaggcgcggtacc

SEQ ID NO: 11883 - DNA, 1636 bp, Zea mays
acaccagagccccactcctgtggctgtactccacacaagccgtaaacgcaatttcgcacacgaagtcccaaaccccgccggccgccgcgtcccttccccttccccttcctctctcggaccccaatggcgtcgtcgtcgaaggcgccgtcatcgcgccgttccgtcttcgacgccgcccacatccgctcggagttttccgcggccggcatctccgcccacttcatccctctcatctggaagtacgtacttcaaaaccctaggtgcagcgacctggatggcgttccgtcgctgccggcggccgcgtacgcgctcctccggcagaagttccggccgaccacttcgacgctaaccgctgccgcggactccaaggaccgcaccacgaccaagcttctcatctgcctgcagaatggggagtctgtagaagcagtggtcatgcgatatgacacacggctggggaagtatgatggaaagcctcggcctggtggagtgcggtcaaccctctgtgtgtcatcacaggttgggtgcaagatgggctgcagattctgtgctactggaacaatgggcttcaaaagcaatctgtcttctggagaaattgtagagcagctggtccatgcatctcgctattctcagatccgaaatgttgttttcatgggaatgggggagccgatgaacaactataatgctttggttgaagcaatcggagtgtttactggatctccttttcagctttcacctaagagaattactgtatctactgtcggaatcattcatggaatcaacaaattcaatggtgaccttccaaaggtgaatttagcagtgtcattgcatgctcctgaccaagacattcgctgtcagataatgcctgctgcacgtgcctttcctttaggaaagctaatgaatgccctgcagtcctatcaaaatgagagcaagcagaccatcttcattgagtatattatgcttgatggagttaacgatcaggaggagcatgcacatcagcttggtaaactgcttgaaacgtttaaagcggttgtaaatctaataccattcaatccaattgggtcatcaagcaatttcaagacaagcagtgaccaaaatgtgaagaacttccaaaaggtcttaaaaggcatctaccgcatcagaactactattcgccagcagatgggtcaggacatagctggcgcttgtggccagttggtggttagcctcccagatgaaagatcagctggtggagcaactcttttgtcagacatcgaagaccttcggatctgacctctctcccaattgttaattctaccattttctcaagatcagatcctcttactaattagcctcacatgatatggtaactggcgctatagtttcaagtcaagctttaaaacatggagatgtttagtttgaccattgttgtgttccccttttgttctgggatacacaattttgctgtacacaatggtgaagacccctgcagttctgctcttgtggataggtggccactgaaacggttggtaacttggtattgtaaatgggacaaccggacaatgttatctcaacaatgccatggtgaaacaaaaaaaaaaaaaaaagatgactttcctgtcagatctcaatgagtatctgatgctcccccctcctatct

SEQ ID NO: 11884 - DNA, 1502 bp, Zea mays
aagggcgaggaaaactgaaagcctacgaaaatggtggagctcacctccttatccccagggccaccacgtccttctccgtttactcctcggcgccggccgccgccgacaccacatgtccgtacctcctcgcgtcgtcgcgggaggatcctcggcgccgcgaccgccacgcctggcgccgacgactaccactccaccatccgctccctcaactcccgcggccgccacgtcccccgaaaatccctcgggcagaactacacgctcaactccaaggtgaacgaggagctggtggcggcggcgggggtggaggacggtgacgtcgtgctcgagatcggcccaggcaccggctcgctcacttccgcgctgctccaggccggcgctaccgtatttgccgtcgagaaggacaagcatatggctactcttgttaaagataggtttggatctacagaacagttgaaggtcattgaagaagacatcacaaaatttcacatccgttcccattttcttcctttcatgaaggagaaatacggtgccaccaaaaaacttgcaaaggttgcatcaaacttaccattcaatgtcagcaccgaagttgtcaaactactactcccaatgggggatgttttctctgtcgtggtgcttatgcttcaggatgaaacagcagtacgccttgcagatgcttcaatacaaagtccagagtaccgatctatcaatgtgtttgtggatttttactcggaacctgaatacaagttcagagtagacagagagaattttttccctcggcctaaggttgatggtgctgttatcagcttcaaactaaagaatgcggaggagtatccgccagttagttccccaaaaagcttcttttcaatggtgaattccgctttcatggggaagcgcaagatgcttaggaaatctcttcagcacatatgctcttcttctgacattgaggctgctcttgacaacattggccttccagttacagctagaccttctgatctgattttggatgatttcgtgagattgcacaatcatttagcgaaagtatgactaagaagtgcctttcaaaatgcctaaggaattgcttgttggcatggtgttcaacagttggagtaacttacgcctgaccgcctgagagttgctatgcagctacaggtgccttcagctcagctccggggcgaagccaggaattacatgtagggaagccggccgaaagagccatcttgtaaaaaatgatcgcggttcaactggtttggttactcgcacttatcgtctgtctgagttaatacttgacaaaaaaaaaaacacagctcaactggttaggtttctcgtagtggtggtggtcgttcggggtttattatagatagtgagggtttattgtattttgatcgtagacgctaatcataaactgtaatgaatggacgccttcgttctctctgagtacaaaggccccattgaaatatgtatgagaaacaaagcaaatttagagggcaaaaaaaaaaaaaaaa

SEQ ID NO: 11885 - DNA, 962 bp, Zea mays
ctcgaggccggccggggaaggatccacaaattatcgaccatctccgctattttggacctactccggtggagtccacctccactcctccagcgagtcaccactggccaccgccaccccggccccgccccgctccgtgtcacgttgtcatccgtccacattgcacccgctcctctccgtctccccaacagtttcattcttcgagggggatcgcttgtcggcggggaagcaaagcttagttcttgacgcccaacctccccgttgcctattcgcctcaggaatttgggaattatgtctctttgaggggaatcaagggacttgcttttacttgtctgggctccatgtctaagtgggagccagtcacgtttcaggaatctcttagctttgttaagaaagtaaaggcacgtgactacatgctatacatatcattgctcgatgtgctcaaccggaatgatcaaatccctctgcaagcttacagcgagctctcgcttctgtttcagcatcacgaagatctgttagcggagctgtcgaagttcaggcccctcccatgcccaaacaacgtttatacacacggctcgatttggatgatcatattcctcatgccttttctgctcctgagccttgtcctcgccttgagaagccattgaagtgtttcctgctccatagactgttgcgagcctaaatgatttgtcgtagcactaacacctagttgttgtatatagatatatggatggggttctatatcctgtaatttctttatgatctccttgtacgctcgtgcgcacggaaataatcgtacaatattatttcagtcgcggcagtctggcagtatgtaaagcctaaacagagatcgtttgacctcgtccaatcggaaattcagctttgtacagagaaaaaaaaaaaaaaaataggccccttacagtttaaacaggtatgaaccaaaaaaaaaaaaaaaaagcggccct

SEQ ID NO: 11886 - DNA, 2716 bp, Zea mays
ctgcagcagtctccgcgaccgaagaaaccaccagccacgccgctgtcttgtctcggcgactctggtggataggtaacccccacccccacccccacccagtagcgtgcagctcctctggtcactcgagactggaccaagataccaagttgagtgaaacacgtgcacctgctctggtcaggtttctgcgaaactggccaagcaacttgttgcagttgcagctcatctttccgtcagttttggccttttggcttctatatatcatataataccggctaccgatgccattgccacgcatgcatagctgatgatggtcggactctgagctcctctccgtgccaagtttctctgcacccatcgcttcagctcaccggttctcccccctgcactgcgctggctgtatggctcctcccttcgcgtgcgccatgcacggccgcgccctgctagcagcagcagcagcagcgctgctcgcgtcggccgtcacgctcacgcttctcccctccgccgccgcgcagccgtgggtgggcccgtggccgacgtgcgacgacaccaccggcaactactcggccggcagcgcctacgccaaaaacatcaagcagctcatcctcagcctccaggcaaacgcgtccaacacgcccgccctcttcgcgacgggctccgccggcgcgggcgccgacgccgtgtacgggctcatactctgccgcggcgacctcagccccaccgactgcttcgactgcggcaccaacgccggccaggacgtgtaccgggtctgcaacggcacccgggacgccgcgctcgtctacaaccagtgctacgtccgcctcgcccccacggacttcctcgccaccaccaacaacaccggcatgagagacctcatcaacggcaacagcgtccccgcgggcgtcgacgtggcggcctacgacggcgccatcaccaggctgctcaacgccaccgcgcgctacgcggtggacagctccgccccgtccttgtctcccaggaagtacttcgccacgggccagatggcgggggtcgacccgcggttcccgaccggcatctggtccatggcgcagtgcgcgggggacatatcgccggtgcagtgccggagctgcctggacgacttgctggcgcagtggtggcagaagttcgacagcaaggagatcggcgcgaggctcgacggttcgcgatgcaacctcaggttcgaaacggggaacttctacaccggcagcccgatggtgaagctgcagatgaacggcgaggaggccgctccagctccggtgccttccacggatgttctacctggcaccacaggaggtaagaaaaattcagttggcaaacttctcggaattatattgccgatagtatttgttgctgcaatagctgccatagccctctgcatttggattgttcgtaagaagagaacataccaaggaacaaatcttccccaaacagacacaacttatatggccgaggacatcgaaagcatcaagtcgatattgttatcgttgccatcactacaagcagcaacaaataattttgatgaaagcaataaactaggcgaagggggatttggaacagtttacaagggcaatctttctggacaagaagtggctgtgaagaggctaccaaagggtttagatcaggggctagaggaactaaaaaatgagctaggtttgatggcaaaacttcatcacagaaatcttgttcgactggagggtttctgcttagaagagggagagaggttgctcgtctatgagtacatgcccaacaaaagccttgacaatattctttttgatcatgagaagaaaagacaactagattggaggaaacgattcaacataattgaaggagttgcacgtggattgcaatatcttcatgaagactctcaaaataagatagttcaccgtgacctaaaagcaagcaatattctgttggattcaaatatgaaccctaagattggtgactttggcctagccaggctctttttgcaagatcagactcgaggcatcacaaaccacatcgttgggacattcggctacatgtctcccgagtatgtgatgcgtggacaatactccataaaatcagatgtatttagtttcggcatccttgttatagagattgtaacaggacaaaagaacaatgggcattacttcgacgagcaaaacgaggatgttgtgagcattgtatggaagcactggagcgagggaacacttgcagagattatagatgattctttagggagaaactactcagagactgaggtgctaaaatgtgttaacattggcttgtggtgccttcaacagaatccaatggaccgacctacaatgtcagatgtcatggtgatgctcaatgatgatgatactagttctctacctgctgctgcaaaaccaacttttttcttggatgcaagctcaggctactcttacacctcgggcaccatttcacatccttctgcaaggtagtgtaggctaaggcctaatgcacacctttatatgaatatcgacatattgttgcttgtttgtttcttattgtgtattggttgaaataaacatggaattcatcctgaattgtaatagcttgtgctcattattagtttcttaccaaatcctcaaatataaattttctcttcctatatgtccaaaaaaaaaacagaaagtatggaaatgcttccaaaaaaaaaaaaaaaaaactcgagactagttctctctctctctctcctggt

SEQ ID NO: 11887 - DNA, 2586 bp, Zea mays
cccctgcaatggtgcacaatcagttctatataaggaatctatggcagcatctatcctatgtgaaaaaatctgggagaaggtgattttgaattgaactagaggaatctgtagatttttaggaatctattctattgtggtacgcttttgatcgagattcccgatttttagtagcgatactagtttagaaagttgaaccaaacacacccttaatatgtttctaaaattatttttgatttaataaaatatgagcatatacctatgttaaatctaacatcaattagacaaaaccagtgttcagctccatatgtagtatgtgtgtatatggggcaatagaacaacctttcactcttggtggtaggcaattggtaatgcccctcgcctttctcttcagccatgtcggcccaactgccaccaactgttagcagaacggggaggacctgagctgagctgtgtgacagagcgaaaaaagaaagaaaaaaaaggtcaataccaacgttgcttaatcgaaaaacgcacgttctgcatgtgcgtattccctggtctgcccacgttatttttatatatataggcaagccgcctcagtcttctgccgcgccgcgcggcacaaacgtccccacacatttcccctaccatctccctcttcttccacgagctaattctagacagaacacaagcgcccgccatcgccatggaagcaacagcagactcgttgccgtgggcggcgcagtgcgcgggcgcggcactgttcgccgccgccctctgcgtgacggctctgggcgtcgtgctggtgttcctccggcggtggccctggtgcagctgccacgtgtgccgggcgtacctgacggggtcgtgggcgcgggacttcaccaacctcggcgactggtacgcgcacctgctccgggagtcgcccacgggcaccatccacgtgcacgtgctcggctgcaccgtcaccgccaacccggccaacgtcgagtacatgctgaggaccaacttcgacaacttccccaaggggaaggccttcgcggcgctgctcggggacctcctcggcggcggcatcttcaacgtggacggccacgcctggcgccaccagcgcaagatggccagcctcgagctcggcagcgtcgccgtccggtcctacgcgttcgggatcgtggcgcaggaggtggagtcccgcctcgtgccggtgctcgccgccgccgccgacgccggcgcggtcgtggacctgcaggacgtgttccggcgcttcgcgttcgacaccatctgcaagatctccttcggcctggaccccggatgcctggagcgggagatgcccgtgtcgaggctcgccgacgcgttcgacgtcgccacgcggctgtgcgccatgcgcggcgccgcggcgtcgccgctagtgtggagggccaagcgcctgctgaacgtcgggtccgagagggagctccgggaggccatcgcgctcgtcgacgagctcgcggccgccgtgatccgggagcgccggaagctgggagtcgccggcagccacgacctcctgtcccgcttcatggcctcggccggcgccggcgacggcgacgacaagtacctccgcgacatcgtcgtgagcttcctgctggccgggcgcgacaccgtgtcctccgcgctgaccacgctgttcatgctcctgtccaagaacccgggcgtggcggccgccatgcgcgcggaggccggcgacggcgagtccgccgcgccgctcacctacgagcacctcaagggcctgcactacacccacgcggtgctgtacgagaacatgcggctgttcccgccggtgcagttcgactccaagttctgcgcggggcccgacgtgctccccgacggcacctacgtggccggcggcacgcgcgtgacgtaccacccctacgcaatgggccggatgccgcgcatctggggcgccgaccacggcgccttccgccccgaccggtggctcaccggagccggcgcctcgttcgtcccagagagcctgtataggtacccggtgttccaggcgggcctccgcgtctgcctcggcaaggagctcgccgtcaccgagatgaaggtggtcgctgtggccgtggtgagggcgttcgacgtcgaggtggtcggggacagtggcgccaccgcctgcgcgcccaagttcgtgtcggggctcaccgcgtccatcagcggcgggcttccggtgagggtcaggaggagagttgttcgatagagattcttgggctggcggtggcgggtggtgtgtgtgtgtttttccagaaaaaaaaagatagaaagagactagagatagatggtattagaaagctccatgactgtgcataaactgattgaaagaagagggaatggaatagcaaagttgaatcaaaaagctccatgactccatgtccatggccatgcatggtctatttgatgcatgtgctcttgcttctctttttgatgctgcaacagaaagcaaactctgaaatctacactgttctgaccaccgtttgatgtctccactggcgtggtagctaacagttgttttcgtggattgtcagcactagcacctgtccaagtagaagtgttcggcataggagcaattgtgca

SEQ ID NO: 11888 - DNA, 1800 bp, Zea mays
atcaccccctaccagtttcaattttcaaaagggcgtggaggcgccgcaccaccgccgccgccaccactgacgagggaggaaacgccacctccccgagccagtccgatgttgtccgaccaggagctggcccagtacgtggagtccctcgtccagcacaccgctgcgcagggtggcaccgggatatcggcggatgccgtggtgcgccagctcggggcgcagctcggcgttgacctctcccccaaggcgcagctcatccgcagcgtcctcgtcgcgctcctcggccccgcggccgcgccggcgccggaccccgcgggttcgcgtaaggatcccttcgaccccgcaaccgctgccgccgccggcgggccccgcgccgagactcctccacagcagatgcacttctctaccgccgccgcgtcgtcggcccccgccccttctccagccgttccccacttcttcccgcagcagcaccagcaccagatgcagtacttcctgtccgccccgcagcagtatcagcaccagcagcagcagcaacgcgccggcgcgtccccttcgccgtttgacatccccgcgtcgtaccgctacgggcaccagcccttgccgcaggccgaccaggcgcagctgcagaggctcgtccagctacagcaccagcagcagcaactggccgccgcggcgagagttgcagctgcagcggcaccgactccgggggagagtccccgtgcgccggagccgccaccggcgccggcgccggcagcctccaagaagaacagcagtgctagtgttggagcaaaacgaaaaggtggtcctggagggttaaacaaagtctgtggtgtgtctccagagctgcaagctatcgttggtgaaccagccatggctagaactgagattgttaagcagctttgggcatacattcgcaggaacaatttgcaggatcctaacaataagagaaagattatatgcaatgatgagctccgattagtttttgagactgatagcacggacatgttccagatgaataagcttctgtccaagcatatacgtcctctggagagtaaaaatgattcgaaaccagaagcaaagaaattgaagccacagggtgatgaaccaatttcttcagttgaaactgatgttaaccaacttccccttatggtttctgatgcgcttgctaccttttttggtaccggagaaagagaaatggtccattctgaggctgttaagcgtgtctgggatcacattaaaagcaatgatttagaggatccagagaatcctacggtgatactgtgtgactcgaagcttaaacaactctttggacgtgaaagtcttaccgctcatggtgtctcggagttgctttcagaccacctttacacgcaatctaccaatatctgactggcgatacgattttctggactcggctgggctaacatcctgggtagtaggcgctgatgaaaggacaagggatctgctcaaattaagtgttgtatttgtatcctccatattggtgaagactgatttacagtagtaagggaaaaggaaatggcagttgtgttgcatactatctagtcagacatagtagtctacgtgacttggaatgatgcggcgttaaactaaaaaggacagcgagagctgatgtaaattcggcagccgtataccgtaggcgcgtgcgttttctggtaagactctcttgcattgctagtgccctaagttgactcgagacatctgtacctcgaaatgttgctgtgttaggtgatacctaaccttaatacagtttagatcgttatccttaataaaaaaaaaaaaaaaaaa

SEQ ID NO: 11889 - DNA, 3914 bp, Zea mays
ggtcaatcctccccctacccacaccaacgcgcacacggaccgggagccgcagcggaaaccacaaaaccagcgtgaaggcgcccgaaccaccgcgagccccgcccaccactccacgaaacccaaacgcacctccgcagcgagggatatcccccatcaccccctaccagtttcaattttcaaaagggcgtggaggcgccgcaccaccgccgccgccaccactgacgagggaggaaacgccacctccccgagccagtccgatgttgtccgaccaggagctggcccagtacgtggagtccctcgtccagcacaccgctgcgcagggtggcaccgggatatcggcggatgccgtggtgcgccagctcggggcgcagctcggcgttgacctctcccccaaggcgcagctcatccgcagcgtcctcgtcgcgctcctcggccccgcggccgcgccggcgccggaccccgcgggttcgcgtaaggatcccttcgaccccgcaaccgctgccgccgccggcgggccccgcgccgagactcctccacagcagatgcacttctctaccgccgccgcgtcgtcggcccccgccccttctccagccgttccccacttcttcccgcagcagcaccagcaccagatgcagtacttcctgtccgccccgcagcagtatcagcaccagcagcagcagcaacgcgccggcgcgtccccttcgccgtttgacatccccgcgtcgtaccgctacgggcaccagcccttgccgcaggccgaccaggcgcagctgcagaggctcgtccagctacagcaccagcagcagcaactggccgccgcggcgagagttgcagctgcagcggcaccgactccgggggagagtccccgtgcgccggagccgccaccggcgccggcgccggcagcctccaagaagaacagcagtgctagtgttggagcaaaacgaaaaggtggtcctggagggttaaacaaagtctgtggtgtgtctccagagctgcaagctatcgttggtgaaccagccatggctagaactgagattgttaagcagctttgggcatacattcgcaggaacaatttgcaggatcctaacaataagagaaagattatatgcaatgatgagctccgattagtttttgagactgatagcacggacatgttccagatgaataagcttctgtccaagcatatacgtcctctggagagtaaaaatgattcgaaaccagaagcaaagaaattgaagccacagggtgatgaaccaatttcttcagttgaaactgatgttaaccaacttccccttatggtttctgatgcgcttgctaccttttttggtaccggagaaagagaaatggtccattctgaggctgttaagcgtgtctgggatcacattaaaagcaatgatttagaggatccagagaatcctacggtgatactgtgtgactcgaagcttaaacaactctttggacgtgaaagtcttaccgctcatggtgtctcggagttgctttcagaccacctttacacgcaatctaccaatatctgactgatgcgactgtttggcttgttggctgcaggcgatacgattttctggactcggctgggctaacatcctgggtagtaggcgctgatgaaaggacaagggatctgctcaaattaagtgttgtatttgtatcctccatattggtgaagactgatttacagtagtaagggaaaaggaaatggcagttgtgttgcatactatctagtcagacatagtagtctacgtgacttggaatgatgcggcgttaaactaaaaaggacagcgagagctgatgtaaattcggcagccgtataccgtaggcgcgtgcgttttctggtaagactctcttgcattgctagtgccctaagttgactcgagacatctgtacctcgaaatgttgctgtgttaggtgatacctaaccttaatacagtttagatcgttatccttaattctctcatccttttcctgaacccctgcatgtatcatcattgtgtgtgcatcgtatgcggcagcagctgtttacgaaaggaacagctagctactgcttttttctgttcctgcatgatgcaggccgtttacaagatcctgcctactgtacaaggctagatacttgctccttgccctcctggtggtgctgctggtggcgacggcgacgacgaagctacaagttcttgagcaatgcgtagaacagcagcatgacgaggaggccgatgacggcgcagaaaaccatcgtgctcctctgcttctcgtcgagggtgccttctggcagcaccttgtgcacgacggccaggactaccgcgtccaggttctgcagtcgcaaaagataaaggaatctcaaactgttttagaccttgtttcgctatctgtttgccattgatcgcatcgtgtgcttgcttgcctgctgcatgatcccaagaatcctctggagcagcggcacgcaggtcttgttcacttggctgcgtgcggtgcgacggcgacggggagacaaggcggttatttagccggtcgttcttttgctgcacgtgcaagcatgcgaaagcagctagcagaaggtacctgatgagcaggaggccgcggtagacgtgggtggtggagacgttgcagtcgaggtcccagggcagcttcttccccgtccacccgccagagcaaatggttcagggccatgctgaaaaaaaaccccacggactgactgaccaagcaagagcaacaaagtgctgtttcgaccgacctagagaccacttgacgcccaggtcgaagcctgcctcgtcgtccggcgacggcttgagcacgaacgacacgtggtgccggaccatcagcgcgtggaggagcaggaacatgtcctgcagcaacaacaacaacaagctagtagggccttgttagatacgatttggctgtctctcctctcctaggatgcatgattagtgaacgctcgttaataggatctcagctcgtcgtcggtttcaccttgcccagccgcggaacgtcgacggaccggaggttcccgaggaagtagaggcactcgtcgccgagcagctccagcagctccctgacgctccggttctggatggccgagttgagcttcaccatcctcatcacggcccggagcctgtctcctcctccgccgccgccgaacagccctcgggcgcggaacttcgtgccggcgtcggcgcgtccttctcgcgccgccggcggcatcctgccatgtctcgggacggttttgggtcggcggtgcggaggaagacagtgcggctgccggtgacggcgacgaagcgacgactgggaggggaggaggaggaagacgcggcagcagcagggtggagtccatggagccggaccgggtccgcaggaggtgcgaaaaggacgtgccgccgccgccggcgtcttatacgtcgccgaggagtcggtctttgcaggcgatccgtgcatgaccggctcgcaagcaaaggattggattgcattgcatgcgagggaaagggaagaatagaaggagatgatgcatgctctgccgtgcaagagcgcaagctaggctgaggaattgggccggtttgccaagcaaagcaaggaaatgatgctcttccaaacttgggttagggtccatgcatgcccccataatctatagggtacctacgtcaagcttgtattcgcggagtattttgtgtgagcacgacagaatgacttaaaaaaaatcatgttcaaatgttaaccatccggctccccaaatctctcggagggaaccgtggagccattccatcccaacggtcttcaaaaccaaacgctacggtagtggagctagttgggaacttgggatggagcggctccgtccgaactttttttagatagccagatgattcagtatctgagtataattttcctttttagagtcattctattttatataaaac

SEQ ID NO: 11890 - DNA, 2578 bp, Zea mays
aattcggcacgaggcatccgcacgctgccgctacggagtacggacagccagagccgaaaaaccgcagcagcgcttacagtcacgggcgcccacctgggcaggacaggagtacaggacactgccattgcccttccccgccgcgcccccccccccaggaccccagtactccactaacactcatcagcgcgccgcggggcgcgggcggacgtgcggcgctcctcggacggccgcgatggcggaagtggcggcgcggcgcgccgtcggcgtcccagcagggggcggcggcgaccaggcgaaccttgcggcggtggcggcggctatgcgggggcgcggcgaggtggacacgtcgtcgccgttccagtcagtgcgccaggccgtcgacctgttcggcggcggggcggccgccgtctcccagtggcgccacccgcaggctccgccgcgcgtccacctccgcccagaggaagaagaacttatgaaagttgaggaacaaacagtgaagctggagatggaactgttcgttaaggaaaaggaaacatttaaggtcttgaaggaactacaggaaacaaagcaggttatagatggcttgaaaatacaaatagagaaggtaacatgggaggacacaaatgctgcaaaaggccatgctgatacagggatggtacatccacgcccgccggcccggcaaaataccgagccaccagtccagagcgcaaaaggtacacagtccccactaaccacgttgatcaagctcaatcaggcaaaagcattccttaacacggataccgtcaacatgctaaagagccagatacagaaggagaaaggctcgcttgagaaaacccgcgaaaggttacaattcaacctggggaaggcttcatcgttagaagcagatttgacgaaaactgtcgcacggctgcaagcagcaaaagctccacagcctgtccttgagccttctgaaatctggttgcagatgaagcacctgaatgctgacaaggcgaggcacaagaaggcgtcagaggatttgaggaacgagatctgtgagctgacagctgcaatcgagcacacgaggtctaagacgaagactctgcagttcagaatcctcatggctgagaaactgaaggaagcttcccaacgtggagaatctgttgctcttgcagagatggaaaaactgagcaacgggcgggacccgaacggcagtacttctgatgctgtcacactctccgttgaggagcactccacgctcgtgctcaaagcgcaagaagcggatggtgccgccaggaagaaagtggacgcggcaatgcaagggctcgatcaagcaaaccggtgtaagctcgaactcttggaaagagtagaggaagcaatggcggctgtcgagacgagcaggaaggctctggaggaggcccagaggagggaggagtcagagaccaaggcaaagctagtagccgaagagacgctccgaaagctgcggtcggaccaaataatccagaactggcgcccgaccaacagcagctccgtaaaattcaagaacacggcgctgctggcgccccggagagcagcagcgggcgctgggatatacgacgtgaacggcctgagcctggtggccgccgggccgaacagcgtgaagacggtgtccatcgggcagatcctgagcatgaagctggaccgcgagctcgagatgacgaggacgaccacgacgagcgcgaggaagaagaaggtctctctcgggcagatcctgagccagaagtacgagatgttctccccgctgcggatcgaccacgactgtgcctcgcacaggcagttccagcagccgaggaggaagaggatgggcttcgtcgtgtacgcgctgctgctcgcgcggcagaggcataggaggcggaaggctgcctcctgcactcgtggtggcttgagctagctagctagtttggatggtcggtgggtgctcagccgcgtcgtagtcgtttatatgcttttattaagagataagcgatcggaataatcgttatatttgtaatatagctagttctatgaacaaaaagttggtatttttagcagctaacaaaaaaaaactggccacgtgggttcgggatgatttcggacccgtcgtctcgtctcatgccatagggctctctttctgcatatcccgagaccatggcgggcgctattcatcggcaaagctcctgcgcacggcagcgattgtgtgtccgcgtgcacggcgttcaaccactcgttcaccacccccaccccacaagtaatacagacgccacatcgcgaaccaaatttactgatctctaaaatagagtttacataaaaaggttagactaaacggaacagaattattttactttcatcaactaccataaaaagttaattttgttcttatttaactataaaatcagatgtaactcctgttttattttattaaaactggacatgtgaccctccttaactattttcgttagtgtttttctctttttatttatttattttagtcaaatctttagaaactgtagtaaatcctagaaaaataataagatagaaattttaattttattgaactatacatgagtaaaatatgatacgatat

SEQ ID NO: 11891 - DNA, 5485 bp, Zea mays
  misc_feature (4665)..(4665): n is a, c, g, or t
gcccttgttcagcaaaaaaaaaaatgccgccacacaccatccgtatgtgaatagtgttttagatgatcttatgcatacgttcttcaagctaaaaattgcatgagattgtgtcgtccgggctgatccaaacgcacggacactcgtggttaatccacgacagtacgacaccatacataacataaggtgataaggataggataggagaagctccttttgcaggcgcactggcgcaccatcttcgactcaggcctcgaccaccaccaccaccagtccacaagaccaccaaacacccttttttgcttgtcgtgccctcctccttcctcccagcttctccggtcatcccagagtacggccattctctatcccgtcaaccacatcagggcaacctgccaaacaccgcaaattgcgcaatccatccaaacccccggcaactccccaattccctctcccggagtcatcgacatgctttcctcctccaacagctcagctcccgccgcgctgtctcgcgggatacctctacaagaaccatgccctgcctattgtttcttctagctccaccgcctcgcccctgtctagctgactcggtgagtcggtcaccgctccccaacaaatatcggttcttcctgccccagacccgtaggcggccaagtccgcggcttggcgacggcgtgcgaatggcggagatgaccagggtttggagcggcggggaaccgctcgaggttggggtttccatggagagtgacccgattgtcggaggggaggcgccttctcgctcgaggtgggaagcgagccggtgggcgcccgtggaggctgcgctgaatcggatggttagtgtctattggaaagatactgttgctgtaggtgtccttgataaagattctgagaatcacatttgctttgatgccgtgttatatactagtagtactgtaaaaggatcttatctttaaacttagggcatgatcggaagcacctaggtttaaagaaactggtttataaaaactgagttggtttcaaatatactaatttatattctaatttatagaaactagattcccggttttttaaaaaacaaaaaggtagtctttcctgtctaaaactagtttatgaatggttctaaacactataaaccagtttatagaaactagagataaaaactggattcttgaaaattagattgattccaaccagggcctcagtagacttcgaaactttgtagccaagctgaagaaaggttgcatagaaccaaaaagcttaccaaaaggcactaaagctcctggatattctggttcctcgatctatagggagcgtcctttgctttatcttcggaaaggtgtctagtggggcagtgaaatcaacttttatgaactggacggctttcattggaccttctttgttgacattacttactgtgagggataaaattagggatgctctaatttcctactgactgctgagtttcagtcaaccattactgacctttccactagaacttgagctcacagctttgtgatattacttggaattatggcccctctgctgaaacttttatactgtgcgccagagtaaatggctggtggctggttgttttgcttttgcagctatttggaagcgtgatgctgaaatcatgtgggttttgctgggtgcggttggcaactctctgctttcgttggttctcaagaagatgctaaaccatgaaagacctgcaccagctttgcggtctgatcctgggatgccatcgtcccatgcacaatccatattctatgctgcgaccgtcctagctctttcatgtaagaacttcagaaagactccagtattcaattttactttgaatcatgatacggcatgactatatatattctcctgtattctatgacactgaatgccttaaggctggttagagctacttagctggtttaagtgtgttgctaacaataatactgttttattttagtattttcttgatgttttgttatgtggctcttcattggtgataaacaaaacaaacaaaactaaattagatataatatgcttattttgtgctctactattttatgataaaattaggaggaacgaattttcactctaaaccaccaaaactattgtgtcttatgataaagaaacttgagaggaatacaattttcagtctaaaccatgggcacaaatcaaatacacttttttccagtttagcacgatgtgtagttaattaatttgcatttccattgcagtgtactactggcttgggacaaattatctgaccatgattcttgggcctgcaactctgtcgttggctgcctatctggtaagaatagtgccttactaagtttaactctgttttttttttatctcaagtaactcggttggtcaagtgttccttggaagctccaagcctccaacatgttcaattatatccgaatgttaaccttcttgtaccattaggcagaggccaaacggggttattttttccgaacctagaacttaatatggtcataattgttagcatcaggcaaactgcgcctccccctccttttcagatggatcacgctcctccagtgccatttggcactagttttaagttttggcccaatctaactctggtcttattcacgtgcagtcttggctacgtgtgtctcggggccttcatacactaaaccaggtcatggtgggagctgttgtaggatctgccgtcggtgctctttggtttgtgctctggcattggcttgtgcaggaggcctttgcttcttctgtgcttgtcagagttgctgtcatccttggatcatcagcattttgtgttagctttgtcgtctacatgattcgtcactggctcaaggatgagtaatgtacttcggagctgcaatgggagatggactgataggcatggtgcgtttggaaaagtgaatccgttccgattcttatcagaatcgcttgaaaaaaatggtgacaaatgggttttggcggagcgattcacgagtggaacaattctcttttccttcagaaactctcggattggggaaaatgaagtttcacaccgattcctaatagtcacatacgcctcgtgtcacactagtaattgtatttttttcccagttaatcatttttaagtacaaggaactaaatatgttgtatctagagcaagctcaggagatttatgtcaggaatacagttttgataaaaaaaatacccctcaacaactcgtttagatagatctttaaatatagactagaatcccctgcgccctatcgggcgccatatagattctatgaggcaacataagtttcacataaacaagaacaacatgattatatgtatatgtgcggtctagggcgccatatagattctatgaggcaacataagtttcacacaaacaaaaacaatatgattatatgtatatttgcagagaccgcaagtaacttgccaattcatgcgagcaccagatgctgacattgtacaaaaatgcatcagagtagttgagaagaaagtacgaaacatagtatacatctaagatcacataaatgcataactaacacttacataaatgcttaactaacacattttacagccatctgccgtaaatacataaagactaaacaacctacgacctttatatacaaaatacaaaagagtgagtcatgttgctgtccgcatcgacaacccgtggataatggcacgcatagaccaagttgcgacggctgaacgttaagagaggaaagacctgatccgtgatcagacgcgagaagcataggcggtggcgcacacctctgtacagtggagaaccatgatcaagcgctagacacatcatggacaaagtaaattactaagcaaatcgaaattttgttgtagcaatatggtagaataggcacgacttattcttttttggggcaaactgaaagagtaatgaaataccaaacaaagaggaataaatctgctttgctacatttgtacattctcgatgtagggtttttgtacgaacatgtgagcaaaatcaactctgtaacagttgtagtgaggtatataaaagtacatctatctggctgaagaagattatgcttgtattagctcttcggttgtaggacataagctgcaagtacataaaaagatggattattgactgtgttgacaacatacatggaagtgctgccatcgacaataaataaataagatacagaataccataagattaggaacattagtgtctatcgttggaattaggaacttgtagaatcaagtagaatttgattggggtccttaacgctctaaataattctcattcggatttttcacagtttcaagatacctacttcttatgatagattttagtgtctagaatattataatcctcaaactgcagtaaatgataggaagtgcagtagagaaaaaaatacaaacatctgcaagaggagtcactgatttatctttaaaaaatcatgttaatttataaaccaagttgttgaaacttcaacatatacctagagactcaataatctccgtgatggttgtgctgctgccctagctctgtcgcctccgtgtctcctcagcatggttcgtccttcgaggaccctaccatttcatcttgatccaaacaaaaaaaattcaaaatcaggttacgtttttcaatccctttttacagtagtaaaaccgaaccatatccatgaccaacatagaaacagncaaacctgtgtagcaataaaatatatagaagctggatatttttgctgtaatctcacagagatataatgaggtaagctcttgtaggcttgtagcaggatcctaggtaaatcaatttaacagaagatccctgcatctttcaaagccaaagcaaattaagtagtgacataatctgcacatttttggttgaaacagaagattaactgacccagtgaaaagattacacacagattacacatggctagatatccatgttattatttattccaaacattatgtcctagatcatgcatagtcatatgggcttcagtacctatttgcgtgaaaccactcgattaaatacttgaagatgaaaatcaaccacttatatgagcacccagattaaatacttgaagatcaaatcaacccattgaatgagcacccagattaccaaaatgttcatctcagggatatacacaaattacacaataagcaaacgagagccaagttaaaagggaaactgacatcctaccgacattgtcacaatgcaactgatttgatctagtcatatcagctgtaagcaaaatattctgaagcaagcaatatacatctctatcagcttgctgagaaaccatttcctcggttataaatcgagaatttccaaatgacaggccaggatcatatgctctaccatggctagttgctacttcagaataaattgccatattcaatgttgacccaaatggactgtgaacaaattaaggatgatagttatacaatatttattcaatcaaaccaatagtgttcaaacttaaataactcccagtgaggcctagaatgaaaa

SEQ ID NO: 11892 - DNA, 1247 bp, Zea mays
ggaccgagatgctctcttcctccgttagttcagctaccgccgcgctgtctcgcgggtcgccgccgctccaagaagcatgccccgcctattgcttccatctccatcgcctcgcccctgtctgaacgactcggtgcgccgtccaccactctccaaatatcgattcttcctgcccaggactcggaggcggccaagtccgcggcttggcgtgcgaatggcggagatgaccaaggttgggagcgccggggaaccggccgaggttggggtttccatggagagtgacccgattgtgggaggggaggcgccgtcccgcccggggtgggaagcgagccggtgggcgcccgtggaggctgcgctgaatcggatgagtaaatggctggtggctggttctcttgcttttgcagctatttggaagcgtgatgctgaaattatgtggtttttgctgggtgcggttggcaactctctgctttcgatggttcttaaaaagatgctaaaccatgaaagacccgcaccagctttgcggtctggccctgggatgccgtcgtcccacgcacagtccatattctatgctgcgaccatcctggctctttcattgtactactggcttgggacaaattatctgaccatgattcttgggcctgcaactatgtcagtggctgcctatctgtcttggctacgggtgtctcggcgccttcatacactaaaccaggtcatggcgggagctgttgtaggatctgtcgtcggtgctctatggtttgtgctctggcattcgcttgtgcaggaggcttttgcttcttctctgctggtcaggattgcagtcgttcttggatcatcagcattttgtgttggctttgtcatctacatgattcgtcactggctcaaggatgagtaatgtacttcttagccgcaatgggagatcgactgataggcacggtgcgtttggatgagtgaatccgttccaattgttatcagaatcgcttgaaatggtgtcaaatgggttgtgagtggagcgattcacgagtgaaaccatttttaattaaaattcaatctagtagttaaatgatttcacgaagtgattctagttcgtgatcagaaacatttcaagaatttagatccaaaatgtttctatacccatcatggtgcaaagacctctaaacgcacatttgatttctgttgtgaattagacctttttatttaacactgaaggaaagttaaagcatggattcttgtgataaaaaaaaaaaaaaaaa

SEQ ID NO: 11893 - DNA, 986 bp, Zea mays
  misc_feature (935)..(935): n is a, c, g, or t
cattggggcccgcccggccggccgggctctccccttcactcgagcgccgcttcctctccccttccatcgagcgcagcgcctgcgccgccgccaccactccgcaccgccgccagttccccacttcctccccacacccgaatcggattgaagccagaaggcaaggtgaagagtgggcttgggtaacggttgcaaagagatatccccaacagttgcagtcactcgcatccagtcggctcagctatggaggaggactcatcagcgatggagccgaataggctgcgcgaggccgaggcggcggctggggagctgaagaggctgcgcgaggccgggcagtctcagtacatgtaccggtctatcgccgacgccagggttgtcggcggccgggtctgcctcttcgccgtcgtctccgagatcggcgctaccgtccacagccgtggcacggatttcactgttacgttgagggtaatagatgaatcatacaagtctggaatatctgtaactttttttgctgacagcactgcactattgccttgtgtgaagtcgtgtggagatgtgatcagtctccataacgtcgtgataaagaaatatagagatttctttgtgcaatttgacaaaaagtactcctcattcgcgctgtttgaaggcaaaacgtatactgaatgcagtccatatcagacttctataagatatcatgacagcgaacacgacaaagattttttaaatcagatgagaacgtggctccctcaaggtctgaaggatttcacttcaaataattccgaattgtatttaatgaatttgaagtccgattctacttttgatctagtatgcaaggtttttcatgtacatgtggagaacaacaattcaatattttatgtttgggatggaactgatacccctgcagctgagtttccagcaattttggatgctgaggcagncaaatcactctctctacatgaaggcccccctctatccagggagattttatg

SEQ ID NO: 11894 - DNA, 1966 bp, Zea mays
tttctttaaatcgagcgccgcttcctctccgccgctttctctccccttcactcgagcgccgcttcctctccccttccatcgagcacagcgccgccgccaccactccgcaccgccgccagttccccacttcctccccacccccgaatcggattgaagccagaaggcaaggtgaagagtgggcttgggtgacggttacaaagagatatccccaacagttgcagtcactcgcatccagtcggctcagctatggaggaggactcatcagcgatggagcggaataggctgcgcgaggccgaggcggccgctggggagctgaagaggctgcgcgaggccgggcagtctcagtacatgtaccggtctatcgccgacgccagggttgtcggcggccgggtctgcctcttcgccgtcgtctccgagatcggcgctaccgtccacagccgtggcacggatttcactgttacgttgagggtaatagatgaatcatacaagtctggaatatctgtaactttttttgctgacagcactgcactattgccttgtgtgaagtcgtgtggagatgtgatcagtctccataacgtcgtggcaaaacgtatactgaatgcagtccgtatcagacttctataagatatcatgacagcgaacacgacaaagattttttaaatcagatgagaacgtggctccctcaaggtctgaaggatttcacttcaaataattccgaattgtatttaatgaatttgaagtccgattctacttttgatctagtatgcaaggtttttcatgtacatgtggagaacaacaattcaatattttatgtttgggatggaactgatacccctgcaactgagtttccagcaattttggatgctgaggcagccaaatcactctctctacatggaaggcccccctctatccagggagattttatgtacaatgccagatttcggaactgtcctaaggattttttcagatagatttgtcaataaagtatcatatatgcaaaagaacatatattgggccaggttctggaacattacttgcaaacaacggcgtggcccccggccaggtactttctcggactccggtggagttcgcctattatcaaacaaagatgatagcgttgttgatcgtctaaagatgtatgacagccgcatcgccaaccgagttcgtcgtcggccgatggcaagcatcccctccagtgttactgatgtagaatacgaggatgcaggttacgcttcattaatgaagtctttaactcatcatgatgtgacgcacaaattgagaaccttggtccgtgttgtggcagcacatccatgtgaagctagtttgctttcaactggtaactgtcatcttcggttgactcttgaggatcctacagcgagaattcatgcgtatgtccacaagaatgatttggtcggattctttggtggtggttttttgacagcagaagtgatagtaaaaaagatgaacatggtactgggcatcccggaaccacaaggcagcgtggaagttgccccctcgaccaggaatccaccttggatatggtgttgcttgatgtcatactatatggacaaaaacgatccctgggtcagcagaaagtacctcggccgcgaccacgctatcagggattgagcagagggatgctgctggaatgtgcaggaacaaacttgtaaatgaatgggacagatgctgtgtagtattggcatcttgcttgtagaagaggccatatgcttttgcaggtgcgatcagtgaatcattccatactgaacactgagaatagcacctcgggttcattctgtatgtgcctacactctagattgtcttttgggtgctcatcacgaaacgtgagcatatcttttggaaacagagacctgcgtttgattcctgtgcttgttatgttgtgattgatcattggggggaggttgagcttttgagccagtataaaaatcctggccggcccatcaatatt

SEQ ID NO: 11895 - DNA, 810 bp, Zea mays
ccggggacgctggcctggctcccggacagaactgctctgctatggccgtcttctggacggacggagggagggaggttgagagaaaagcaggggggcagcaacggaaacaaaacaaaaataatcgtactgtagaagccgagcgcaggagatccaacaacgaaactccccttcgttccttcctcgtgttcttctccctcctgccgccgcggcccgctccgctcccgagccccgttgcacctccacccgccgcttccgtcccgtcccctggcaccttcctctcaccgcacttgagtcgctgcgcctcctcccgcccgcctcctcccgcagccgcagcaggacgagctcgtcgccgccgtgtactagaagaacgggaggtcgctgtcggtctcccgcacaatcctgattcctggacctgcgccgcgtggtttcgcctcaggttggagtgtctcgatttgtcaggatagcttgtataactgaagctttcctttgtatgatgatgggggcatgccatggaccagaagtgagggggctagggtttagtatgtggtagtagctcctgcttcagcaaaagaagcaaggatcactactttcgccgtttgttccgtggaggatctgaaccctatcggcattggttcgggtggcgtcagctgttctgggtggggtagtatgatgaaacagatatttggatggcgcaaggcgtccaaaactgcaggcaaggagtgtggcgggaggacgttcaaccagctgccaggttctggatttgctgacctgagtggccagctgccaattctgtctagtactggggacatc

SEQ ID NO: 11896 - DNA, 1559 bp, Zea mays
tgacagcgaacacgacaaagattttttaaatcagatgagaacgtggctccctcaaggtctgaaggatttcacttcaaataattccgaattgtatttaatgaatttgaagtccgattctacttttgatctagtatgcaaggtttttcatgtacatgtggagaacaacaattcaatattttatgtttgggatggaactgatacccctgcaactgagtttccagcaatgtaagattttagatttgttttgcaattttttgtaataactaagaaaaacatctatgaaatataagatggtgttttagtgttttccaaatactactgcagcttttattttttgtttggttgtttttacttggtgcactgaacataagcataggtaatgaaaacataataagttttatcttagaaaaaaaatatttggtgatgtcagtcatgtcactattttcacttaatttacctgtttttgattggtgaacatatagtttggatgctgaggcagccaaatcactctctctacatgaaggcccccctctatccagggagattttatgtacaatgccagatttcggaactgtcctaaggattttttcagatagatttgtcaataaagtatcatatatgcaaaagaacatatattgggccaggttctggaacattacttgcaaacaaaactttggcatttggaaaggtactttctcggactccggtggagttcgcctattatcaaacaaagatgatagcgttgttgatcgtctaaagtaatcttcttttctgatgagttttaatgttctttgaatattatataagtaaactttactaattacataaacacctccaggatgtatgacagccgcatcgccaaccgagttcgtcgtcggccgatggcaagcatcccctccagtgttactggtgagtgacgcacaaattgagaaccttggtccgtgttgtggcagcacatccatgtgaagctagtttgctttcaactggtaactgtcatcttcggttgactcttgaggatcctacagcgagaattcatgcgtatgtccacaagaatgatttggtcggattctttggtggtggttttttgacaacagatgtgatagtaaaaaagatgaacatggtactgggcatcccggaaccacaagacagcgtggaagttgccccctcgaccaggaatccaccttggatatggtgttgcttgatgtcatactatatggacaaaaacgatccctgggtcagcagaaagtaccggatctatagcacagccatcagggattgagcagagggatgctgctggaatgtgcaggaacaaacttgtaaatgaatggaacagatgctgtgtagtattggcatcttgcttgtagaagaggccatatgcttttgcaggtgcaaccagtgaatcattccatactgaacactgagaatagcacctcgggtgcattctgtacagtctggatgtgcctacactctagattgccttttgggtgctcatcacgaaacgtgagcatatcttttggaaacagagacctgcgtttgattccaaaaaaaaaaaaaaaaag

SEQ ID NO: 11897 - DNA, 1439 bp, Zea mays
agcgtccgccagcgtccgcgtcacccgtccggccggccgtgcgcggcgcacccaccaccacccgtcccgctcgacaggaggaggaagaagaagggaccgggcgacagcgcgcgatggccgccgtcgtgtgcgtcaccggcgccggcggcttcatcggctcgtggatcgtcaagatcctcctcgcccgcgggtacgccgtccggggcacctcccgccgcgaagctgctgaccccaagaacgggcacctgtgggcgctcgacggcgcggcggagcgtctcaccatgctgcaggtggacctgctcgaccgcgccagcctccgcgccgccttccgcggctgcgacggcgtcatccacaccgcctcgccgatgcacgacaaccccgaggagatcatcgagccgattatcgcagggacgcggaacgtcgtggaggcggcggcggacgccggcgtgcggcgcctggtgctgtcctccaccatcggcaccatgtacatggacccgcgccgcgaccccgacgccccgctcggcgactctagctggagcgacctcgagtactgcaagagcaccgagaactggtactgctacgcaaagacggtggcggagcagggcgcgtgggaggcggcgcgggcgcgggggctggacctggcggtggtcatcccggtggtggtgctcggcgagctgctgcagcccagtatgaacaccagcaccctgcacatcctcaagtacctcacgggacagacaaaggagtacgtcaacgagtcgcacgcctacgtgcacgtcagggacgccgccgaggcgcacgtcagggtgctggaggcgcccggagccggcggccggcggtacgtctgcgccgagcgcaccctgcaccgcggcgagctctgccgcatcctcgccggactcttcccggagtaccctattccgacaaggtatgggcattttaataatggtttcgtcgtttcgaacaatgtgctatcaaaggaaatagtggtggactgctccaaaaattcaacttgtgcacgataatatttgaagaaatccatggcctggagggtttatgacgagtagcctagttggtctggtcagtaacgactagttaatatcctttggacaaggtcaagaatagctctccatggatagaaaagtccatctgatgatgctgcacagtactttgttagctacgagtcagatgatgggtatccatgcttagataagccaagatactccacgtaatagaaaactgaaacccggagtgcattttagtcatgtgaatgatcatgcggcccactcttttcttaccctgtacgttctaatttataattcgcttgatttttttactctaagtttgactgactcgtcttattttaaaaaattcataattattgttatttttcggtgatattgttttactttaaatgtggcattgatttttaaatttttttccta

SEQ ID NO: 11898 - DNA, 1162 bp, Zea mays
aaaagcaaagcaatgcctattctttcctttgaaggcagcacatggatggacgaccctaggggtacctcaaggcaaaaaagaaaaaaaaattcttcaccttgttttgaagatatagcaacaacaacatatatacatggtgtctgcctgtctggagtcccaaactgcttcgagacaaatgcatttgctctttgctgttgcagcactacactgatagcatgctatttttttgttttgtttttgcaggtgcaaggatcaggtgaacccactgaagaagggctacaagtttacgaaccaacctctgaaggaccttggcgtcaagttcacgccagtgcatgggtacctgtacgaagcagtgaagtcccttcaagacaaggggttcctcccgaagacatctggcgccaaggtaataacatgttgcctttttttgttgttccaggtgcctgaacgacgcagctgcctgcctcaaacgacatcacagccaccacccgaaatcgtttcgaaactttgaggtggatctgcacacgtgctcaaaatagcaaaaatgtcttgtctctgtctatggtgcatcctgttgcttttgcactacaactatacacatccttgtctgggtagtctgttctttacatagcaaaatgcgaagtctgcagggtgatttcagcgatgatggaagcatgcccgcccacctcttgactgcatgcgctggtcagctgcggcttattctacacatcttgcttgtctgtactagcctttgcatcgtgccttcgtattatgcttttctcctttcatagtacttattgacctttgcggccatcatcatcattttcatgataggccaccttgcccaatcttgggtatggacttaaaccttccttgctaaatatggctcgtctccgtgctccattttcgacccaacaacaagaacttgatcgaccccacccaccaccatgagtcgtcctcgtccatgacctctcagtgttgcagtgtactggccggccggccggcagcatctccccatgctttcagctcccaaggcgaagggtaccactgcaagatgaaaaatttggggataggggaaaaaaactagtagtagcgccaatcatttactccggtactacaaggccaatagctagcttctcatgaccagcagcagcatcggtagcag

SEQ ID NO: 11899 - DNA, 844 bp, Zea mays
ggccgcttttttttttttttttggccccaaattttttttttttttttttgccagaacaagccgttcatttgattggttattaaaagattttgggcagtctgttcttacatagcaaaaatgtcttgtctctgtctatggtgcatcctgttgcttttgcactacaactatacacatccttgtctgggtagtctgttctttacatagcaaaatgcgaagtctgcagggtgatttcagcgatgatggaagcatgcccgcccacctcttgactgcatgcgctggtcagctgcggcttattctacacatcttgcttgtctgtactagcctttgcatcgtgccttcgtattatgcttttctcctttcatagtacttattgacctttgcggccatcatcatcattttcatgataggccaccttgcccaatcttgggtatggacttaaaccttccttgctaaatatggctcgtctccgtgctccattttcgacccaacaacaagaacttgatcgaccccacccaccaccatgagtcgtcctcgtccatgacctgcacacagaaagaacaaagaaaccttgaaactagcagagagagagagggagaaggtagagagagagaaggagcgcgccaacgtagtttgtactcctttgggaacctctcagtgttgcagtgtactggccggccggccggcagcatctccccatgctttcagctcccaaggcgaagggtaccactgcaagatgaaaaatttggggatagggggaaaaaactagtagcgccaatcatttactccggtactacaaggccaatagctagcttctcatgaccagcagcagcatcggtagcagtcc

SEQ ID NO: 11900 - DNA, 1276 bp, Zea mays
  misc_feature (1186)..(1186): n is a, c, g, or t
ccggtgcatcgacctgtcaagcatggggcatttatttaaactgctgtcctttttacaatggactttaataaaggtcttacattttaggataaagagtcacggggtaacaaatgtgagatgaatgctggtcagttatctgttgttatcctcttcttcatgcccagtctgtgtgccccccctggggctggctctgtggccgtggatagcaaatgcgcctctgcgagtccagagcaccagcgtcctatcgtgcttcccagtattcaagaacgctgtgggaagaagcaagcaagcaagcagcaaccccatggaggtggagtcggctctgcgatgccatgccacccagctccacgtgcatcaggtacaagaatctgggggatatttgcctatccgcgaccagcctttgcctgagaggcaggggaccatggctgcctgcctgatgagcacgaggcacgagcagcagcagccgccggccggccagcggccaggcttttgacgcactggatgcaggctggccaaaggactgacaccagctcgatcagctgaccggcatccatccgcccgccacgccagatcccatgcttgtttgataacaacagctcatgcatactgtgaaaaacaaaaggaggagcacagactcgaatccgagtaaaattcagcagtgtgaagccatagcagcctgtgaggttctcatcaagctagctggacctctgtcagcaaaacccagagctggaatctcccacctcgctctgcttctgctcatccattcatcaagccatcaatccaggaccaggaccccaggtacgcaatttatattcctcgacagcttttcagaacatgttctcctcggcggcagtcgtggctttagcggaatataaccgctacaaagaaaagtaaaaaaaaatcacatcagccccagctcagcagctatatggagtggagtggagtggagcatggaggggagggaatccgcttttcctggagcaggttcaaacgccagccatggatggagggccaactagtgcggccaatcggctactttgtctcttccccacctgctcttgacttgatccccgagcatatattcctggacacctaatcactggatttctagcctctagtgttcatcaaggactccactcgcatcacctgacatacacaggaggccgcatgtaacaggggaagtccngcgtagtttcttgagagaaaaaaaggagtcccctgtaccaagcaatctacctacacaagtagaccaatcaacggtcgtcctacaggggta

SEQ ID NO: 11901 - DNA, 1252 bp, Zea mays
  misc_feature (1232)..(1232): n is a, c, g, or t
accatcagaacgataaaagattgtattctcaagtcaatttgcttccggagattacaccagaaaatctagaaaaatgttgctatcgaatcggtcccgtaacagaacattgaccaaaactgagactgatcggggcaaaaaatacatttgtaaagggtcaaaaacaccataaactcttgctttaatctgccagctatagtatcttacaaaaggagaaaaggaagtatcttctacattctagacagagaagcggtggggatggtggtgcgttgcctataacatcagggaaacaacaaaagatacagcttagaactcctcgtctcaacctcagcaaagaaaacaaaaatgtcctcaaaataagccgcgcgaagcgttagggagtagaccaccaagatccaattgacaccttaagtagcttctgaagaactgcatgaaaaactactcatgtggtgaatgtttgccctccaagtatgatctcaggcgtttaatgagattttccatcagtgactccggaacttttgacctaaatattgctgcagaatctgacactagctgctttctcattgcatcaaaatcttgagtaacgtctgaacttagaagtcgacgcctcttttgcgagcgcataaaattatagacatcatccatccatacagacagccgaagctcagaagaagctgacttagcaagcattttctgaaacttatcttcttcaagttggcgtttgtttcctgaagagtttgcatgctctttttggtgagatgacccctcaaaacattgttcagcatgtgaggccttgccattactggtctcttgttgagcgggcgtggcattgccattactggtcacttgttgagcaggcgtagcattgcctatactggtctcaccaagatactgggactgatggattggctggccatttccatttgcatcctgcagtattctttctgattgttcgcctccctctccacaagaaatagtattattagcattaattttactgggtcctacaaagtgttcagtcttgcatccatttgattctgataatttcacagtttcattaacctcgggattaatttttgaagtgaggtttattttgccatttggtgtagccttttctgctgcactattcttgaagggttggcgcttggggagtggacctgatgcagtcttgccattcctcaagggcatcagtacattacctttggcaagacgtaggtcattctgttttaccaaanggtatcttcgaggtgacact

SEQ ID NO: 11902 - DNA, 4477 bp, Zea mays
  misc_feature (4363)..(4363): n is a, c, g, or t
cgccggggcccaccgccggagagtccgactcccgcgccgcctgctcgtttctgtgatcgcgcacccgcgcctgcagcggcgtccactcggggagatggggcggtgccgcagctggtgcaggagatccaggacaagctctcccgcggcgcggtggagtgcatgatctgctacgaaatggtgcggcggtcggcggccatctggtcctgcggcagctgcttctccatattccacctcccctgcatccggaagtgggtgcgctacccggcctccgctgcggatgcatccccggcagcagagccggcctccccttcctggcgctgcccggggtgtcagttcgtgtacgccaccccggcccgcgagctcacctacagctgcttctgtgggcgccggagagatccccccaacgaccatttcctcacaccccactcctgcggcgagccctgctccaagcctctcgacagagcggaaccgcctggcgccaagggggaggatgttgacgccaccaggtgtccgcacgtctgcgtccttcagtgccacccgggcccgtgcccgccatgcaaagcatttgctccggatcgaccctgcccctgcgggaagcagatcatcgtgcggcgctgtgcggacaggagcacgcctgtcacctgtggccgcccttgtgaacagatgctgccttgcaaaaggcatcgctgcgagaccctcgcccccgctggttcttgcggggattgcgctgttctcatctctgtgtgttgcttctgccggaataagaatgagacattgctatgtggagacttgatggtaaagggggagctgtctgaggaggacggggtgttttcttgcaatgaggtatgtggccgcacgctcgcctgtggcaaccatgcttgcaaggatatgtgccacccagggccttgtggggagtgtgagctcatgccgaggaaggtcagtacatgtcattgcggcaagaccaggctgcaggagaggagggcgagctgcttggacgcaatccccacctgcgataagatatgcgataagaaactgccatgtggggtgcacaagtgcaaggtcaattgccatgagggagaatgcccaccttgtttggtgctcgttgagcagaagtgccgttgtggctcatcaggtcagatggtggagtgtcacaagttctcaatggaagagtttcgctgcaagaagccttgtggtctcaagaagaactgtgggagacatcggtgcagtgagatctgttgtccactgtctaggaaagttgcacaccttgaaggtggcaactgggatcctcatctctgccagatatcatgtggcaagaagctccgatgtgggcagcatgcatgccagctactctgccacagtggtcattgcccaccctgcttggagactatattcactgatctcacttgtgcctgtggcagaacttctctcctgccacctctgccttgtggaacaccaacaccatcttgtccacatcagtgctcagtgccccagccttgtggacatcctgcctcacattcatgccattttggggactgtccgccttgtattgtgccggtgatgagagaatgcattggaggacatgtgatgctgaggaatatcccttgcggatcgaaggatatcaggtgcaaccaaccatgtgggaaaaatcgccaatgtggaatccatgcttgcaacaggccttgccaccctcccccttgtgatcagacacctgcaaatggagatgctagttcaagctctggcggcaaagctgcttgtggacaagtatgcggtgccgcgaggagggaatgcaagcatacatgtactgccccatgccacccatcgtccccatgcccagatttgagatgtgaatttgctgtgactattacctgctcttgtggccgaatcactgcaactgttccctgtggtgctggtggatcctccatgggtgataatatgtttgaagtctccatcatacagaagctgtcaatgcctctacagtcagtggaatcaaatgggagggtgcctcttgggcagaggaagctttgttgtgatgaggagtgtgcaaagatggagaagaagagggtccttgctgaagcatttgacatcactccatccaatttggatgcattgcattttggtgagaattcaagttcatcagatttggtttctgacttgttccggcgtgagccaaagtgggtgctggccatagaagagaggtgtaagtttcttgtacttagcaaggtgagaggcagttcttcaagcaatgtgaaactgcatgtcttttgccccatgatgaaggacaagagagatgctatcagtctaatcgcaggccggtggaagctttctgttcagtcggctggtcgggagcctaagcgttttgttactatccatgccacacccaaatcaaaaccacctgctcgcatcctgggatccaaggcaggtgtacctgttacagctgcccatccttactttgatccacttgttgacatggatccgaggctggtcgttgccatgcttgacctgccacgtgatgctggtgtcagtgctctagtcctaaggtttggcggggaatgtgaattggtctggctgaatgacaagaatgccatagctgtattcaatgatccagctagagcagcaacagcgctgaggaggctggattatgggtctgcttaccagggcgctgcgatgtttatgccaagcagcgctcaggcatctttttcaagcaatgtttggattggagagcagaaggatggggggatcactgctaggaacaatccgtggaagaagcctgcttctgctgctgagcctgatccgccctctggagactggactggtgttgctggccatgctccagcaccaggacggagaggcgtcaacaccgcctctcaagtcatggggactacaaaccgatggaatgttctggaatcagacgctgctgcaagctctggtccaggcgacgagcggaagcctgctcagcgcatggatactgcatacagcgcaataccaaatgttgggaatgctgggccatcgatgaccaagctgcagcctgacgcagaggtggaccactgggaagaagcttgtgaatgaggtagcaagtagcatcgggaagttgggtccagattttttttttgggttcttaaatctggttataggtcgctctgcttagctggtataccgagcctctatgttctagcacattttaaattagtttggtgatttcctggtggactgttgggtcagtgtcagaagtgtttgattttgttacgcaggccaatgagccggcaaatgaatatctgtaaggctgctgattattttagcaggtcttcttttgagttcagaaggtattaatgttttttaggtttttcgatggtatcttgttataaattacttggcagcgggtggtagtccaatttctcaatcttgggatccagaggatttgttctcacaattgtatacgctaaaaattgattcatatgcattcctcatctgcaaccctgacataaaagcagttgaactgaattagcacttaagccaggttattcagatctgagaaaacataagtaaaaatcggcaacttactagctgaattagttatgtcttagcatggaggaagcatcgagaagttatgttacatatgcatttgtatattcaaattacataacaataatgtccagctgtatttttgccatgtctgatatccaactgacttcataagaaataaggacatgtttggaagcaacctaatgtttaagaaaccaatttttatttttatctaggcgatgctagtttttggtttttaagaaaccgagaatttaatttctataaactgagttataaacttgtatgtttggaaccacctcaatttctataaaccagtttcttaaaaactaagtgcttttaaacaggacctaagtcaataaataattagacacagagaaatttaatgtggacttaagttcgtatgccagtcaatataatttagtttttacctgtctattcatttcacaactgaagaactagtcttcggtatctgttatgttatgaagtaaacttgctataaaactgagaaagattgttaattgttatattgtctctagcataaagtgtaaaatagaggacacaaaaatatttgtagagtagagtttaaaataaagaatatggtaaatgatctgttggagataggcttcccttcgccctaatattaatgtcgttgtggcaggtactaagaacggagccaaatgatctgcacacacctagggaggcacatcgtccatcgatgagggcgcacggggtgcttctatagtgtgtttggtttgtggagtcacattgatgaggatgcacggggtgtttctatagtgtgtttggtttgtgaagtcattctatncttcatgaggtgatgcatcataagtttattccatcaattttggtagaatcaacccactcctcatgtatatactaattattagcttatgaggaatgaggttgtgatggatcaaca

SEQ ID NO: 11903 - DNA, 5032 bp, Zea mays
  misc_feature (1330)..(1330): n is a, c, g, or t
tggtttctctgtacgaatcgattttttttacaacaccttttttttttcttttttgagttttagttgacaattgacgatgtcccgatctatcggtaccacagcaacgccggaggccggaggccgggagtaatacacacgtggtgacgtcaccgccgcagaactgaaccgacccgatcgtatcgcaccatacacctcgtcatctcgaaccatccgcggacagaaccaggcctcctctctccttcctcttcccccatccccctcgccggatcgccgtcctctccaaggctcctcccaatcaaataccctcccacccctcccgttactcaccaccactatcctcctccgccgctgtatccattccccccacccccaccgcactccacccccttcaccaacactcttccataccccaccgctaacccagacccgacggcgggcggcgccgcaaccctagggttactcctcccctcccgccgccgtatgcagccctccaccgatcgccgccgcggaggtggacccgtggccaccgcctcccgtgtgtggcgagcccgccccgccgcctcttcccccggctccgccgcgggccccgccgccgccggcccgattttgcccctccctagctcagccccggaggcccgcccgccccgccgccgctcgcgccgttccaaccacggcaacaaccagaatcaccgccccgccgcgcctcaggagcaaaacgacaacgcaggacaccgtcgccgcggtccgccgccggagaggccggctcccgcgccgcctgcccctgcccgtgagcacgcaccggcgcctgcggcggtggagactcggggcgatggggcggtgccgcagctggtgcaggagatccaggacaagctcgcccgcggcgcggtggagtgcatgatctgctacgacatggtgcggcggtcggcgcccatctggtcctgcggcagctgtttctccatattccacctcccttgcatccgcaagtgggtgcgctccccggcctccgccgccgacgcatccccggcagcagaccccgcctccctctcctggcgctgcccggggtgtcagtccgtgtacgccaccctggcccgcgacctcgcctacacctgcttctgcgggcgccagagagatccccccaacgaccatttcctcacaccccactcctgcggcgagccctgctccaagcccctcgagagggcggaacccctttgcgccaagggtgaggatgttgacgccaccaggtgcccgcacgtctgcgtccttcagtgccatccggccccgcccccgcctcccggggcatttgctcccgatcgaccttgcccctgcgggnaaggagatcatcgggcggcggtgtgcggaccggagcacgcctgttacctgtggccgcccttgtgaacagctgctgccttgcaaaaggcatcgctgcgagaaggtttgccacactggttcttgcggggattgcgctgttcccatttctgcacggtgcttctgcgggaagaagaatgagacactgcaatgtggagatatgatggtaaaggggaagctgtctgaggaggacggggtgttttcttgcaacgaggtgtgtggccgcacgcttgcctgtgggaaccatgcttgcaaggatatgtgccacccagggccttgtggggagtgtgagctcatgccaggcaaggtccgtacatgccattgcggcaagaccaggctgcaggagaggagggcgagctgcttggacgcaattcccacctgcgacaagatatgcgataagaaactgccatgtggggtgcataggtgcaaggtcaattgccatgagggagaatgcccaccttgtttggtgctcgttgagcagaagtgtcgttgtggctcatcaggtcagatggtggagtgctacaaggtctcaatggaaagagttccgctgcaacaagccttgtggccgcaagaagaaatgtgggaggcatcggtgcagtgagctctgttgtccactgtctaggaatgttgcgcagcttgaaggtggcaactgggatcctcatctctgccagataccatgtggcaagaagctccggtgtgggcagcatttatgccagctactctgccacagtggtcattgcccaccctgcttggagactatattcactgatctcacgtgtgcctgtggcagaacttctctcccaccacctctgccttgtggaacaccaacaccatcttgtccacatcagtgctcagttccccagccttgtggacatcttgcctcacattcatgccattttggggactgttcgccttgtatcgtgccagtaatgagagaatgcattgggggacatgtgatgctgaggaatatcccttgcggatcgaaggatatcaggtgcacccaaccatgtgggaagaatcgccaatgtggaatccatgcttgcaacaggccttgccatcctcccccttgtgatcagacacctgcaaatggcgatgctagctcaagctctggtggcaaggcttcttgtggacaggtatgtggcgccgtgaggagagaatgcaagcatacatgcactgcctcatgccacccatcgtccccatgcccagatttgagatgtgaattttctgtgcctattacctgttcttgtggccgaatcactgcaactgttccctgtggtgctggtggatcctccatgggtgataatatgtttgaagtctccatcatacagaagctgccgatgcctcttcagtcagtggaatcaaatgggagggtacctcttgggcagaggaagctttcttgtgatgaggagtgtgcaaagatggagaaaaagagggttcttgctgaagcatttgacatcactccacccaatttggatgcattacattttggtgagaattcaagttcatcggatttggtttctgacttgttccggcgtgaaccaaagtgggtgctggccatagaagacaggtgtaagttccttgtacttggcaaggtgagaggcagttcttcaagcaatctgaaactgcatgtcttttgccccatgatgaaggacaagagagatgctatcagtctaattgcaggccggtggaagctttctgttcagtcggcttgtcgggagcctaggtgctttgttaccatccatgtcacatccaaatcaaaaccgcctgctcgcatcctgggatccaaggctggtgtacctgctacagctgcccatccttactttgatccacttgttgacatggatccgaggctggtcgtcgccatgcttgacctgccacgggatgctgatgtcaatgctctagtcctaaggtttggtggtgaatgtgagttggtctggctgaatgacaagaatgccatagctgtattcaatgatccagctagagcagcaacagcactgaggcggctggattatgggtctgcttaccagggcgctgcgatgtttatgccaagcagcgctcaggcatcttcaggcaatgtttggattggagagcagaaggatggggggttcgccgctaggaacaatccatggaagaagcctgcttctgctgagcctgatctgccctccggagactggtctggtgttgctggtcatgctccagcaccaggatggagaggcgtcaacactgcctctcaagtcatggggactacaaaccgatggaatgttctggaatcagacgctgctgcaagctctggttcaggcaacgagcggaagcctgctccgggcacagatgtgcacagcacagtatcaaacactgggaatgctgggccatcggtgaccaagctgcagccggatgtagaggtcgacgactgggaagaagcttgtgaatgaggtggcatcgggtagttgggtccagatgtttttcattgttctggaatctggttatagtttgctctgcttcgtaggtactgatgccatgttggtatcgagcctttatgttcttgcacattttaaagtagtttggtgatttaccggtagactgttgagtcataagtgctgattttgttacagaggcgaatgtgccggcaaatgaatctctgcaagaccgctgcttattttggcaggccttctgtggaattctgaagaaattatagtattaccataaggtttctatcttttattattggttattaggtttcgatggttatcttgtgttactcgcttaaaattagttgtgagagtatctgggtcacatgggtttgggtcttgtgtgctgacctgcgtgagaaaagctggagaaatgatatgcatgttttgcgtctgttaggcatctgtcgttgtggctggtagcaacgacagcggcttcctccattgctgtatctggcgctgcttgttcgtcccaaattgattgcagactaggctacaccagcgtcaccagccacggcggcttcaccggtgcctcttcctccacggagcctttctattaattttaaatatcaaggagattttagcctgtccgatatccttgctcctacaatctgatgaccgatttggtgaccagggatcacaggaggattgatgaggaaattagttcatttctccatcaatttcaatcatcctatgagcctttgttacaaatcaacctggttttctattctctccgtctccatctcctgctcggtgaaaacctggctgtggtggtagtccaacttctccgtcttgggattcagcttggtaaattcttgtttcaataatgttcaggatttgttattgcaattgtatacgcataagattgattcgtatgtattcctcatgtgcaaccctgacataaaagcaggtgagctgaattagcacttaagccaggttattcagatctgagaaaacacaagtaaaaaatctgcaacttactagctgagaaaacataagcaagcatctaacttagtagctgaattagttatgtcttagcatggagggagcatcgagatgttacataaacattttgtatatggaaattacatatagggatggcaacgcgtcgggttcggatcgggtagagtaaatacccgcccgcgatcatacccgctggggttatccatttccgccccatgtctatgcccactgggtaaaat

SEQ ID NO: 11904 - DNA, 1070 bp, Zea mays
cggccgggccgggctgccaaatcgcctcacgcttccgtttcgaatccttcgtcgcctcacgctcacgctcacgctgcttgctcctcctcccccccatccctccgcccctcccatggcgtccctcttcggggctcgccgccggcgatcgccggagtacgacggcgaggacgatagatccggcggagggagggccaagcgccggcgcctgtcgccggaggaggcggcggcgtcgccggcggagccgggcgcggcgacggggactagccacggctggctctccggcttcgtctccggagcgaagagggccatttcttccgttttgctgtcctcttcgcccgaggagaccggctcgggggaggacggggaggtggaggaggaggacgacgacgtatacgaagagggcatcgacttgaatgaaaatgaagatattcatgatattcacggggaaatagttccttatagcgagtcaaaacttgctattgagcaaatggttatgaaggaaacattctcaagggatgaatgtgataggatggtagagctaataaaatcaagagttagagattctactcctgaaacccatgagtatggaaagcaagaagaaatcccaagtaggaatgcaggcattgcacatgacttcacaggaacatgccgctccttgagccgtgataggaatttcactgaatcggtcccattctctagtatgagaatgagacctggtcattcttctccaggctttccactccaagcatcacctcagctatgcactgcagcagttagggaagcaaaaaaatggttggaagagaaaaggcagggactgggcgtaaaacctgaagacaatggatcatgcacattaaatacagatatatttagttctcgtgatgactctgacaagggttctccagttgatttggcgaaatcatacatgcggtcattacctccttggcaatccccattcttaggccatcaaaagtttgacacatcaccctccaaatactctatctcgtcaacgaaggtaactacaaaggaggaatacctttccagcttttggacaaaattggaggaatcacgaa

SEQ ID NO: 11905 - DNA, 2100 bp, Zea mays
gcccacgcgtccgcgaactcttcgtcgcctcacactggtgcctctctccccatcgctccgccactcccatggcgtccctcttcggggctggccgccggcgatcaccggaggacgacggcgaggacgatagatccggcagagggaggaccaagcgcttccgcctctccccggaggaggacgcagcgtcgccggcggaggcggggcccggcgcggcgacggagaccggctggctctccggcttcgtctacggagcgaagagggtcatttcttccgttttactgttctcctcgcccgaggagaccggctcgggggaggacgaggaagaggagaaggacgacgacgacgacgaagagggcatccacttgaatgaacatgaagctactcatgacactcatggagcaatagttccttatagcgagccaaagcttactattgagcaaatggttatgaaggaaacattctcaagggatgaatgtgataggatggtagagctaataaaatcaagagttagagattctacttttcctgaagcccatgagtatgtaaagccagaagaaatcccaagtaggaatgcaggcattacacatgacttcacaggaacatggcgctccttgagccgtgatcggaatgtccctgaatcagctccactctctagtatgagaacaagacctggtagtttttctcaaggctctccactccaagcatcacctgagctaagcactgcagcagttacggaagcaaaaaaatggttggaagagaaaaggcagggactgggcttcaagcctgaagacaatggaccatgcacactaaatactgatatacttagttctgtaaccacaaaggaggactacctttccagcttttggacaaaattggaggaatcacgaagagctcgtattggatcatctggaggttctgctgatgctcctaaattctggaattatggttctaattccaggttatttgagaatgacacctctatattttcattgggcactgatgaaaaagttggagatcctaccaaaatctataatgggtctgggaaatttgcagcaacagaaccagttggtggatgctgcttacctattacacccactgaagatagaactgatggtattactgagcctgtggaccttgcaaggaacaacgggaatgcaccccaagaaaaccaggttgcatctgaaattctccctgataaagttccagagggtaacgatgtgtcttccactggaattactaaggacactactggccatagtggagatgttaaagctcccacttcagaaccacatttaggggaaacacgtatcaactcagcatcagaatccataccaaatgatgcgggtcccccaacccagaacaaaaagaatgggccgacaatcaagaaaacattagtaaacggtctcgtggaccaaccaaatgccaactccgggctagaatcttcaggaaacgataaccctagctacaccaactcgagcagtgctgtgccagtgccacccgcaagcacccaaccagtcgagtctgctgccgctgctgtagacgttgattcggtcgagaaaggcccaggtacgacaccagagcaaccggcgaagcgaagggcacccaacgttcgacgaggacagagaagggtgctgcgaagcgcaacgagagaaggaagagcgacgtaggggatattgtgttatagcgaattaaagggggcaacacatgatccctagctaggttaactagagctatagcaatgactggccgtttccacgtacgagatgcgtagtgtgcatcaaactgtatccatgttgtattatcgtagtagtcgtaggccttacagtgaccacgcttactggttagagttggtcgttcaggaccagtagtagctgcttgatttgggtttcggtgtcaggatttggttaggtcctgtgtgtagtttgcgcagtcggaaagagactgttggttgtatttgcaggttgcaagcagacagtgttgtagccaccaggtaggaaatccagcgagagctgctcctctctgtatcatggacgctggtgtttcaagcgatgtactcatgtaacccttgttttgtgctgtgctatatgggcctttctgtgt

SEQ ID NO: 11906 - DNA, 857 bp, Zea mays
gccggccgggttggaaaatagtggaggtagtgccgacagaggcacgagcgcctccctcgtcttcgttccgtctctccccacagggaaccgccgcccgtcgcctccagatacgtgcctccggcggaaaatcggtatcgagctcgctttgttcgagtgagtaacgcgcagcgactcctctcccaaccagattttgatggatttcgggcacgcgtggcacagatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactcctgcactcgagttgccccctgtcatctcctgtagcaaaccgcccgctgtcgccccaccttcctctgaagaagccacagttcagcgcgactttctcaatctcgcatcgtatattcggtgtcgcgttgggagttgccatcgtatctgttcctctcgccaccaagttcagcctaatgtttggtgtctgagagcgatttgctgcgtctcatgagaaacatcattttccgtttctgtgtctgtttttcatcgtctcggttaccttgcgacacaactgtaggtgccgttggaataatatctttgccatgcttgcagacttgtgtaataagtaaataaacctataaaataccagtttaactgtttgaggagatttgcctcattatggatatacatgctacgaaaaaaaaaaaaaaa

SEQ ID NO: 11907 - DNA, 787 bp, Zea mays
actcctaccgcgcgcctggggtacctcgagccggccgggggaagcccaccatttggtttggttgtttgtttggtggacgccttgcttttcacttcaccggaaaccaaaatggcagccagcaggatccctccttgccatcttcacccttcttcttcttcctcctcctcctcctccatggccacgatctgcccaaggccaggcacaaggcagtcgtcggccttcaggttcagggcctctgctcatgggagcggttcctcaccacacctctcctccttcactgctgtgacaggcaagaaggttaaggtgttcgaggaccagctgagagggatcgtgtgctacagagacgaggacggggagatggtctgcgaggggtacgacgaaggccccaggctcggaatgcggctgccggagaaggcctccttcccatggcctgtgggggttcggatcacggacttcatccagctggcgacgctccaggtcttcgacgacgacgtcgatgttcttcagctcacgggtgaccagaactaaagcatgtaagcatagtggtgtcgtagtacagtacagtgatgggtatatgcaagaataatgcgtggtgttgctcttatttgctcaggcttacttgtttgtacataatcacttactgcaaggatgagattgttgtttaaagcacaacctttatgtatgcatatatatactatatgaattgagaaaattgagatctgaatacaaggataaaaacgcttgtactcaaaaaaaaaaaaagaaaaaaaaaaaaaaaagcgccccc

SEQ ID NO: 11908 - DNA, 800 bp, Zea mays
aaaatagaggaggtagtgccgacagaggcacgagcgcctccctcgtcttcgttccgtctctccccacagggaaccgccgcccgtcgcctccagatacgtgcctccggcggaaaatcggtatcgagctcgctttgttcgaatcttctgtatagccagcaaggaggcctctccatctcctccgggaagctattgtgcaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactcctgcactcgagttgccccctgtcatctcctgtagcaaaccgcccgctgtcgccccaccttcctctgaagaagccacagttcagcgcgactttctcaatctcgcatcgtatattcggtgtcgcgttgggagttgccatcgtatctgttcctctcgccaccaagttcagcctaatgtttggtgtctgagagcgatttgctgcgtctcatgagaaacatcattttccgtttctgtgtctgtttttcatcgtctcggttaccttgcgacacaactgtaggtgccgttggaataatatctttgccatgcttgcagacttgtgtaataagtaaataaacctataaaataccagtttaactgtttaaggagatttgcctcattatggatatgcatgcaaaaaaaaaaaaaaaaaaggcccctagggcc

SEQ ID NO: 11909 - DNA, 3072 bp, Zea mays
agataagttttaaactgtttttcccctttggtatctgatttgatacgcatatgtctatttctaattgcaatttatcatttgttaaatggatggtttgcctatcaaccagcttaaaattatttctcaggctgctgaagctgttaccacaatgtatgcatacacattgtttgtgtataggtgtgcaggacgaacaccatccggcacctatgatccctttgctaaaagaaacaaaattaggatggcaaaccataggcataaggtgtcatacaggcaaaactattgttgccaccttacattttgcactaatcatagacagcactaatggagcaaaccataattgtctatcttactaagtcctgttgactcaaacgcgtgaagaggataaacatacatcgttagagtgtacctgtgattttcttaatacaagaaaaattgaaggatctgacttataactacatttacaacagtgaaattttggatataatgattgaaacactgataaaccacagtatcatttatcttttacacaaaatcaactattcataggaatatacaatgtaatttcaaattcccattcaaatacataagtagtgccaggttataacacttattatggggggtgaacaaaaaatagaataaaataaaaatatcaattggaaaaactcccaggaaagtccagtgcaacgctaggtggatcagagttttcatccacttgatcccatgaacattaggacctggcactagaggtctgagagcaaagaagagcttctgcagaacaaaccaaactatctagtgaagcaaggcagtgctaccttattgaataggagcaatattacatcgctttggcagacatgcaagtcatggaagttttgtatagcaagtccacaggacatagtaggatagacctgtgtagtttgcttcattagtgatgttgatgaatgattgaaatgtaagttagctgcaagcctgcaatagtgtgactatgcttatccttacttagaatgcatgtctatatggattttcggccaagctctctgcctctctttaaacatgtgtgaagtgcgggtgcctagaattttaatatgttacaatgctcaaatttatgttctctatgctatcagatatatcatttttagctctgtgtacatagtcacagtggttagcattgatattgactagggtctaggaatttgcttaaatgtgttacttgggtttgttctaagccaccaagttcattaggatcaattgattttggtattctccaatttaattgatatgttaatctttctatgttgagctttgcaaaacttgtattcaaattttcttttaccaaaaccatgattctgtgctgatccgtgattattagctattgtgcaggctgtgcagcaatggagaagtataacagcaagactcagttagcacccttgagagataccccatttgctctccgtggtaagaaatcctgctctggtttgttatatatgttctctgtcatgttgtagtttcaagacaacaatcaatgatacacggacacccattaggagatagttttagcacactgtaatcaccccaaccacattatttgggatgccaacaaggactatatctctccaatcattttgcagtacgtagtcagaagttgctttcctaaatcttgaaaaacaggcgtgcgtgcttcctaaagcttatctttagggagttgttttgcaaaagtgttggagggcccgtttgcaaaaaggaaaaaaacgaattatggagttgttttaaggtacttttggaatataatgaatgtgttaggaagtgctacttctgacgggtgctgttgtttagcttttcgttggtgctggtgctctgcatctgcagccgaaacacagccaatgtttgcagttcatttcattacatatagttagctattataaatctggggcctctaataaatttgtctcattcatctttcaggtgctcttggtagttcaagctcataccttgagcaagccaggggctacacgtcttcccctctagcagctctgcgaccaaagatgtcttctactactggaaatcgactcctgcactcgagttgccccctgtcatctcctgtagcaaaccgcccgctgtcgccccaccttcctctgaagaagccacagttcagcgcgactttctcaatctcgcatcgtatattcggtgtcgcgttgggagttgccatcgtatctgtccctctcgccaccaagttcagcctaatgtttggtgtctgagagcgatttgctgcgtctcatgagaaccatcattttccgtttctgtgtctgtttttcatcgtctcggttaccttgcgacacaactgtaggtgccgttggaataatatctttgccatgcttgcagacttgtgtaataagtaaataaacctataaaataccagtttaactgtttaaggagatttgcctcattatggatatacatgctatgaaagtcgattgtcatcgcaatctattaactgcatggtgtgttatgtttgctcgtctggagaacgtatgcattgctaaacgttaagtttcacaaggtatacgtatgagcttatgttttgaagcatcattagggcatgtataacccatttaatatagggtctcttgagttgtatttaggaggctaattgaaaaaatatataagagacatgttcaaagaagagtctgtgtctacgcactctctctatatatgttgtctattaattgtatttataactgtctctatatatgttgtttattaattgtatttataactatatttatagtctagtgtcatcgtcttaggttgtacatgctatcgtgaagtgacaagcagttatttatatcatcaagtgagaagttattcatgttgttgagtaaagaggatatcgatacccaaacatggcaggccgtcatatccaaaggtttccaggttgtctgttttttttatacaataatgctggtgattgtgtgtttggttgtaaataatgggacgggatataacgtggttcagagggtcgggagtttgaacagaactattttagacacagaactattttagagccgttctcagggg

SEQ ID NO: 11910 - DNA, 869 bp, Zea mays
cgggaagtgcgccttgtgctggccccagggcgcccccggcccgaaaataaaaatagtggaggtagtgccgacagaggcacgagcgcctccctcgtcttcgttccgtctctccccacagggaaccgccgcccgtcgcctccagatacgtgcctccggcggaaaatcggtatcgagctcgctttgttcgaatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactcctgcactcgagttgccccctgtcatctcctgtagcaaaccgcccgctgtcgccccaccttcctctgaagaagccacagttcagcgcgactttctcaatctcgcatcgtatattcggtgtcgcgttgggagttgccatcgtatctgtccctctcgccaccaagttcagcctaatgtttggtgtctgagagcgatttgctgcgtctcatgagaaacatcattttccgtttctgtgtctgtttttcatcgtctcggttaccttgcgacacaactgtaggtgccgttggaataatatctttgccatgcttgcagacttgtgtaataagtaaataaacctataaaataccagtttaactgtttgaagggagatttgcctcattatggatatacatgctatgaaagtcgattgtcatcgcaatctattaaaaaaaaaaaaaaaaaaaaaaggccggcc

SEQ ID NO: 11911 - DNA, 953 bp, Zea mays
gaaaaaaaattctcaaactggtccataaggatcgtagcaaaaggaatcctctcaaagtacactgaacataaggtaggaactttggcctcagctctacgattttaaatgtacggttcgatccggatgtttgggctttgcgagtgcattgcgacgaacgcaaataaagtctttaccaaaatccaatatacacaggtaaaaaaaagcctgaaaagaaaaataagttctactgcttgcacacttcctcggccccacatggaagaaaagatttttcagcctttctctagtgccatcaatgctcgctcacggttcacacactcgtccaccagaccaccacgttgcgacttgcgagcctgtgcagctgcgtttgcgcatctggtttcttctgggtcatctatatacttctctcctagcaggaacaggaacagcaagccactcgctcctgccggcgagacgatggagcgggagccgtcgcgttccactgacatgtgggctaggtatgcgcttcgccggcgacgtgatgcggcacggggctggtggacccctgtgggtgcgccgactggtaccgaaccatcggtttgcggacgttctacccgaaggcggggtccggcggcgcctcaagcgtataggacctgcgcgttgcagggcgccatcccggcgaactcggcggagcccttgaccacctcccactccaccacttcgtcctcgacgccgggtaccgcggcggcggcggatgcggcggcagaaaccgtgcccacggcgacgtcgagcccggcgccgacgacgtatatcctccgcctcccgccagcgacctccccgagctcgccagcgaccacgtgcggccggcgcacctcggggggcaccccggtgccggccaccatccgccactcgtcccgggccccgtcgtgccgcttcagccgccactccccgtactccgccacgactcgtgccgaatt

SEQ ID NO: 11912 - DNA, 925 bp, Zea mays
  misc_feature (45)..(45): n is a, c, g, or t
ttttttttttttttttgtcaaattagtccataaggagcgtagcanaaggaatcctctccaaagtacactgaacataaggtaggaacattggcctcagctctacgattttagatgtacggttcgatccggatgtttgtgcattgcgacgaacgcaaagccagcttacataaagtctttaccaaaatccaatatacacaggtaaaaaaagcctgaaaagaaaaataagttctactgcttgcacacttcctcggccccacatggaagaaaagattttttcagcctttctctagtgccatcaatgctcgctcacggttcacacactcgtccaccacgttgctacttgcgagcccgtgcagctgcgtttgcgcatctggtttcttctgggtcatctatatacttctctcctagcaggaacaggaacagcaagccactcgctcctgccggcgagacgatggagcgggagccgtcgcgttccactgacatgtgggctaggtatgcgcttcgccggcgacgtgatgcggcacggggctggtggacccctgtggctgcgccgactggtaccgaaccatcggtttgtggacgttctacccgaaggcggggtccggcggcgcctcatgcgtataggacctgcgcgttgcagggcgccatcccggcgaactcggcggagcccttgaccacctcccactccaccacttcgtcctcgacgccgggtaccgcggcggcggcggatgcggcggcagaaaccgtgcccacggcgacgtcgagcccggcgccgacgacgtatatcctccgcctcccgccagcgacctccccgacctcgccagcgacaacgtgcggccggcgcacctcggggggcaccccgctgccggccaccatccgccactcgtcccgggcctcgtcgtaccgcttcagccgccactccccg

SEQ ID NO: 11913 - DNA, 1425 bp, Zea mays
attcgatgcatgattggtcacctaagtcctggattactcctaatttttagcaattgccacttgactctgtactctgtagttacacagtttccctgcgttgctcagattgtagcttgccttcatggctgctacttctaacaacagattcagtggcaaaattgatatatctaaaacagtaataccaggggcactagctagttatgtactacttcgacttcctcattaaccattgtaattggcttcatgtacaatctcctgcttgggtgccttttccttagttcttaattagttactatgtttgtcggctcccggatgacgctctcaagggatcaggagctgtcagagaaatgtccatcacaagagtgtgcaacgggttcaaaagactcagaagtctcagctaatactaataaaagcaatgaagatgaggaggatgattgggaggctattgcagatagtggtgcccttgatgacacactagtgcgctctcttgagcaaggagctagagtatcttcttgcagctcccccgaaaaaagtagcaccccatcttcagggcccaaaaggagggggaggggctcatttctttacaataagagtgttttgtacagtgaccagtgtggttcggaaagagagttggataacaaacagtctaaacctcaggttggatcaaaggatcatgtgaatgagccagagaataatgctgttacagctgctacacagtttgggacaaggcatgtccttgttttttatgactttccgccaagtacacgcacaacagatctggaaaggatttttgagaagtttggggatcacggggttgccattcgctggattaatgatacttctgcacttgctgtttttcggactccatcagctgctaatgaggctcaagcttgcatacctccaagatacaaagtacggtcactgaagccggatgatgatctattgacaaaaatagatggtagagacctagatccgcccaagccaagaccaaagacatctgcaagaacggctcaaaggctaattgctcatgggatgggattgaaacagttcacaaactttgggtctgatgagttgaagaaacaggagggagagaggaaggacagaattgccgctagacaagcaatgcgtgatgaggcttggggttcagattgatggagaacatactatgattgctggtcgcccacatcatgtctgcgagtttgttacattggtgttttagatgcttgtactctttgcatggtcaaatgttgattttgatacagagaaatctgacgcgatgtgtatcgtagtggcgacgtgtacgccaagcatgttgtacgggcagcaagggattaggatgagatttttctgaactgaaaagcaaagcacgcgcagcactatattttgcgaccttaaaaaaaaaaaaaaaaaatcctccaggaaggg

SEQ ID NO: 11914 - DNA, 533 bp, Zea mays
aactaagagagacccagatagcaattaaaacttttacagacatactttaaaattttatagacttgcaaccgaaatacactttattctttcttcagcctagtccgactaccgactaagaccgactcagctccggcgaccctcaaaccgcaccagccatggacgggccgcgttggacggaagaggtggacgacctggtcgacgccggcgacgtcgacggcgccatcgccctccttgagtccgtcgtctccgatttgtcaacctccgctgctccccctgccactgaccttcgcctcgccacggcgctcggcgacctcgcgggcctgcacgcctcccggggagacaccctccgagccgacgagctccgcgcccgcgccatcgcccttcggtcccgcgccacggtccctgggactgggaccctagggtttgtttccccccctcgtcgtccttgttgctcttgtagttcgttggtggaagcccttcgctcaggcctcatgtttcaactgcttagttattgctctattgggctattatta

SEQ ID NO: 11915 - DNA, 2676 bp, Zea mays
tttgtgcgactttatgggaaggtatgaaaataggtgtttttgaagcatccttggaggagattcaaaaatttcatgaaactggtctctagtttcagtttttttaagctaatgctagtggagctggacctgttatttggacagaagaagttaaaatataaatatgaaattattgaagtgaagctctcccaaacggggcttatatatactctaagaaacacacaagtccagactaaatgatgaaccagataaaataaaagaagtgatggcggtgagtgattattgtcaaatatagcttggcagttggcccccggccctctagctacctaggaaagaaaataattaaaaaaaagtaataaagggctgaacagtcgccctcaaataatgtattggttgtcgtctccagctgatattagctggctactcatgtcatatatagtagtgaggggagtgaggactagtacaggacacgacacgcgccctttatattcctgtgacttgcttgagccgtcgtcaatgagtgtgggcatgcatcactatgtatgcatgtgttgtacgcaaggtatgtcgacgcggattcgttgctcatttcaccggacggcgaaggaggaggggcacatgtatgcatgcgtacaagctggctagccatgtgcgcgtgctacctagctagctgcacatcatgcatgcattattcatgccgcctaacagtatatatatatatatatttttatatatatatatgtatatatatatatatatatatataccagcgacaaatcatattaattaagcatgcatgtagcaatatatatatggcaatagcaatggatgtcatgtgaatcatgtgatgggatggaaggtgatgggtgaggtggttagcgtgccccatctatcggccggacgcatcaactcacatgaccgcacgtacgcctagctatagctagctaataaccattccatcatccaaaaggaccacgccctccaacatgtctccttgtctgccttaactacgccctcccctgcatgtctccttcaggtcgttctcagcatgcactctggtagtaaacaaaaaaaaaaaatggtttaccgtacctaacgatcgacatgttaattaatagcatcgaggatggttgccaatgattgatttgcctctgggcgctggctcgtcgccacactgctgctgcagcaacggtgtggagcagagatccgtcgtcgtcgcgctacgccaccgacagaagctgcagggacgcgcacctgggctagctgtcagcctcgcccaccagttcattctgcaaacctcctgcccaacaccagtacgtacgtacgtactgcatgcccccctcaacgacccatcttctgcgctgcgcattagtattcttttctcccagcagcatgcatgcacatgccgtacgtgtagtgctttgggttcttgcatttgcctcaactcgcccggctgctaaattctcacacaaggctgggcgagctcttggctctgatctgctgttacagccttacatgacagtgacgcaacgcaaaccagtggggcaaaaaaaaaaaaaggaacatgaatgcgcacagctagcggctaccatgggctacactacatgcgcagctagcatagcatagcatatatagggcaggctcgtgcatgtgtccaccacacacaccatgtgtagctagctgggccatgcgtcgtctcctccccattacaacaaggtcgagatggaaagcacccgtacctgctgctgcagcacatacccgttttaaaagggaatccaacaagagcgcgtgtggctcgtcgatgctgctgagagcgagcactcagttcatcacacccatttcagaccttgcgttccatatatatgtatgcttagtaggtgatcatcgataggttgccgaggccagctagctcttgcgttgattaggaaggaaaacgtagctagccagccaggttgatatttagagttgagagggtacagaaatacatacagaggccagtccagaccatagcgctagctggctgagacggccgagaggaacgaagacgatctcgatcctgagctctgggcatgatgaagctcttgttccagtgtccctgctgctcctgcttctgcttcatgaagacggccagcagcaagacccaacacggcggcggcagcggcaacaaggagggagcagcagcccaccaccagcgcaccggtaaactgcaaggagtagtggtaggcaaggccatggagatggtgtagcttatcatgcatttgtgtccagtccagtattcagccgctgcttatatatagtagctattcttctttcgccaccccccacccccccacccacaggtaccggcagcttgttcatgctctccacaccacattatgatcactcatctgatcatcttgcattgtgcgtgccttcgggacaggttctttagtaatcttgtgtgctagctgcgtcgtttctccagcactgcagtacctccctgcaggctggctagtgaactactgctgtattattaggagttaggttcctcttagactgagtggtaccatcagctgctactccactcaacggaagcatgcagcaccgcttgtctgcaatcaccccccccccctgttttgtttgttcttctattttctatttttggctcgtccagtctcgccataaaaaaaaaaaaaaaaa

SEQ ID NO: 11916 - DNA, 838 bp, Zea mays
  misc_feature (822)..(822): n is a, c, g, or t
cgattgggtacctcccggccgggcctcgtcgatgctgctgctgagagcgagcactcagttcatcacagccatttcagacctgcatccagagggttccatatatatgtatgcttagtaggtgatcatcgataggttgccgaggctagctagctcgatcttgcgttgattaggaaggaaaacgtagctagccagccaggttgatatacagagatacatacataggccagtccagatcatagcgctagctgagacggccgagaggaacgaagacgatctcgatccagagctctgggcatgatgaagctcttgttccagtgtccctgctgctcctgcttctgcttcatgaagacggccagcagcaagacccaacacggcggcagcggcaacaaggagggagcagcagcccaccagcagcgcaccggtaaactgcaaggaggagtagtggtaggcaaggccatggagatggtgtagcttaccatgcatctgtgtccagtatcagctgcttatatatactagctagctattcttcttgcattaatattgtgcatgcgtgccttggggacaggttctttagtaatcttgtgtgctagctgcgtcgtttaatttctccagcactccagtatctccctccaggctggctagtgaactactgctgtattattaggagttaggttcctcttagactcagtgtaccatcagctgctactccactcaacggaagcatgcagcaccacttgtgtgtgcaatgccccccttgttttgtttgttcttctattatctatttttggctcgtccagtttcgcccacaaaaaaaaaaaaaanaaaaaaaaaaaaaaaa

SEQ ID NO: 11917 - DNA, 1672 bp, Zea mays
ctgcgactacaaggctgcctcacagcgcgcgcgggggcgggcgcctgcggtgaagagtgagatgcagagaggacgccaaattacggcgcttgctaatgatctcagcacactggagaggacactagggcagtctgggctgaaggagcgggagatgctggcattatcgcacaagcaaaggcagctcaagggtcagctgcgagcattgtgtggctatgactcattgaatgatgtgttggattatggggataagctgcttttggcaccaccgctgatgcatggggagtggctcccacggacggcggtgtttgtgctcgtagatctcatggttgttatggtaggtcgcccgaaagggatatttaaggagtgcgggaagagaataaattcaggactccggctcatccatgatgaacttgtgaagcttggcattgtggatggtgtgatggaggcagatttggaacactcaacaatatggacagcagggctgtacttgatccttttacttcagtttctggaaaacaaagttgctgtggaacttacaaggtcagaatttgttgaagcccaagaggctttagctcagatgaaaaactggtttactcgcttccccacaattcttcaaggttgcgaaagtatcattgaaaatttaaggggacaatatgcacattctgttggctgcttcgatgaagcagctttccactttcttgaagcaaaaaagctgacagagagtaaatcaatgcaatcgatgtgtgaaacctatgcagctgtgtcatatatttgtaagggtgatgcagagtcgtcttcacaggcactagaactggttggtcctgcctatagaacaatggactcatttgttggtgtgcgagagaaaacctgtatcatttttgtttatggactattacttatgagacagcataatccgcaggaagcacggaaccgccttgcaagtggtttgaaaatagcgcaccaacagttgggtaacatccagttagtttctcagtatttgacaatactgggcacattggcgcttcagctacatgacgcagcacaggctaaagagatcctgaagtcttcgttgaccttagctaagacgctatttgatattccaacccaaatctggatcttgtcagtatttacagagttatatcgtgaactggaagagaaggaaaatgaaatggagaactctgagtacgaaggaaagaaggaagacgatctgcagagaagactttctgaagcttattctcattcttttcaccatgagctggtggaaaaatcaagaatccagccgctgcacatgtcaagtaagcagccagagatggctgttccatcagctaatggtgatcttgacatcccagaatcagtggggctttccgctccccagccattcctcaaaagacttgttgaggccgagccgatgaggcgcagtaccaggaggcggcggtagtaatgaaactagtactgtaattaatagcgtagtgaatttgttggttaagtgttgttatgacttgtaacttttagcagtttaggtttttattttcttttgtttgttgtgttgattatgtgtatcttggtttagaatttatagatttggagaactgttggattgacaacattctgagtggtaaaataccaattattccactgtgttgggacggcgtgttgaaaaaaaaaaaaaaaa

SEQ ID NO: 11918 - DNA, 2115 bp, Zea mays
  misc_feature (1958)..(1958): n is a, c, g, or t
agggttccgtaggggactctccatctagctcttactatcagagcgaggaccaggaagattcttccaagagggtgccgatccataatgatgaaccacaaggaaatctgctaggcgagcaatgcactgacaagcgaactagaaagccaacaaaaagatacatagaggagctatcagacattgagactcatgactcaactgtaaaaaattcttcaccagcaaaaaaggcctgcacatgatgaactgttaatgaacccgcgagtagcacctttcaatgagactggttctctgggcacaatctatcctactagaaaggatacctttggaggatttagtgtacacgttccttacgtttcaaggatgagaagggggcgccctaggaaggacttcatttcatttgcggataagggaccctcggttgaacctaaagggattcagccatcagttgagatgatattagtgaaggatggtgacaagggaaaccacctgaggaaagtacctgaggttccactaaaggttagttctgagaacgagcatgcagaagcagttgatagcaaaggggttcggaacctacaagcaaaggtctgcagtgctgtttccaagcctaaaataaagcatggtttaacgcggaagcatcatcgagcatggacattgagtgaggtcgtgaagctggtggatggtgtggctcggtatggagctggcaagtggtctgagattagaaaactgtccttcgcctcgtattcctaccgcacttcagtggatctcaaggataaatggcgtaatctgatcagagcaacccagacacagcttccggcgcaaaaagatggtgcctgtccacggaagactaacccttctatcataccaataccaccatccattttgttgcgagtgaaggagctacatgagctgcagtcgcaagggggtggcttcacagccccagtcaagttctctgggcaggacggcaaggttctacagggaaaaggctcgggttttttgtgatccgtgtaatgcagatatacgtgtacgcttctggacgatgtggtatatatacgagtaaatattatttgaagtaggtgtaaccacgttatccatcacaatgttctctacacgctggaacatgtgtaactcaggacgtccagaaaatattgttatacttagataagggcagacgtctgtcgccatgtattacaaacgtgtcaggcgtacacaatttaaaaggcaaatgcaaatctagacaggaagaggaaagttagagtaaacggaatgttgttgcagcaataatgaactaaactagtattggcggtgcattacagaatggagggcatgtttggtttcatgcctaacttaccacattttgccttacttttctgcctaaggttagttctttaatttgaacgactaaccttaggcaaagtgtggcatagttagccacgaaccaaacagacccagaatccgccttgtaaatagaggcaaacagctttctcgtttcggcttctgctttataaattgctttggcgcaaaagacgacgttttctccagcactggttgattcatgggcactgttggagcaataggaatgtccaatcacatcaaactaaaaaaaaagtaatattaaccacaaagtagcttgagtgttgaactatgcataagcttctataggagatttgcagtgtctgatttagtactaaaactagatgtgatttacaatcgtcatgcggaatggtagcacttttttttccccattttgctgcaagaccgacttagccccatgctgccgataaagcataatttaccactagcttcccatcaattccaaagttctttctagatgaaaacctatgagaatcattaaatcatgagtgcacagattgcaagcgggagatgctctatgattttttttggatgaaaccttgcttcatcataagacaaaggccccgattttttttatccccagattttgngtatagaagtgaagaaaataaatggaaacaaattactgaaagaaactcaagttttgatgctgcaagttgtaacaaaggggtacagatagatatggagataacctttcaaaaaaatgtatgcgtagagttatcctttcctcaggtaaagcttggaaga

SEQ ID NO: 11919 - DNA, 1207 bp, Zea mays
  misc_feature (6)..(6): n is a, c, g, or t
gccggnacgttgtcgctcccgcgcccgaccttttcctcccctcttctctagatcgcgacgaggcggactccccactcctgctgcccggagcgaagcggaccgcgtccccgccgcgtggcctgatcgatccctcagctctgccggtcgggccaatgctgcgtgcatcgagctgccgctgatcacgattatagggtttaatacttgtatattttgattgtcacaaatgttggatgaagtttgacttatctatggaaatggatgactcacatggcaccatggttaataaaagtgaagagaatgactttgaaaagaaaggcacttctgatcctgtggtttatcagctagttcgggttgaaggtgatggaacacttgttcctgctacagaggatgatgttttgcagtttgaacatttccttcacaacgagaaggttgatcttcctcctattgaagatgcagaccatgtggaagagtttttcaacaatgactgcatgttactgaagaagcctgacttggaagatggatcttccaaattggagactgtggaagcacacacacaaaaattgggtgccaacttagaggaaaacatattacagtcattggatgattcccttagtcctccctcagactttagaattcatagtcagcattcagataaattgcttacagaacaaggggcaaacgtcactcgacaggacaatgcttcaactgagactacaaaatcgacagtgttaaatgactcttgctgtgctgaaaaatataaggctgatgcctgctcaagatctgtatgcgacacatctacagatccatctgtttcgggagttaatagttccatgcctgatttttccatattaagaggagaagtctgtttggatgatcttactattagagaacttcaggaggcgtttagagccacgtttggccggcagactaatgtcaaagacaagatatggctcaaaagacggattacaatgggcttgactaattcctacgatgttccaagttcaggttgtgtagttaaagactacaaaattgttggccaggatgccaaaaatgatatgtcagacatggatgaaagagctaagactgggcttagagctacttctgtggttatatatccaggaaacgaaggggactctccatctagctcttactatcagagcgaggaccaggaagattcttccaagagggtgccgatccattatgatga

SEQ ID NO: 11920 - DNA, 915 bp, Zea mays
  misc_feature (37)..(37): n is a, c, g, or t
gcttgatgaaggtttgaaccgtggttggggatttcgncctggccaagctggtggacggtgcagaagacgcccgtgactacccaggtccgtggaaccatgggtcacatcgcccccgaatacctgtccactgggaagtcctccgagagaaccgatgtttttggctatggcataatgcttcttgagctagtcactggtcagcgtgccatcgacttttcacgtctggaggaagaagatgacgtgttgttacttgaccatgtcaagaagctgcagagggaagggcatctcgacgccatcgttgaccgcaacttgaacagctgttacaacgggcaggaggtggagatgatgatccagatcgcgctgctctgcacgcaggcgtcgcccgaggaccgcccgtccatgtccgaggtggtccggatgctggagggcgagggcctcgccgagaggtgggaggagtggcagcaggtggaggtgacgaggaggcaggactacgagcggatgcagcagcgcttcgactggggcgaggactccatctacaaccaggacgcgatcgaactgtccgccggcaggtgacgacgtcgggtcgtcacacggagcttgtcgtcgtcgacgtcgcagtgccgacatgtaactgtatatgtaaggcattgttgcgaagcttgttagcaaaatataatctgtgacactcacttagtgttgatacgtgcctgtattttattatttgtgtgtgtgtgtataaggaaggatgatttaaacgggttcaggtgtttaccggttgtccggctcccatcctgtaaagctctatataggggggtggggaccggttgaaaccacatcacatgcaagctgcaagaattggcttgacaaatatttaacgaactctattgtcgacagaaaaaaaaaaaaaaaaaagcggcc

SEQ ID NO: 11921 - DNA, 2578 bp, Zea mays
ttgggtacctcgaggcatcgaaaaatcggcgtcgccatctccggagtgccacgcctaggagctattctctctagtactgcggcgacttcactccaagcctcccccttcagcgatcagcacacatcacgtaaagcgcaaccaaatgatttccaccaccgtcgctgctcaccccgccaccgtcacagcgctgcggcgaaggtacccgcttcgccctcgccagccactctgtgctccaatcttcacggcggcgacgaggcagtgcatggctacggcgaagccctcggtcacaaacgcgctcgctaacctatccgttgagagcgcccccgcggcgcttcccaagctttcgttcccgatactggtgaatagttgcactgggaaaatggggaaggctgttgctgaagcagctgtctcggctggtcttcagttagttcctgtatcattcagtgccattgaggtccctgatcgaaagattgaaatatgtgatagagaaatttttattcatgacccatctgaaagtgaaaaaattctgcctaccattgttaaagaatacccaaatgtcatagttgtagattacactgtgcctgatgctgttaatgcaaatgctgaactctattgcaaatttggtttgccatttgtaatgggcacaactggtggaaataggcaactcttgcacaaaactgtgcatgatgcgaatatctacgctgtgatatcccctcagatggggaagcaggttgttgcttttcttgctgccatggaaattatgtcagagcaatttcctggtgcattttcaggttacaagctggaggtcatggagtctcatcaagcaacaaaattggacatttctgggactgccaaggctgttatctcttgttttcagaagttgggtgtatcgtttgacatgaatgaggtaaagcaagttagggatcctgaggagcaggtaacgttagtgggtgtcccagaagaacatctcgggggccatgccttccacatgtaccatctcacttcgcctgatgggacagtttcgtttgagttccagcacaatgtatgtggccgttcaatatacgcagaaggaactgttgatgcagctatgtttctctacacaaagattcaatcgggtgcgagcaagaaattgtatgacatgattgatgtcttgagagaagggaacatgagatgaggtccatgttggcgtcagatgagctttcatgtaccaatttgcaagctcaattccaccgtgaattaggttacttttacaatgtacccttcccaatttaccagttaactcactttcagttttgaattggctgcttcaatgatggaaggtactccgttccagagtgtatgcaattttagtttctctaggtatattgattttggcgttttgctatacacctatatgcaatctatagattgtagtaaaaaaaatgtattcagaaaggccagaatgatctacaatttgaaacggagtaatgcttagggacttaatgctttgagtcacgtccagccaaggatgctcgctcaatttattaactttatcacactggtggctgctagttgggtcaacccttggacgtgagtagcaaccataggaaatcaaaggtggtctgtggtttacctttctgacttttgggagttgggacttgcacaccatctaatattccacctggatctcagagttagttggctcacttctgagttaaagcacttgatgtcttggttggttctaacccttctggcttttattgtactagtgtattgctgtgcgcatgcgcgcggtgttaggtgttaaatccgtttgtgagattttaatgtgtacacaaataagaaacaaagaatgtactctccacccattgcttctttcagcgcgtcatcattgtcaaaccattgataaaggattttaagttgtgcataaataagagacagaatgtactctccatccattgcttctttcagcgcatcatcatcgtcaaaccattgataacgtttgtcatgtgtcttttagagtgatgctagatgtcggcaaatatcaaatactggtcctaaatctatttcacagttactataacaacatattttgtcagaaagtgggcagtttaaaggttttccttctactttttgagctatacagaacgaaaagtttctgttgcaaaacatgttatttcattatgaccaacccaaggggttcgacagcttctcccgagaggacacaccttttagggatatatcccttcatgttgtatatatatctatgtaatcactgcaataaaaaacaactgtcatttatcattctctctattctctgtgtctcgttaccactgtcattcaagacgttatcagcacttgctctctaccgagcggttaccgacgacagcgatgcgatgaaatggccaagccccaacgcacgcctggcgagcgtcggcgcaggtgcctggcaaccagtgcctgacacaccctacagcggtggtgatggcgctcacgtgcatggccgaccgcgatgtccatgcacccggcgccggcgcctgtcggaaggaggccgtctgcaatgcatcagcgtagagcaacattactggccagaagtggc

SEQ ID NO: 11922 - DNA, 1227 bp, Zea mays
ggccattgggtacctcgaggccggccgggaggacacaccacccaaactaaacaacaccagcttctctaaagatcacaatgatgagagccctggcggtggtggccatgctggccaccgccttcttcgctgtgcccgctcgcgccgagcagtgcgggtcgcaggccggcggcgcgctgtgccccaactgcctgtgctgcagccagttcgggtggtgcggcagcacctccgactactgcggcagcgggtgccagagccagtgcagcggcagctgcggcagcaccccgaacccgccgagcagcggcggcgtggcgtccatcatccccgagtcgctcttcaaccagatgctgctgcaccgcaacgacgcggcgtgccccgccaacggcttctacacctacgcgggcttcatcgcggcggccaacgcgttcccgggcttcggcaccacgggtgcgcccgacgtgcagaagcgcgagctggcggcgttcctggcgcagacgtcccacgagacgacgggcgggtgggcgacggcgcccgacgggccctacgcctggggctactgcttcaaggaggagcagggcggcgcgtcggggccggactactgcgagcccagcgcccagtggccgtgcgccgcggggaagaagtactacggccgcgggcccatccagatctcctacaactacaactacgggcccgccggccaggccatcggcgccggcatcctcgccaacccggacctggtggccaccgaccccaccgtgtcgttcgagaccgccgtctggttctggatgacgccgcagtcgcccaagccgtcgtgccacgacgtcatgacggggcagtggacgccctccgccgctgacacggccgccggcaggctgccgggctacggcgtcgtcaccaacatcatcaacggcggcctcgagtgcggccatggcgctgacagccgcgtcgccgaccggatcggcttctacaaacgatactgtgacttgcttggggtcagctacggcgacaacttggactgcgccaaccagacgcccttcaacggctaattaataagctagctacctcaccatgcatgcatgcattattattagagaacacaataagacctgatcgatatgatgatgggtatgcatgtattactttactacacgcagatccagcaatcaagaataaagcaaattaatgtttactcattggttgattaatcccatgatcgagtgggtttggctc

SEQ ID NO: 11923 - DNA, 1207 bp, Zea mays
  misc_feature (1093)..(1093): n is a, c, g, or t
  misc_feature (1174)..(1174): n is a, c, g, or t
cattgggtccctcgaggccggccgggacacaccacccaaactaaacaacaccagcttctctcacgatcacgatgatgagagccctggcggtggtggccatggtggccaccgccttattcttcgctgtgcccgctcgcgccgagcagtgcgggtcgcaggccggcggcgcgctgtgccccaactgcctgtgctgcagccagttcgggtggtgcggcagcacctccgactactgcggcagcggttgccagagccagtgcagcggcagctgcggcagcaccccgaacccgccgagcagcggcggcgtggcgtccatcatccccgagtcgctcttcaaccagatgctgctgcaccgcaacgacgcggcgtgccccgccaacggcttctacacctacgcgggcttcatcgcggcggccaacgcgttcccgggcttcggcaccacgggggcgcccgacgtgcagaagcgcgagctggcgcctggcggcgttcctggcgcagacgtcgcacgagacgacgggcgggtgggcgacggcgcccgacgggccctacgcctggggctactgcttcaaggaggagcagggcggcgcgtcggggccggactactgcgagcccagcgcccagtggccgtgcgccgcggggaaagaagtactacggccgcgggcccatccagatatcctacaactacaactacgggcccgccggccaggccatcggcgccggcatcctcgccaacccggacctggtggccaccgaccccaccgtgtcgttcgagaccgccgtctggttctggatgacgccgcagtcgccccagccgtcgtgccacgacgtcatgacggggcagtggacgccctccgccgctgacacggccgccggcaggctgccgggctacggcgtcgtcaccaacatcatgaacggcggcctcgagtgcggccatggcgctgacagccgcgtcgccgaccggatcggcttctacaaacgatactgtgacttgcttggggtcagctacggcgacaacttggactgcgccgaccagacgcccttggacggctaattaataagctagctgcctgaccatgcatgcatgcattattgttgngagaacacaatgagacctggtcggtttggtgatgggtgtggggggctttgctgcgcggcggtgcctgggtgggggatgagnggggtgggggggtggggaaaaaaaattttttag

SEQ ID NO: 11924 - DNA, 2681 bp, Zea mays
atcgtaacggatcggaaataaggtagatagattccacgagttttcctctcaagaaaggtgggatacagcttcagcacaaatcaaaaggaaaccacggaggctacagtacattccaattcccaatattccatgaaatcagtacttgaataaacatcagataatacctgatgttatttgtacagcaaaaaaatttatagaatatgctaactgataatctgagatgtccacgaagagacaaggctgtaagcatcgaagtataaaggctatctacccgctctacacttttggcagaagatttgtatgtcttgcactttatccgctggcgacaatctcatgaatcttatcactgacttcagggtcatctgatctcacagctaatttcattgccacttcgttgggcccgctcagtccaaatgacaacctaactaggaccttcatgttgccaataaatacaccagatagaaggcaggtgtgcgatcttgcatttttcggtacaacctcagtgccctcacacggctgcattccaaggatattaatgacagcattgacagcctcagccaaactttctctaaccccgagtccatactcatcgacacgctcactatctgggtccatattttcccaggcgttcctgaagttggagacaacaaccctcagcatataatcagctgaaacaatttcaaagtcctctaactggtattcatcctccacaccatcctcatcagcttcccccgtagttgtgtcaacctctttaactgtaaacttcaacaaatttaaaaacttcccaacaacaggtacacgctctggcttttcaaaagcaacaaaaacttgcccaggtgaattatacggcaagcttgcaagaggctttgaacaaatctctgaaaactcctcagcatctgaggcatcaacgcaaacagtgacatcttctagcagttgttcttctatagtgtttgcacaattgtactgcaatacaatgtagccgtcataaatgtgtttaaccacactaacagcatattcagtttctgcctctgtcagctccatgggttcagaggacttgaagagccttccaaacccagagaactcgggaatgaacgaaagcattttctgataagcatcaacagttgaaacaggggcggcggcggcggcagcaccagcaggtggcctcttgccaggggctgccttctctttaggtggtagcgacctgacttctcttgacaccaaagatatgtcaaatggctcctctgaaggttcataagttcttaggcttgcttccaggttggctaatggcacatcaaaagatccaaataggaagtctttcacatccttctcatcattaccaatggcaacttcaccgctaagggtttggagatagagtgtagcacgatcacgaacctcatcttcagtatcaaacaggcatcgttgcaagagaacaaagatctgaggcttgagcgtatcaaccagggcaccaaactttgccagcgtgctgacagcactagcacgaacagtggcattttccaatatcacacggttgtatatgtagcgaatgtacctgcttggatctgatgtccttggtccttcatttcccaaaaagtgcaaaatctgactagaaagatatgtgaattcacagtcttcgatgaattcacaaagatgaagcaggccaatttctttggcatctggtatttcactgaccaaagtaactatggaatccactatggcttttttatactcaaagcccccttcttccctcaagctgttgctcaaaaaattcaacattgagcgatattttagtgggaacttcaggcacaaagaccgtatagcttcaacaacaactatcttgaattcatctgctatgtcagacatgaaaagggtaatttgtttaatgagacgatccacacttgattcattgccagttttaagaagagtagtgattgccagggtcgctatactcctgttctggtctgacaacaaactctccaagtccacattgcagtttgtcaccgccagaggtcgtgtcctagcaaccttattgagagtccggacagcagcaaatcgaagcacaggcttggatgaactcaagtataactgtaacaaagtaattgctggtgccaattcacggcttgtaacatccatctctgttatcttccgtgcagcttccaaagccaccatttctgctttatgtctgagggatgattccagaaaatcaaaaaatggacggtcaccattttgagtgttcatgcttgactcacacataacctggcttgtgtaacgaatcagaagacattgtgcaagaggagaacggacagatccccttgtcaaacttgaaactagtttgcttacagctaaacgatcattctgtctaatctggtgaagaagagcaaggccatgaaactggacaagtggagctcttgattgcacagcttcctgaacttcgttgctccatcttttcacaatttctgggtttgcctgggccaggtggatgccactaacaagagaagcactagcaaccactgggttcttgtcaacaatagcttgcttcaaatatctctcaatttgagttagtagggtaccatcaattattctacaaagaactctaatagcattggcacggtacatggggggggggggggggggccccctccccggggggcccgcgactatgatgacctattacaatcataaag

SEQ ID NO: 11925 - DNA, 3643 bp, Zea mays
  misc_feature (1327)..(1327): n is a, c, g, or t
gcccgcgcgaccccctctcagccacaccagcttctctcacgatcacgatgatgagagccctggcggtggtggccatggtggccaccgccttattcttcgctgtgcccgctcgcgccgagcagtgcgggtcgcaggccggcggcgcgctgtgccccaactgcctgtgctgcagccagttcgggtggtgcggcagcacctccgactactgcggcagcgggtgccagagccagtgcagcggcagctgcggcagcaccccgaacccgccgagcagcggcggcgtggcgtccatcatccccgagtcgctcttcaaccagatgctgctgcaccgcaacgacgcggcgtgccccgccaacggcttctacacctacgcgggcttcatcgcggcggccaacgcgttcccgggcttcggcactgactggacgcctctaagtcagaagcgcgagctggcgcctggcggcgttcctggcgcagacgtcccacgagacgacgggcgggtgggcgacggcgcccgacgggccctacgcctggggctactgcttcaaggaggagcagggcggcgcgtcggggccggactactgcgagcccagcgcccagtggccgtgcgccgcggggaagaagtactacggccgcgggcccatccagatctcctacaactacaactacgggcccgccggccaggccatcggcgccggcatcctcgccaacccggatatggtggccaccgaccccaccgtgtcgttcgagaccgccgtctggttctggatgacgccgcagtcgcccaagccgtcgtgccacgacgtcatgacggggcagtggacgccctccgccgctgacacggccgccggcaggctgccgggctacggcgtcgtcaccaacatcatcaacggcggcctcgagtgcggccatggcgctgacagccgcgtcgccgaccggatcggcttctacaaacgatactgtgacttgcttggggtcagctacggcgacaacttggactgcgccaaccagacgcccttcaacggctaattaataagctagctacctcaccatgcatgcatgcattattattagagaacacaataagacctgatcgatatgatgatgggtatgtattactttactacacgcagatccagcaatcaagaataaagcaaattaatgtttactcaaaaaaaaaaaaaaaaaagcggccccaaaaaaaagcggcctccaatccacacccactcagctctgagctcgatcgatatgcatggcctgggtgcgcacgggcaccgaaatctcatagaattatataatctagatcgatatgcaagctaggaggatgaaaatnccatgaggagaggagacagataaagtcagttctatatatataatacaatatatgcatgctatctagttgggtctctttgtttaggattataatctatctaaattatataatccaacttattttaaactagtatttaattaaaattaatttagattatataatttacatatagattataatcttaaacaaacactctcgacacttaattatgtgtgtaaaacatcgcagcaatatatattatgcctacctagctcaacaacatagtaagatattttggatcggatatgcatgccgcgccatgcatgtatgtattaacatgcagttcgttcgtgcaacgccactgagaaaaagcgcgcggcaaccagaaccagtcaatatccacactgttttcgtacttatatcggatacccgtcctattttcatctctagtaggtcatcgtcgtcgccccctgcccccgcgtaatgcggcgacccacaacggaaagtccagtagtcttctatggcggcgcttgcatgtaaggcctctgcggagtgcggactgcggacagcttgattggatggtggcgcacgctgcacatcctagcatggcattcacgtaataatagaaccaacctacatgtgggctgctttgctttgaatgttgttccttatatgtgttttgaacatacggtggtactctatccacgtaaagatgacaatgtatacccgatattggatgggtacaaaaatatcattagaacaaggatataacgaattttgttgtccacggatatgatatattctctcatgccctatacctgctgcccagaaactcactaacctatgaatgtgggtctaatttattataagtgctccatataaaataaaatcccaaaaccacaaccctaattccttgtgcgaagttgtgtaaaaatcagctaacctataacatgtttggttcgataaatttgtcatgctggacacaaagataatatgctattttaatatctttcattgttgataaggtatgaggcttcaatattttgtaattaccacttacttttgtgattaaattgatcatatctactggaatgtgttggtgggtatggttacccgatgggtaccgggtgttacccatgatgagtatgtgtatagggtaattttgtacccataataggtagtgggtataagtattgggctattttttctatggtgtgtatgggtataacattgtatgcccatcagacatcttacccactgccattatctctatatccaagaaacccttctccttaattccaaaccaaacccatctccaaatctaagaaattctaggaagtagaaaagattttttgaattaggaaacccctttgggttcaaacctatctccattttcctttggagacatgggcaaagcccaccacctcctcctcgtcccatgtctgcgtgggccgtcatcagttgctctgcctaacttgacctgacccaacaaggcaagcgcatgcgcgcacgtggcacatatgtattcttttccaacttcacatatggtatacatagattccaacttataccttataagttggttaatatcccttttagcttttgatgttggattaattatcattgactccctagcattattcgaacacccacttgcatcctacaggtttgcacccatataaacgatttttggggttaactgacacgtggtcaggtgggcccaaacactcgagaaggggacaacacaagtgctcaacaaaatattaagtaggaaattgtagcgtcttgttaagtgtgtcccatcaatgtacagtacggtggtatatttataggtaatcgagtagatgggtgtgccctcctaagtactgttatacctcaggttacctgctatagctccggaatattcccccttacggggtcactacagcaatattaagtacagtctgatttaaacataccacagaccctaccctaaggaggggcttacaaatgggtccaaatgacagcggaatgtggccttcgcccacgcgcggcaccctttgccctatgaagcggggtcttcgaccttgccgagactataggtgtacattcgggccgcccggcccggcccaagcccgaaaaggcctgtgcccacggcccggcacgtaattgcttaaacgtaccgggcttatttcgggcggcccgaaattctaaaagcccgaaattcacattagtgcccaaaattcagtttttagcccgaaattcacatcagggcccaaaattcacatcagagccctaaattaaaaacaaatttaataaaacaaataaaagataagacaaataaattgaccaaaagaa

SEQ ID NO: 11926 - DNA, 3877 bp, Zea mays
agtttaaagttcagagttcaatctcacagcaccaagcaaaaaggaagcagatcaagggcagccgagcgagcagaggttgtcaattacgtgccttaatgagtctctggaagcagccgtcgaaactcgccatgcttgtagtactgctgctgctgctatgtcatgcagtggacagagtccattgctcgacgcaccataacaacagccaagattttcattcgctgcttgagttccacaagggcatcaccagtgatccgcacggagccttgagcaattggaaccccagcatccacttctgccattggcatggtgtgaactgcagttccacgcgaccatatcgagtcacggagctcaacctcaccggccaaagcttggctggccaaatcagctcctctcttggaaacctgaccttccttcagacccttgatcttagcaacaatagcttcattggccccctacctcttcttaacaagctccgaaacctggacttactctttctgggaagcaaccatttggaggatgttattctagattggcttacaaactgttccaacttagtctacctagatctctctaaaaaccatctcacgggtcatattcctccgaacatagcctttcttaaaaagctagaaggtatcaacctttatggtaattatctcagtggggtcatccctccaaccttaagaaacctctccacactattgttagttgatctttcaaacaatcaactaaatggaagcttccctcgggttcggccgcgaataccgaacatacaaatggtaaatctagcaataaataacctatcaggtggaatcccagatactttcactaacttatcttctcttatgatattaggccttgaccacaatatgctgggcggcacattgccatcaaacattggtgatgtgctccctcatctgcaaggactatacttaggaagcaacttattttttggtacaattccaacttccctaggcaatgcttcaaatctagaagtcgtagacctaccaaacaaccttttcagtggcacaatcccaagttcttttggaaacctttcaaagttgcagattctaaaccttgaggtaaacatgcttgaagcaagacatagtgagggctggcaattctttgatgccctagcaaaatgtagatatctcgttatactttcagtgtctcataatcatctacacggacctataccaaattcgattgctaatctgtccactagtcttcaacaactattcatgggttggaataacctttcaggaatagttcccccaactattggaaaacttagtggcttaactaaattatcactagaaaacaacaacctcataggtaccattaaggaatgggtcagaaagatgacaaatctacaagttttaacactacaatcaaacaacttcatagggaaaattccaccttgaattggcaatcttacacagttggcacgtttctctgtagctagtaacaatttcttcggttctatatatgggtgacaatgggctctaacttttacaatataagatttaaggattggatcggattaggatcgggtcctattactattcatttttgaactaaaatttatttagggccctaccattttgtgaagaagcatttggatcgtgatccattaccacccctagttctataccatctaacttctgtgatcctaaattaatgacaaagttagaccttagccataacaatttctaagggagcatacctgttccctaaatcttacttagaactcatctcgctaaatctttcatcatacaaatttagtggcgaaattcctaaaactttatgaagacttgaacaactaaaggacaatcaaatggaccacaacattcttactagaaacattccgtccacattcagcagtctacacagcttgaacttgttcaatctttcccataacaatttatctggtcgaatgccaaattttctaagtggtctaaatcttagtaaactagacctaccgtacaataataatttccaaggagaaagatcaagaactggtctatttgataatcctacagtcatatcgctagatggaatctgggattgtgtggaggagccatggttttgcatatgcctccttgccatgttgcttcaagaatagtagggagtgcaacattattgatcaaaaatattgatcccaatatttgggttcatgtctctcgtattgcaggtgtagttttactcctagaaaagaggacatcaagaagagcatatagatcagagcaatcttattatgagcattttgagaaagttacctataacgacttagctcaagcaacacatgacttcttagaatccaacctgattgggagaggaagttatggttcggtgtatcaagggaagctgaaggaaggcagaatggaagtggcagtaaatttttttgacctagagatcagaggagcaggaagaagcttcttgtcggagtgtgaagcattgagaagcattcaacactggaatattcttcccatcatagtttcttgttcaatagtagataatgtacgaaatgttttcatagatttaatttatgagtacatgcctaatgggagcttggacacatggctacatcacaaaggcgacgaggaggctacaaaatgtcatggcttgactcaaagtataagcatagctgttaatatagctgatgcattggattatttgcaccatgattgtggacagcaaactatttgttgcgacttgaaacctagcaatatccttctagattgtgacatgaatgctcttttgggagattttgaaattgcacgtttgtatcatgattccgagtcaaaatggacaggttcaataagttcaattggtgtaaaaggaacatttggatatattcctccaggcacatatagttactttagctattctgttttgttcatttatgtcaataatttttctaggtagaaaataagttacaacacaattgttaatttgtgtatgcctttccaatttagagtatgggggaggtggtcatgcatcaacgtctggggatgtttatagttttggaatagtgttgttggagattttgacgagcagaagcccaatagatccaacgttcaaggacggctagggcatcatcaactttgttgagaataactttccgaatcaagtatttcaagtcattgactctgacctcctagaagaatgcaggaactcaactcaaggaaataatttggtacaagaaaatgagatctaccaatgcttggttgatctactgcaagtcacactttcgtttctctattcattaccatctgaatgatcgaacatgaagaaagtagccagcagaatgcatgcaatcaaaacatcacatattgggtggaagcacatgtaacaagagcaagggtgttccctaaattatacagtaacatacttaggatgggtcatagtcgaaaatgaccagtggcatggtggtacaggcagttagtaccgaccgggctggttccaatgctggttagttcgatcgactagtcagtagggctaccgaccagtcgacccggttgatatcgtccgcattggaacaaaatcggtcggtaccatcccgtacgctggtaacctagtcgatatcgaccctgaccggtcgatacttactgtctattgccatgtggcagttcctgactatttcacaccattttgaatttcaaaaaaataaataaataaagcttttttaaaaatctataatatggcatataaatagaggagtgtttgagttcattcacaccccactctccaaatcgcttttaacactttatattgcactcctctcactatagtttcactccactaaagcatcattgccatgtctttctcgagctcgagcattgggacgaccgaggacaaggtactcgatatgctccac

SEQ ID NO: 11927 - DNA, 2500 bp, Zea mays
ctgcagttttgacaaaagaatatggaaactgagagtagcagaccccactcggcccatgggatgccaatctggcaaccatcacaaacaacacatgcacgagaccattacctagaacatcctaatcgacaaatcgcaactcatactagaacatacagcatttcacaagacacaacataagcaatagccatgggagctgtgaagcatacattgaaaatgctttcatggctcctactcttcgcacaattggctgcggccaccacctccaagtgcacaaatgccacaaatgggactgagactgacagcctgggtgcaatgaaactgaagctgattgccattgcatccatcctcacagctggagcagctggtgtgctagtgccagtacttggccgctccatggccgcgctacatcctgatggtgacatttttttcgctgtcaaggcatttgcagccggtgtcatcctggccacgggcatggtccacattctgccagcagcatttgatgggctgacatccccatgcctctacaaaggtggcagtggtgggaacattttcccctttgcaggactcattgcaatgtctgctgcaatggccactatggtgatagactcactagctgctgggtactaccgccggtctcacttcaagaaggcacggccaatcgacatcctagagatccatgaacaaccaggagatgaggaaaggtctgggcatgcacaacatgtgcatgtgcacacccatgcaacacatgggcattcacacggagaggtggatgtcatcagttcaccagaggaggcttcaatagctgacacgatccggcacagggtggtatctcaggtccttgagctcggaattttggtgcattcagtgataattggggtgtccttaggtgcatctgtgaggtcatcgaccataaggcctcttgttggtgcccttagcttccatcaattctttgaaggcattggcctgggtggttgcattgtgcaggcaaatttcaagttgagggctaccgtcatgatggcaatttttttctccctgactgcacccattggcattgcattagggattggaatttcatcaagctacaatggccatagcactacagcgttcattgttgaaggagtgttcaactcagcctcagcaggaattttgatctacatgtcattagtcgatcttctggccacagatttcaataagcccaaactgcagacgaatacaaagcttcagctgatgacatatcttgcacttttcttaggtgcagggatgatgtccatgcttgctatatgggcatagattttcagaccatcaaaggatggctagagttgaagaaataagtttatttgtccaagagttctccattttctcaaacaagatgcccttggtgaagggttcatcatattaatccacgagttctccatcttccgtacgatatagcctcagatagtccttttgtacttcataatgtgagattacatgatttgtcatttgttggcatagtccattatcctaaagctatgatagtcattagctgtggttcatgtgctgaacattcagtcataaagacagagctaagccaattctaccaaaaaaaaaaaaaaaatgtatctttagcttatcgcaataaccaaaagaaacatgtaaaaatcatagtcaaacaaatgacatagagatataaactacaaaggccacagatgtatgcaggataatcaacagtggtacactcttgttttttttttctcgaaagcgcaggaaagctgcgcgtcattatattaaaaaaggaaaggtccaaagtggaccgaattacaacaccaagaccaaaccctcaagcctcccccacaaggggaagcctgacgggccctacgagaccctatttaaagcgataataatttccaaactgtctaaatgcttcgctcccgccttactccaactaatcaactcatctagaaacaacctctttgtctaaatgcttcgcccctcctttatttcagttgcgctaatgacagaagaatgctaaagggtattttagtccttttatgatttatttaatgcattttgaatacttttagttcctagaaccaaacaggatagggactaaactttagtctcataactaaactttagtttttggactaaagtaaccaaacgggtcctaagtctatctcaaattcatgatgtgtaggatgagaaatgattttatgtattagtagaatttgtttctgctttataacttacatgaccctctttactcactcttttatagtaaaattgtagcacacataaatatttccgacatcttgctaataatagtatactgctaataatagtatacaaatatattttgtataaaactgaattagcttaattgatatatgtgtaaattactattattaaattagaatagaataaactgaattagcttaattgatatatacgtaaattactattattaaattagaatagaattcaatttcaatgatacaaaccttaacacccaaatctgcag

SEQ ID NO: 11928 - DNA, 862 bp, Zea mays
gcacgaggtctgtcacctaccctaccctgctcgacaaggcaatctgagaccgctctgcgcagtctccacctccgcaatctccacctccctagtagttagtactcttcggtgcagtccgcatccccccatctgaccgactctcactcacaaaattcacagctccaatcctggtgcaagcgcacagtagcggagcaagatgcggggaggagaccggccatctgcgtcgctccagctcctctcgctggggctcgtgctcctctacttcttcacctcaggcagcaccgttggtctcgtggagggacagaagacgtggtgcatcgccaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacatactactgaggaggagtgtgaggaggagtggagagacgaggagaggagagagatccattcgtgcctggcggtggcggctccactgcatctgtatgcagagtcttggttttctagtctcgactgccaatttaccaaatgcacattgttgtgttgtgttgtgttgtgtagccgtgctgcagctgacatttcgcagcgaactcgtggatactccgtttcgcattcatgtgctttgaagtacattgcagcggcgctgcacaaatttcccccctaaaaaaaaaaaaaaaaaaacaaaaaacccccgcttct

SEQ ID NO: 11929 - DNA, 879 bp, Zea mays
cattgggtacctcgaggccggccgggcaagtgagtgttgttcccttccctttataaaccagagaacctgcagtgcagtgcaggcagagtactccgtctgatctcggtgatctgtctccacgacaaggagtgcactgtcagctctagcttgctgcagaacaagggcaagatggcaagaggtggtcggctactgatcctctccctggggcttgtgctcctctacttcgtctcaggaagtgttgctgctgctgctgcacagaaaacgtggtgcgttgccaagccgtcggcgtccaacgatatcctgtctctgaacctcaactacgcgtgctcccaggtgagctgcggcgtgatccagaagggcgggccgtgctactacccggacaacctggtgtcgcgcgccgccgtcgccatgaacctctactatgccgccaatggcaggcacccctggaactgctacttcaacaactcggcgctcgtggtgcagtccgatcccagctatggatcctgcacctactactgatgtctgtctgatgctcttttgtagcagagatcggtcgatgaaaggaaatataatccctgtgtatgctgtgctgtgttgtgtctagagatgacaatagggacctgattcccccgtggggaatttcctattgctatccctagttgcgtcctagtagaagtgtctcttgttccatccagttgatatgcatgataacatttggagatgcatgcatgtgattttgtattcgaggatatggtgtgatcgcaaatgaacaaagtgatgcaaggcagcaatcattcataaatttgtcattctcagattaatcatgagcaaataaagccgagtaagtgtctctgagtgccaaaaaaaaaaaagcgctct

SEQ ID NO: 11930 - DNA, 794 bp, Zea mays
  misc_feature (757)..(757): n is a, c, g, or t
ctcgaggccggccgggacatccccacttgtcgttacttagtactcttcggtgcagtccgcatccccacatctgaccgactctcacaaaagttcacagctccaatcctggtgcaagcgcacagtagcggagcaagatgcggggaggagaccggccatcggcgtcgctccagctcctctcgctgggcctcgtgctcctctacttcttcacctcaggcagcaccgttggtctcgtggagggacagaagacgtggtgcatcgccaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacgtactactgaggaggagtggagagacgaagagagagatccattcgtgcctggcggctggctccactgcatccgtatgcagagtcttggttttctagtctagactgccaatttaccaaatgcacattgttgtgttgtgtacccgtgatgtagctgacatttggagatctcgcagcgaactcgtggatactccgtttcgcattcatgtgctttcaagttcattgcagcggcgctgaacaaatttcccccctttttaaaaaaataanaaggcccctagggcaccggccctcgagcctccagctt

SEQ ID NO: 11931 - DNA, 4976 bp, Zea mays
  misc_feature (1696)..(1696): n is a, c, g, or t
  misc_feature (2384)..(2384): n is a, c, g, or t
tctgctttaggaactctaacaatgagccacaccataagagtcgttagaatctcataacacctcccttgccgccatctctggcaggcgagaatgcattggtgggtctgcacgacgtggttcccataggtttggcttcgacgcgtgcaccaattggagtgtgtaatgctttcggggcattacatgtttacaatgtatgcctccatatgctttgaaggagcatgacccatctatgtgtctcaccccagccatgcgtcaggaccgtggcgaggctacctcaaagcatgaatgttcctcctagcactgaccatcctggcggcctcgcctgatgaggacatgacacctaacaatactatcattagttataaggtgagcttgtttctgcatttgtacaattataaaaccaagaattggttgctacctagcattggtgctgatgataaagaatatatgcaccgtaccatacaatgaaatgataatatctttacctagtctgacataaaagcccacggattacacaaaagattcaattgtgaaagcccaaggcccataaaattttaatacctttatcgacgtttatcttcaagctcagaccccggctctgctacccgggcacagggctccgaacacgcgtttccatggctctcctccgactccaagagcagtgctcgctcctccgaatctccagctcccaccacccaaaccccatcgatatcccaagaaatcctcgcaagaaccaacttttagtgcccaatgcggccaagattgccaacgcctccgaaattccggttcctcgcatccccactagcacttccaaggccgcaatcctggcccggaaggccgcgctttggcgggacgcccttgtccccgttgccgccgccttcgcgtcctgtccgctcccttccctcgcggcggagggcgacgggaaagtgagcctcgagtccatcgtggtggcaatcgacgacttcaacaatcgcaaccctttcttcgtggctggggtcgtgttcgtgtggctagtggtgatcccgctcctgcaggagtacgtcttcaagaagtacaagcccgtgagcgccatcgacgcgttccgcaagcttcgcgacgtgccggaggtgcagctgctggacatcaggcggggcaagagcgtgcggttcatggcgccaccgaagctgaagcttatcgacaagagcaccgtgcaggtcgagttcgacgaggaggacgagaaggggtttgtcaaggaggtgctagcgaggttcccagacccggcgaacaccgtcgtctgcgtccttgacaagtgagtgctatatggaaaattgattgatttattttacctaaagcgccagatgcaatgtctgatgtccctttagattggatgagtttcgctttcgcctcaaatgcagctgcgtattatctaggggcgataataaatgtgtgtagcacaatttagtcgcaatttgcagattagtgtacatattgttagtgttagataatataatctaaagtgtaagcattgaaataacttataaattagaagcggaaagcagttgtacactttcacttctagcaaaatgcatatagctgtgtcctctgtaaacaaaatggttctttgattttacaactctgtattgtgcaaattcttggtaaatacaagggtttggtgtgttagtgtgtacattctcaggaaagatgaagaatgctttgntaacaccgttaagttgcgatttgtaatttcagtgtttctgatgtagggaaccaacattgggagggagatttcttattgtctccaaccagtttcaaattaacatatgattaaaaatacaaatcaggaacaaaatattatcccactttctctttaaatcagcctaaccaaaatagacgccatgtaaattttcatctctctaggtttgttacttcaacaagattaataaaagctttcgtttaggtttgctgtatgtttacttcatgccaaagcaattatatttaacttccttcagaaccattggtcttttcacatgctgccatctagtagcacttaccaacttttctcctccatgttaccaacttaaatttatgctgtgtaaggtagctttgatggtaattcttcgaaagttgctgagctactagttgagaatggttttaaggaagcctatgcaattaaagggggcttgagaggtccggaagggtggcaggtaagttttggttctattatgtgagttattgcatacaattcatttttgttttccttcctaactttttccgtctcctttaggcggttcaagaaaactatcttcccccatctgtccatgttttcccgaagaaaaaaaggggcgcgaaattagctcacacagatgcaagcaatgatggaacatacgttcagcaggagggaagcnaggaatcatcggctcctccaagcaggtttgtagtcaacacaagcgctgaatccaaagatgtttatgaaaatcccaatggaagtacaactgctgcaaaacatgcaactaggagaccgttatcaccatatccaaatgtatgattctttttgcctttttcaccaccacactcaaaattaacctgcttattctagatttttcttcatatgtccaactgtttaccatttattatttgattcaaaatggcagcagtattgacagtttcacacacgttttgctgcttttctttgtactgacagtgaactacattgagaaattatgttatctccagctatcacacttatagctatgccagacctactaagcaatggttgactcatatccatctaaaatgataaataatttgggaagaactcagcagtcagcactgcccttgtatttggtatgcttctgcctagagatatcagatatggctatagtgtttcgttttaaagccttatgtgaatatttaggaaggaactagatcatgtcgatgacagcacggccaagttcttttttaagacaatgaagaggcttccaggaagaactggccatggcctttatatttcatatatgcttctaggatagagttatcagttatgactatattatttctttttaaagctagtatatgtgaataatttaggaagggattagatcttggtaatcacatcatgagttattttgatttaacataatggatagagttccagcttcaacccattcatagaagagacatcataccacaactattacaaatttgtggcccaagctaccacaaccaaatccacgtgcctaacccaagagtcagaacctcaaattattgatgtatcaaccggcgtgacccaagacagcacaaggcatattttgagcgaatctaactgaaagttagataatgacacttggaaggcgcataaatggcttgactcaggtccacagaaattactaacaggcaaggacagggaattccagtgcaaatgctatttgctgacataaagtagagagacctgacagactgccctttagatatgtacactcatttatatcctttgtttcttcactctttatgatgcaaactgacaagtgaccacaaaaactatcatgcatctgtacaaggtgttacaggcctttgagtttattgtgcagtaccctgacttgaagcctccatcatccccaacaccatcaaaaccgacgaattaagagcaatgcaggacaataacatgtgtggaactcaaaaggtcagaagtagttgtctcctgcacaaacatttttgtatacttccaaccgtggatgtccaggagattgactgggatggcatggaagaggaccagcagtggtgtttggagctcttgctgctgttgaggccatggtgaattcttagttgtgtaatttgtgaagcttgtacccgtatggtgtactattaagtgggggcaaaatgacattttgtacctgacttgatacagtttggggcgccttagcgttctcaatttgacaattgtgcttaactctgttttattatcaccggctcagacaccgtatataggtggcatcactataattgtaacagaggttcagttcattcacgctacgtacatgctggaagtggtttacattggggataccagtttgagcaacagcattacatcaaacaaagttcaaaatcttaatcaaaacgaatcaagtttgagcgacaacaattcatccaacaaagttcaaaatcttttacaaaaagaataaaaaaaatggcccatgcaggtctcgatccacgctacgtacatgctggaagtggtttacattggggataccagtttgagcaacagcattacatcaaacaaagttcaaaatcttaatcaaaacgaatcaagtttgagcgacaacgaatcatccaacaaagttcaaaatcttttacaaaaagaataaaaaaaatggcccatgcaggtctcgaacctgcgaccttggcgttattagcaccacgctctaaccaactgagctaatgggccatcgatgcataccgttcaaaacaggttaataactggcatcgaaatgacatcaaagcaaaaccattttatgcgattcacatcagtacattcgttgacctaccatggagtaaaataatatatccgtagaatgtggaagccgaatatattgacgtaccatggagtaaaatccattgcgtgtttgttgtggccttcatgaacatcaaaggcccctccatccttagagatgatggtagaatttgattattggtggtgacattaacccatctaatgatcaaggttttgttcgaacttctcgctaacactcggcaagtcttggtcattagagccagcgtggacgtggttgtgacgctcctcacagttgcacaagcggatcatggatacatggcttcaacaataatttgatgcatccacaacctgatgcttatggcaacaactccaacaaaagcaacatagatactaggtttaagtgccagctaggctacaagagggaacatattattctcaattgttggcataggtttgatgaggactttgtcctagatgagcgcaatgtcgg

SEQ ID NO: 11932 - DNA, 1322 bp, Zea mays
tttgggtacgcccggggccggccggggtccttgcacagggctccgaacacgcgtttccatggctctcctccgactccaagagcagtgctcgctcctccgaatctccagctcccaccacccaaaccccatcgatatcccaagaaatcctcgcaagaaccaacttttagtgcccaatgcggccaagattgccaacgcctccgaaattccggttcctcgcatccccactagcacttccaaggccgcaatcctggcccggaaggccgcgctttggcgggacgcccttgtccccgttgccgccgccttcgcgtcctgtccgctcccttccctcgcggcggagggcgacgggaaagtgagcctcgagtccatcgtggtggcaatcgacgacttcaacaatcgcaaccctttcttcgtggctggggtcgtgttcgtgtggctagtggtgatcccgctcctgcaggagtacgtcttcaagaagtacaagcccgtgagcgccatcgacgcgttccgcaagcttcgcgacgtgccggaggtgcagctgctggacatcaggcggggcaagagcgtgcggttcatggcgccaccgaagctgaagcttatcgacaagagcaccgtgcaggtcgagttcgacgaggaggacgagaaggggtttgtcaaggaggtgctagcgaggttcccagacccggcgaacaccgtcgtctgcgtccttgacaactttgatggtaattcttcgaaagttgctgagctactagttgagaatggttttaaggaagcctatgcaattaaagggggcttgagaggtccggaagggtggcaggcggttcaagaaaactatcttcccccatctgtccatgttttcccgaagaaaaaaaggggcgcgaaattagctcacacagatgcaagcaatgatggaacatacgttcagcaggagggaagcgaggaatcatcggctcctccaagcagtaccctgacttgaagcctccatcatccccaacaccatcaaaaccgacgaattaagagcaatgcaggacaataacatgtgtggaactcaaaaggtcagaagtagttgtctcctgcacaaacatttttgtatacttccaaccgtggatgtccaggagattgactgggatggcatggaagaggaccagcagtggtgtttggagctcttgctgctgttgaggccatggtgaattcttagttgtgtaatttgcgaagcttgtacccgtatgttgtactattaagtgggggcgaaatgacattttgtacctgacttgatacagtttggggtgccttagcgttcccaatttgacaattgtgcttaactc

SEQ ID NO: 11933 - DNA, 1137 bp, Zea mays
  misc_feature (972)..(975): n is a, c, g, or t
cgcgtccgtccgccccaagacccaagattgcgaggttattgcccccacaaatttctttcccctccgggccttccgtgcaaaccaaatctcaacgaaacattgccgcctccccctgaccgcgccccactccccagacgccgtcgcctagatccatgagacttcccgatcttcctgcggcccgaggatgtcccagagcgacgtcgactacagttgcggatcttgtggataccctctaaacctttcatcttctaaccgaagcacatctgaagtaggctcatataagaagtctctgaagaaaggactgatttcattcatttctgttgatctcagccgatttactcaggtggacgaggtatcttgctttcccctcacctggcgtggttacaggccaaaaactaagcttctgtgccgaatatgtggggcatctattggctacggatacggtgagccggctgttttgtgtagttttgatccagcaagttcatcttcctccagtacatcccagaagtatttaataaagatccaagcactccaaccttcagacaggactcagtaagtgaaatatggaaagagaggaaataggtgtcagcctagagaactccatcagttacctatctgatgattgcttgctttctatatttaacaagctagaaagcgggtcagagaggagtgctttcggtttaacttgcaagaattgggttcaaggttcggaaccttggccggaaatcactaacattccattgttcttttaatcctgccatagacaaggagcatgccaagtgcatccccaagatactggctcactcaccttgtctgaaccggatatcccttgctgggctcacagagctacctgactcggctttgagcacgcctgagagtgtctggatcatctctaaaatcctttccattgtactgctggtctggcataacagatgatggtctagcacacgtggctattgcgtgcccgaacannnnagaggttgaacttcaaagctgctttaacactacagatgctgccttggaaagtctttcaaaaggctgccgtggtttgaagagtctaaaccttggttcttgcatgggcattacagaccaaggggtttctgccatcttcagcaattgtccaaacatctgcacgct

SEQ ID NO: 11934 - DNA, 1935 bp, Zea mays
  misc_feature (23)..(23): n is a, c, g, or t
atctttttttgttcgaacgcatnatcccgttcgtaaaaagtgtactactggattctcacaccgcagcatccgttcacgtgtcttcaccccgagtgctgtctctctccttcctctctgctacggctgggtgaggcggggggctactgccgccgcctaacgccaggttccgaggccttcgtcggtctatttgccggcgatgaacatccaccagggatggttgcaacaatttgggcatagcgttggtatcagtggttcgaagatggttctccatatgacccacaatgtattcagttttcgatgctttgctgccaatgggcgtggcttcagtgcggattctaccaataagagaaaaattaaaagcaagaagaggcgaaaggatgttgcactggaatcaagtgaggtaatatctggaaatccaaggaacagggaccaatgggtgccagaattaagaactgaaagtgaaaacaaatctggtaaaaaagtcatggataagaaatttttggaaaaagtggaagcggttcgaaggtctgctcttgagaaaaagaaagctgaagagaacaaagattatcaagctattgattatgatgctccaattgagtcagataaaagtactattggctttggtactagggttggaattggtgttgcagttgttatatttggactagtcttcgcttttggggatttcctgccttatggaagtgttagccctagcaaagaaagtgcagtagttaaacaaaagctttctcaagaggaagaagaaaaatttaagaatgcactgcaaggctttcaagcaacgctgagtaagtcgcctaatgatcctactgctcttgagggtgcagcagtatcgttgtccgaactaggtgagtatgagaaggcatcaacattccttgagaagctaattaaggtaatccctgataaagcagaagcataccgtttgcttggtgaagtaaagtttgaactcaaggattatgaagggagttcatcatcatacagaagtgctttatcttcatcagataatattgattttgaagttctccgtggactgacaaattcattacttgctgctaagaagccagatgaggcagttgatataattctgttatgccgtcgaaagttgaatgaaaagagtcaaacaggactagcagatttggaggctacaaatgacaatggtcgccaaaagcctcaagatattgacccgatccaagttgacctgcttttagggaaggcttattccgattggggtcatatcagtgatgctatttctgtctacgataagctaataactgatcatcctgaagacttccgtggttatttagcaaagggaatcatattaaaggaaaatggtaaagcaggtgatgcagaaagaatgtttattcaggcaaaattcttcgccccggaggcagcgaaggcactagttgatcgctatgcgcaaagatagtcgataagagattgaatggtgttgttttaaaccaatgagatcattcggattccagaaaaacgatcaacatgtttggaacgtcttgtatgatagcaacattatgggatctgggacattttgaattgtattgttttagaacaggcctgacgcagtatcgaaaaaagccttcccactgagacaagagattctgggttcgacagtctctgaaaaaatgcagggcaagccctgcccttggttattccttctttctgaaaaaaatgcagggtaagccttgcccttggttattccttctctctgaaaaaatgctgggtaagccttgccctgggttattccttgcttagacctcgctcacgcggaagccgccagcagcccttttattgctttagaacagcagaaatgaaacatgtatgctttgcctgggaacaatgctcagttaaacattttgatgtacgtgtttagtccattatataaaaaattatttcgatgtgttggtt

SEQ ID NO: 11935 - DNA, 2544 bp, Zea mays
tttccggtgtacagttctgataagtcttcgttttttttggccaaacttcaactatgttgcgtatttttcttcacagtttgaaacacattcttcttatattttctctaacattatttcatttataaccttccagggtaaatgactttgttggtactaaacaagacccactaataccgatgtatgacctatacttgatagtataattactctgaagcatctacaaatgctattatgaattgactcctttgatttttcagaacgaagaagacacacagatcatgccgtcttttttggtggatcaggtttgcattccattacttattcctgccattgattgcatggcgggtgcatcaaaatcttggtaatatttcgttatagtttcacctaaaaaacttaaacataagatgaattagcaaaacttggagaatgcaagtttttttagataattgaagaaatatccagcttcatcctttaaagagaggaatgggaccaaaattattataagttaaaccacaacaacggccaaaccaagttctccaacttgcggtgtcacactgaagcaaaatggctctctttttttctgcagaaatagtggtgtccgcatggttttgtagaaaccttctcttggactagaaaacacaaacactgagccattgtgctctcttgctgaaatttgtggcatagtacttgttggccgataacttatcattttcttaagattcattgttaatgtgctttcaagactatagaacatttttaccatgatctcataccattatattttcttctatgcgtatcagattgtagtttgatctgttgcttacattggtactatgcaactcagttccttttcgtattgaatttctgcaatttctgagcttactgtttccccctccatgcagatcaaaactgtgcatatgcgtgccatggttctgctgttcctgccattgcatgcccaactgcaaaaggccatgcttcttggattgctcctgctgctcatgcccagatctgtcatgctgctatcccagctgcaaatcatgcaacaaaccatgctttgggcccaacagctgctcatgttgcgacatatcatgccgcaagccagattgcccatcctgtacctcgagctgcagctcgtgctgcaatcggccatgtggcaacccagactgcagctcgtgctgcacctgcaatccatcatgctgtaaaccaagctgcaactcgtgctgcagaccaaactgtagctcgtgctgcaatctgtcatgctgcaaacccagctgcagctcatgcttctcatgctgtaaagcgaactccagctcatgctgtaaacccaaatgcagctgcttcaaggccctctcgtgctgcaaattacagtgcagcccaaactgctgcacttgcagtctcccgagctgctcaggctgcaacccctgcggcagttgcaagcaatgctgctcatgccccagcgactgctttgattgcaagccaaactgcggctgtttcggcgcgcaatgctgcagctgcgtgggatgctgctcgtgctcctgccctcggtgctcaagctgcttcggttgcttcaagtacttcaagtgctccaacctgttcgggtgctgctcctgcaagcagtgcttcaagtgccagtcctcgtgctgcaagggggcgccgtcctgctgcaaatgccagtcgtcgtgctgtgagggtgaagacggcagcagcagctgctggaggtcatgctgcagcgttccgaagccggattgccctgggtgttcgtgcgggtgcgtttggtcctgcaggaagtgtacagaagggtgccgatgttctgggtgccgcaaaccatgctgtgccaccggatgcttgtgctgaagttgaactagacgttttcttgtttttttttatttgcgtgtgctatttagatgcctgttggcttcgttcgtgcttttgctatatggtgtagcgtccttgcctgtaaagaaatcccatatcaccagaagaatttgagacgtcaacagccatcaagtactataaaatttagatgccttttgagttttgactttcatgacctggtggtatatagtctccactaggagaatttagggcatgtttggttcgtggctaactgtgtcacattttgcttaaggttagtcgttcgaattgaaaaactaaccttaaacagaaaagttaggtaaagtggggcaagttaggtatcaatccaaacaggcctttagtgaatgactttttggttacttttatctgcataaacaatcaaatcactccttatatttagggttttgatttgaggaactgacttatgatgcttcaattcatttagatttagaatagtttgattctttaaaccagacaccgttagtgatgctggagaatgcatattgtgtagtgtgtttagcaaagtaagaataatgcttctcaacaagatttcatttggtcattggtaatcatcatatgatatcacacatgaggtacaaattatcccaaacctttgatccaacacaacattcttggaaataattggcatacagtgtcagcgttgattgg

SEQ ID NO: 11936 - DNA, 1493 bp, Zea mays
  misc_feature (1463)..(1463): n is a, c, g, or t
acagagcccacgcgtcggacaacgatagtcagctagagattaaataattgtcaatacaatagctgcacgtgcacatgtcagaaataaataaataaacaattgcaaccgtaaatcaaaaggtcaacacaactcaccaagttgaatatgtcatcgatgatggtcccactcaaatgggtgatatgttaaattttaacatatttagaaggtaatatatagagaactgttggaggagatgagttttttttcctatgttatttaaggacttgctaaatctaagatttaggtagtataattatacataactattggagttgctctaatacacgcgcgcagggcgcgcacccttgactagtatatatattattattattattattatttctatacatgaaagccggttcaaaaccggctctctcgttgtgtccacgtctgctttttttccaaccattcattttagcatcgacggtcagcggtcgtagctcatctgtgtgtctgttctgtctccatgccgctagagacttccagatagtaagcgaaggggctgggaccgtatcgtggcctcccgggccaactggattccgtctccctaaaagctatgccatcaccgtctccaccaaaacatcgttgtcgttccaccagtccatcgtccgtcgtgctgttacgatcacatttcaactgcggcatcctctcacaagaattccagagttcttccctccccttccctcaaacgcttcccaacccacgacggaggcacgcgcgttaacatctaccttttgagcgacactccccatgtgcgacatcctctgcctgccgctaagtccccacaccaccgcccccacgccgagcaatccatgcccatcccggctcttcttgattttcgtaactacgcgcctctggctcgctcttctcaattcctgctgcatgtccgtcgtgccgccgttgcgcgggcgcagggccaagcgtcactaaaaggcatcaacagagaagaaggcgaccgtggccgcaaggggtaagcagaaggcgcattgagcattctaacagtctgcaactttcattcagaacaggtttgaccctatctatatggatgatgacgtacatgttgccagggacataagagatttaatagttgagcatatgctccatattcttggaatgggtagtttctgaagtccaaagctgaccaaaagaacgtttggagaaccttatgcattcccagccaaatattcatgtcttactattatggttcagtaagtctgattcgtgttgtacgtgtacttgtttcgtagtagctaattgccactaacattttcaaatccatttgtgttgtagttgaaggacatttctagtactttttttttcgaaaaacgcaggagagctgcgcatcattgtattaataagaagaggaaattaaggtccaagaggaccagtacaaaaaaaaaaaaaaaaagcttatcgataccgcncaacctcctccagggggggccggacaattc

SEQ ID NO: 11937 - DNA, 3648 bp, Zea mays
cgaacccgtcccacaagcacgcgcgacgcgagccaaggaagacgagagcgaggtggagagagagagagagaggaaaaccctgccccgtccaggcagccgtcgtcgacgcaaacggcggaggccacagagacgccacgcgagggagccccgccgcagcagcacccgcgccgtcccaattcggcgccccgatcgccggatctcctcgccggcgccggggccctcgatcgccctctccccatgcccgtgcccctccgggggtttcattgcgcgggcgccggccatgtcggacctcgcttccagctgcaaggataaacttgcgtattttagaataaaggagctcaaagatatcttaaatcagctggggttaccgaagcaaggaaagaagcaggaccttgttgacagggtattggctattttatcagatgagcaaggtcaacatcatcatggatggggaaggaaaaatgctcttacaagggaggcggtggcaaaagttgttgatgacacatacaggaaaatgcaagtatgtgctcctgaccttccctctagaagccacagtggatcagatttcagtcatttcaggcccaaagaggaagcgcctgacttctaccatgtggatactaaggtccgctgcctttgcaatagcacattgctaaatgacaatatgattaagtgtgaagatggcaaatgccaggtgtggcagcatattacctgcgtactcattccagataagcccacggagggtgctggccctgatattccacctcatttttattgtgaactgtgccgactgaaacgggcagacccgttttgggtgactaccggaaatccattactacctgtgaaatttatgtcatctggtgttggaaatgatggagcaagtgtacctcaaattgtggagaagactttccaactttcccgagcagatagagaaacagttcagagacaagaatatgatctccaggtttggtgcatccttataaatgacaaagtccagttcaggatgcaatggcctcaatatgcagaattgcaagtgaacggtattcctgtacgagtaatgaccaggcccggttctcagttactagggataaatgggcgggatgatgggccactggtaaccacatgcagtagagaagggatcaacaaaattagcttatctagagtggatgctcgaaccttttgctttggagttcgaattgttaggaggaggactgttcctcaggtattaaatttgatcccaaaggaaggtgaaggggagtcttttgaggatgctcttgctcgtgttcgtcgctgtcttggaggtggaggtgctacggacaatgctgatagtgatagcgacctggaagtggttactgaatctgttacagtcaaccttcgttgccctaatagcggatccagaatgaggattgctggaaggttcaagccttgtgttcacatgggctgttttgatcttgaaacttttgtggaattgaatcaacgctcacgcaagtggcaatgcccaatatgtttaaagaattactctctcgagaacttgatgatcgatccttatttcaaccggattacatctttgttgcacaattgcagtgaagatgttaatgagcttgatgttaaacctgatgggtcatggcgtgtgaagggtgatgccgctaccagagatctatctcagtggcatatgcctgatggtactctttgtgactcaaaggaagatacaaaccctggtgtcgttagtgttaatgagttcaagagagagggtacttctgatggacatagaactttgaaacttggaattaaaaaaacccctaatggattatggcaggttagcagtaaaccagatgataagaaacccgtggttagaaatcacatccaaaacaacacggggtactcaataccaaacatagtacctatgatcagtagccccactgggagttgcagagatggtgaagatgtaagtgtgaaccaagaagggggtggtattcagtttgatatatcattgaaccaagagtttgacagttttgcgcataactttggtcaaacatacaatacagaggataggcaacaagagccacaacataatgctgcagatgtcattgttcttagtgattctgatgaagaaaatgacccgattgttcgcctgccagctgtctatgcaaatactcctacaaatggtgacagtttccctttcgtcactgatgctgctgtatctggatatcctgaagggtaccaggaggatgctggggttggtacaagtggccttggtttattgagcaacaatactggtgattttgaaataaataactggcaaatgcattcttatccacaaccagagcaagggttccagttttttgggactgatactgatgttggcaatccttttgttggtccgcataattcctttagtattacaccagaagactactcccttgactgtaatgttggcatagaggatccatctgcagctcacgatgtctcaatttgccgaaacagtaatgatgtgcatggaagcttggttgataacccattggctttagcaggtgacgatccatctttgcaaattttccttccaagtcaaccttctactgttccccttcaggaagaactgagtgagcgcgctaatactccaaatggagtccaccctgatgattggaggatatctcttacgcttgcggctggtggagggggtaatgaagaacctacaagtgttgatggcctaaaatcacagccaaaagttccatcaaaagaggcaggagttgaacctttacttgatgctgcttctgctctcccaagcatgaacaatgacagatgtaatggatctaatctaaacccgagaaggattgaaaatatattttctcatcctcgccaaccacggtctgttaggcctcgtttgtgtttgtcattagattctgattcagagtagttcggacatcacactgggatagctgaatttgctattaatctggcaaagttggcttccagaatcttgatttttattgtggagggctatcaggttattctggttgatacaaagagaaacaccagtgtggatgctttattgcattaacctggtaagattcaagtgttctatatgatccaagtgggatctccatagagttcatctaatggttggtacaggatattttctaactgggagtggtttaacgtggctagtggagcaggctgtacattttccctgacatttactgggtataaggaatagggggccatcacttggcacaagacaaatacatgtgaatgttttgtgtgtaccatcattgtatttagggttcgggtgttaatttagatgtttatgaccctgatgtttgatggaaaataaattattccttgatgaagcggcggtcaatgaacagagcccttcggttttcagtcggagctactgacccttcatctgttcctgttgtgaagtggttgcttccgcttccgtggtgggaccaaccatgccgaagtcgtgtctagcagagggcaatcaatctccttggtgtctagcaggtttctttgtgcatcatgctgtattattctggtgtcctttgcaggtggtggtgggttgtatcggttttgtgaacccttctgattgaaaggtgctaggatggagtactggtatgaagaacttatcttctttcaaaaaaaaaaaaaaaa

SEQ ID NO: 11938 - DNA, 2413 bp, Zea mays
aataattactctctcgagaacttgatgattgatccttatttaaacatattgggcattgccacttgcgtgagcgttgattcaatatgtttaaataattactctctcgagaacttgatgattgatccttatttcaatcggattacttctttgttgcacaattgcagtgaagatgttaatgaacttgatgttaaacctgatgggtcatggcgtgtgatgggtgatgccgctaccagagatttatctcagtggcatatgcctgatggtactctttgtgactcaaaggaagatacaaaccctggtgtcgcaagtgttaatgagttcaagagagagggtgcttctgatggacatagaactttgaaacttggaattaaaaaaaaccctattggattatggcaggttagcagtaaagcagatgatatgaaacctgtggttagaaatcacatccaaaataacactgggttttcaacaccaaacattgtgcctatgatcagtagccccactgggagttacagagatggcgaagatgtaagtgtgaaccaagaagggggtggtattcaatttgatatatcattgaaccaagagtttgacagttttgcccacaactttggtcagacatacaatacagaggatagaccacaacatccacaccataatgctgcagatgtcattgttcttagtgattctgatgaagaaaatgacccgactgttcagccgccagctgtctatgaaaatactcctacaaatgatgacagttttcctttcgtcactgatgctgccggatctggatatcctgaaaggtaccaggaggatgctagtgttggtacaagtggtccgggggcctggccgcggcacactggtgaatttgaaataaataactggcaaatgctttcttacccacaaccagagcaagggtttcagttttttgtgactgatactgatgttggcaatccttttgttgctccacataattcctttactattgcaccagaagactactctcttggctgtaatgttggaatagaggacccctctgcagctcacgatgtttcaatttgccgaaacagtaatgatgtgcatggaagcttggttgataacccactggcattaacaggtgacgatccatctttgcaaatttttcttccaagtcaaccttccactgttccccttcagcaagaattgagtgagcgttctgatactccaaatggagtccaccctaacgattggaggatatcgcttacgcttgccgctggtggagggggcaatgaagagtctacaagtgttggcggtctaaaatcacaaccaaaagtttcatcgaaagaggcaggagttgaacctttacttgatgctgcttctgctcttggaagcatgaacaatgacagatgcactggatctaatctaaatcctaaaaggattgaaaatatattttctcatcctcgccaaccgcggtctgttaggcctcgtctgtgtttgtcattagatactgattcagagtagtttggacatcacactgggatagctgaatttgctattaatctggtaaagttggcttccagaatcttgatcgttactgtggagggctatctggttattctggttgatacaaagagatacaccagtgtggatgctttgttgcattaacctggtaagattcaagtgttctatatgatccaagtgggatctgcatagagttcatctaatggttggtacaggatattttctaactgggagtggtttaatgtggctagtggagcaggctgtacattgtccctgacatttactgggtataaaggaatagggggccatcacttggcacaagacaaatacatgtgttgtgtgtaccatcattgtatttagggtttgggtgctaatttagatgtttattaccctgacgtttgatggagaataaattattccttgaagtggtggtcaataaacagagagcccttcggttttgagtcggagctgctgaccgttcatctgttcttgttgcgaagtggtcgctcccgctttggttcagctgcagctttcatggcgggactgaccatgccaaagtcttgtgtagcagagggcaatctccatgatgtcatgcgatacaagtgatctgtattttgccctacaggatgacaagtttctttgtgcaacatgctgtattattggttcgatactctttactatgtgggttcagtgcaggtgcataggacataccggcagtctccggactttgctgggatctgcctggaaacaaaacatcttgccgcttatcccacttggaaaacttgcagggggggggggaatggaccagattttaatgaaccctggcaatttaaaaggcccttgggattggaaacctgggaacgaaaaaacgccttttcttttccaaaattaaaaaccccctcccccggggcccacaaag

SEQ ID NO: 11939 - DNA, 1053 bp, Zea mays
acatccaaacaagatatttttattattcacataaaggacaaacaaatgttgctcaagtctggtaacaaacatttcgaaatgaaactgatcagcataatccacaatcccggtatttactactgaaaaatctcagcactgcagttctgtaagaaaaagcgaatcaacgaaggaaaaacagcacagcaattcaggcactcatattctattttcgattttgaaggaatccacaacagtatgcagcctatccttcatcttttcccacctcctctcgtttgctccagtggtcaatgtgtaaaatttgccatttgcaattacaatagcaccaagtgcatgtctggtgtagtttggagcctgagctgtgaactcaaaagtgtagtaagccctcccatcaacatcattctctttcgcctcaattaactttgtcttctgtgttgatggtgccaaaacttttttaatcagagcctcggcaaccttatccggaggaccaagatcacggatatcctccttgctagttggaatagagttgacgctcacactctcgagaggctctatcacatctttgtacaccttgtcttgcccttgcacagccacttcctcccatccgaacgggtagaggaaagagtagccagccttcttgtcgacgacgggcaggaaccctttcttagcctctgctgcgaatgccgccggattaggccgggagaggaacgcggcggcaccggcaaccagcacacgccgccgtacggagcagaccgcctcctcgttgtcaagcatccgcggcggcgcggggccgcaggcggcagcgacgggcgcgacggcgcaatgccgcttgcgcagcgacgggccaccggccccaagtcggcgtgcgacggccgctggagaggagcacggcgcgcggaggcaggcggcgggcacggccgttgccatgtgaggcgtcgggaaggaggatggggcggaagcgaatcgaggcgacgaaaagcttgcggaccccgtgcgccgagtaggattcccctcccgctcgcgtccagccccccggtccccctcgaggtacccaat

SEQ ID NO: 11940 - DNA, 1289 bp, Zea mays
cgagtgatgccagcggtgggtggggtcgccggctccccgctttggtcgtcgtagaggaagtgaagtgaaggcgggcgggcagggcacggcatgaccaaccccgcacgccggatgggtgggtcgcggactcgtacggccccgcaaaaaaccggatttgatagcggccgatacgtccgccgcggcggctgaataggagagagaaaccgccccccctctctcctcaccctttctcgacgaaccccgcccacaagcacgcgcgacgcgagccaaggaagacgagagcgaggtggagagagagagagagacgaaaaccctgccccgtccaggcagccgtcgtcgacgcaaacggcggaggccacagagacgccacgcgagggagccccgccgcagcagcacccgcgccgtcccaattcggcgccccgatcgccggatctcctcgccggcgccggggccctcgatcgccctctccccatgcccgtgcccctccgggggtttcattgcgcgggcgccggccatgtcggacctcgcttccccctgcaaggtatacgtccgcccgcgcccaattcgccacccgatctccgccgattcccctcgaatttcccggatgatttggctgggctcgtgggattcccgcccctgccgccgctccgctgcccgctgccgcccggcggttatttccacgccgatgtttagatggattggctgagagctcggatcctactttttttgcgcgtgctggcaccagtgcattctttccaaatgcggaatcgcgtggccggcggttcggcctcttagatcgctgcccgctgtcgtcaagccccgagttttggagctgcgtgctgttgttggggtaggtgttctatgctgtcttagccgccgaatcaactcctcatggattgtactaattgataggctagtgttggattcttctgttgcatgacgcagtactcacttaagctgctcctagcttgcgcatggctaactgagaccgtgttacccatagtttacccaaaacactgtattttcccactatatgcagagtggagtttgaatatgggtatgaagatggttaagctgctggagatattttttctgaaatgtttctttttgttctatggattaaccatggcaagtgtggcggtgtacttcacgcacgcaacatgtaacagtcgctcttgaagatctcacatgttgattctttccctgttcgtcacaggataaacttgcgtattttagaataaaggagctcaaagatatcttaaatcaggggaccgagtccgaatcgtata

SEQ ID NO: 11941 - DNA, 1424 bp, Zea mays
ataacggagcgcacgcacgcacgcaatggccatggccgccccgccacccacggctctctgcgcccgccgcttccggccccaccacttcgcatactcctcccccgccacgctccgcctacccacggcctcctcctcctcacagctccggcgccgccgccggctagccgtctccccgcgcgcggacgcggcgaccgggacgggggatgtggaggcgctcagggccggggtgtccgtgtacaagccgcggtcctacgacgtgctcgtcaccgacgcggctcgctccctcgcctgcgccatcgacgacggcaagacccggctcgagatcgaattcccgcctctgccaagcagcatctcttcttacaagggctcctcagatgagttcatcgatgccaacatccagcttgctctcgttgttgctaggaagctcaaagagctcaaggggactaggtcttgtatagtgtttcctgatcaacctgaaaaacgtagggcatcagagttgttcaagacagctatagacacgattgagggtgtaaccatcagctccctggatgatgtacccactgaccctgtcaacagcttcttcaaatcaataagaaacaccctggattttgacttctcagatgacaatgaaggtagatggaaatctgatgaaccaccatcgttatatatcttcatcaacagcagcacgcgtgaccttgcttctatagagaagtatgtggaaaagttcgccacatctgttccagcccttctattcaatctcgaactagatacattgcgttctgacctggggcttctcgggttccccccaaaagatctgcactaccggttcctttctcaattcaccccagtattttatatcagacagcgtgactattccaaaacaatcgcagttgctccatacatagtgaattatagtggagctgtattccgccaatacccagccccctggcaggtcatgctgaagcaggctgatggttcctatgcatgtgtcgctgagagcgaagctcggttcactttgggacaggcgaaagaagaactattgagagttattggtttacaagaagaagagggaagctcccttgaatttctcagaagaggatacaagaatgctacctggtgggaagagaacgttgatcaggagacgtcgtctgcctggcgaacttgagatgctatacttgctggatggatgcttttctaacctggaactgggaatggataatttggccaacgagtgtccatgtcttgttgtatggaactaaaaaatctgaaattacagaaagagaagtccatgtacagcgtaataacattgcctgtgatgatcgtattattattattgttgttattattatgcgagtacacagagcttgtgagcactaagaatgtttttttacaatggtgatttgtacatttgttcgaaaaaaaaa

SEQ ID NO: 11942 - DNA, 1882 bp, Zea mays
attattattacatgtacttcttttggctaaaaaaagatgagattttgattaatccccgcgcatgttttttttttttgtttttcatctctgtttcttgctgtatttacgccgtaccatggcgctgatgaattggtttccatgtgattgtgccggctgtgggcgcagacgaaggctacgggcctacttgggacagcgacgacgaatacgacaacttcatacgcaagatgaacccgccaaggatccgttgctgtcgcgagtcctcggcggaggccacaattgtaagggtagatagcgcgaatgaatacgggatattgctggaagtgatccaggtcatgattgatctcaaccttgtcataggcaaggcatatataacctcggatggtggatggttcatggatgtcttcaatgtgaccgataaggaagggaagaagatcaaagatgaggcaaccctcacacagatcgaagactacatcagaaagtccttgagcgccgttgctagatcgcattccttcccgccggagatcggtagacgtcgccgccgcagctgaccacaacatcatcgaactgacagggacagacaggccaggactgctctctgaggtcagcgctgtgctcaccagcctcaagtgcaacgtggtcagcgccgagatctggacccacaacacccgagccgcggccgtgatgcgggtcactgacgaggacactgggctggcggtcacggacgccgagaggctggagaggatcagggagaagctgtcgtacctgttccgtggaggcaatctctctcgaggtgccacagtgtcgtcgaggactgccaccacgcacaccgagagaaggctgcaccagatgatgctcgacgatggcgactacgagcagctccagcggcaagctccaggacagtctcagaggcctaacgtcaccgtgaggaactggaacgacaaggactactcggtggtgaccatcagatgcaaggacaggtccaagcttctgttcgacacggtctgcactctgacggacttgcagtacgttgttttccacgcgaacatcgatgccaaggacaatcaggcttaccaggaattctatgtaaggcatgtgaatggatcgccaatgaacactgaaaccgagaggttgcgagtcatccaatgcctggaagcagccatcgaacggagggtatctgagggtgtgaagcttgagctgtgcaccaacgacaaggtcgggctgctatccgaggtcacccgcatcttccgcgagaacagcctgacggttacgagggcggaggtgaccacgcggggcaggatggccgtgaacacgttctacgtgcgcggctccgcgggagaggccgtcgaccagaaggcgatcgactccatcagggaggccataggccacagcctccaggtgaaaggacaggccgagccgccggagccgcagaagaaagagtcccctacgtggttcctcttcgccaacctgtttcgccccaggtcgctctacagcttcgggttcatgcgctgatcgcgccgccgtcctgtcctggccattgcttccaagaaccgccgtcgtgcagtaagttcaccaccgttcacacgaagcaatccaggacatggggggatctttttcagaaggtggagaagccttcgttgggtcctagcagtgcaggtttggcatgtaggtagagcatggcatgggtggtgttcatatatccttcgtcgccgtcgtcgtcatcaggatcatcatctgtgtcatcagcatccgcgtctgtaaatatgacagcatttgaccatttgtacatataacgtgtaaactaaaggacgtaaatataagctgtacagaatatagttaaattccagatttgttgcgacgtcgtaaaagccggcgcctttttctc

SEQ ID NO: 11943 - DNA, 1819 bp, Zea mays
tcggtaccctgtgtacatgctttaacgcagaattattagtatggcgccgcgcggcaaggcaacagatcgagcgcgagcgcatcatctggtagagtcgatttggcgccaagaagtgggcgggagcgttgtgcccgccgttttctccggtatcctctcctctcccgtcccgtcaatccggtctcggcgtctcgcctttcatcatcattacgtctgctaaacaaagcaaaggccccgagctaccgaccaccgtcccgccactcctccagcgccacggggaagatgagcgcgcgagaaaaggctactcctactagtcctactaggagcagtattcccctcccctccccccggcccggccgacatgcgccgcacgttcgtccctcgcttaaattaggcggggccgccgccctccctccttttttagttttcccgcgggccggccgggtccatcgcctcgcctaattcaaccccatctcggccgtcgtgcgcgacatgctctctccatcccgtcccgcccaccgctgctcccttgcctgagctgccgcccgccgccgtcgccgtgggaccgatcggtagtaatcggtccagagcgcggtgcagcgagcgggagcgagggaggcgtcgtcggccgtccttcgtgccccgcgttcgttcttggaattggtccgcgcgcgtcctcatcagtgagtgtactgttccggatgtctctcgctagtcatcgacgtcgtttatctactcccattgagattatgggttcgaaagaaaactgtgtgacactcatggatgctgctgcctgctccgttgtaggaattctatgtaaggcatgtgaatggatcgccaatgaacactgaaaccgagaggttgcgagtcatccaatgcctggaagcagccatcgaacggagggtatctgaggtaataacaattccacgcgctcatctgaaaccacatcaccgaagaaaaaacagcaaaaactgcagctccttccttggggcagccatcgcgcgctggccgtcccagggtgtgaagcttgagctgtgcaccaacgacaaggtcgggctgctatccgaggtcacccgcatcttccgcgagaacagcctgacggttacgagggcggaggtgaccacgcggggcaggatggccgtgaacacgttctacgtgcgcggctccgcgggagaggccgtcgaccagaaggcgatcgactccatcagggaggccataggccacagcctccaggtgaaaggccaggccgagccaccggagccgcagaagaaagagtcccccacatggttcctcttcgccaacctgtttcgcccgaggtcgctctacagctttgggttcatgcgctgatcgagccgtcgcttccaagaaccgctgccgtgcagtaagttcaccaccgttcacgaagcaatccaggacatggggggatcttcttcagaaggtggaaaaaccttcgttgtgtcctagcagtgcaggtttggcatgtaggtagagcatggcatgggtggtgttcatatatccgtcgtcgccgtcatcagcatcatcatctgtgtcatcagcatccgcgtctgtaaatatgacagcatttgaccatttgtacatataacgtgtaaactaaaggacgtaaatataagctgtacagaatatagttaaatcccagatttgttgcgacgtcgtaaaagccggcgcccttttctccttttcctccagctattttcggtctttcccgtaagaggagaagaaggcatccgttagcgtctttttatcctgcccagaacgagaggccgagtcggctcgctttgctctcgaattattgcagggtacc

SEQ ID NO: 11944 - DNA, 1207 bp, Zea mays
ttgggtacctcgaggccggccggggcaaagtcagcgcaggccacaacaactccctcctccacctccccttcttcccctcacccccaccctacccgggcacccggctgctgccaggagaggagggccgggtccggaccaccacccctctcttccccgccacctactcttcttctccctgtcctttctctctctactagtactaggtctagggtcgcctcgccgccagccaaccacgcgcgcacacgccccgtccggccgtacccgctcttcattccccactgcacacaaatactactgtgactccgtgagggagcaacaggaggaagaagcaggggggagaggggaggggaggggaggcattcgtgctccttttttccttcctactgtacgagtacaggactgcgctgcctgtctctcctcgcctgctgccgacttcgcggcctcgtcgccctgccatgtccaccatggacgaaggctacgggcctacttgggacagcgacgacgaatacgacaacttcatacgcaagatgaacccgccaaggatcgtcatcgacaacgagtcctcggcggaggccacaattgtaagggtagatagcgcgaatgaatacgggatattgctggaagtgatccaggtcatgattgatctcaaccttgtcataggcaaggcatatataacctcggatggtggatggttcatggatgtcttcaatgtgaccgataaggaagggaagaagatcaaagatgaggcaaccctcacacagatcgaagactacatcagaaagtccttgggcgcagattcaagatacattccttcccgccggagatcggtagacgtcgccgccgcagctgaccacaacatcatcgaactgacagggacagacaggccaggactgctctctgaggtcagcgctgtgctcaccagcctcaagtgcaacgtggtcagcgccgagatctggacccacaacacccgagccgcggccgtgatgcgggtcactgacgaggacactgggctggcggtcacggacgccgagaggctggagaggatcagggagatgctgtcatacctgtaccgtggacgcaatctctcacgaggtggcagacagtcctcgacgactgccagaactcatagtgtgagtatgctgcaacgtaggaatcactatgaccgcgttcacgcaccactatctcagctccatccacgacgatctca

SEQ ID NO: 11945 - DNA, 2441 bp, Zea mays
  misc_feature (701)..(701): n is a, c, g, or t
  misc_feature (720)..(720): n is a, c, g, or t
atccgaatcggtcgtaggctcgtagcagagcgcgcgcatacagccatgcactcacacgtcaggaataataataggcagctttaatttcaggcgattaatttagtcattcactaaaaggttggagctcgattgctcgatattattccccctctgaaaaaagcaagatatatatgctcgcctatcgatcttgttaccatgcacacaccctctttccagcggcggaatccaatctttctttgcaactagctatttggggacagcgactgaatgttcttgaccaaataattgtgcgtctgagctgtaagttgacaaagcatgcattttccgtagtatgtagtgtgtgtgtgtgcatgttccaacgcaaatctatggctgctgtggctattggctaatacggtgtatgtatacaggtcatctttgctaaatgttcgatccatctccacatgcagctagtgacaattgcctccttctgaatattcatcagtgtgagacgaacatgcatgcatgcatcggagacggagagatcagtctttgggtgcctggagttggaaaaatgtctgaacttctcagctgtgcagagaatatttcagctccttgattaatttcttgcgttagttaaccagcaccttcacgagtatgagcatttcattgaccacgagagatcgatcgagtatggaaatcgacacgcactgagagctgangcagcaagagaagcgagangtagctctgaatcttttggtcaggacgactcaaggaggagctaggagatagaagtagaacagatgccaatacaagcagccggaccgcgacgtgaccggagcggggatgcgatagaaaggtccggagtagatgagatgagaatctgagatccccactcccaggggacagaaatctttgttcccttcccagctgctgttgctgctggctctctcgccgcctcagctcggtacccctgcatgcagtgcagcgtgtggtgtgcccccgccggcattattccttccctcctcttgtcctagctagctccccccactctgatgagatcgatgatgcgccatggtccacctccctcttcatgactccatgtccatgaggcctgccgccacggccacttcgtcttctataaatagcagctcttcccacacctcctccactcatcagctcagcatacacaacatcatcatcatcatcttctcgctagtcgagcgagcccttgtagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccgcctaccgctaccccgccggctacggggccgccgacaggtacgcatccaaccggccgcccggaccgccggagcaatggctaatcttttatctctttctttcattcaacactcactgatgcaaatttgcatatgtgtatgtgcaggctgaaacaggggtaccgcgcgcgggtcaattgaacatataggacgaacgatcgatgatccagaagatgcaaacatgtgtgtatataggattaatgggacagtatcagtatgcatgcaatggtccatgctgcaagtgcatgcaagtggtgtgtgaaagcaagaatcagattagatgcatgcatatgcatgtgttaatttagtagtaataattgtagtatgggatgagtcctatgctagccagtcacgcgcgatcgaccgaccgacccatcgatctccaatgcttctgttccctctccctcctacttgtccacttgtgtgtatatataaatattatgtatttttattattatatatactctgcctgttctaaattatgagtcgttctaattttctcagagttaaaacaaatcaaatttcataaaattcttgatacaattataaagacttatgacattagacatatatacaataattgacaaaaaaatctaataatacttatttggtaccataaatgttgtaattttattatataaatctacttaaatttgaggtgttttaacgtttaaaataacttataatttaagatgaagagtatattgccactacagctgcgtctatgttccatatcaatcaagaaggaagaactttatattgctcgttaatgcatttctatgacggcctctttgttttccatgcagtgagtacggctactaactaaacatggataatttttttaggactacaaaaactttgtcacgtaattttacatagagaaaaagacaaagtttggtcccatatt

SEQ ID NO: 11946 - DNA, 1027 bp, Zea mays
ctcgaggccggccgggggctctctcgccgcctcatcagctttcagctgcatgcagtgcagcgtgtggtgtgcccccgccggcattattccttccctcctcttgtcctagctagctccccccactctgatgagatcgatgatgcgccatggtccacctccctcttcgttcatgactccatgtccatgaggcctgccgccacggccacttcgtcttctataaatagcagctcttcccacggcccggcctcccatcagctcagcatacacaacatcatcatcatcatcttctcgctagtcgagcgagcccttatagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccgcctaccgctaccccgccggctacggggccgccgacaggctgaaacagctgaagatctaggaggtcaattgaacatataggacgaacgatcgatgatccagaagatgcaaacatgtgtgtatataggattaatgggacagtatcagtatgcatgcaatggtccatgctgcaagtgcatgcaagtggtgtgtgaaagcaagaatcagattagatgcatgcatatgcatgtgttaatttagtagtaataattgtagtatgggatgagtcctatgctagccagtcacgcgcgatcgaccgaccgacccatcgatctccaatgcttctgttccctctccctcctacttgtccacttgtgtgtatatataaatattatgtatttttattattatatatactctgcctgttctaataaaaaaaaaaaaaaaaaccttag

SEQ ID NO: 11947 - DNA, 3907 bp, Zea mays
agcatctcattccacgggcgctttttacaagtcatgctggtccatcaacaagtttgacttgatggcggtcatacccttcatgcccagtgttttcaacattttgatatcctaaacgaagctaatatcatcttgctaccaaagaaggaaggtgcggaaaaaatcgaagacttcaagcctatcagcctaattcaatgtgacgctaagctttttctgaagcttttttccctcaggctccggtcatggagaacatcgtttccaagtgtccgagcgccttcatcaagggaagaagtacctatgataccttcttgtatgttcgtagcatggcaaggaaattccaccaaaacagatctccgatgcttctcatcaaacttgatatctccaaagctttcgactaattcagatgagactaccttttaactcttctctctcaacttggtttctggatcgctacagtgctggccacatcctcgtcccaggttcttctcaatgggatcccggggcaatcgttctaccatggaagggtgacccacttttgcctctaccttttgtcctggtattggagccgctgcaaagaatgctcagcttagcaactcaggctggaactctgtcacaaatatctagcaatagattgcggcttcgtgtctcaatgtacgtagatgatatctactgtcattttcatcaaacccatcaaaagcgaattagacgccttgacctacattcttcatggtttcgggaaggcatccaggctccaaaccaatattcaaaagtcatccttcctgacaattagatgcgatcacatgaacctcaatgaaaccatttgcaacttccctgcgactagggcgtttttcccagtcaaatacctcggcatcactctgacagtttctagattgagaaaggtagtttttcagtatctactggacaaggtgcataacaggatggtggcctggaaagggcgcaacatcacccatgctggaagacttatccttactaaggcggtgctttcctcgcagccgactcatacactttccgtcctcaacgcccaaagtatgtgtttaaggaccttgataggatcagtaaaatgttcctttgggccggtggagaaaacctaatgggagggaaaatgtaaagtgaactggccaacggtgacacgtcctgtcaacctcgacggccttggaatgcttgattcaaaaagattttctagagcgttgcagttacgttggttgtggctggatgggcaaaccctgatgctccatgggcggggctcgaaactccttgcaccaacactaaccaacttctctttgcggcggcaacaagaataataatcgtcacaatttgacagtcaaggaagcgctagttgaccatggttgggtgagaagtatcaacttacagttcatctcggcaatcgaccacttgagccaattcattgagccttggacaattgtgcaatctatgcgcctcgtgcaaaatacggaggatgagataacttgggccttcactcaagcaggctcctattcaacgtcaacagtatacagagcatagttcataggccacaccgatgtaaacttcaaggcgcttatacagagcatagttcatctgcctaggatgcctagaaagggagtacgctccatgctccttctcacagtgtgggaaatttggaaggaacgaaactcttgtatttttcaatagaaggagagaagcgtgccgacgctcctgtcgaaaatcaaagaagaggccaccctttggggcaccgccgacgccttgcaacttcaggcgatccttccggctatgtaaacctaaagccaatcctcgcgagatccaaaaaaagttgtaaatctgtaatctagccaagttttgcttgcccctttttttggggggagcgccctaggaaaccttgttcaaactcttctttttttttaatagaaatgcacactatcttgtgccgttcatttcaaaaagaggacttgatgatgcaatgttggatgatgcagagtcaagctggggcattccctcctgggaagaagatcacggtggtgtttgtcataggtatgccatgcctactgtactgtgtttttatcgagcgaatgtatatgatcatattttttgcctaggcggcccaggcagtggcaagggcacccagtgctccaagattgtcagacactttggatccgcccccctgagcgctggcgacctcctgcgccaacaagttcagtcagatactgaacacgggtgacacctgatcgctcgccattttccgatatgttgtaggcgccagcttgccatatatccttctgacatgcccatatatctcgtcagtgccatgatcaagaacctgatgcacgaagggaagctcgtgccgtccgacatcatcgtcaggctcctgctcacggccatgctccagagcggaaacgacaggttcctcgtcgacggattccctcgaaacgaggagaaccgccgagcgtacgagagcgttgtgagttccgatcgacgtcgtgtctgtcgtctgcctcagcttttttctctgtcggccggagaactccccgtgcgtcgtcctgtttaagcttctctcatgccttctagcttgttcattaattaccagattggcattgagcctgagttggtgctgttcatcgactgcccaagggaggagctggagcggcgcatcctgcaccgcgatcaggtgtcaggcttgctctttgcttgtcactccagtcagcgccaagccctgtaacctgtgtgtttcttctggttgtctgtctgcagggaagagacgacgacaacgtcgacactataaggaagcggtttcaggttttccacgactccactctacctgttgttctgtactacgacagaatggggaaggtccgacgggtaataataattctttttattttgtatggaacgtacaccgtgctgattaaagtttgtaaataaatatgaactgctattttttcaggtcgatggcgccaaatccgctgatgcagtctttgacgatgtgaaggctatatttactcagctactgaccactcaggtccactcactcactcacatttatcttccctttttttttccaattgattgttctctcctgataaagccttgaaaaaacatcggcgctcgtccgtctatcctctttttgtttcactatgtatataggcaagccaaggtggcaatgcgagcagcaggcggagcaatccgccgctttgttcagtgctctaggatgaagcaacatacctccagctccaaataaaaaaaagaggatttcagaaaacacacacttgctgtgcgtatgtggtgtgttcgtgctgtgctgtgctgtgctgtgcagatttaatggcttgttaaaaagaaacagagaataatggccctccccagctgcagctggtatggtgggccgccctggggcgccccctggggctgcgagcctgctgcaaacacacagcttgtatttctaattgtaaaatgtagcgaaatggatgaatgtgatgtgtgcaactcattcagtttgctttgctgcatctcatctgatgatgcttgtgatggctttcttccgcaaagctgccgatctggggcttgtttatttatttatttccaactcaattagcatcgtgtttgagttttttcccccctgctattttgggttcgtgatttctattttttttgtttgtttggtcaagttaaacatgacaatctattttcttgtgtagatttttaacgttctatgtttttagaccgattttttttacgttttcaccatttctcgtgaattatatataactcactggctttagatgttttttgggatcttttcattagctttctaaaaatttcatgtcattaaaaattagtgtccaaatatgaaagcttgatatactgcaaataggatatcatatagtctgacgctctctga

SEQ ID NO: 11948 - DNA, 1108 bp, Zea mays
ggtaccctcggggccggccggggtctcctctcctgcacccagactcctctctctctctctctctctctcccctctgtgtgcggtgtgccctggcctcctccgccgccattgcagcgagcaagatcaatccctctgctgccattcatgagtcaagctggggcattccctcctgggaagaagatcacggtggtgtttgtcataggcggcccaggcagtggcaagggcacccagtgctccaagattgtcagacactttggattcacccacctgagcgctggcgacctcctgcgccaacaagttcagtcagatactgaacacgggtgacacctgatcgctcgccattttccgatatgttgtaggcgccagcttgccatatatccttctgacatgcccatatatctcgtcagtgccaccacgcgtccgcccacgcgtccggggaagctcgtgccgtccgacatcatcgtcaggctcctgctcacggccatgctccagagcggaaacgacaggttcctcgtcgacggattccctcgaaacgaggagaaccgccgagcgtacgagagcattgttggcattgagcctgagttggtgctgttcatcgactgcccaagggaggagctggagcgacgcatcctgcaccgcgatcagggaagagacgacgacaacgtcgacactataaggaagcggtttcaggttttccacgactccactctacctgttgttctgtactacgacagaatggggaaggtccgacgggtcgatggcgccaaatccgctgatgcagtctttgacgatgtgaaggctatatttactcagctactgaccactcaggcaagccaaggtggcaatgcgagcagcaggcggagcaatccgccgctttgttcagtgctctaggatgaagcaacatacctccagctccaaataaaaaaaagaggatttcagaaaacacacacttgctgtgcgtatgtggtgtgttcgtgctgtgctgtgctgtgctgtgcagatttaatggcttgttaaaaagaaacagagaataatggccctccccagctgcagctggtatggttgttcgctcagtggcagcactagaggctgcgagcctgctgcaaac

SEQ ID NO: 11949 - DNA, 895 bp, Zea mays
  misc_feature (832)..(832): n is a, c, g, or t
acactcctatgggcgattggctcccgcccggccgggccggagactcctctctctctctctctctctctcccctctgtgtgcggtgtgccctggcctcctccgccgccattgcagcgagcaagatcaatccctctgctgccattcatgagtcaagctggggcattccctcctgggaagaagatcacggtggtgtttgtcataggcggcccaggcagtggcaagggcacccagtgctccaagattgtcagacactttggattcacccacctgagcgctggcgacctcctgcgccaacaagttcagtcagatactgaacacggtgccatgatcaagaacctgatgcacgaagggaagctcgtgccgtccgacatcatcgtcaggctcctgctcacggccatgctccagagcggaaacgacaggttcctcgtcgacggattccctcgaaacgaggagaaccgccgagcgtacgagagcgttattggcattgagcctgagttggtgctgttcatcgactgcccaagggaggagctggagcggcgcatcctgcaccgcgatcagggaagagacgacgacaacgtcgacactataaggaagcggtttcaggttttccacgactccactctacctgttgttctgtactacgacagaatggggaaggtccgacgggtagatggcgccaaatccgctgatgcagtctttgacgatgtgaaggctatatttactcagctactgaccactcaggcaagccaaggtggcaatgcgagcagcaggcggagcaatccgccgctttgttcagtgctctaggatgaagcaacatacccccagctccaanataaaaaagagaggatttcagaaacacacacttgctgtggcgtatggtggtggtgttcgtgct

SEQ ID NO: 11950 - DNA, 1240 bp, Zea mays
aaaactagcccaaagaatgacaaatttttcggagggggaaattgccaattttctcgtttcattcctcctcgggtggcccgtcatcgcgttcaccctagttctttctttcctggcagcgacaactgcgcagcggcgccgccaccggacgtcagatctccgttgggtgtttgatggcgatgagcacctgtcaggtactctaaggccactttctctcattaaggtagtactgagttcattgcatgactatgacttctgaagatggagacattttggctcttctgtctgagccaagcctaaaggaagagcaacttgaggcttctgaatctgatgctatgttttctgcaattatgaaagccattgaatcaaataagaatgtagttgaagtttcacctgaggaagctgcctgggcagattcatgcttcgtgcagacttctgaactgtcatatgatgactggggagcgatgaggagtatgctgcttgatgccctcgaaaagccaacagaaagtcccagtgatacttcagaaagtgcacataatgcaatctcagaggcaaaacctcactcccttcctgctgaaaacatttctgagcatggcgacatccacatggagcaaataaacaataccgatgatgacaaggatggtactgaagcttttgaaattgctgatgtaatcagacgtgtagacgataatggtaagcaaattgatagttatgtagcagacgctggtgatgagttggtccttgagcagacccagtcaacaggttctatatttaaggtttgggacctggaactgccattttctgatgatgatgatgatggcgagcttgaactcgtcaaggatctgaagaagcttctcaaggagaacagccttccagaggatatatatccaactcttcctccagatgatgcagccaaacccttgagccagataagcatcaatgaaattgtggcgggcttgagcgatttatcaatacagcaagcccatgagtgactattatttctcaaatagctgtggcacaccttggtcgtccaggcgatattttgttttgtgcaaatcacttgggtggtttaaacagcaggtttaggctaactgttgtgctgtctgttttttctgtatactcgccgttttgatttctgcttaacttgaaatcagctaaaaatgaagatgctttggtagaattcgcgttcagaaaaaaaaaaaaaaaaaaaaaaaaaaaaagacctgcccgggcggccgctcga

SEQ ID NO: 11951 - DNA, 1566 bp, Zea mays
  misc_feature (19)..(19): n is a, c, g, or t
cttttctggtaggctgggngaaaaaaagtgggagccgacaacgacgaaagcgagcaggcatggccgcgagcttatctctccacgtcactcccggctgcgggtccaagaagaagaagttcaagcaggcggggaagagcagagcagcagtgaccagtgagctgcttgtccaagaatcgctcccactcccggctgtcgggagagcgcagcccagctagccgcctccgcttcttggaggtcgatggccgcgaaggggttgagggaggtggggaggaggagggcggcggaggtcgggcggcgctgcttgtctggcgggagcgctgggccgccggcgccggcggcgaagcggaaggagggagggaaggcggtgaacctgttcacggccgtcaaccaggcgctccacatcgccctcgacaccgacccccgcgcctacgtcttcggagaggacgtcgggttcggcggcgtcttccgctgcacgacaggcctcgccgatcggttcggcaagagcagagtgttcaacacgccgctgtgtgagcagggtattgctggatttgccatcggcctagcagcgatgggcaatcgagctatcgcagaaatccagtttgcggactacatctttccagcctttgatcagattgtcaatgaagcagctaagttcagatatcggagtggaaatgaatttaactgtggaggcttaacgattcgaactccctatggtgctgttgggcatggtggtcattaccattcacagtcaccagaggctttcttctgtcacgttcctggactcaaggttgtcataccacggagtccacgcgaggctaaggggttgctgttggccagcatccgagatccaaacccagttgtattttttgagccaaagtggctgtatcgtttggctgttgaagaagttcctgaggaggattacatgctgccgttatccgaggcagaagtgattagggaaggaagtgatataacgcttgttggatggggagctcagcttgcggtgctgaaagaagcctgtgaagatgctgcaaaggatggggtgtcttgcgagctcatcgatctgaaaacactcgtaccatgggacaaggaaacggtagaggcctcggtgaagaagaccgggaagctcctcgttagccacgaggctccagtcaccgggggcttcggcgcggagatcgccgcgtccattgccgagcgctgcttccagaggttagaagcacccgtggcgagagtctgcggtctcgacacccctttccctctcgtgtacgagccattttacatgcccaccaagaacaaggtcctggatgcgataaaagccaccatagatttctgaaacatgttgcttgatcgatacagagtactctagttacatgtgcacggtttgtgctggtctgggtctgtagcctgcctgaggatgagcgatccacaaaccggcttatttgtattcaacaatacagcgataaataaagccgcaaggtgcaaaattgtaggataaaaaaaaaaatcgaagtgttccccgcgaaattcatacgtatgtaattatcacactaatcagtggtatgttatgtc

SEQ ID NO: 11952 - DNA, 1567 bp, Zea mays
ggggtggcatgtctgcctccacccctccgccaccaccacagccgttgccttcgccgcgagcgaccgtagcgaggtgattgcaatggtggcctccactgcttcccgcctctcgcccccgcgcttcagcaccccttccccgtctcttcatcctccaaaccgccgctcgcgcttctcccctgttcgcgcagccaagttggaagctgtgctgtctattggtgctcatctaatcccacacccaagaaaggctgcaagtggcggagaagatgctttctttgccaatagcgatgctggcggagtatttgccattgcagatggtgtctcgggatgggcagaaaagaatgtcaatccagctctattctctcgagagctcatgagaaacagctctaatttcctcaatgatgaggcggtcagtcatgatcctcagattcttctcatgaaagctcatgctgcaacttcttctattggatctgcaacagtaatcatcgccatgcttgagaagaccgggactctaaaaattgcaagtgtgggagattgtgggttgaaagttattcgtaaagggcaagtaatgttctctatatcccctcaagaacattattttgactgcccataccagataagctcagaggcagagggtcaaacatataaggatgcattggtttgcagtgtaaatcttatggagggtgatataattgtgagtggttcagatggactttttgacaatatctttgaccaagagattgtttccataatttctgagtcgccaagtgtagatgaagctgcaaaagcattggcggagcttgcaagaaaacactcggtggatgtcagattcgattcaccctactcaatggaggcccggagtagggggttcgatgtcccctggtggaagaagctacttggaggcaaactaataggcggtaagatggatgacatcacagttgttgtcgcacaagtgaagacagtagtggtcccagaggacgaggttcagggtggcgacacagaagaacaaaaggggaatgagcagggcgctgcagctgtggttgcatacaaaatgaatgatgaagaagtagcttgagttctgggaccatcctcattttcattctcttcattttacttttctgtgatgactgtattatactgcacataaaggaattgaagcaaaataaatttgtgtgattgtgtctaaaaaaaaaaaaaaaatccccgcccccagatttttcgcacctttaccgttaatgaaatacgccttccaagctgggaaacgtaccaggggtaagccgtttgtgaccgttctttttgcgccgtctttttgcattttagccctttttaggttttattttcacaaatacatcctttccagcttcattttaaaaaatggaccctcagctcggcgccatcactattgtcgtcgagttataacgtgtcggcgccaattagtttggcgtgtacatgtaagagctgacgcctacgtggatctgatgtagcagcacatcggcgtcgacctcggcgccatggatctcggcgccgacctcaaattcgtagtacctatctcgcgagacaaaaaattcag

SEQ ID NO: 11953 - DNA, 1401 bp, Zea mays
gtacccttttgagccggccgggatgtctgcctccacccctccgccaccaccatagctttgcctttgccgcgagcgaccgtagcgaggtgattgcaatggtggcctccactgcttcccgcctctcgcccccgcgcttcagcaccccttccccgtctcttcatcctccaaaccgccgctcgcgcttctcccctgttcgcgcagccaagttggaagctgtgctgtctattggtgctcatctaatcccacacccaagaaaggctgcaagtggcggagaagatgctttctttgccaatagcgatgctggcggagtatttgccattgcagatggtgtctcgggatgggcagaaaagaatgtcaatccagctctattctctcgagagctcatgagaaacagctctaatttcctcaatgatgaggcggtatctcttgctaaacctcaacactatttataggcatcattttctttactctatgtgcttgtaacaaattcatgtcacatggaagttgcaggtcagtcatgatcctcagattcttctcatgaaagctcatgctgcaacttcttctattggatctgcaacagtaatcatcgccatgcttgagaagaccgggactctaaaaattgcaagtgtgggagattgtgggttgaaagttattcgtaaagggcaagtaatgttctctatatcccctcaagaacattattttgactgcccataccagataagctcagaggcagagggtcaaacatataaggatgcattggtttgcagtgtaaatcttatggagggtgatataattgtgagtggttcagatggactttttgacaatatctttgaccaagagattgtttccataatttctgagtcgccaagtgtagatgaagctgcaaaagcattggcggagcttgcaagggaaaacactcggtggatgtcagattcgattcaccctactcaatggaggcccggagtagggtgagattgaaacatctcttatgatactctcttctacatgtcattctttacatcgtcaatgatggaacatgttgcactccggatatgcaggggttcgatgtcccctggtggaagaagctacttggaggcaaactaataggcggtaagatggatgacatcacagttgttgtcgcacaagtgaagacagtagtggtcccagaggacgaggttcagggtggcgacacagaagaacaaaaggggaatgagcagggcgctgcagctgtggttgcatacaaaatgaatgatgaagaagtagcttgagttctgggaccatcctcattttcattctcttcattttacttttctgtgatgactgtattatactgcacataaaggaattgaagcaaaataaatttgtgtgattgtttccaaaaaaaaaaaaaaaaaagcggcc

SEQ ID NO: 11954 - DNA, 1884 bp, Zea mays
cgtagtctcttgggagttgtctaaccgagtggtttaaaggtaggcatcgttctcatatctcatccatctataaattcgaagatccggactccccccggacaaccggacatcccaatcgaatcagatgagaagctggaggctgctccacgatttccttcggcgcctgctcaaacccaccgatactcccgcccaaatccgcccggcatcacacctttccacaaaatccggccaggctgcggcgcaatccgctgccgccgacccaacccgcgcggtgtcgctcctggccgagcgggactggttcgctcggatcaactcagagttcgccgccccactccggcagctgggcccgcgcttcgtcgtccgcgcgctgcagcacgccgccggcgagccgctcctctgcgtgcgcctctacgtctgggcatcgaggttcggtcagcacttcgcgcgggaccggtccgtgcggcgcgcgctcggggacgccctgttgcggcgcgggcccgtggtgctctccgcggcactggtcgccgacgtacggagctgtggctgcgaggtctcggaggagctgctgtgcgcgctggtggagagctggggcaggctcgggctggcgcactacgcgcacgaggtgttcgtgcaagtgccgcgcctgggactgcggcccagcacggccatttacaatgctgtgatcgccgcatcggtgagggcaggcgcggtggacgccgcgtacctcaggttccagcagatgcctgcggacgggtgtcggccggactgcttcacgtacaataccctggtgcacggagtctgccgacgcgggatcgtcgacgaggcgctaaggctggtgaagcaaatggagcgggcagggatcaggccgaatgttgtcacatacaccatgttggtcgatgggttctgcaatgctagcagagttgaagaagctgtttgtgtgttggagaggatgaaggagaagggagtgtcagcaactgaggctacatacaggtctctggttcatggtgcatttcgttgccttgaaaaagaaagggcatacaggatgctgagtgagtggattgagagtgatcctactctgcattcaattgcatatcatactttgctgtattgcctctcgaagaatgatatggacaaagaggcagttgaacttgcgaagaagatgagcaaaaggggatatctccttggcagcacaacattcagcattgtgatcccttgcgctgtgaaagtcttggagtcaagtgatctgtgtgagttggtagatgatttcatcaagaaaggggggaatctgggatttgatatgtatattatgattattaaatcctttctgaggtgcaaggatatctcaaaggcaaataagtattttagtcagatggtttcagatgggcttttgtctagtgtggaatcttacaacattgtgatagattgctttgccaaggcaggtgaagtggaaagagcactggagaccatcaaagttatgcaagagtcaggtttctctcctaatcttgtgacttttaacacattgataaatggatatttgaaactaggcaatgtacatgatgcaaaagcatttcttaaaatggtcatggaacatggtttaatgccagatgtcattacttttacttcccttattgacgggctatgtcatacccatcagctggatgatgccttcaattgcttcagtgagatgtctgagtggggtgtcaggccgaatgtccagacgtacaatgttctaatacatggactttgttcagctgggcatgttagcaaggccattgaacttcttaataagatgaaaatggatggcattacacctgatgcatattccttcaatgcacctattttgagtttttgcaggatgagaaaaaaaaaaaaaaaaaagcggcc

SEQ ID NO: 11955 - DNA, 5525 bp, Zea mays
tggctccgataccatttattcctataactattttaaaatattaattttgtaaaataatccagatatctactttcatccctatttgtggcattgtcgagactgatctcttcatctcggtcatcttctgtaagcacgctaatgtgacgaggcggacgagctgctccgcacgctgtgggattcgacctatatcctcataatttatatcggactgacagggttgtttccggtcattatgcgtgtgtatggttacccgcatcaagagagccagactctccgtatgtattgacctcagtccatatttagtaccttgcactcagaagactagacgtgcatgcactggtacagcctagacttatttggctgcacccgtagtatttgggcggccaagcttgctctgtctgcgcgcaaggaggcatccaatcacacggaatttgattgtcagggtacaaagtgattggcacccaaaattcaataccgaacatctcgcatatactctttatttcagaaaaccatccaatcactaaccaacaacgacaaacaaattaaagtcgtcatacatgtaacgtgcggttgtgaaacgaccccgccgccgttccattcagttgtttatcggagtcggacgacggtggtaccagccagcagcagcagttgtggtagtgtggcgctatgcactcgccgcccttggggtagcctatcctcttgcaccatgcgtcgcagttgggctggatctcctggcactgcgtctggcacataccgtacttcaccgccgtcgtccctgcaaaacccatgtcgccatcaaacaacacttctctcgctcgtatcgtaccaccacgcttctgatgaaaggtgtaaacgaacaatagacagagggatgggatcgagctcaccggcggggaagagagcgaccatggctactgtcgcaaccatgagaataataatcttgcgtgtggtaattgctgtcaccataccgaaactctggtgctcaagatctgtggaaatcgatggaagcggtaagatcagaggggatggatggtcttctgctatggttcgttgttgtatgctgctctatatatatacacacacgaagacgaaggatgcatatatatggcagcatatagatgcagtttattgtctgcactactggcagtctggcgctgctagtatatagatttcgccactatttattctcttgctcggtttctggcgtaattcttagcgattaatgcttggttgccaaatatatctttaacaattaatgtctgtaattgtggtgataatgaatggttgccaaaaactagtcattactataatatttaactggtgcttttgtctggtgtctcactggatacgtccggcaagtgtaccgccactcgaatgtacacttaatttgtaggcctatccgacttccttgtatcatgtcatgtacaatgccatgtcggacacgtacgttcggtaagtactcaaccttttggtttgaaacctctccgggatgccctattgttgtaacacccagatttctatttttttcggaatctaaatagaatttcccgaaagatttatttgaattaaagtgcttttaatatgtattaggaacttaagttatttccaaaaaaataaatacatgcatgggcaaatgtaaaaaaaaaatatcatgtttgtgtactggaagccggagcactatatttattctgtgtggattcagatttgaaattgggattttaaaattggatttgaattctcttttttttcttcttctggaaatacaaaagatttctattttttttgtattttgttcgtgggctaacatccgtttacacggcccccggctgccctcgccgccacgcgaacgggccgagccggccacagtccagtccgcgctcgtttactggatccacccgaaaccaacctacccgctgaaggagtgaaggcgtaagcgtaatgctaggagtcgcccatcacttcgggacttcgggttcgcgcgcgcgatcactcgtatttggccgccgacgggtgggcccctgttggcagccccgtcttcttcctcgtgcctgaatgcctgaatcgagcacgccgccgagaccgagtttgcgtcgaacaaagcgttgtgaattcctcagcaggaccaaagcggaacaagtttagatccaagatgacaaagccgaacaagtacgcgcgcggtgtgaattgttccaaatgtaacgactctccatctctcgttgtgtggatgcaagacaagggctagaatgaatagaatgtgtggtcacaatcagacaactggagctgcaggactctcgctcgctaggttagctggcgtagtcccgcaagctttgtgagctctatctgctgacacgacatgtacgtgccccttgcttggcagcttgcacggctctctctctctctctctctctctctctctcatcccatggcctggcgccctggccgcacgtcctgacgatcgacgctagcgaacaagcggacgagtttcccgggtcacgcatgtctcgtcgtctcgttggaccacaaccgtcgccgggcaagcagtacaagtacgccccacatgcttctctctcggagttggggacaggacagcctaccgaaatctctctgctcggtcttccttcactctctctcatagtctcatgcatgcatggctcccactgcccatcatcaggtaaggcacgcaccaccagcacgcgacgcatgcacgcaaatgggatgggatcatcacatgcgccaccactgctcgtcacggctaagccgccgccgccgcgcgtttatctgcttcacctgctgcaggcagcgcgggacgatgagctggagaagagccgccgcaagcccggcggcggcggcaaggcggcggcggtccggtgccacccggtcctggcggaggagcgcaaggcgtccatcaggggcgtggtgggcgacctgctggccatggcgggcggcggccggaggagcctcatctcgctcggcgtcggcgacgcgtcctcccacgcatgcttccgccgcggcggggagttcgccgccgaggccgtcgcccacgcccgccttgtccggcgccttcgactgctatgcgccgtccttcggcttccccgacgcccgccggtgagtcccagtcgcctagccatcacactcacaccacaccacaccacacgcatcgaattcccattttttcaaagccaagtacagcacgagtatccagcggacgtggtcctgtccacgtggcacgtaccaggacctcgagctcgagccacgtggcttcttgcgttctcatgcataccatccctcacgccacggttgctctctctctctcttgcatgcatgctgctgcgccgtctgccgtgccgaaccaaccgaccaaacaaacagcgcggtcgccgcccacctgtcgaccggcgcggtgcaccgcacgcacgaggccgacgtgttcatgacggcgggcggcacgggcgcgatcaccgccatcgccacggtgctcggcggcgcgccgggggccaacgtcctgctgccgcgcccgggcttcgcgccgtacgaggccgcctgcgaggtggccggcgccgagccccggttctacgacctgctgccagcggcgcggctgggaggccgacctcgccggcgtgcgcgcgctggccgacgccgccacggccgccctcgtcgtcatcaaccccaacaacccgtgcggcgccgtctactccgctcaccacctccgccaggtgagcgctgcgctgattggttattagttcatctgcaaacaaagctcgctcatatccaaatgcccaagttcatgaatgatcgatcgtccaagaataatgcactgaaaatgaaccctgcagcttgctgaaaccgcaagagagttggggattcccatcgtagcagacgaggtgtacgcacacatggtcttcggcggcagcaggttcgtgcccatggcctccttggcgcacatcgcgccggtcgtcagcatcggagctctgtccaagaggttcatgctgccaggatggcgtctcggttggctggccttctgtgatcccaacggcgcgctcaagcatgtaagccacgccacttcttgccatgtctccacattcctctctgcatgcacattcagacgcgcgtctcatggtttcggatcttcgaaaggtcagggctgcgaccgagatgctgctcaacgtgacttctggccctgcctccatagtccaggtcagcaagcagttcttcaaaatgattctacatgtatccaaaaaaaaaggtgaacacatactgatacagatggaatttgttggcacgtaggcggcggttcccaagatcctttcagctgaacaccatgagttccataggaatgttgttcacctgctcgagtctgcagctgatgctctgtacagaagagtgaaccaaatcgaagccctgcggtgctactccaagcctgaaggctcaatgtttatgatggttagtcagagatacacaaaaattcagtatttgaaactttgttacttcccaacaaggtgttggtattcacaaaaccctgcaggttgagatcaacacttcaattctacatggcgtcgccaacgacatggactttgctcgtgagttgatcaaagaagaatgtgtcctggttctacctggtacagctcactcactccatttgttgcgatattattttatccaacctttaacaggtgcattggtttctctggctgctgagaactgaatgttagtaataggttgacttgacattccagtacaagattcttcatgctggcatgcttaatctactctaaaattgatctgtagtaacagatccaatatcttttctgtttcttgttattttacaggttctgtcattgggttgaagaactgggttaggatatttttcggagcacctgttagtttaatactagaagcttgcgacaggattgagatgttctgccgaaggaggacgctcaagcaaaacaactgaagagctgaaaatgttttgaaaccaggaagtagggtttttgttagcccagtaacatatatatacagcttcgatttattttccaatgcacattctgaggtttgcatatagaaaactgagaacagatgcttgtctatagttaaaatatatgttatacataattccaggaaatggtgtaaacatttatcatttctttacttgtgccttctacttcacagatgcattaaggttattgtctttttattgaacagacagcaagcaaaagaagcaagctaacgctaaattcgtagacgggcggggtgttatctgttcaatgcccctcaacttcaaacttcagaatagcacaagctccaaatgacatttgttgaaaactacagggaggtgaaaagatatactgctagttctgacattacagcgaaaggtaatccaatcatttgtgacctaacattaccagtcaatgtactacagcagtctgacaaggccaaaaaaacacagaatctatgaaaaaaaaagagttttttgaattgtgctaaaactgacaaatacaaattgccaactactctaaactctatgcaaa

SEQ ID NO: 11956 - DNA, 1613 bp, Zea mays
gttggggacaggacagcctaccgaaatctctctgctcggtcttccttcactctctctcatagtctcatgcatgcatggctcccactgcccatcatcaggcagcgcgggacgatgagctggagaagagccgccgcaagcccggcggcggcggcaaggcggcggcggtccggtgccacccggtcctggcggaggagcgcaaggcgtccatcaggggcgtggtgggcgacctgctggccatggcgggcggcggccggaggagcctcatctcgctcggcgtcggcgacgcgtcctcccacgcatgcttccgccgcggcggggagttcgccgccgaggccgtcgcccacgccgccttgtccggcgccttcgactgctatgcgccgtccttcggcttccccgacgcccgccgcgcggtcgccgcccacctgtcgaccggcgcggtgcaccgcacgcacgaggccgacgtgttcatgacggcgggcggcacgggcgcgatcaccgccatcgccacggtgctcggcggcgcgccgggggccaacgtcctgctgccgcgcccgggcttcgcgccgtacgaggccgcctgcgaggtggccggcgccgagccccggttctacgacctgctgccgcggcgcggctgggaggccgacctcgccggcgtgcgcgcgctggccgacgccgccacggccgccctcgtcgtcatcaaccccaacaacccgtgcggcgccgtctactccgctcaccacctccgctagcttgctgaaaccgcaagagagttggggattcccatcgtagcagacgaggtgtacgcacacatggtcttcggcggcagcaggtttgtgcccatggcctccttggcgcacatcgcgccggtcgtcagcatcggagctctgtccaagaggttcatgctgccaggatggcgtctcggttggctggccttctgtgatcccaacggcgcgctcaagcatgtcagggctgcgaccgagatgctgctcaacgtgacttctggccctgcctccatagtccaggcggcggttcccaagatcctttcagctgaacaccatgagttccataggaatgttgttcacctgctcgagtctgcagctgatgctctgtacagaagagtgaaccaaatcgaagccctgcggtgctactccaagcctgaaggctcaatgtttatgatggttgagatcaacacttcaattctacatggcgtcgccaacgacatggactttgctcgtgagttgatcaaagaagaatgtgtcctggttctacctggttctgtcattgggttgaagaactgggttaggatatttttcggagcacctgttagtttaatactagaagcttgcgacaggattgagatgttctgccgaaggaggacgctcaagcaaaacaactgaagagctgaaaatgttttgaaaccaggaagtagggtttttgttagcccagtaacatatatatacagcttcgatttattttccaatgcacattctgaggtttgcatatagaaaactgagaacagatgcttgtctatagttaaaatatatgttatacataattccaggaaatggtgtaaacatttatcatttctttacttgtgccttctacttcacagc

SEQ ID NO: 11957 - DNA, 1468 bp, Zea mays
ctctctatcatgcatgatctcatgagggccatgaccccgtccatggtagttatgtttttttaataaaatcagattgacactcgctaattatcttgcccataaacttttctagtcttagcatgcgaactttagtaaagatttttaacactacattcaataaataatttggtctatattagtggatcttgttagcatatttgactttaggaagaagagtgatcaccacgtaattgaatatgtcaatctctagcttgtttggataaagatcattagtacaaattatatcttgattagtacaaattatatcttgatagaactcgatggaagatatatactccggtccagcgagtaaaagagaagaaaatccggtctgtaccgtaccagacggcccagaaggccagaaagggaaagacggcccatctagtactgctagacaaggcgacaagctgcgacgccggcggctagaactccgggaccgggactcattcggtgccgcgcgtctactgctgatggaggctatggatttcaccgtcgccagcgccgacacggggtgccaggaacctccgaatacgctggtggactgggcgctggagatcctctccacagccgatccggacgagaaggcccgcctcggggacctcgccgcgtcgcggtggctgcgcggcgacatcccgctcccctacgacccgtcccgccccgcgcgcccgccgcccgaccgccccgcccggagcgccgaggtgcggctgctcccgccgtcgcggatgccgaagctgggcaagggcggcagcgcgcagagccgtttggccatgctccactcgctggcgcacaccgagagctgggctgtcgacctttcctgggacatcgtcgcccggttcggcgcggccatgcggatgccccgcgacttcttcgacgacttcgcgcgcgtcgcgcaagacgaggggaggcactacacggtgctctcagcgcggctgagggagctcgggtcgcattacggcgccctcccggcgcacgacgggctatgggactcggcgatgcgcacctcgcatagccttctcgcgcgcctcgccgtcgagcactgtgtccacgaggtgaggatcaatgcctttgcaatattatgtttatttaattcgggaactattggttccaacacattaatctgcattgctttgccaaatcatattagtcctgataagaagagtgaggtcgatgttcagtataagtgtcttttccaattttgtttttgatgaaacatgaggagaatcctctgctgacgatttcattatatataagaaaatcctaaaaaggaaaagaaaagacatacaaaagagaaaggaaaaacacaaagaagaaaagtaagaagagtaatgtagccaacttctaagaatgtactgtcagacaatcaacttcgaagagaaaggtattcttagaagtctttaccataagaacaatcaactccaattcgtcgtga

SEQ ID NO: 11958 - DNA, 1506 bp, Zea mays
gggtacctcgaccgggactcattcggtgccgcgcgtctactgctgatggaggctatggatttcaccgtcgccagcgccgacacggggtgccaggaacctccgaatacgctggtggactgggcgctggagatcctctccacagccgatccggacgagaaggcccgcctcggggacctcgccgcgtcgcggtggctgcgcggcgacatcccgcttccctacgacccgtcccgccccgcgcgcccgccgcccgaccgccccgcccggagcgccgaggtgcggctgctcccgccgtcgcggatgccgaagctgggcaagggcggcagcgcgcagagccgtttggccatgctccactcgctggcgcacaccgagagctgggctgtcgacctttcctgggacatcgtcgcccggttcggcgcggccatgcggatgccccgcgacttcttcgacgacttcgcgcgcgtcgcgcaagacgaggggaggcactacacggtgctctcagcgcggctgagggagctcgggtcgcattacggcgccctcccggcgcacgacgggctatgggactcggcgatgcgcacctcgcatagccttctcgcgcgcctcgccgtcgagcactgtgtccacgaggctaggggattagatgtccttccaacaaccatatcaagattccgagcaggtggggatgagcaaacagcaagactactagaagatattatttatcctgaagaggtgacacattgctcagctggtgttagatggttcagatacctgtgccttaggtcccacggtaatcacccaacctcatgttcagttcctggactggaaccccgttcctctgggctgccgggggatggcactgctgatggtaagacagctagggaggctgaaggtgaacctacacccaaactggcgaaagacgtcaggggtgacgacaaaatggtccagcaggtggaagatgaactgccatccaggattgcacaggatgctaatggtcgatctaaggtgaccgaacacgtcgaggacggattagcaaagtgcaaacttgatgacagtattgagaaatacgaagagttggtcattaggactttccacagggtggtaagagagtattttcggggacccctgaagccgcccttcaacacggaggcgaggaaagctgccggctttgagcctgcctggtatgaacccctggcagtgaaggaggcatgcatagagggggagacaattgagtgatgaatttgcactgttgttgtagtgtctgtgctatgtagcaggctagaaggcatatttgaaaatttgctgcgactagcgttccagtaccattatttgtttagcagatggtgcggcgctgagccttttttctaatcatgtttgtttgcttgccatggagacgcatgaacctatctgtgtgaaagcctttgttcagcttgacgtgggcttggagtgtgaaaaaaaaaaaaaaaacctcaaaggacgatgccaattgaggctggatttcaattaaaaaaa

SEQ ID NO: 11959 - DNA, 1880 bp, Zea mays
ccggccgggatagtgttcgtcctacttatctcaaaccaaacagacgtcgcgttcgcgatcggtgaattttaaacaagtgcatcatccgcagatagaacgcttcctcgtgcgaagcgattgcctgaatttccgccacagtccggcgcagttcggcggcaattcggccggcgagcacggttgcgccgccacgggcctacgatgcgctcccacccgacgcaacgaccggagtaccggaccggacctgcccaacccacggacgacgcggcaagtgaaatccgcgagcgaccctgcctccggccgacagggtgactccgtgaccgtgagtgcctacccgccgaccgcacgaaccccactcggtcggtcactcccagtctccatctcccactacggcactaccccatccccggtgcggcgccaccttcccggcttccccttccggccttccccctctcgtcacttatggtgcccagccgctcgctgcgcaactactagcgcaccgtcccctcctcagccatggccgcggcgtcgttcgcccgcgccttatgtctccacatgctcctcctcttcctcgtggttggctcggcgcgctgcaagacggtgaagagagacgtgaaagcattgaatgagatcaaatcttcactaggctggagagttgtatactcatgggtcggtgatgatccttgtgggcatggtgatctacccccctggtctggtgtgacatgttctcagcaaggggattacagagttgtgacggaactggaagtctatgctgtatcaatagttggccctttcccaacagcagtaactaacctgttggatctaagaagattggatctccacaataacaagttgacaggaccaattcccccacagattggacggttgaaacatctcaggatattgaacctgaggtggaataagcttcaagatgtgcttccacctgaaattggtgaactgaagaaactgacacacttgtatttgagcttcaacaacttcaaaggcgagattccagtggagcttgcaaacctgccagaactccgttacctttatcttcacgagaaccgcttcaccgggcgaatcccccctgaacttggaacgctaaagaacctacgtcacctcgacgtgggcaacaaccacctgacaggcactctcagggattttatcggcaacgggaacggcttcccgtccctgagaaatctataccttaacaacaatgagctgactggtgtgctgccagaccagattgcaaacctgacaaaccttgagattctgcacttgtccaataacaagatgatcgggtcgatatcgcctaagctagttcacattccaaggctgatctacttgtacttggacaataacaacttcattgggaggataccggaagggttgtacaggcatccatttctgaaggagctgtacatcgaaggaaaccacttcagaccaggaaccagatcgaagggaacgcacaaggtgctggaactgcctgacgccgacattctagtctagcaagctcgtttaggggacctgaggtcttggcgtcctgcagtagtagactgctgccggtaccaggatcacttctgtctgtcgctgtactattccgtggcaaaactacagttgagaaaaaaaaattctcttggaaaaaaaaagaggcaaaaaaaaagtgaatagtagaggccacggtcacactgccgtcatcgttagatgagccatgagtgtacaggttgtattgttctgccctgcatcttcgctgtatgatggagatgccggtcagatgtaaagccagcacatcgcatggcaccgacagtcctggtacaactagtggccaatgatatatggcctctttcggaagcaaaaaaaaaaaaaaaaaaaaaaaaaaaaaa

SEQ ID NO: 11960 - DNA, 1151 bp, Zea mays
attgggaccctcgaggccggcccccagatatggttttcggatacttgaaagcccatcttactctccttccggtcgccgcagtaaacccctaggaagaaaccccaccgcttctggccgccgccggctcaccggtgacggcatccaaatccatggcctcccgccaggcgctccacatcttcacgccctcccggcgggcgatgcacatcctcacgtcgtcccgcggcatcgcctcgaccccgcacctctcgtccttcggctggtttgataagatcaagtccaccatcactggcaagaagcccgaggaggcctccgaggcatcctccttcaccctcatccagttcgcagacacgatggagaaagcgaggaagctggggacgttcaagaacttcgttgccgggcgggccagcgaggccaccgtcgtgaacgtcttcgagaagcactccgctgtgctgcgctacctcggtgccatcgaccccaccggcgagaacctccgaaacactgacaaaattaacgcgaccaagcactgcaactgcacaattgctgacgtggagcacattctggccaagtacacatgggctaaagaggctcagaagaagattgcaaagctcaaggaagaagggaagccattaccaaagtcatttaacgaggtccaaaatctaatgggttctacaccagtggatgtcggcagaagtaatctggcaaagagtggtcagataagtaggaatgctttctgcccatgtggttctaagaaacgatataaaaggtgctgtggagcttcatgagatgaacaacaatcctctcgttcactagcacatgcaggccaggtgcagcgtttgtaagctcttttctttgccaaactctaccaagctctttcgtggacaacacctgaatttgaagcttgcaatttgtaaagcactatgagcgagccctatgtttcagaaggctttctcttaaactctgatttcttgattggagttgttgtttaacattgattcagttcaaccatgcatgaatctaggtaatatatatccacctagctcgttttctgcaacaagatttgttatagattcatttttactcagcattttatgttctactcggcagcttcattttttatggatgtgtttgaataaagccttctgttattctag

SEQ ID NO: 11961 - DNA, 1575 bp, Zea mays
  misc_feature (1548)..(1548): n is a, c, g, or t
cgttgctgtcggtaataaaaaaaaactcccagtctctcccggtgccgtccgctgttcggctccggaagtccccatccgctccacctctcctcctccactcccccgccccactgatcgcggcggtgagaacatgctctttctacatttcgctgaagttttaagttatattggcattcgtgttgtcaagtctgaactaaagcctcagccaaggtggcatgtctgctaaggtgccaaggtgcctagaagtttgttccagtggcatggcggattgggcctctattcaaacggatattcttggtataataataaagaagcttccaatccctgattacattagattccgtgctgtgtgcacatcttggaacaatgtctgcaaggatgtgtcatactgtccaagggtggacccatggctgatgctccccccaaaccagaatcctcttggtgctcagttcttttgcattcctgaaagaaagaatcaaagtatccgcctccctaacaccgcctcactgttcgaatcggtctgggctccggttggttcttccaatggatggcttatctacttcagtcacacttacggaaccatgcagctggttaaccctgtaagtggcaaacatatccagctccccccgatagggcgcaggaccttctctaaggccaagctgcttgaaatcagcgagaggaacttcatcgtcgctgtcctctatggtgatgagaaaggctacaaaataacacggaaagggtccagcaactggtcgtcggtcgagtcaaaattcattttggatgacatcatcaagcatggaggccggctatacacgtgcgacatgtatggcacagtggagatgtgggcagagccgccccgcgcatggccagatgaggaagtcacgcatcggtggaggttccgctgtcttatagagaccccagctggtgatctggtcagggttaagcgcctgtgccagaacaagtttgctgtttggatattggacaaggcgagctcttcctgggttgggaccgagaacattggggatctcgcgctgtttgtgagccactacaactcattctgtttccctgccagtggccagcccaacctgaaagcgaactgcatctacttcatcgacatctacaacaacctgtgcgctttcaaccttgagcatgggaccaaggaactcgtccaaactcttaccatcggccgaggccaagggcgcaatgactaccaccgttggcctgagcgagaccaggtcttatggtttatcccttcactaaagtaaatactgaaggtaatggtggatgatgcgtgtccgtttacccccccagagatggagctcatatagtactgtaggctcctcctatggacggccatttatcccgatatgaaggtcgtatagtatcctgtatttccaaagtattggatgtcgcacatgcaactgcaggtctatgtatatgagtaccgaacatcgtcttaacttgttgctaaatcaactgtttgaaccatttgaagctttcgtttcaaaaaaaaaaaaaaaaaaaaaaagaaaaaaaaaaaaaaaaaanctcgagggggggcccggtacccaatcg

SEQ ID NO: 11962 - DNA, 803 bp, Zea mays
cctcgaggccggccgcggtccgctgttcggctccggaagtccccatccgctccacctctcctccactcccccgcccccgcggccccgccccactgatcgcggcggtgagaacatgctctttctacagctcgttgaagttttaaattatattggcattcgtgttgtcaagtctgaactaaagcctcagccaaggtggcatgtctgctaaggtgccaaggtgcctagaagtttgttccagtggtggcatggcggattgggcctctattcaaacggatattcttggtataataataaagaagcttccaatccctgattacattagattccgtgctgtgtgcacatcttggaacaatgtctgcaaggatgtgtcatactgtccaagggtggacccatggctgatgctccccccaaaccagaatcctcttggtgctcagttcttttgcattcctgaaagaaagaatcaaagtatccgcctccctaacaccgcctcactgttcgaatcggtctgggctccggttggttcttccaatggatggcttatctacttcagtcacacttacggaaccatgcagctggttaaccctgtaagtggcaaacatatccagctccccccgatagggcgcaggaccttctctaaggccaagctgctcgaaatcagcgagaggaacttcatcgtcgctgtcctctatggtgatgagaaaggctacaaaataacacggaaagggtccagcaactggtcgtcggtcgagtcaaattcattttggatgatatcatcaagcatggaggccggctatacacgtgcg

SEQ ID NO: 11963 - DNA, 1364 bp, Zea mays
gcaggatgtgcatatcctccataacatggaccggagcagccacatggcaagtaggcaccaaacgtaacaaaagtcgtcaagtccttccgtcaagtggaggaaggtgatgcaaaaaaagttgtcctgtgttttttagttggtcaagtttttattttagtgttttgttagaaaaactgttggagtatacaggtaatatacatctaaaaagttttagtccgccaccattgatcagcttttgggaaaaaattaggctaatttgagaatccaaattttccaaatgatttctattttcctaaaaaaaattaattttttcacttttaaaaaatacgaattatttagaaaatagtgtttccaaactagtccttaatatctttttagatttgctctaatccccaatcccagttcccgttctattcccgggaggagacggcgtcgtctctcgctgtctccgcgttcgtgccaatccaagcgaaacaaacggcgtgacgggagccaagagcccgagagcgccctccgcggccgccgcaccgcgtcgtcgttgtccccagccaacccaacccagcgcaatcccaaacgaatccagccccacctcagccgctgcgcggacctccgaatcccggcgccggtgcgcgcagggcaccgcagggcgcggcgcggccatggacatggacagcgtggagtgcctctccctcccggacgctgccatggacgtggacgacatcgaaggccgcccgcaccacggccatctcggcctcccgctccaccccgcccacctcccatcctcaggtgccggccgcgcgttccccaaggtgaatgccgggggcgccgtggcgggcccggcgggagcggcgggcacagcaggagcaggcgtggggccgccggcgaccagcgtgcacgagctgctcgagtgccccgtctgcaccaactccatgttcccgccaatccatcagtgtcaaaatggacatactttgtgttcgacatgcaaggccagggtgcacaacaggtgccctacatgcggacgccggcttcgtgacagcggaatcggatcgaattgacctattcttcgcggatttgccctgctacgaatgggtaatttgctccctgttgaccgggccatttagcttcgaattagttgcgattagcatatctaattggctgcgttcggagtactcgactgtaaaaccatctgcaaattggtccttctttgtcagatgatttggccagttttgcgttagatttcagatgaatcgtgtatttcgctatggatctgagttggacgcgttatgctacagagtctctcctagtcctaggctcctagccaagctggtcgatttcgatttttggaggatacaaatattgcattt

SEQ ID NO: 11964 - DNA, 2834 bp, Zea mays
tgaatcaatcgaaattgtttgagcatttcacaagtggatagatcgctccaccgtcgacatagttaatgtgacagtcgataatatggtcggcaatacgatcaatagctaatgtgacggtcaataaaaagatggctaggttggatccaacgttacctcgctaataataagtggctgtcatccctgtgaaactaaaactagctggtagcccctagctaatacatattacatagtagttatttagttacttggttggtctacttccatgcactagtactgtagcaacgatttttaacctctaagtaactattaccgcaggtgggtcctgctctgccgccagcagtgtatgaacttgtgcacaatccgctactacttgatgatccagcaggcagcagcattcgcgctgctgtgcattttaccgagatggactggctgcctgaccagggggattgacttcgtctgggcccacgagccagtcaccccatgaacctagggcccagtccgaacgcgcctcccacggcggcgcgtgcgactcccccagcatgggaaataaatagatgtcccaattacccatcgagccgtcgtcgtggagcggcaggatttgaaaatctcgcgagaggccttgtccttgtccacttcctccgcttcgccgtcctcaaagcagcggaaggggagaggccagggtgcagcagcaggacccccaacggcaacctccgccacgcgccacggagcaaccaagcagcaggtgccgtgcgcgcggttcccacttccctcctctccctctctctctctctctctcgctagtcgctaacttctcgatttgatcgctgcggttgccgtgtgggcgcgtcgtctgttttctctctctctctctctctctctctctctctgttctcgattacttctcgttcgtgcagtgcagatgaactattaatgttcgttttttttcttgaagttctgctttgttctgtgacataagtgaggtactacatcgaaaaacgatctgattttatttttcaggtcacaaacctgaaaataccaatctacgatacagatctagaaaccacgaatacatattttgtcggggctaatagggaaaaaagaagatattttgtggcatcggaactctgtaacactgttggtttctgtgaacgcttcaggtaagtgacgagacaaagatggtgcaggaggagctgccgcaggcatggtggttcgacagccacaacctcgcgaggccgtcgccgtggctgaacagcacgctctcaggtttcgcctctctctctctctcctgatactggatgctctgctgttcttactgcgtgccttttagcacgtggatctgtcttcgttttgtaaacgggaaaacatgcggaactgtctttgttctgtatgcatagctttattttgttagcatgtatcttctttgcatggaggaattattttgtctaggcgctgcgctagtactaatttttatttgctttgtttatgccatgatgaagtacctgaagtttttgttcgattattacatttcctttttgtgtttacctgggaatttctctaatgatctttaatctacattgctcatttgcacttgacattagtacattacttcacatctgaatctattgctcacttgcacttgactttacatggccacatgggaatttataaccttgttgtatctctaggactttgggctctgatggatgaaagtgatggaactaccactgcttactgacgagaggttattatgcttgtccccctttggtctcagagctggatgacaagaccaagcaaatgctgaagctgatcgaccaagacgcggactcgttcgcccagcgcgccgaaatgtactacaagaagcggccggtgctggtggacatgctcggcgacctgtaccgcacgcaccgctcgctggcggagcagtacgacctgctgaagcacggcagcggcacacggcacacggtcttcggcctgtcttcctgcacacagagccggtcgtcgacgaacggcaggaccactcctcgctcctcctgctcggcctccatgtacgactcggagtccgaagtggacgaccccgggcaggaagaatacgaggcagagcagctggcgcgtgcggggatggccaagacggactcgccgccgccgccgccggagcagcagcagcaaagaacagcgtgagcaggcggagcagcagatgcgcgcggagatcgagaggctcaaggcgcagaacgcggcgctgcagaaggcggccgaggagagcgcggcggcgctcagggcggagctggccgggaaggacgaggagaagcgggaggtgatcaggcagctggcgtcgtccatggacgtgatgaggcaggagaacctcacgctgcgcgagcacatcagcaggggatcgtcgaagcgttcctctgcgccccgcgcgggagctgcgttcgatctcaggaaggtggccaggggcctcttctccgcgaggctgttcaccgcgcactgcaggcctacgggccccatcgtcgcgctctgagcaggatgccaggatcgtgaagagagacagcgtagatatgcatttgttgtaggcgagtgatgtgcatattataggatggcatcgatcgatattccctccgctgtctgtttctcaggttcaactaaactagagggagcactcgttttttactatgatggcgtagtagtagtagttaactgtagttaaatatttactagtcatatggatgcatgtttgtatgatggcgttaattattgttaaagtattattttgtcagttcctcttctgctatgactatgatttttgggcctgggtagaaataaaaaaaaaaaaaaaa

SEQ ID NO: 11965 - DNA, 1295 bp, Zea mays
gtcgtcgtggagcggcaggatttgaaaaatctcgcgagagggccttgtccttgtccacttcctccgcttcgccgtccctcaaagcagcggaaggggagaggccagggtgcagcagcaggaccccaacggcaacctccgccacgcaccacggagcaaccaagcagcaggtaaggcaaggcaaggtaagtgacgagacaaagatggtgcaggaggagctgccgcaggcatggtggttcgacagccacaacctcgcgaggccgtcgccatggctgaacagcacgctctcagagctggatgacaagaccaagcaaatgctgaagctgatcgaccaagacgcggactcgttcgcccagcgcgccgaaatgtactacaagaagcggccggtgctggtggacatgctcggcgacctgtaccgcacgcaccgctcgctggcggagcagtacgacctgctgaagcacggcagcggcacacggcacacggtgttcggcctgtcttcctgcacacagagccggtcgtcgacgaacggcaggaccactcctcgctcctcctgctcggcctctacgtacgactcggagtccgaagtggacgaccccgggcaggaagaatacgaggcagagcagctggcgcgtgcggggatggccaagacggagtcgccgccgccgccgccggagcagcagcagcaagaacagcgtgagcaggcggagcagcagatgcgcgcggagatcgagaggctcaaggcgcagaacgcggcgctgcagaaggcggccgaggagagcgcggcggcgctcagggcggagctggccgggaaggacgaggagaagcgggaggtgatcaggcagctggcgtcgtccatggacgtgatgaggcaggagaacctcacgctgcgcgagcacatcagcaggggatcgtcgaagcgttcctctgcgccccgcgcgggagctgcgttcgatctcaggaaggtggccaggggcctcttctccgcgaggctgttcaccgcgcactgcaggcctacgggccccatcgtcgcgctctgagcaggatgccaggatcgtgaagagagacagcgtagatatgcatttgttgtaggcgagtgatgtgcatattataggatggcatcgatcgatattccctccgctgtctgtttctcaggttcaactaaactagagggagcactcgttttttactatgatggcgtagtagtagtagttaactgtagttaaatatttactagtcatatggatgcatgtttgtatgatggcgttaattattgttaagtattattttgtcagttcctc

SEQ ID NO: 11966 - DNA, 958 bp, Zea mays
gggtacctcgaggccggccgggaagataaccagggaccaagaccaacccagtgcaccacacaaggcattgtcagcggcggcggcggcggcgggccggcggagactcccaggccaggagcagtctgccgattggaaggggagatgaaggccacgctcaagggccgctacgagggcgacaaggccacggccgccaccaccctcgccgcccccgccggcgacctccgcctcaaggcctccgccaccgaggccgccttcaccaacggtccttccctgcgaggcctcaccctcaccctcgagaagcccggcgccttcctcgttgacctcaagccccacaaccaggatgtgcgctttcagttcatgaactccgcgctcgtgctcgacaagcgcgtcagcctcacctacactcactccactagcctcgccgcggcccccgccgccgcgccgccctcccgcaccgcgctcgactgcaccgtcactttcgaccccgccaacaaggtcagcctctcccactcgctaggctccggcggctgccgcctcaagtacacctacgcgcacggggtcgaccgcctcaccaccatcgagcccctcttcgacaccaacaagaacgcatgggagttcgccatcaccaggaagttcgccggaggggacgccgtcaagggcacctaccaggcctccaccaagctgctcggcctcgagtggagcagggactctctcgccggcggctccttcaaggttgcgacgacattcgatttgtcggaccaaagcaaagcaccaaagctaatagcagagagcacgtggaactacgaaatatgaaaaatggaagtgtccttctcatatcatacatactgcttgattgctgtatcctcctgaactatggagctattgttttttcggaaccattggtggtggtttacatctgattcttttgaggaaaaaaaaaaaaaaaaaatttgcggcc

SEQ ID NO: 11967 - DNA, 1218 bp, Zea mays
  misc_feature (17)..(17): n is a, c, g, or t
cctcgaggccggccggngaaaaaaatgcggtaagtaggtaggtaggggggccccccggccccccggggcgcacggcggcgcccggccgggccaaggagtccgtccgggtacggcggcggtggcgactggtgcgatgcaaagggcggaagacgcggaggagataggacaactcagcgcaccacacaaggcactgtcagcagcggcggccggagactcccacgccagtgccagactcgattgggaggggagagatgaaggccacgctcaagggtcgctacgagggcgacaaggccacggccgccaccagcctcgccgcccccgccggcgacctccgcctcaaggcctccgccaccgaggccgtcttcgccaacgggccttccctccggggcctcaccctcaccctcgagaagcctggagctttcctcgtcgacctcaagccccacaaccaggatgtgcgcttccagttcatgaaatccgcgctcgtgctcgacaagcgcgtcagcctcacctacacccactccaccagccttgcggcgccggcgccgccctcccgcaccacgctcgactgcactgccaccttcgaccccgccaacaaggtcagcctctcccacacgctcgggtccggcggctgccgcgtcaagtacacctacgcgcacggggtcgagcgcctcaccaccatcgagcccctcttcgacaccaacaagaacgcctgggagttcgccgtcaccaggaagttagcgggaggggacgccgtcaagggcacctacgccgccaccaccaagctgctcggcctcgagtggagcagggactccatcgccggcggttccttgaaggtcgcgactatgtttgatttgtcggaccaacccaaagcaccaaagctaatagcagagagcacatggaattacgagatatgatttttttcccataaaaatgagaaatcatccttctcatattacttacacctactgcttgcttgattactgtatcctccagaacaatggagctattgtttcccatgtgctggtttgcatctggttatgttgaccattttgagctgcggtcgaatgatgccgcgacattggattctgagaatgaatggacgccgaatatggtctgtccttcggcaaggttacatctaaataggagtaacattgtacttaaactgaaacctcatgaccttagtgtctcatatcaacattgagtagacggttcatattt

SEQ ID NO: 11968 - DNA, 1098 bp, Zea mays
catggggcaccgaccaacccagtgcaccacacaaggcattgtcagcggcggcggcggcggcgggccggcggagactcccaggccaggagcagtctgccgattggaaggggagatgaaggccacgctcaagggccgctacgagggcgacaaggccacggccgccaccaccctcgccgcccccgccggcgacctccgcctcaaggcctccgccaccgaggccgccttcaccaacggtccttccctgcgaggcctcaccctcaccctcgagaagcccggcggcttcctcgttgacctcaagccccacaaccaggatgtgcgctttcagttcatgaactccgcgctcgtgctcgacaagcgcgtcagcctcacctacacccactccactagcctcgccgcggcccccgcggcccccgccgccgcgccgccctcccgcaccgcgctcgactgcaccgtcactttcgaccccgccaacaaggtcagcctctcccactcgctaggctccggcggctgccgcctcaagtacacctacgcgcacggggtcgaccgcctcaccaccatcgagcccctcttcgacaccaacaagaacgcatgggagttcgccatcaccaggaagttcgccggaggggacgccgtcaagggcacctaccaggcctccaccaagctgctcggcctcgagtggagcagggactctctcgccggcggctccttcaaggttgcgacgacattcgatttgtcggaccaaagcaaagcaccaaagctaatagcagagagcacgtggaactacgaaatatgaaaaatggaagtgtccttctcatatcatacatactgcttgattgctgtatcctcctgaactatggagctattgttttttcggaacccttggtggtggtttacatctgattcttttgatcaaaaaaaaaaaaaaaatggcctgggagtttccactgagctgcggtcgtgccattggagttttctgttgagaatgaatgaacgacgagtatggtctatgttcctggggtttgtttgcgtggaagcccgtctgggttctggcttttgctcatgtggtggcgtcaactcatgaaaaatggaagtgtccct

SEQ ID NO: 11969 - DNA, 1643 bp, Zea mays
ggccggccggggtaaagtgcaatccgcttgaaacgaaagacaaaggagttgagattcacgtctttcgccacgctgtcgcggccattcccggcctccgttgtcggtgcccgaaccctccactccatccctccacggctgaggtaccattcccgtcgcagcgaattgcgccaatgagggtggctcttgtcgaggcctgatccggagacctaaccaccggggctttttgtcggcgccgtcgggttcgagcggcggcggcgatgttttggaaggatagcggcagccggagcagcagtggcagcggtcgggatcagaacggcgtcggccccttcggccaagtgcgcgtcctcattgtcggtgattcaggtgttgggaaatcttcattggtgcatctcattttgaaaagttctgccattgctcgaccatctcaaacagtaggatgcactgtgggcattaaacatgttacttacggaagtgcaggcggttcatctaataacatcagtgacgctgaaaggaacttctttgttgagctttgggatgtctcaggacacgaacggtacaaggcatgccggtcgattttctatacacaaataaatggcgtcatatttgtttacgatctctctcagaggaagaccaagacgaatttgaataaatgggcagttgaagttgctgaaactggcaccttttcagctccattgggatctggtggaccaggaggacttccagtgccctatctggtaattgctaataaagtggatatcgttccaagggatggggcaagagcaagcagggggaatcttgttgatcttgctcgccaatgggctgagaagcagggccttcttcggtgcagcgaagaacttccactcacagagagctttcctgggaactccggtcttgtgtcggctgctaaacaagcaagatatgacaaagaagtcgtgatcaagtttttccgcttgcttattagaagaagatacttctcaaacgaacctcctgccccaagtccctggtcccttgctccaagagaagataccatccttcctatggagactcttggagatggcgcagatagcttccaaaggaaaagccttagtggtgagggttttttgtacaacggactggtcccactcccagcgcagaggaacctgacgccgccaccgactctgaatccgcagcagcccgtgtcgcccttggataactacagatatcatcgattctcctcctcgtcgcttccggacgtgagcagcagcagaacaagccgagaagatattattaatctatgatgtggtaggcatctgagagaggtcatacgccacaacattacctgcaaaacgtgggaagcatatggtgcctgggaattgtgttcctgtggcatcttgaactgcttaaagcctttgcttgcagcatttggaatgctgccagggtgagctttttgttctgttttaaatgtcatgtcgttgtcagatcactaggaagtggttctttctccttttcgtttcctttccatcctccacctgcattcatttagaatacgtgttgactgggatggaggcaatacatgatacgccagtataccttcaaaggcaaatgtaagtttttttatgtactgtttctttcactaaaaaaaaaaaaacttggcaagcttgatg

SEQ ID NO: 11970 - DNA, 1436 bp, Zea mays
attctcggcccacctcgagttgacaagctcacaaaaggccacgcggacacaggagaggggagagcccgagagcttcccttgccggcgagatccagtccggctcacgcgatctgactttcccggagcagatccaggttaagcagatggctgacaacagcattgagcaagcattgatagagaatcctcctaatgtgctgaaatggaagccatcagaaagagctaaacggtttcgacgatgcaggtcaactccctcagatcccaccgatcaaaaacctgcagaaaacggatctgtgcttaaagccaaagagttattcaaggagaaaaggccgagcttcatgcttgtaggcctcctccttttcgcctacctactagtgggtgtcatcatcttttacctattcatggatcaattatctgggaagacaactaatagagtgcttgacgccttgtacttcgttattgtcacaatgacctcggttggctatggggatcttttcccaaacagtgacacaacaaagctgcttgcttgcgcttttgtattcacaggaatggcgatcattgctctcttcatcagtaaagcggcagattaccttgttgagaaacaggaggtgttgttcttcaaagcactgcacatgaatatgaagggcagcgaggccaaaatgctaggagcaatggaaacaaataggataaagtacaaattctacactgtcgctctgcttcttgcaatggttattgttgctgggactgtatttctgtggaaggttgagaagctcagccttgttgattccttctactgtgtctgtgccacgatcactaccctgggttatggggataaaagcttctcgtccaaactggggcgtgtttttgcagtgttttggataaccacaagtactctcatcatggctcagttcttcatgtaccttgctgagctctacactgagcgccggcagaaaatcctgaccaaatgggtgatcaacaggaggataaccaccatggatcttgaggcagctgatatagatgacgaccgacaagttggtgctgctgaatttgtactttacaagctaaaagagctcggcaagatcagccaagaggagatatcttgttttctcgaggagtttgacaagcttgatgttgaccagtctggcacactctcaacttacgaccttactctaggacaaacaattcaatgactgatgatgcatatgtgattttgctgactgaatgattttgtttgatgtcgttagcatttctgttgtccatatgtaacgctgtaatgttgtaaagatgtaaattgagatgattgagaaattgtgccccgccttttctccaaagcaacttgaatcaaggctgtaaagaacaaatacttgctggagacagacgacatacctgcaaatttatgattggcttagctcaaaaaaaaaaaaaaaaaaaaaaaaaaa

SEQ ID NO: 11971 - DNA, 1356 bp, Zea mays
atttctcggcccacctcgagttgacaagctcacaaaaggccacgcggacacaggagaggggagagcccgagagcttcccttgccggcgagatccagtccggctcacgcgatctgactttcccggaggtccttgaatgtgatcgcatcattgcagcagatccaggttaagcagatggctgacaacagcattgagcaagcattgatagagaatcctcctaatgtgctgaaatggaagccatcagaaagagctaaacggtttcgacgatgcaggtcaactccctcagatcccaccgatcaaaaacctgcagaaaacggatctgtgcttaaagccaaagagttattcaaggagaaaaggccgagcttcatgcttgtaggcctcctccttttcgcctacctactagtgggtgtcatcatcttttacctattcatggatcaattatctgggaagacaactaatagagtgcttgacgccttgtacttcgttattgtcacaatgacctcggttggctatggggatcttttcccaaacagtgacacaacaaagctgcttgcatgcgcttttgtattcacaggaatggcgatcattgctctcttcatcagcaaagcggcagattaccttgttgagaaacaggaggtgttgttcttcaaagcactgcacatgaatatgaagggcagcgaggccaaaatgctaggagcaatggaaacaaataggataaagtacaaattctacactgtcgctctgcttcttgcaatggttattgttgctgggactgtatttctgtggaaggttgagaagctcagccttgttgattccttctactgtgtctgtgccacgatcactaccctgggttatggggataaaagcttctcgtccaaactggggcgtgtttttgcagtgttttggataaccacaagtactctcatcatggctcagttcttcatgtaccttgctgagctctacactgagcgccggcagaaaatcctgaccaaatgggtgatcaacaggaggataaccaccatggatcttgaggcagctgatatagatgacgaccgacaagttggtgctgctgaatttgtactttacaagctaaaagagctgggcaagatcagccaagaggagatatcttgttttcccgaggagtttgacaagcttgatgttgaccagtctggcacactctcaacttacgaccttactctaggacaaaccagtcaatgactgatgatgcatatgtgattttgctgactgaatgattttgtttgatgtcgttagcatttctgttgtccatatgtaacacgctataatgttgtaaagatgtaaattaagatgattgagaaattgtgccccaccttctctcc

SEQ ID NO: 11972 - DNA, 1289 bp, Zea mays
ctcgaggccggccgggactcgaacaatactactacgactactataaatacagggccgggtccctctcccccgctttttaatttagtgcacgatttgttgcatcgtagccaactagcaacgacaacccagctagtgattcggttgccgccatggcttacttgctcaagaacaggagtaaaccagtgcagcagctgctggtaccggcgtcttcagaagaacagcagagaagggtaaatgaggtccgggagctccttggcgatctgccgacagagatgccgaacttcctttctgatgccactatccgccggttcctccgagcaagaaactggagtacgatgaaagctaccaagagcctcaaagaagctaccagttggcgacgtcagtacaagccagagaaaattcgttgggaaagcattgccgactgtgagaatgaggctaggagagcctacatacctgactaccttgacaagaaaggaagaatggtcttcgtaacacttccaacaataaagtccaaatcttcagagaaggatcatctaaagtatctagtgtacaacttggaaaacctgctcatcgattgtgcagatgcagaagaggacaacgttgtttggatctcggatttcaaaggctggtcaatatcaagcacaccattttcgttgacccgacaatcgctgcacataattcaacaatattatccaggattgatagcagttggtattctaaccaacgctcccaaaatttttgaatccttttggaagataatgaaacacttcctcgagccaacaatggacgaaaaagtgaaatttgtgtacaacgacagttcggagagccagaagatactgggcgacatgttcgacctcgacgagctggagcatatatttggaggaagaaacacggccgactttgacatcaatgtgtatgcagagagaatgaaacggcgagatcggatacggggagcttcgacagaggataatggcgaggccacctcttcccgatgttggacgaagaccacgagaaactccagttctgtttgaagagcgcagtaccactaatctggacgaaggttgaaactttagtgttatcctatatactgtatatgctctgagccacgcgagcgcggttatatgataaaactgcttagcatttatagttatgaacacaaagagtgttaactttaaggatctgcgactcgactcctaaaagaatgtaaaggctagttcggaagtttgagaaataaacctagggttcgaaaaatctttcataataactaaatatcttatccaaaaaaaaaa

SEQ ID NO: 11973 - DNA, 830 bp, Zea mays
  misc_feature (758)..(758): n is a, c, g, or t
  misc_feature (801)..(801): n is a, c, g, or t
  misc_feature (813)..(813): n is a, c, g, or t
cattgggtacctcgaggccggccgggaggagggtaccaccagctacccctctctcttactgcttcgaacttgtctctccatattccttcccgcacgcccacatagaaacagaagttcacacacgaacaatactactactactataaatacaggagaatgttttgccgcatgtttttctttttaatttagtgcacgatttgttgcatcgtagccaactagcaacgacaacccagctagtgattcggttgccgccatggcttatttgctcaagagcaggagtaaaccagtgcagcagctgctggtacccgcgtcttcagaagaacagcagagaagggtaaatgaggtccgggagctccttggcgatctgccgacagagatgccgaacttcctttctgatgccactatccgccggttcctccgagcaagaaactggagtacgatgaaagctaccaagagcctcaaagaagctaccagttggcgacgtcagtacaagccagagaaaattcgttgggaaagcattgccgactgtgagaatgaggctaggagagcctacatacctgactaccttgacaagaaaggaagaatggtcttcgtaacacttccaacaataaagtccaaatcttcagagaaggatcatctaaagtatctagtgtacaacttggaaaacctgctcatcgattgtgcagatgcagaagaggataacgttgtttggatctcggatttcaaaggctggtcaatatcaagcacaccattttcgntgacccgacaatcgctgcacataatttcacaatattatccagnattgatagcagntggtattctaaccacgc

SEQ ID NO: 11974 - DNA, 1491 bp, Zea mays
gctccctgggccgaacaattccggactgggctaccgccgtccaccgcagccactttcgacccgcgcgttctttctctctcgaggcccgccgggctcttccggcggctgggcagtgggctaccgccgccgccgccctacgccaggtgctgaggtcttcgtcgatctcgagctcccacaagggaagctgtccaggatgggatacaaccgccacaggcgtggccggggatcatcctcatcgtcttcgcgccgcaccaagcaagaagcctcgtgtgatgatggccttgggacatcacttccaaggcaagaagaaggcacagaagacgaactcaaaggttcaagaattcagcttgcaatgtgggactttggtcagtgtgatgttaaaagatgcactggtcgtaaactttcaagatttgggcttttgaaggagttgagagtgaccaatggttttggtggtgttgttctcagccctgttggaacacagtgtgtatccaaggaagatcatcctattgtgcaaagaaaaggattggctgtggttgattgttcctgggcacgtttaagtgatgtcccttttgtgaaactacgttgcggtgctcctcgtctcttaccatggttggtagcagcaaatcctgtgaactatggccgcccatgtgaactgtcatgtgtggaagctttatcagcagccctcataatatgtggggaggaagatacagcacatttgctgcttgggaaatttaaatggggtcacgcattcttgtctctaaacagagatctcctgaaagcatactcccaatgtgaaaatggagctgagattatcaatgtgcagaagtcatggttatcaagtaactcgagtgttccaaagccacctgtaaacggggcagaggaatcacggcaaaacaaggaggagggatctgaaggtgattcagacgatgacttgccccctctcgagaagaatatgaaccacctgaacctcgaagaagacgaagaaagcgaggaagagagtgaaagcgagtaaaattgtggtctgaaagtgctgccatggtaactttacgactgttttacaagtgaatttcagttgccttgcctgctacgaagcaaccgttgtaggtgcttcagtgtctaatagccagaataagcttcagtggccttttcgcccagatgttgaatgcatggttcgaaaagaaatccttgtacgcctttaatagtgtgtacctatagcactagctttgaagataaatgatgagttgaacacattgagatcatttttctttctaggagaatacacataccgctagctggctggttacatgatgaattgggctggtgtgttgcccgtacttggtttttattagtttgtttcatatatcagtccatgtagtatatgaaaatgacttgagaaacatcgatcatgaagatacatgcaattgtagaaggcttagtcttatcttaatctccagttctctacaatataaagcactagtttttacggttcat

SEQ ID NO: 11975 - DNA, 1260 bp, Zea mays
ggctccctgggccgaacaattccggactgggctaccgccgtccaccgcagccactttcgacccgcgtgcgttctttctctctctctcttccggcgactgggcagtgagctaccgccgccgccgctacgccaggtgctgaggtcttcgtcgatctcgagctcccacaagggaagctgtccaggatgggatacaaccgccacaggcgtggccggggatcatcctcatcgtcttcgcgccgcaccaagcaagaagcctcgtgtgatgatgatggccttgggacatcacttccaaggcaagaagaaggcacagaagacgaactcaaaggttcaagaattcagcttgcaatgtgggactttggtcagtgtgatgtcaaaagatgcactggtcgtaaactttcaagatttgggcttttgaaggagttgagagtgaccaatggttttggtggtgttgttctcagccctgttggaacacagtgtgtatccaaggaagatcatcctattgtgcaaagaaaaggattggctgtggttgattgttcctgggcacgtttaagtgatgtcccttttgtgaaactacgttgcggtgctcctcgtctcttaccatggttggtagcagcaaatcctgtgaactatggccgcccatgtgaactgtcatgtgtggaagctttatcagcagccctcataatatgtggggaggaagatacagcacatttgctgcttgggaaatttaaatggggtcacgcattcttgtctctaaacagagatctcctgaaagcatactcccaatgtgaaaatggagctgagattatcaatgtgcagaagtcatggttatcaagtaactcgagtgttccaaagccacctgtaaacggggcagaggaatcacggcaaaacacggaggagggatctgaaggtgattcagacgatgacttgccccctctcgagaagaatatgaaccacctgaacctcgacgaagatgaagaaagcgaggaagagagtgaaagcgagtaaaattgtgggctgaaagtgctgccatggtaactttacgactgttttacaactgaatttcagttgccttgcctgctacgaagcaaccgttgtaggtgcttcagtgtctaatagccagaataagcttcagtggccttttcgcccagatgttgaatgcatggttcgaaaagaaatccttgtacgccttagtagtgtgtatctatagcactatctttgaagataaatgatgaattgaacacattgagatcaaaaaaaaaaa

SEQ ID NO: 11976 - DNA, 1396 bp, Zea mays
  misc_feature (12)..(12): n is a, c, g, or t
ctcgaggcttgnccgggtcagccgccacgcgacgcgaccaagtggacgaaccgcaacaggcaagtcttcgcttcgctcctctctgcggctccctccggcgagcggcgatggccttctcacccccgctgatcgactgggaggcggagagctaccctgcctacccagatttcgcggccattccccttttcgtcgtcttcttcctcgtcgtccgtttcttcctcgaccgcttcgtattcgagtggttagccaggaagctgattttcaaggaggaggatgagaagaagcttggccctactacatatgcaggcaagagaaagatcaggaaatttaaagaatcagcttggaaatgcatgtattttctttctggggagctattggcattgtctgtgacgtacaacgagccatggttcacaaccacaagaaatttctgggttggaccaggcgatcagatctggccagatcaaaaaattaaattgaaactcaagacagtctatatgtatgttgctggcttttacacatactcgatatttgcccttttgttttgggaaataaggcgctcagacttcggtatttcaatgactcatcatgtagcaaccgtctgtctgatagcactgtcttacatattcagatttgctcgggtgggttcagttgtccttgccattcatgatgctactgatgtgttcctggagcttggaaaaatttccaagtatagtggccatgagttgtttgcagatgtttcatttcttgttttcgtcagttcttgggtactcctccgccttatatattatccgttctggattctctggagcacgagctatgaagttgttctgactctagacaaggaaaagcataaagttgacgggccaatatactactatgtattcaacagtcttctcttctctctacttgttctacacatatattggtgggttttaatgtatcggatgcttgtgaagcaaatacagtctagagggcacgttggcgatgatatacgatctgattctgaaggtgaagaggaacatgaggattgattgagctgtgtagagtcggaagataataagtaacatggggatggattgagctgtataagttccaaaggcgaaaaggaatacgtggatggattgagctgtgtaaattctgaaggtgtatcaaatcattctgctgtttttcttctgtccttgttcttgataagtaacaataaattagtgcccttctctaggtgagcatcatcgatagatgtcacttgggcattatcattatctattgatgtaaaatcaggtcacattgcatagcacacacacaacagttaatggaaaatgttagcagtgcacatataaaaaaaaaacttggccagttccccctttcaatactgggcttaaatgaatgctaacttatc

SEQ ID NO: 11977 - DNA, 1006 bp, Zea mays
ggtaccccccggcccggccgggatgccttcacggggagcaatccgcaaaccctttctactttcttcccctgctcgattcgcgcagctgcatcaccggcgacggcggcgatggcacggaggagaaagacggacgccccgccgcggctggacgaggcagatcgcacgctctactccaccttctgcggcgccgccaactccctctcccagctctacgcgcaggccatggcccagcagaagctcaacttccatgccggcgagcgccacgccttagaaaagctctaccagtggatcttgaggaagcacgatgaagaggctaggctcactgtggctgaaataatgtctcatatccagcatgagatagactatgtaggtactgatgcacatgtctccccaagagtacctcagcatcctcagattgcaaatccattcgccaattcagttgtcccacctggaactggtttgtatgggcaatcagcagctgggtttgctcctagacccagtgtcactgaccagtcgaagaatacaatattctctaatgccttatcaagcccagtgcgcaggagtctccagaactctcataccactcaaggtgctggcaatggaggccggaatgcagaagcaaacttagcaggtgcaaatagagaggccaattctacaagctccaacgacacttctatggatatggtttcagacacgaatgaattctaccagtgatttgcagtaagatgcttctgcaatcaagcagcatcgcatgccagtgttttttttgggcctttcctttcgttgaggttttcacataaactctcaccattatgtgagcaatgtagttgtatatccggtgattctggtttgttcaagttggtatttaagttgaaacgtgttgggcatgctttattccccacaatgtgttcgtgagttcaaatattatgaatgtacatgcagattgcgttgtgatataatcaaataaaagaaattgactgaaggcccctaaaaaaaaaaaaaaaaa

SEQ ID NO: 11978 - DNA, 1659 bp, Zea mays
attgggaccctcgaggcggcacgagaccattacctagctactcgatcgaaaagccgcacccgcacgccagaaacagctctcgcgttgcttccgcacgccgcccatggcgagcctgtcgtcgccgagtctcctctcttccttcctcggcgaccgcctcgcactctccactaggcctctccttctccgctccgctgtcccaggcagcaggcggctggcgtatcaagcaacgagaacgctatgcaacttggtggatatcctatttaacaggagaaatcaggatgatgcaccagaaaacaaccctagacgcctgcgtcctgggaaagtatctccacgccttagtgttcccaatcatatacaacggcctccatatgtcaattctcgtcaacaacgacctggtatgaataatggacctgaaatacatgatgagaacgggatcgagtgcatgagagcttctggaaagcttgctgcacaggttttgaaatttgctgggactcttgtaaagccaggcataacgactgatgaaattgataaagcagtgcaccaaatgataattgataatggagcatatccttcacctcttggttattgtggatacccaaagagtgtctgcacttcagtgaatgaatgcatctgtcatgggattccggattctcgtccccttgaggatggagatatcatcaatattgatgttactgtctacctcaatggctaccatggtgatacatctgctacatttctttgcggtgatgttgatgacgaagctaagaaattagttaaggtgacaagagaatgtctcgacaaggctatatcgatttgttcacctggggtggagatcaaacaaattggtagaactatacagtatgtaatttctgagtaaccaagcttttaaacagatgcacatatttttttattatctttatcttaaaaaacaacattcagtttatcgataagctgtattgtcttaatttgtatgcgtaacagatctggtaatcaaaacgaactcttgttccaactactatacttacgacatttaatctttgaagggatcatgcagacaagtttaagtttggtgtagttagacagtttgttggccatggggttggcaaagtttttcatgctgagcctgttgtgcttcatttcagtgagttccccactttaacgaaaacatctttttattaattgctgtcttgcctcccggctatctcaaggttctggttgcactctgcaccatattaggatgtgatatctgtgccaatgacttcgaaatttgcaggaaacaatgaatggggacgtatgatgttgaatcaaacatttactatagagcccatgctaaccatagggagcatcaaccctgtcatgtggtccgatgactggaccgcagtgacagaagacggcagcttgtcagcacagtttgagcacacgatactcattaccgaagatggccctgaaatactgacacagtgttaatggaaggccaaataacaaagaacaatcgttagtcagctggcaagatcctgcatttctttttggggactaattggtccaacctaaactctgatgcaaaatggcaaactcacattgtaatctcggttcatcggtacaacgatatatgtatagaaattgtactaaaaaaaaaaaaaaaattttcgaagttatatt

SEQ ID NO: 11979 - DNA, 947 bp, Zea mays
gggaccctcggcgcccgcccggccgcgcagattaaaaagaagagaaggccggtgctgttctactgctcgcataactttccctttccccatcccacgcagcagcgacaagagcaaatcgaagggctaacgactgagcgagtgccactatccctttgcttgccctggagaggagagggtgcgctatgggcgatacagggagcagctccattctggtgcacattctggtggtcgccctatgcctgaccgcctttggcttcgccgtcgccgccgagcgccgccgcagcacgggttcaatagtcacagacagctccaatgccacattttgtgtttatgactccgatattgctactggctacggtgttggtgctttcctgtttcttctctcaggccactcactgctcatgggtgttacaagatgcatgtgcttcggtgcaccacttgcaccaggtggaagcagagcatggtccatcatatacttcgcatcgtcatggatcacatttgcagttgctgaggcctgcctaattgccggagcaacaaagaacgcataccacaccaagtatagggatatggtatatgctggtaactggacctgccaaactctgcgcaaaggagtgtttattgccggagcagtcttcgtggtgttcaccatgattttggacgtctacttctacatgtactattctaaggccactagccaagctacaaaaaggatcagtaagacaactcccagcgttggcatgactggctatgcgtgagccacctaatgaaagtcccggtctgattagaaaaataactatttctttttttgtgtcgtttttgtaccactgcaactatttctatgtttgttctattttcagtaacactgcagtgagtgatttgggatatgacttagtttcagttaaatattttatgcatatatatatatgcctgatgatggattggtttgg

SEQ ID NO: 11980 - DNA, 1844 bp, Zea mays
attattaaaatttgatttgaacctcacgatgcaaaggcacacgcgaatccgccccgcaatcgctgtcgtcgattctcccatctccactaaaagcatccgttggacggctggagtcattccggcgactcgagaaccgtccgacgtggaccaccaacgaaccgggaaatgcccgcatcttccagattctatacttccgccacgtgctccctcgcctccgcctccgcctcctcccgttccccacctcgccgccgccgcgtctccctcacgggccagtccccgagcacccccctcacgcgccacagtcgaaaccaaagcagctcgcggtggccacacccggacctcgggctcgacatggggttcctgctcgtgcgcaagccgcgtccgggggacgagaagccggacctggcgaactggatgcggtgcttcctgtcgcagcgtctgtctcagcccgccgcggcggcggaggagaccgcgaacgcggagggtaaggccgccgggagacgagaggaagaggagggtggcggggatgacgctgaccacctcgtcgtcatggtgaacgggctgtacgggagttctgcggattggaagtttgcagcagagcagtttgtcaagagattgccgggaaaagtctacgtgcatcgtagtcagagcaattattcaaaattaacatatgacggagttgacttaatgggtgaaaggctagcagaggaggttcgacaagttgttcagaggagaagaaacttgaggaaaatatcttttgttgctcattcacttggcggcttagtaacaagatatgcaataggaaaactttatgaacctgccatggatgaaacatcttcttgtgacattgataagccttctgatgaacaaaatgtacgtgatgttggtaaaatagctggtttggaaccaatcaattttattacatctgctacacctcacttgggctcaaggttgaataagcaacttcccttcctttttggtgtcccacttttggagaaaactgctgcaggaacagcacattttatagttggaagaactggtaaacatctattccttacagacaatgatgatgggaagcctcctcttctcctacgaatggttgaagattgtgacgacgggaaattcatgtctgctttgcgctgtttcaagcgtcgtgttgcctatgctaatgtaacatatgatcatatagttggttggagaacatcatcgcttcgacgtcaacatgaattaccaaaactcaagctaacagcaaacgatgaaaagtatcctcatattattaatgtcgataaaggaaatctagaggatcatcggcaagagggatctgtagaagattcactggcagatagttatgaagaggtgatgatccgtggccttacacaagtggcctgggaacgtgtggacgtatgctttcataagagttggctaagatacaacgcccataataacatccaggttaggatccatccaattaattcagatggagaagacgtcatataccatatgatagacaattttgtagtgtagccaagtagtccgtccggtgaatgccaactactacgtaaaagattactgctatttccagtggattcgccttgagaggtcattaatcttttaccatgtgggttgctatgcacaacagctagataattggcatcaatcagcacgtaactcatacgtgctgctaggtgattcgagcgtaggacctgtgcttgttggttgttgctggcaatgtaaatataagtgttaggtaatgcaaatatttgcatgacagtgcatattcttgtaaatgggaatttaccatgttattggaaatccaaagttcaaactgaaaaaaaaaaaaaaaa

SEQ ID NO: 11981 - DNA, 2989 bp, Zea mays
ctaatattttgaaaataaaaaatataatcatgtttaaataactattttatttatgtaaagtctatatctatatgatataaaaaaccgtgataatatataatcactaaccactaaaactctatataataagtgcatgttagtatttactctattttgttatttagttttaaaatctaatatttatatgcactgatttatctttaaaagtacttttataaaaatatagatgtattaaaattttatttatattaaaaaatattgattaaaactatattttagagacgtgtggttgtgctaaacgataattaatagaataccagatagattactccttgagtcgttaggtgtgcctgatgtgagacacactcactgtttcacacagtcacacactcccaccttaattcgccgaggtcccccccgaccgagcggcagcggcagcggcagcggcagccaagagcaggcggcagcccaaccccacgtccccaagcaaagatgctgtcgtcttccacctccaccctacgcctccaccaaccaacccgcccccacccggcggctgcggccgcgggaggcgccacccacctgacctccccgcggcggtggcgcgggcactccccggcgcccctccgcgcgctggacgccgcccagccgttcgactacgagtctcgcgcggcggggccgctggaggagcggcagcggctgaagatcgccatcgtggggttcggcaacttcgggcagttcctggcgcgcacgttcgcgcggcaggggcacacgctgctggcgcactcgcggacggaccactcggcggcggcgtccgcgctgggcgccgccttcttcaccgacccgcacgacctgtgcgagtgccacccggacgtggtgctgctcgccacctccatcctgtccgcggaggccgtgctgcggtcgctgcccctgcaccggctccgccgcagcaccctcttcgcggacgtgctctccgtgaaggagttccccaggaacctgctcctgagctcgctgccgcccggcttcgacgtgatctgcacgcaccccatgttcgggccggagtcggcgcgcgacgggtgggacggcctgccgctggtgttcgagcgggtgcgcgtcggggactgccccgcgcgccgcgcccgcgccgacgcgttcctcggcgccttcgagcgcgaggggtgccggatggtggagatgtcctgcgccgagcacgacgcgcacgccgccgagacccagttcctgacgcacaccgtcgggcggatgctggccacgctggagctgcgctccacgcccgtcgacaccagggggtacgagacgctgatccgcctcgtggacaacacctgcagcgacagcttcgacctgtacaacggcctcttcatgtacaacaagaactccaccgagctgctcaaccgcctcgagtgggccatggactccgtcaagaagaggctcttcgacggcctccacgacgtgctccggaagcagctcttcgagggctccccgcacgcccccaacgtctcctccccctcctcctccaacgtgcgcaagtagccatcctcccaatgtcatatgtttattagtaaaaagtaaaagatccagccccaattctccttctcttctccgaccaccaccgtgcttgcctgccgctcatgtcacggtcgacagcctgtatctgtatctgttattgggaatttggcagctggccgttgggatttgtgatatggtgatgtagagaatgaataaagcggcagtctttgtgctttgcgagttcctgatagcaggacgagggaagatcagaagcaacctcaaatagcctgctgcttgcgtatgttttgcactgaggatcttggatcaggagcaatttccagccaaaaaccagatggcttttggtctcttgtgtgtaaaatttataaattctttaataatacactgataaatttgaaagaaaaaaagttatatcatatagagaagttgagctcaataactctgaataatatttttggctagattcgtcgttgtcattgtgggtccatggacgctgctgattacggttggtaagctgctttcttgattgacagcggtgtcaggaacactgctagggatcaaaaaagtactattgccactaaaaaaacaaaacggtgtgctttggctgcaccaccgtggaacactgcatctgagacgaaggtttggcatggattggaatgggatctatgcttccttggatctgtacgagattcgttcgaaacggcgtggcccagggtcgggtctgcctgtctacaacaaaacacaacgttgttgttgttgtgggggctgcggtaggtaggaggagtatatatacttaggttttaatggtgttgtttcagtctctcaagggccagattaggattcttatcctttgggttttcgacttgcggttgagtggtctctcggcagctccaagagctggtggctggttccctgaccctgctcaagctgtctctgtctggttttcttctcctccttttttccccttccttttccattgctgctcagctcaaccggattccctgagcttctctcaagctctcttgccgttcttcccagcgcaaggaaaacgttttcgctgtcgatgattagttagtgccactgttatggtgggccttgccggcgctaaaccacgctatgggagtgagaaactaatgggcctaaggttcagcccaaaggctggaccttatcttgcaagtcactgaagcctgaagatgtatgccagggcagattcaatataagaggctctcgcaggagtaaaatgtggcatcatatttgatggtatatttaggggtggtaatgggtcgcgatcaaaatacatacttcttcgcaaaatgttaggatcataaataagttttagttcaaaattgtataaaaatagagtctgatcctaacctgatctgatccttaaattttatagtgtaaaatttagaggtcattgttatccctagatatatttggtggtataatg

SEQ ID NO: 11982 - DNA, 2641 bp, Zea mays
ggatatttttatgtgaagtgtctattaagactctcaagtatcgcttacttatccaatcaatatcatcaaatatagttgggtaccgtcgcaacgtccaagtattagactagtgttgaattaataaatcagttttataattccatttttaataaaaatgtacttttatttcagcacttaattattattttatcccatttagtttctagtgggttagcagcaaggtcaccaacgagtacacaaaagggaaacaaaaacgcaacctttcttctcgacgcagttgtggtcgcggcagcaggcgtcgaggtcgtgcaggtgcagggctcctcgccgtcgcagccgctccatcccacaccgcagtacttaccgtagcggatcccaacggctgcagcaaagaagcgttaaaccgggtcagatcgccgtcccgacggaatcgatgaggatggctgaaggggggtcgcaattgagggccgcgcaagagcggctgcggcgggggctggggcctggggcgccgaggacggcggcggcgaggagcgtccgccgcggcgacaacgcttcgtattccgcatcgcagtttgttgaccggattggctggatgggccgaaccaggtcaagtggagatggagagagtcctggtgtggtgcgggccgcaagtgtgagtgagacgtcaccatcgaatcccaccacaaaagctcctttcgtcacaccggccagcacccagcttctcctctcctcacccccacgccccaccccaccaaacaatggcgccggcggcgacttccacagcctctgcgccctcctccttccactccaccggtaggcatagggccagggtcggggcccggccatcgctcgtctctctccgcgtcagagcagccaatcccaacgttaccgccgatcccgcaccggccttccagtccgtcacggccttcgcgccagccaccgtcgccaacctcggcccgggcttcgacttcctcggatgcgccgtcgccgacgcctccctctccctgggtgacaccgtcaccgcaaccctggacccgtcactcccgcccgccaccgtctccatcgcctccgtcacatccccgtcccgccccaacctcgccgagcgcctctctagggacccgctccgcaactgcgcgggcgtcgccgccatcgccgcgctccgcgccctcggcgtccgctcccacgccgtgtccatccacctcaccaagggcctgccgctcggctcggggctcggctcctccgcggcctccgccgccgccgccgccaaggccgtcgacgccctcttcggctcgcgcctcggccgcgacgacctcgtcctcgcggggctcgagtcggagaaggccgtcagcggcttccacgccgacaacatcgcccccgccatcctcggcggcttcgtcctcgtccgcagctacgacccctttcacctcgtcccgctttccttcccgccagcgctccgcctccacttcgtcctggtcacccccgacttcgaggcgcccacgagcaagatgcgcgccgcgctgcccaggcaggtcgacgtccagcagcacgtgcgcaactccagccaggcagcggcgctcgtggcggcggtgctgcagggggacgcgggcctcatcggctccgcgatgtcgtccgacggcatcgtggagcccaccagggcacccctcatacctggcatggcggccgtaaaggcggcggccctgcaagctggagcgctgggctgcacaattagcggcgcgggccccacagtggtggccgtcatccaaggggaggaaaggggggaggaggttgcccgcaagatggtggacgcgttctggagcgcaggcaagctcaaggcgacagcaaccgtcgcgcagctcgatacccttggtgccagggtcatcgccacgtcatccttgaactagcaaaaggttgctctctttccattaccacctcatctgcatgcacatcagctgcaatttgaggttgttgtttgatttttcaacctatcaatggttttaatcataagttattgcttctgtttgaatccacagattcggaaagtggtactgcaattgtatcaccaaacaaggaagaatgaaggggaaccccatggatttgtatgttttctcttctttcttgcatctttaggtggttaattggctttggaataaatgagatggaggacatcgctagaacaattctgttccgtgggctgtaatttcaatttgggctggtttcttcatcatgccatggataattatgaataaatttgaggtagtttgttacctgtcgtcctcgacccatgggcaatgatgatcatcaggctctcacctccgacggcagcgtctgcttcaccttcaaaatggagcacctcctattggggctttcgtggccgctcggctaggacagggacgttccctggcgtcctctctcgtccctctaattttgagggacaacactggaatagttttgtcctaaccttttacccagaaccaaacaacctaatttgaggatcgtccatcccgtactatcattgttaactgatcatcaggagctaatgctttggagttctcacgcatgcatcatgcagactcgacctgagcttgctagactgactgagtggtgacaaacataaccagatgctatctagtcgtcattcaca

SEQ ID NO: 11983 - DNA, 2103 bp, Zea mays
agacgcagttgtggtcgcggcagcaggcgtcgaggtcgtgcaggtgcagggctcctcgccgtcgcagccgctccatcccacaccgcagtacttaccgtagcggatcccaacggctgcagtacttaccgtagcggatcccgacggaatcgatgaggatggctggggggggtcgcaattgagggccgcgcaagagcggctgcggcgggggctggggcctggggcgccgaggacggcggcggcgaggagcgtccgccgcggcgacaacgcttcgtattccgcatcgcagtttgttgaccggattggctggatgggccgaaccaggtcaagtggagatggagagagtcctggtgtggtgcgggccgcaagtgtgagtgagacgtcaccatcgaatcccaccacaaaagctcctttcgtcacaccggccagcacccagcttctcctcgaaaaacccccacgccccaccccaccaaacaatggcgccggcggcgacttccacagcctctgcgccctcctccttccactccaccggtaggcatagggccagggtcggggcccggccatcgctcgtctctctccgcgtcagagcagccaatcccaacgttaccgccgatcccgcaccggccttccagtccgtcacggccttcgcgccagccaccgtcgccaacctcggcccgggcttcgacttcctcggatgcgccgtcgccgacgcctccctctccctgggtgacaccgtcaccgcaaccctggacccgtcactcccgcccgccaccgtctccatcgcctccgtcacatccccgtcccgccccaacctcgccgagcgcctctctagggacccgctccgcaactgcgcgggcgtcgccgccatcgccgcgctccgcgccctcggcgtccgctcccacgccgtgtccatccacctcaccaagggcctgccgctcggctcggggctcggctcctccgcggcctccgccgccgccgccgccaaggccgtcgacgccctcttcggctcgcgcctcggccgcgacgacctcgtcctcgcggggctcgagtcggagaaggccgtcagcggcttccacgccgacaacatcgcccccgccatcctcggcggcttcgtcctcgtccgcagctacgacccctttcacctcgtcccgctttccttcccgccagcgctccgcctccacttcgtcctggtcacccccgacttcgaggcgcccacgagcaagatgcgcgccgcgctgcccaggcaggtcgacgtccagcagcacgtgcgcaactccagccaggcagcggcgctcgtggcggcggtgctgcagggggacgcgggcctcatcggctccgcgatgtcgtccgacggcatcgtggagcccaccagggcacccctcatacctggcatggcggccgtaaaggcggcggccctgcaagctggagcgctgggctgcacaattagcggcgcgggccccacagtggtggccgtcatccaaggggaggaaaggggggaggaggttgcccgcaggatggtggacgcgttctggagcgcaggcaagctcaaggcgacagcaaccgtcgcgcagctcgatacccttggtgccagggtcatcgccacgtcatccttgaactagcaaaagattcggaaagtggtactgcaattgtatcaccaaacaaggaagaatgaaggggaaccccatggatttgtatgttttctcttctttcttgcatctttaggtggttaattggctttggaataagtgagatggaggacatcgctagaacaattctgttccgtgggctgtaatttcaatttgggctggtttcttcatcatgccatggataattatgaataaatttgaggtagtttgttaccaaaaaaaaaaaaaaaatgggcaatgatgatcatcaggctctcacctccgacggcagcgtctgcttcaccttcaaaatggagcacctcctaaatggtgtttggttgcgggacggctaggacagggacgttccctggcgtcctctctcgtccctctaattttgagggacaacactggaatagttttgtcctaaccttttacccagaaccaaacaacctaatttgaggatcgtccatcccgtactatc

SEQ ID NO: 11984 - DNA, 1273 bp, Zea mays
catggggtacctcgaggccggccggggcgcaagcgcaataaaacccctgcaaaaacccgccactcgcagatccgcacagcgacgccgccagccagacccgatcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctggctgcagaagcccttcatcttcgacatccgcacgcgcccgcacaacttctcctccaactcggggaccaaggacctgcagatggtcaacctcacgctccgtctcctctcccgccccgacgtccagcacctccccaccatcttcacctccctcggactcgagtacgacgacaaagtgctcccctccatcggcaacgaggtgctcaaggccgtcgtcgcccagttcaatgccgaccagctcctcaccgaccgcccccacgtctccgccctcgtccgcgacgctctcatccgccgcgcccgcgagttcaacatcatcctcgacgacgtcgccatcacccacctctcctatggtatcgagttctcgctggccgttgagaagaagcaggtcgcgcagcaggaggccgagcgctccaagttcctcgtcgccaaggcggagcaggagaggcgggcggccatcgtgcgcgctgagggagagagcgagtccgcgcgcctcatctctgaggccacggcgatggctgggacagggctgatcgagctcaggaggatcgaggcggccaaggagattgccgcagagctggctcgctcaccgaatgtggcatacattccttctggggaaaacggaaagatgctgcttggtctcaatgctactggatttggccggtgattcactgtttttttagtctgcttgtgctatgtgctgatgcatgactaaaacggaggttcgaactttgaaggacagtgatatctgctatccttgcttatgttaagttttccttgtcttggaactaaatgtgtctgttgtgctccaaataagttttggtttttgactgcaaaaaaaaaaaaaaaaaggttaatgccacaccgtgttacaactaagcggccacaaaaaaataaaacttcctactaaaaaatataaa

SEQ ID NO: 11985 - DNA, 1080 bp, Zea mays
  misc_feature (8)..(8): n is a, c, g, or t
gcgggccngggaccccctctcccctccccaagcccgcacccagagaccaaatccctcgctagggttttactcccgcgccgccgtcccgaaatcccccccggaaggcgaccatgtccggcggtcccgcggcggtctcgttcctcaccaacatcgccaaggcggcggcgggcctcggcgccgcggcctccctcctctcggcgtcgctctacaccgtggacggcggcgagcgcgccgtcgtcttcgaccggttccgcggggtgctgccggagaccgtcggcgagggcacccacttcatcgtgccgtggctccagaagccctacatcttcgacatccgcacgcgcccgcacaacttctcctccaactccggcaccaaggacctgcagatggtaaacctcaccctccgcctcctctcccgccccgacgtcgtcaacctgcccaccatcttcacctccctcggcctcgagtacgacgacaaggtgctcccctccatcgggaacgaggtgctcaaggccgtcgtcgcccagttcaacgccgaccagctcctcaccgaccgtccccacgtctcggcgctcgtccgcgactccctcatcaaaagggcccgcgagttcaacatcatactcgacgacgtcgccatcacccacctctcctacggcgccgatttctcccaggccgtcgagaagaagcaggtcgcccagcaggaggctgagcgctccaagttcttggtcgccaaggccgagcaggagaggcgcgctgccatcgtgcgtgctgagggagaaagtgagtctgcacgcctcatttctgaggccaccgccatcgctgggacagggctgatcgagctcaggaggatcgaggctgccaaggagatcgccgcggagcttgcccgctcacccaacgttgcctacatcccctctggtgacaacggcaagatgctgctcggcctcaacgctgctggattcggcggccggtgatttaccactccagttttacttgcccaaacatatcttgtgtcatgacggactaaactatggtttggagagacaatgatatctgttgctgtaggtctttaagtttgaatatctt

SEQ ID NO: 11986 - DNA, 1682 bp, Zea mays
atcgcgaccccggccggggttcccaaacctcaccgcctcaactgcttcgccttcgactgcgggcggcggcggcgtacaaagaaccaaaagatgactccttgcgctctcaccgtcgactccctaaacccaaaggtgctggctctcgcggatcacctcggcgacaacgccattgcccgccgcgcgcagtgcatccagaacgagatagaagcagaaccggagtcacaccctttccgcgagataatcgattgcagcctcagcaatccacagtccatgggacagcggccaaacaagttcttccgagaggttcttgccttgtgcgactatccccatcttctagaacagagtggaactaattccttgttcagctctggtgcgatagcaagggcacgggagattctagacctctttcccgggagagcaacaggaggatatagccactctcagggcactgaaggattgcgcgacataatcgccgctggaatagccgctcgagataatttcccctgtaacgcggatgacattttcctgacagatggagcagctccgccggttcacatgatgatgcacctgctgatacgggataaaaaagacggcatcctctgcccagttccatcgcattccttgtacacgagtgctatgcttctccagggcgctactcttgtgccatatttccttgacgagtcaagaggctggggagtgagcatgtcagacctgaagaagcagctggatagtgcccggtcaatgggtgtttttgttagggggcttgtggttataaatccaggcaacctactggacatgttctcgtggaggagaatcagcgtgagattgtggatttctgcaggaatgaagatcttgttcttctagcagacgaggtttaccaggaaaatatttacgcagatgagaagggatttcactctttcaggaagatagcacggtccagggggtacggcgaaggagacatatctttagtgtccttccattcagtttctaatggatattatggtgaatgtgggagaaggggaggctacatggaagtcactggcttcaactctgatgtaaagaaacaagtgtacaaagttgtatccctaagctcgtgctccaacatctccggccagatcctcatgagcctagtcatgaacccgccacaggtcggagacgagtcgtacgcctcttaccatgccgaaagacacggcgtcctgtcatctttcgctcgctgcgcagaggccatggtgcgctcattcaacgggctggaaggggtgacctgtagcgaggctgaaggagcagtgttcgtgttcccttcagtccgtctgccaaagaaggcggtcgcagctgccgaggcaagcaacacgcagccagatgcgttctacgcgctccgcctcctcgaaaccaccgggatcgtcgttgtgcctggctctgtttttggacagatgcatggaacgtggcatttcagatgcacggtcctgccacacgaagagaagaagacgatgacggtgatcatctccagctttgtggcgtttcatcgagccttcatggaagagtttcgcgactaacagatttcagctcctcttcttctatctctgtattgtaccacaacttaatgctgtacttcggagaaaacctagacctctccaaatgcatgattcctgtatgaaactgtttgagtttttctaaaaaaaaaaaaa

SEQ ID NO: 11987 - DNA, 1427 bp, Zea mays
gggaccctcgagcccgccggacctcacacaaacacacataccgaatccagccccgcacccaccgttgcgcccgccgcccgagtcgccgtggccgccgcggcagcgccctcccggccgtgagcgcggcccagcgcgcgcgccgcggccaccgccgccctcgaggcgcccagatctgggccctagcgcccccctccctcctataggcctttccccgctgcatcgccatggcgcggctactgctgtggtggacagcgctgctcctcccttccctcctcgccggcgttggtcccgccgccgccgccgccgcgatccccgccccacgatgcgtgcctggtgcctaccatcgcgcaatccgtccttaggactcccgacacgtgctcgacgctggatcgccgccttggcgacccggtcggcgtcatcgagggagatgaggtgacgttggcaagggcagttaatcttcttcacgcaaacaaggatgactacattgccgtactattctatgcctcgtggtgcccattctcacaggaatgcaaaccgaattttgagacactggcttacttattcccagctatccggcattttgcatttgaggaatctgcaattaggccaagcataatttcgagatacggcatccatggtttcccaacactctttctcttgaactcgaccatgagagtacgatatcatggaccaaggactgttaaatcacttgcagctttctacactgatgtctcaggtatcaatgcatcggtgaagtcaactgcaggggaggccatggtacatcccttggatgatattgagcataaaaaggacgctgaacaggaaaattgcccattctggtgggctcggtcaccagagaatatacttcagcaggatacttatctagcattggcgaccgtatttgtaattttgaggttgctgtatcgtatttttccaaagatagattcctttaccagatgggcatggaggaggcacaatatgtttgcaaaattgatgggagcacatgaatatttcctcacctaccttgagcaagcaagacagaagtttcataggctatacccttcaagttcaaagcgaggaaatctgcaggagggcgcaatgaacgctaccgcttgggcttccaaatcattagcatcagtttcaattggagaaccaagtgcaattggaaggacaaactctacaagtgagctaagatgaaatctgatcttttttgtccccagggattatatgtacagtacagtagagcgatcaggatatgaacacccagaaactgttgtaacggctatattactctttgtatcctccttagaataaatacatccatgatttggctccttattttctgttgttgttacagcccaattctttggaggaataaagtttctggtgtattgagaggtgtctttctgaaatagggggcctttcga

SEQ ID NO: 11988 - DNA, 2634 bp, Zea mays
  misc_feature (1616)..(1616): n is a, c, g, or t
gacccccgggcccgccggggatccctattcccttcccaccccacccccgcacccaccgtggcccgagtcgccgtggccgccgcgtcaggccggcagcgccctcccggcggtgagcgcagcccggcgcgcgcgccgcggccaccgcgcgcgctcgaagcgcctagatctagggactagcggcccccctcctccatggcgcggcgactgccgttgtggacagcactgctcctccccttcctcctcaccggcgttggtaccgccgtcgctgcatccccgccccacgatgagtgcccggtgcctactatcgtggaatccgttcttagtactcgagacgcgtgctcgacgctggatcttggcaacccggtcggcgtcatggagggggatgagttcaccttagcaacggcagttaatcttcttcatgcaaacaaggatgactatattgctgtacttttctatgcctcgtggtgcccattctcacaagaatgcaaaccaaatttcgagacactggcctccttattcccaaccattagacattttgcatttgaggaatctgcaattaggccaagcataatttcaagatacggcatccatggtttcccaacactctttctcttgaattcaaccatgagagtacggtatcatggaccaaggactgttaaaccacttgcagctttctatactgatgtctcaggtatcaatgcctcggtcaatgtcaagtcaactgcaggggagaccatggtacatcccttgcacgatattgagcgtaaaaaggatgctgaacaggaaaattgcccgttttggtgggctcggtcgcctgagaaaatacttcagcaggatacttatctagcattggcgaccgcatttgttattttgaggctgctgtatcgtctttttccaaagattgattcctttgctagatgggcatggaggaggcataatctgtttgcaaacttgatgggggcacatgaatatttcctcacctaccttgagcaaggaagacagaagtttcatcggctatacccttcaagttcgaagcgaggaaatctgcaggagggggcaatgaacgctaccgcttgggcctccaaatcattagcatctgtttcgattggagaaccaagtgcgattggaaggacaaactctaccagtgagcttagatgaagtgtaacccttttttttctccacagagatatatgtacagtacagtagagcgatcaggatatggacacccagaatctgttgtaacggctgtattactctttgtatcctctcctccttagaataagtatatccatggttttgcaccttttttttgttgttacatcccaattctttggaggagtaaagtttctggtgtattgtgtagtgtcttgtgttctgaaatttggaatatgtaccaggatgttggagccttggagggcatcacaataggatattgtcactttctgctgtcatgccgtccttggtctgtcatagaaattagcaatttaggtgtttagggtttaggaatggtaacaggatctcttgtcggtggtaatgattactggctgtaattagattggatagtactttctccgttcttttttatttgtaacggtttagtgtaaaaatgaactagngaatggtaaatatttaagaacggaggtagtacgaaagaattttactaaacaaaagtatttattaccttctgtaatccgtttgtgttatatttctgtgaaccaaacaccatcttaatgttgatatcaaataagaattccggttatgctatatactgcatagatacagatactcttttgagccttatctaccactcaatatctttttttctttttgttctatctcgatagtagtcgatagtattgaactcaagcatcatgcacgcatcgtcatcaaccagccccccttccagatcattcattggaggccattcagtttttaggtagctataggagaagaatacatagagctaggatgtgggagatgctagacgacaagagtgcaagcagtgtgtatgagctcaatgccatcgaggagtgacgtgaggtggaccagagatagggtagtgtgtggaaaagagtagggggagagaggcggtcgacaggcttgcgtataagcttggatgctagtctactgtggtgggatgtgatataaatggtcctataaaaccatctagggatgtcatttgaatattcttgtattatctaagggtcacaatattatatgttttcagatttccaagtgaattatatagtcaatgttcgctatgttatggggttatgtaggttttttaatatgctatgttggcaaaaaccacttttaaaactgccttagagaactatttaaatagtttttaataatttaagttgcggaatactgattttataggtgaatgaaagcatctaggttttcactgattttgatggttaataatgatataagattattgtgactaatgtgtgttttgaagagccagcttaagttaggtcacaatgacgataattagttggacaatcgatgattttcgtttcagtttttaaaggatgcatgacaagattaaggatagactagttttaagtgtccaataaagataagagacacgtataagtagtgtaggattttgtttttcttaaaccaagc

SEQ ID NO: 11989 - DNA, 919 bp, Zea mays
cactcctatgggcgattgggatcctcgaggccggccgggatcagatcaagatcgcatcaggtagcataccataccgcgcggaccgggccgggagaaacaaaactgacaaggacgatatggtgcgtagcctcgtcgcgctgatcctcgtcgccacggccgtagccgccgtggccacagccgcaccctcgccggggtttgtcgtcaccggccgcgtctactgcgacaactgccgcgccgggttcgagaccaacgtctcccacgccatcgaaggcgcgacggtggagatggagtgccgtcacttcgagtcgcaggaggtccacgacaaggcggaggcgacgacggacgccggcgggtggtacaggatggagatcagcggtgaccaccaggacgagatctgcgaggtgctgctgctcaagagccccgaggcggactgcgccgagatcgagcgcacccgcgaccgctgccgcgtcccgctcacccgcaacgacggcatcaggcagagcggcatccgatacgccaaccccatcgccttcttccgcaaggagcctctcagcaactgtggcgagctccttcgcgcttacgacctcttcaacgagacgtccgagaattcctaagcgtcattttgttttttttttaatttcctctcccatagcacatttgttcgactgatcgacgttatattagcagacgtgcagctatcctaaaaataaaaataattttcatctccaatgttttagtagctaccatattaatatatattaatggtctttgagtagttgtactgtataaataatgccatcatatatatttgtagccgaaaaaagggaccaaccctatgctgtaaatttaattttttaatctcctttatagccgaacgtctgaattatctgaatttgcatgtggcgctgcagccgttgcc

SEQ ID NO: 11990 - DNA, 2150 bp, Zea mays
  misc_feature (1421)..(1421): n is a, c, g, or t
cttattagagattcacattgtaggtccatgtggggagaacagaagagccgtcgagaagagaatgtgtaaggccagcgacgacgacaagctagtagcaccacttgattttgacggacgggagtggccgaaccgcgagcggacagaattggcttggagcccctacgacaaacgagctccgcctctcacgtgtaaccgctgtttcgtcctcacggctcgccattatattcttaagctgcccggccgagaccccccgcccccccaccatcaggtacaagaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggtgagcattacattacgcatcatccgtgacaaaacaaaacacaacacaaaacaatgcgtgccaggcgcgacggtggagatggagtgccgccacttcgagtcgcagcaggtccacggacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgccaaccccatcgccttcctccgcaaggagccgctccccaactgcggcgagctgctccgcgcctacgacctctacaacgagacgtccgagaattcctaagcgtccaaacaaaagttctctcgctcgctttttttttaaaaaaaaatcccatatacatatagcacatttgtttcggtttgttgatgcgcgcatgcatgctagcagacatctttcctaaaaaaatttaaataatttccatctcgcattattttagtagctaccattcatgttttctgagtagttgtataaatgctaccaccgtcatcttttgtacccggccggaacaaacgaaaaacacactatctatgctgtgttgtgaattcaattcttgaccatcttctctaaatagaaactaaatttaaggctccctttagctggctttcgctctggattttttcctggaaaaaagtgagagttctgtcaaacactttttttttataaaaaaaagtctcactaagaaaaacgtagagccctttttgtactacgaaaaagaagctatcaatattaacttcaccggctctagctctatcactttaatacaggtgaatgactctggctctaagataagctgtttttgtcaaacgatttgtaaaatagttttaactctagtaaaaatgccgttntcaagaaaagctagaactagagtagtttttggataaatcagacctctatcaaacagaccacgttgagaaatttagaggggagaggtaccccaccttttcattgccattcataaggggttatacatgatcaagttacatgtctgttctctgatgtttgacagtcttttcaatgataataagaatgatttattcaacctctgcatcagttatatgatgcagcactgaactaatcaaatatagattccttgtttttattcttttcccttaaaattaatttaaaaaatcaattatttccttgtgtcagcaggccataaatctggcgtgtgccatgagtgtcgcctaaagttcccgccaatcacacgtagctgcacggaaagttgcactaccacagtataccaatcatatttaatagtatagtataacagttatacgacatgaggctctaatggtgtgatgaatccttctcacaaaaaaattaaaataaaccatgcttacaagaaataaatttaaaactaaaatagacaatgtgaacatattaaatattaaactacagatattatattttatcttaaccaaaagcctaagaaagatatgagttgaaaataagacttgctcttattttatagctcgatctatagggtgtttgatttaaaaaataagttggtttatcatcttctcactccttacttctttgtttggtttgtgaaatggaataagttaatctatcac

SEQ ID NO: 11991 - DNA, 971 bp, Zea mays
actcctatgggcgattgggcccctggcccccgcccgggaccccaccatcaggtacaagaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgccaaccccatcgccttcctccgcaaggagccgctccccaactgcggcgagctgctccgcgcctacgacctctacaacgagacgtccgagaattcctaagcgtccaaacaaaagttctctcgctcgctttttttttaaaaaaaaaatcccatatacatatagcacatttgtttcggtttgttgatgcgcgcatgcatgctagcagacatctttcctaaaaaaatttaaataatttccatctcgcattattttagtagctaccattcatgttttctgagtagttgtataaatgctaccaccgtcatcttttgtacccggccggaacaaacgaaaaacacactatctatgctgtgttgtgaattcaattcttgaccatcttctctatattgtatctatattttagattccgtttagctggctttcgctctggattttttcctggaaaaaagtgagagttctgtcaaacacttttttttataaaaaaaaactcgctg

SEQ ID NO: 11992 - DNA, 2532 bp, Zea mays
  misc_feature (70)..(70): n is a, c, g, or t
cagttcagaaactgatacgcagctttcatctctcttcaggaagaaggaaatagaagaaagaaaaaaaaanctgctgctgccttctcttgttcgcaggccagaggatatgagctgtatcaatccacggttcttgttctatacgtgagctgagacagcatcaattttggagtcgagatataggccacatcatccatgtcgtcgatgcgacctcagactacagctttggtagctagctacctcgcactaggacggacaaagatgcagtagcgatcatgtccaaaacaattagctggctctttttgtcttgtattccagggacctagcgaatgtggtttactaggacggacaaagatgcagtagcgaatcatgtgcaaaattccaaactgaagaatccgattgctgtgcctttgaggtaatcagcagcgaatgtccgtgaaccttgattgatgcatgggggtggggataaagctaggctaggcaaatttattttttattttttccccacttgcctaaacaatatcctatagtattggtcgcgtccccctccccccccgggatgtcacgatgtaggttgttcatctccgtcccccaaatggcgccgcgacgggaaaactatataaacacacaaatcatcaggatccatctcctccctatatatacgccactctccgtcttcgcctttggtctccatcactgattctgattctgattccagccaccctgaccggcgaagcgcggctgacatttcccccccaccataccgccaccacctgagaagagatcgatccaatcagattaaccaattagcagggagggaggagaggggcaaaggcaatggccgggacggaggtggaggacccgccggcggcggcgttggaggtgcccgcgaaacgcggccttctgcggtacaactcgccgctggcgcaggtgtccctgctgggcctcatctgcttctgctgccccggcatgttcaacgcgctgtcgggcctcggcggcggaggccaggtcgaccccaccatcgccgacaacgccaacaccgcgctctacgcctgcttcgcggtgttcggcgtgctgggcggcgccgcgcacaacctgctgggcccgcgcgcgacgctgctggccggcgcgctcacgtacccgctctacgccggctccttcctctactacaaccaccgcccgggctcgcaggtgttccccgtcacggcgggcgccctgctcggcgccggcgcgggcttcctctgggcggcgcagggcgccgtcatgacgtcgtacccgccgcccaaccgccggggcacctacatctccctcttctggtgcctcttcaacctgggcggcgtcctcggcggcctcctccctttcgccctcaactacaaccgcggggacaagaaagggagcgtcagcgacggcacgtacatcgccttcatggcattcatgctcgtcggcgccgcgctcaccgtgctcgtgctgccgcccgccaggatcgtccgcgacgacggcaccagggccaccagggtcaccttctcctccccggccaccgagggcgccgagatcctcaagctcttcgccaactggaagatgctgctcgcgctgccggccgcctgggccagcaacttcttctacacctaccagttcaacaacgtcaacagcggcctcttcacgctccgcaccaggggcctcaacaacgtcttctactggggcgcgcagatgatcggctccgccggcatcggctacttcctcgacttcggcttcgccagccgccgaaagagggggctgttcggggtcgccgccgtcgccgccgtcggaacggccatctggggaggcggtctggccaaccagctcagctacaaagccgtgccggtggccgaccccatcgatttcaaggacggccaccgctacgccgggcccttcctgctctacttcagctacggactgctagatgccatgttccagagccttatctactggatcatcggcgcactcgccaacgactcccaaatcctcagcaggtacgtcgggttctacaagggggtgcagagtgcgggagcggcggtggcatggcaggtggacaggcgccacacgcccctcatgtcccagctgatcgtcaactgggggctcatgaccatcagctaccccttgcttgcgctgctggtgttcctggccgtgaaggacgagagctactcggtttcgtcggtggaggacggccgggagaaggacagcaagctgtccgcgccgaccagcttccactgatgaagaagaagaaggatagaccaagatgcacgtcactgtaattgtaacacggtgtttccatccaagtaagttttagtagtagaaatcaagaaacaactggagcatactcagggtgtggcgttcgtttttaagtaagttgtagtagtattcgttttggtgattgttatttattatagcacctctgggttagcttgagcatcatgcttccttgtcagtggtgtgaccaagaaattggatagaatctatatgaaggaattcttttgctatttaaaattgttctctctc

SEQ ID NO: 11993 - DNA, 2653 bp, Zea mays
tcagctccttataaacagggtaacgaacattctcatccagtttttttcataaatcattttttagaaatttgggacagaaactgatttttttaaaacagtggtgcttataaacaaaccctaaaatacacgctcgcagaaaaaaaattgaaaaagagatgaagcagtaggtagacccaagggttcaaaaactaaacgccataattaccgtacgggtcttcgtcccgtggcaggggcagacgcggcggcgggcccggcattactctcccgctataaatcctactccgccgcacagcccggcccggaagacgcctccccgctccgcgttccccagcgccagcggtaaccccacccaactcctctgagctgtgacacagctgtcctcctccccccactccaggcgctcacacaccctccacttccctccacaggaatccgccgccataatctcctccgctccgctccaccccgcattgcaggattgcgccgagcacgagcaccctcctccccgaagcctcttcttggctctgctttcggtggtatggtgggatgatgagcagggcggcagtgctgctgtgtctcctctgctgcctcgccgccgccggcgaggcggcgtcagtggtgggcgagggcgaggcggcggagctggccgtgtcggtggacccgtcgtggcggttccccagccagcggctgcgggacgcgtacgtcgcgctgcagacctggaagcagcaggccatcttctccgaccccaggggtttcaccgccgactgggtgggcccgggggtatgcaactacaccggggtcttctgcgcgccgctgccgcgcggggtgccgggcgccggggagctcgccgtcgcgggcctcgacctcaaccacggcgacatcgcgggctacctcccgccggagctcggcctcctcgctgacctctcgctgctccacctcaactccaaccgcttctgcggcctcgtccccgccactctgcgccgcctccagcttctcgtcgagctcgacctcagcaacaaccgcctcgtcggggcattcccggccgtcgtgctggagctcccggcgctcaagttcctcgacctccgcttcaacgacttcgagggcgccatcccgccggagctcttcgaccgcccgctcgacgccatcttcctcaaccacaaccgcctccgctccccgctccccgacaacttcggcaactccccggcctccgtcatcgtgctcgccgacaacagcttcggcggatgcctcccggccagcctcggcaacatgtccggcacgctcaacgagatcctcctcatcaacaacggcctcgactcctgcgtcccgccggaggtcggcttgctccgggaggtgaccgtcttcgacgtcagcttcaactcgctcgtcggcccgctgccgcagcaggtggccgggatgcgcaaggtggagcagctggacgtcgcgcacaaccgcctgtccggggccgtcccggaggccatctgcgccctcccgcggctcaagaacctgaccatctcctacaacttcttcaccggcgagccgccgtcctgcgcgcgcgtcgtgccttcggacggtgacaggaggaactgcctgcccaaccgccccacacagcgcacgccgcagcagtgcgccgcgttctactcgcagccgcccgtcgactgcgccgcgttccagtgcaagccgtttgtccctgttccgccgccgccgccatcataccccggcccgttgccaccggtataccctatgccgtacgcatcgcctccgccacctgcgcagtaccgatgattcgtcgaggagggagaagcactatcactttcaccttaattcgccaccaccgctgctgcgctggatgaagacagcaaagttcaccgtcacaattgtacgtggtcagtcattgttgtgcttagattagtagtgttcttgattgatagctaccggcatatagaagattatattattatacggtgcatatatcgctcttgcttttgcatttgtcggtctctgtttttcgcgtcgatccgggttggcgttgtggcgacggtgaaaaggattgaaggtggtggtgatggagggaacagtttgagattgagcttggattgattgttgactgggttgtgaataataaactgcttgagagagagagaaagatgaggatgaggaggattggttggtgacttcacctgggcctgggatgtatagagggaactaagcttcttcagttaagctgctgctttcagttgagagtccagacataagttttcagaccaagtaatgtatcctacttactattctttttttttggtgtcacagctacttactgttaatcgattgttatgatataatctctctacatttttatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaagggcccccccagccccccttttttttccctttaaggggggtaaattggccctttggggaaaactggggcaaaactggttccggggggaaatttttttcccccccaaattcccccaaaaataaaagccgaaaaattaaagggaaaaccccggggggccctatggggggcctaccccccct

SEQ ID NO: 11994 - DNA, 3349 bp, Zea mays
  misc_feature (2667)..(2667): n is a, c, g, or t
gatggtggactcaaaaacgatgcaccaccatgtagtacaaaatagtgttttaaacgtcgttgttgctgctcccggtgcggcctatctttcagattataaagggttgcaggaattatggtttgcatctgggttgtatgggatttttttctgattagtgacaaggaaattagatatgattgagagggagaaaatgccttgttaatgtcattaaaccggaatagccgagaatttcctcccatcaaatactctcacattcctttgtcaaaccagcactagagagataactagcaggtagacgaagggagttggaaatcaaaagtaaacccacccgatcgccgccataattaccgtacggttcctcctcctcggcacctcccgtgtgcaagtggcagggccagacacggcgggggccccggcattactcccccgccataaattctccgccgccgcacaaggcagcccggaagaggtgtccccgctccgcgcccagcggtaaccccacccaacccctgtgagctgtgacacagctgtactcctctccccactccaggcgctcacactcacatccccttccctccacaggaatccgccgccacaatcccctccgctccacattgtgggattgagccgaacacaagcaccctcctccccgaaacctcttctttgccctgctttcggtggtatggtgcgatgatgactagggaggctgtgctgttgtccctcctcttctgcctcgccgctgccggcgaggcagtgtcactggtgagccagggcgaggcggcggagctggcggtgtcggtggacccgtcgtggcgcttccccagccagcggctgcgggacgcgtacttggcgctgcagacgtggaagcagcaggccatcttctccgaccccaggggcttcaccgccgactgggtgggcccgggggtctgcaactacactggggtcttctgcgcgccgctgccgcggggggtgccgggcgccggggagctctccgtcgcgggcgtcgacctcaaccacggcgacatcgcgggctacctcccgacggagctcggcctcctcgccgacctctcgctgctccacctcaactccaaccgtttctgcggcctcgtgcccgccacgctccgccggctccgcctcctcgtcgagctcgacctcagcaacaaccgcctcgtcgggccgttcccggccgtcgttctcgacctcccggcgctcaagttcctcgacctccgcttcaacgaattcgagggcgccatcccgccggagctcttcgaccgcccgctcgacgccatcttcctcaaccacaaccgcctccgctcgccgctccccgacaacctgggcaactcgccggcctccgtcatcgtgctcgccgacaacagctttggcggatgcctcccggccagcatcggcaacatgtccggcacgctcaacgagatcctcctcatcaacgacggtctcgactcctgcgtcccgccagaggtcggcttgctccgggaggtgaccgtcttcgacgttagcttcaactctctcgtcggcccgctgccgcagcaggtggccgggatgcgcaaggtggagcagctggacgtcgcgcacaaccgcctgtcggggtccgtcccggaggccatctgcgaccttccgcgcctcaagaacctcaccatcgcatacaacttcttcaccggcgagccgccgtcctgcgcgcgcgtggtgccacgaggcggcgacacgaagaattgcctacccagccgccccgcgcagcgcacgccgcagcagtgcgccgcgttctactcgcagccgcccgtcgactgcgcctctttccagtgcaagccgtttgtccctgttccgccattgccgccgccgccgccatcgtaccccggccccttgccaccggtataccccatgccgtacgcatcgcctccgccacctgcgcattaccgatgattcgctgcgggagagaagcaatatcactttcaccttaaattcgccaccgccgctgcgctggacaaagttcgccgtcacaattgtacgtggtcagccattgttgtgcttagattagtagtgttcttgattgatagctactggcatatagaagtttattattataaggtgcatatatcgtccttgcttttgcattggtcgttctctgtttttcgcgtcgatcggggtttgcgtcacggtgatggtgaaatagatggtcagatggaggtgaaaaggattggagggaacaatttgagtttggattgattgctaattggctgactgcttgagagagaggtcaggatgacgaggaggattggttggtgacttggcgccaccttgggcctcggatgtatagggggaattgagcataagttcttcagttaagctactgctttcagttgggagcccggagataagttttcagaccaaggaatgtaccccacttaactattctttttgcatttttatgtctcagctacttactgttaatcgattgttatgatatatctgtttcgattcttagaaggttttggtcctttgcttgctacttagtgttgtatggttcacgtatttgtaacgtgaacgacaatattcgtttaagtccaaccgtaattggatatctttgataccgtgctattcaattcgtgaaccaaacgacatgttactatatattttcagttgggttagccattntttgcatgtggatccggtttccgttatcttattggttgcaacaagaatttccccattgcaccataaaattagatgcttcacatgatgtgttgaggactggcccagattttccaaagcttgttttgtctttggaaaaagatggacatgggacgtggccaccactggccaggtgcttcttgccccctccaagctttgccgttacttttcttttttttttgttaggagatgactagtctatatatacccatgtggaacaaaataacaaagaccatggtgtctggttgtgttaaccttggtcctatttaaggatccaatctctgtttgagtctttgttatgtcctaatgaattgttgtggcctatatctcagttaacgttgtctattggagcccgtacacccttctttctccttcctcgacaactgacatgtagcccataacaaaccttaggacgtaatagagattcctcgacaactgacatgtaggccatagcaaaccttagggacaactgacacgtaggtcatagcaaatcttaggatgaacccttaagagatatactttaagaagcttatggacccaattaaagacatattttaaaagcttatggaccggattgccagtcaaagaaaaacttatgtcaaacaagtttaaggaatggaagtgttgagcgatagatttggcactt

SEQ ID NO: 11995 - DNA, 2235 bp, Zea mays
  misc_feature (1842)..(1842): n is a, c, g, or t
  misc_feature (1929)..(1929): n is a, c, g, or t
  misc_feature (1970)..(1970): n is a, c, g, or t
  misc_feature (2037)..(2037): n is a, c, g, or t
  misc_feature (2218)..(2218): n is a, c, g, or t
cggcgtcgggcccggcattactctcccgctataaatcattgggtacctcgcggccggcccagaagaggcctccccgctccgcgttccccagcgccagcggtaaccccacccaactcctctgagctgtgacacagctgtcctcctccccccactccaggcgctcacacaccctccacttccctccacaggaatccgccgccataatctcctccgctccgctccactccgcattgcaggattgcgccgagcacgagcaccctcctccccgaagcctcttctttgctctgctttcggtggtatggtgggatgatgagcagggcggcagtgctgctgtgtctcctctgctgcctcgccgccgtcggcgaggcggcgtcagtggtgggcgagggcgaggcggcggagctggccgtgtcggtggacccgtcgtggcggttccctagccagcggctgcgggacgcgtacgtcgcgctgcagacctggaagcagcaggccatcttctccgaccccaggggtttcaccgccgactgggtgggcccgggggtatgcaactacaccggggtcttctgcgcgccgctgccgcgcggggtgccgggcgccggggagctcgccgtcgcgggcctcgacctcaaccacggcgacatcgcgggctacctcccgccggagctcggcctgctcgctgacctctcgctgctccacctcaactccaaccgcttctgcggcctcgtccccgccactctgcgccgcctccagcttctcgtcgagctcgacctcagcaacaaccgcctcgtcggggcattcccggccgtcgtgctggagctcccggcgctcaagttcctcgacctccgcttcaacgacttcgagggcgccatcccgccggagctcttcgaccgcccgctcgacgccatcttcctcaaccacaaccgcctccgctccccgctccccgacaacttcggcaactccccggcctccgttatcgtactcgccgacaacagcttcggcggatgcctcccggccagcctcggcaacatgtccggcacactcaacgagatcctcctcatcaacaacggcctcgactcctgcgtcccgccggaggtcggcttgctccgggaggtgaccgtcttcgacgtcagcttcaactcgctcgtcggcccgctgccgcagcaggtggccgggatgcgcaaggtggagcagctggacgtcgcgcacaaccgcctgtccggggccgtcccggaggccatctgcgccctcccgcggctcaagaacctgaccatctcctacaacttcttcaccggcgagccgccgtcctgcgcgcgcgtcgtgccttcggacggtgacaggaggaactgcctgcccaaccgccccacacagcgcacgccgcagcagtgcgccgcgttctactcgcagccgcccgtcgactgcgccgcgttccagtgcaagccgtttgtccctgttccgccgccgccgccatcataccccggcccgttgccaccggtataccctatgccgtacgcatcgcctccgccacctgcgcagtaccgatgattcgtcgaggagggagaagcactatcactttcaccttaattcaccaccaccgctgctgcgctggatgaagacagcaaagttcaccgtcacaattgtacgtggtcagtcattgttgtgcttagattagtagtgttcttgattgatagctaccggcatatagaagattatattattataaggtgcatatatcgctcttgcttttgcattggtcgttctctgtttttcgcgttgatcggggtttgcgtcacggtgatggtgaaatagatggtcagatggaggtgaaaaggattggaaggaacnatttgagtttggattgattgctaattggctgactgcttgagagagagatcaggatgacgaggaggattggttggtgacttggcgccnccttgggcctcggatgtatagggggaattaagcttaagttnttcagttaagctactgctttcagttgggagcccggagataagttttcagaccaaggaatgtaccccncttaactattctttttgcatttttatgtcacagctacttactgttaatcgattgttatgatatatctgttttgattcttagaaggttttggtcctttgcttgctactcaatgttgtttagttcacatatttgtaacgcaatattcgtttaagtctaaccgtaatcagataccttaccgtgntaaaaaaaaaaaaaaaa

SEQ ID NO: 11996 - DNA, 1538 bp, Zea mays
gcaccagatgccataccccatcacaacggtccgtctatcccttcccttggaaacgtccacgcatcctccgtctccgtccccatctcgcgaagctagcgggaataacaagcaacgatacctacgacgacctacccccctttccctgctctctccttccaactcttgtttctgcaacgccagggcgcaaccatgggtcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcaggtgggattgggcagccacttgcgctattgatgaagatgaaccctcttgtttcggtgctccatctatacgatgtcgtcaacgcacctggtgtcacagccgacatcagccacatgaacactggtgctgtggtacgtggcttcttgggccagccacagttggaaaatgccctggctggaatggatcttgtaataattcctgctggtgtccctcggaaacctgggatgacaagggatgatttgttcaacataaatgctggaatagtccgtaccctgtgtgaaggaattgcaaaatgctgccctaatgcaattgtgaatgtgatcagtaatcctgtcaactctaccgtcccaattgctgctgaagttttcaagaaagctggaacttatgaccctaagcggcttttaggtgtgaccacacttgacgtagtgagagcaaatacgtttgtgggagaggttcttggacttgaccccagagaggtaaatgttccagtcattggtgggcatgcaggaattacgatactaccactcctttcacaggtgaatccttcctgctcattcacctcggaagaggttaaatacctcacttctcgcatacagaatggtgggacagaagtagtcgaggctaaagctggagcaggatcagcaactctttcaatggcctatgcagctgccaaatttgcagatgcttgcctgagaggattgcgtggtgatgctgggataatagagtgctcttatgtggcttctcaggtcacagagttgcctttctttgcatccaaagtgcggctagggcgatgtggcattgaggagatcctaccacttggaccattaaatgagttcgagagatctggtctggagaaggcaaagaaagagctggcggagagtatccagaagggcgtctctttcatcaagtgaggccggcgacggccagcccaacatagaaatagatgtggcgtgtttctgcttcttgagaactcatcttgttatctctctgtaagactgagtgcatgacacgaataatccacgtacacggctgtactaaaaagatgatgaatctgtggtggctaaaaaaagggaaatagaaaagtctggtaataaaagttgtttctgaacaaaaaaaaaaaaaaaaaaaaaaaagaaaaaaaaaaaaaaaaaaaaaaaaaaaaaaaaaaaaaaaaaaa

SEQ ID NO: 11997 - DNA, 1560 bp, Zea mays
ccccgcgtccggccaatttagggggaaccgctgaagacagtctcagcagcagcagcagctgctgcctgctgctgtctagtccatcttcatcctccccatcgcccgactggatttctcccccgaattcgcacctcccccctcacttcgctgtgtctcatcaacgccggcatcaccgcgaggactgggccagctctccctccctttctcctccctccgccttcattgctgacggcgacgactgggcgagctctaccgccgctctgcgctaggtgcccaggtcttcctcgggcacttcaccggcgacgagcacccatcaggagcgaaatggacgaggctgttcctgctttggctaccggccaagcttcaaccgacgccgtgacagagcagcctgtgaatgtgtacatatgggacatggatgagacactcattttgctcaagtcacttctggatggctcatatgctggggcttttgatggcctcaaggatcatgagaaaagtactgaaataggaaagcgatgggagaacctcattcttgaactctgtgatgagcacttcttttatgaggagattgagaactacaatgaaccctatctcaatgccttgaatgaatatgacgatgggagagacttgacctcatatgattttgaggctgactgttttagttcaccatatgatgatgcgaacaaaaagaagcttgcttacaggcatcgtgctattggagagaaatatgcaaagggtttggaaaaggttctggacggacacatggtcaaagtctgcaatgatcagtacagtttgactgacaaatatactgatggctggctgtcttcagctcataagttactggaagaagcattgggcaaatcagcatcagcaccttcagccaactcttcaagcatcaactgcatagttacatcagggtcactgattccaagccttgccaaatgtttgctgtatcacctggatgatgtggtctcatctgagaacgtctacagctcatgggaagtgggtaagctgcagtgcttcaaatggatcaaggagcgcttcgacggtccaaacgtccgcttctgtgcaatcggtgatggccacgaggagtgcagtgctgcgcaggtcatgaaatggccattcatcaagatcgagttccgccctgaagcccatcacaggttccctggcctagacttgcccacagtgcagacctacatggatgtgatatacgagtcatcgagcaaagatggttgaccgacgattgatgtcgattctgttttctcctctgacctccaccacccatggagctattgtttgaggaaactgtaagcaaagagatgtcgtgggaaaggaacgtgtcgtcctccctagatctttcaccttggcgaattaggaggcaggtgtgataaataagagtcttgctagttcgtcgtcgtcgtccatgttgtcatagatcctgtcttgtgtgttcatgttactgtgatgcaggcaatggtgtgttgtgtactggcgttaaaaaaaaaaataaaaaaataaaaaaaaaaaaaaaagggcggcttttcgcgatctagaactagt

SEQ ID NO: 11998 - DNA, 1544 bp, Zea mays
ctggatttctcccccgaattcgcacctcccccctcacttcgctgtgtctcatcaacgccggcatcaccgcgaggactgggccagctctccctccctttctcctccctccgccttcattgctgacggcgacgactgggcgagctctaccgccgctctgcgctaggtgcccaggtcttcctcgggcacttcaccggcgacgagcacccatcagattgagaactacaatgaaccctatctcaatgccttgaatgaatatgacgatgggagagacttgacccccgacgattttgaggctgactgttttagttcaccctatgatgatgcgaacaaaaagaagcttgcttacaggcatcgtgctattggagagaaatatgcaaagggtttggaaaaggttctggacggacacatggtcaaagtctgcaatgatcagtacagtttgactgacaaatatactgatggctggctgtcttcagctcataagttactggaagaagcattgggcaaatcagcatcagcaccttcagccaactcttcaagcatcaactgcatagttacatcagggtcactgattccaagccttgccaaatgtttgctgtatcacctggatgatgtggtctcatctgagaacgtctacagctcatgggaagtgggtaagctgcagtgcttcaaatggatcaaggagcgcttcgacggtccaaacgtccgcttctgtgcaatcggtgatggccacgaggagtgcagtgctgcgcaggtcatgaaatggccattcatcaagatcgagttccgccctgaagcccatcacaggttccctggcctagacttgcccacagtgcagacctacatggatgtgatatacgagtcatcgagcaaagatggttgaccgacgattgatgtcgattctgttttctcctctgacctccaccacccatggagctattgtttgaggaaactgtaagcaaagagatgtcgtgggaaaggaacgtgtcgtcctccctagatctttcaccttggcgaattaggaggcaggtgtgataaataagagtcttgctagttcgtcgtcgtcgtccatgttgtcatagatcctgtcttgtgtgttcatgttactgtgatgcaggcaatggtgtgttgtgtccgggcgttatttcctgtgttgtgctttgccaatttgccagcttcagtttatgtgtatatgctttttaggctgtcttcggcagatcgtgtaaaataggggacgtgacagtgtagatgacaccgtttaacttgtttttaaaatgaagtttgaaatatacacacatcatagttcatcatcaggaggcaggcggcaataccgatgcagctatgctagttaggtcgagcttcagtcatggcgctattgtttcagtcagattgaggtttatgaatttgtggtgacaaatacttcagttttgtttagctaatatataaattggtcccgctgtattcccatacatacactggcagggacgcatccatgttttcttaatttttccatttcggttcgattaacaaacaggaaaggtatccat

SEQ ID NO: 11999 - DNA, 1644 bp, Zea mays
ctcgagggccggcccgggttttttccccaaaaccaaaaccaaaaagaagggttgctcccaacgcaacggaactgcctttcccgtcagcagcagcagcagctgctgcctgctgctgtccatcttcatcctccccatcgcccgactggatttctccctcgaattcgcacctccggcctcccccctcacttcgctgtgtctcatcaacgccggcatcaccgcgaggactgggccagcgctccctccctttctcctccctccgcctttattgctgacggcgacgactgggcgagctctgccgccgctctgcgctaggtgcccaggtcttcctcgggcacttcaccggcgacgagcacccatcaggagcgaaatggacgaggctgttcctgctttggctactggccaagcttcaaccgacggcgtgacagagcagcctgtgaatgtgtacatatgggacatggatgagacactcattttgctcaagtcacttctggatggctcatatgctggggcttttgatggcctcaaggatcatgagaaaagtactgaaataggaaagcgatgggagaacctcattcttgaactctgtgatgagcacttcttttatgaggagattgagaactacaatgaaccctatctcaatgccttgaatgaatatgacgatgggagagacttgacctcatatgattttgaggctgactgttttagttcaccctatgatgatgcgaacaaaaagaagcttgcttacaggcatcgtgctattggagagaaatatgcaaagggtttggaaaaggttctggacggacacatggtcaaagtctgcaatgatcagtacagtttgactgacaaatatactgatggctggctgtcttcagctcataagttactggaagaagcattgggcaaatcagcatcagcaccttcagccaactcttcaagcatcaactgcatagttacatcagggtcactgattccaagccttgccaaatgtttgctgtatcacctggatgatgtggtctcatctgagaacgtctacagctcatgggaagtgggtaagctgcagtgcttcaaatggatcaaggagcgcttcgacggtccaaacgtccgcttctgtgcaatcggtgatggccacgaggagtgcagtgctgcgcaggtcatgaaatggccattcatcaagatcgagttccgccctgaagcccatcacaggttccctggcctagacttgcccacagtgcagacctacatggatgtgatatacgagtcatccagcaaagatggttgaccgacgattgatgtcgattctgttttctcctctgacctccaccacccatggagctattgtttgaggaaactgtaagcaaagagatgtcgtgggaaaggaacgtgtcgtcctccctagatctttcactttggcgaattaggaggcaggtgtgataaataagagtcttgctagttcgtcgtcgtccatgttgtcatagatcctgtcttgtgtgttcatgttactgtgatgcaggcaattgtgtgttgtgtccgggcgttatttccaaagaagagctttgccaatttgccagcttcagtttatgtggccatgctttttaggctgtcttcggcagatcgtgtaaaatagaggacgtggcccgattaact

SEQ ID NO: 12000 - DNA, 2562 bp, Zea mays
ttggggaccctcgaggccggccggccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcaggaaataactggaagccgagggctgagggcgagcgcagagtcgggtggttatcgctttctttttcgttttctttttccggaggggagagtattagggatgccggttgctaggccggagccgcaggagccccgggtgatcgcccatgtcgacatggactgcttctatgttcaagtcgagcagcggaggaacccggcgctcaggggacagccgaccgccgtggtgcagtacaacggctggaaaggcggcggcttgattgccgtcagctacgaggctcgtggatttggtgtgaagaggtccatgcgcggagatgaggccaagagtatgtcctggtattaatcttgttcaggtcccagtggcgcgtggcaaggctgaccttaatctttacagaagtgctggtgctgaggttgttgcaatccttgcaagcaaagggaagtgcgagcgggcatccatcgacgaagtttatcttgaccttactgatgcagcaaaggaaatgctcttacaagctcccccagattcaccagaggggatttttatggaggcggcaaagtcaaatatcttgggccttccggctgatgccagcgagaaggaaaagaatgtgagggcatggctttgtcaatcagaagctgattaccaggacaagttactggcatgtggagctataattgttgcacagttacgagtcagagttctggaggaaacccaattcacatgctctgctgggattgctcacaataaggtttataatgagtcgtactaatgttagctaaacttgtcagtggaatgcacaagcctgctcagcaaacagttcccttcttcatcagttcaagacttactagcatcactacctgtgaagaagatgaaacagcttggtggtaagcttggaagttccttgcaggatgatcttggggttgagaccattggtgatctcctaagttttacagaggaaaaattacaagagcagtatggagtaaatactggaacttggttatggaagactgccaggggcattagcggggaagaagttgaggaccgtcttctcccaaagagtcacgggtgtggaaagacatttcctggcccaagagcactgaagtacagtgcttctgtcaaaggctggctggatcaactatgtgaagaattaagtgaacgtatccagtctgacctgaaccagaacaagagaattgctcaaacgctaactcttcatgccagagcatttaagaaaaatgaacatgattcaatgaagaaattcccttccaaatcctgtcctttgcgctatggaactgggaaaattcaggaggatgcaatgaggctatttgaatctggtcttcatgagtttttagaatctcagaacactggatggagcataacatccctttctgtcactgcaagcaaaatatttgatatacctagtggaacaagctcaatcctgagatacattaaaggtccaagttctgctgcagctctgactatacctgattctccaagttctgctgcagctctggctatacctgattcttcatttgtaccagaggatccatctcttggtgatgttccttagttcaagtgtgcctactgtttgcaatttttgtttgttcttacttaggatcttccaatatttttctgtagataatgatgtatctgtggagtcaattaatgaagaagaatgccaaccatctacctctgaaaaagaagacaataatacacattctgcgtctgctatttcagctaaacaatgccaagcaattgaagaaaaaagaatatcaaagaaattgcctggagttcagggaacttcctcgatattgaagtttctttcacggggccaatctaccttacatgagaaaagaaaatctgatggactaatttgcagtcagcaaggtcccgggagttcttcggaagcatacaaagctggagcacacaatgtgcccgcggaagctgaggataggaacaacaccaacagttgtgctgaaccctctggcagtaacaaatggacgttcaaccttcaagacattgatccagcggtggtagaggagctgccaccagagatccaaagagaaatacaggggtgggtccgtccatcgaagcacccgatcacgaagagacgtggttctacaatttcttcatactttccacccgcgaggtcttagatacgttgatatgttagttcttgattgtatattctttattttctacacacaacggcctcgctctgtgtattgtaattgtaagatgtttaggtagccctatatgtgattaacggcttgacgggacctctgagaatggtaagtttatttacgtggggtatggaaacatgaacattaatgaatgtgcaaatgggttgaggtcctaaaaaaaaaaaaaaaaaaaaaaaaaaaaaaataaaaaaaaaaaaaaaa

SEQ ID NO: 12001 - DNA, 1175 bp, Zea mays
ctcgaggccggccgggttttagttcagtttaccattcgtcgattcgagttccgctcgccttcgtcttcgtctcggcccacggcccacggtccatcagcgctcgtcctcccttcctccctctagcgcctgctgcctctctcactccatggcgtggatctggatggtcctcgcggcgggagccgtgctcctgtgggcgatctctttggggcgggtcctctcctccgccgcgccgtcctgtgtgcccccgagcccgcagttcatgccccctctcagcggtgacaggaggagccggaacgtgctgctggtcgtcgcccaccccgacgacgagtccatgttcttcgctccaaccattcttttcctcaagtcgaaaggccacagtattcacattctgtgcatgtctcgaggtaatgctgatggtctgggagatactcgtaaggaagaactgtaccacgcctgtgtcagcctcaagattccacatgaacaagtcaaagtcttggaccacccaaaactgcaggatggttttcatgagaaatgggaacatggactagtagcagaacttaccatggagcttgtccaactgtgggccattgacacgattgttacatttgattcatatggagtatcaggccatccaaaccacaaagatgttcatcacggcatatgcaagtttctccatacgaacaagcaagggaacgtggaagcttgggaactagcaagtctcagtattcttcgcaagtacagtggtccgattgacatttggctttcttcattgacgtccttcgcaaggtcaaaacagccaatctatactctagttaacagtagcccgtccaaaagctatgaggcaatggctgcacacagaagtcagtgggtttggtttagaagattgtttgtcatgttctcgagttatacatacataaatatgctacggagaatttaacatgtgatgtggcgtcataccagagcaagccgccattgtcgtctccaatgttgtacttgtgcatcgtcaattgtacatctatatgtatcaatggattttagttgtacattctctgtaggcagtgctcatagggtgactgtagaatttcttatccccaattcagaattgcactgaatggctgaaatacagttgtctttcaaaagaaactgaaatatagtgatgctcactggcttagctt

SEQ ID NO: 12002 - DNA, 1461 bp, Zea mays
tcgaggccggccgggacacttccagatgggccccatccacctcgatgaaacaatagtatgttctgtctgccaggtacggcccgccggaacggatcccctgcttcttctaccgaaatcgttgcttccgacgcaccagggccgcgcgccgccggcgaccttgccgtggcccttctacaaaaccgacccgcgccggagctccgccgtcggatgtggcggagacggcgtcaatggcgtcctcctctgctgccgagtccagctcccgcctctctgatcgagcgaggaggtcggcgctgggactcagattcatggtgctcctgatgcacgtgctgttcgttggcgctgtcttcatcctcgatccgaccctcgactggcgaatccacggggagccgtggtatatagggttgtatggagtgcttgttctgctcacgctagtgcaatacttctatacagctggctcatgtccagggtatgttattgatgtaatgagagctggttccatgatgcatgcaaccttcgtcaacactgctgctctttcaaagcagtcaaattcaagaaatggaaacataaattctccgacgagtcgtgctcaactacagaaacttagcacgatgactcctacatcttcatgggcacagatggttatggatctttatcctccagggtcaagcagcagggattggacttgcacttactgcaggattgttcagccacctcgcacccgacactgccatgactgaaacaatcttgtgcatcgcgactctgctctctccatcgagtcattgtgtttagatgtggacaaggcctggtggaaggactttgttggtgttatcctgttggcagcgcttatccttatcctgatattcctactactattgtggttatttcattcgtacattgctctaacaaatcaaacaacctacgaaattgccagaaggaagcgaatattctacctaaggggagtccctgaaagagttcttccattcagcaaaggcatatgcagaaatctctacgatttctgctgttctagccagaagggatatattctggaagctgtgcccccaagtgaagagctggaagctagagctgcccgttacacgtgccgagatgtcatttgctgccgttgctgctgataggctgtaccatagcattctgcccatatagcccagttgtgttgttctctgttcaaggttaagttaatggaagcaaattttagtgtcctgcggccgttagatgcccccagagttcattatttgtgcatagtcacttgtacatttcactcagaaaaatgtgcgctctgagatccagttgttcacattctgtatggctttgaattgaaataggttttcaggacagacagaaccgatctgtacttcagttttttagtcgaaatgtacatttgaggtcgtgttggtaatttattttaagattttcttatatttaaaaaaaaaaaaaagagaaaag

SEQ ID NO: 12003 - DNA, 1728 bp, Zea mays
taaaaaataacttctcaaaaagcgtgaacaacccggggagtagatggagtggcacgagggagcgcaaccaaatccagcccacgtcgtggcctcgtctggcccactcacacttccaaatggggcccatcaacctccatgagatctgtctgccaggtaggacccgccggaacggatcccctgcttcttctaccgaaaatccgaaatcggcgccggtgaccttcccgtggcccttgtacaaaactgacccccgtcggagcaccgccatcggatgcgacggagacggcgtcaatggcgtcctcatctgctgtcgagcccagtttccgcctctctgatcgagagaggaggtcatcgctgggactcagattcacggtgctcctgatgcacgtcgtgttcgttggcgctgtcttcatcctcgatccgaccctcgactggcgaatccacgaggagccgtggtatatagggttgtatggagtgctggttctgctcacgctagtgcaatacttctacacagctggctcatctccagggtatgttattgatgtaatgagagctggttccatgatgcatgcaaccttcgtcaacactgctgctctttcaaagcagtcaaattcaagaaatggaaacacaaattctccaacgagtcatgctcaactacagaaacttagcgcgatgactcctacatcatgggcacagatggttgtggatctttatcctccagggtcaaacagcagggattggacttgcactcactgcagggttgttcagccacctcgtactcggcactgccatgactgtgataaatgcgtccttcaatttgatcatcactgcatatggcttggaacatgcattggcaaaaagaaccattgtcgtttttggtggtacatatctgaagaaacaatcttgtgtatctggactgctgttctctacattgagtcattgcgtttagatgtcgacaaggcctggtggaaggattttgtcggtgtgatcctgttggcagtgcttatctttatcctgatattcctactactattgtggttgtttcattcgtacattgctgtaacaaatcaaacaacctacgaagttgccagaaggaagcgaatattctacctaaggggagtacctgaaagagtccacccattcagtagaggcatatgcagaaatctctatgacttctgctgttctagccagaagggatatattctggaagctgtgcccccaagggaggagctggaagctagagctgctcgttacacgtgccgagacgtcatttgctgccgttgctgctgatagctgtactaccatagcattgtgcccatatagccagttccgctgttctttgttcaaacctttcgttaatggaagcaaattttagtgacctgcggccgttagtgaactctcggagttcactatttgtgcatatgtcatttaaacagtgagaaaaatgtgtgccctttggtccagctgttcacagtttgtctgtaaaattctgtgtggccttgcatccaaataggttttcaggacaggtagaattgatctgcacattcgaggtctggttggtaatttcggaatttagtctaccgttttaaagcctttcttatttgtgttactagcgaaatattttatttatcttgataggtttttgtaacgttgtactgatacatcatgtggtactatttgcataatttgttgtttcgacaaaaaaaaaaaaaaaaattaaaaaaaaaaaaa

SEQ ID NO: 12004 - DNA, 2500 bp, Zea mays
  misc_feature (694)..(694): n is a, c, g, or t
  misc_feature (713)..(713): n is a, c, g, or t
catccaagtattcatcacactccattcaatacaagagcaaagtgcaacactccaagacacaaatcaaagccaccgatccaatcaaagtccccaattcagttctagtactttaggacttgtgagaggatcgttcttgtgtttctttgtgttgctcttgttgcttggttggctttcttctttctctcagtcttactctcaaagccttgtaagcgaagcaagagacaccaattcgtgtggtggtccttgcggggtctaagtgacccgggaaatcaaggaagaaagctcactcggtctaggtgaccgtttgagagagggaaagggttgaaagagacccggtctttgtgaccacctcaacggggtctaggttttcttagaaaccgaacctcggtaaaaaaaatcaccatgtcatccgctttattccttggtttatttgttttcgccctctttttcggactcaattttaattctaacgctaacctcggcttgtagttgtgctttaagtttataaatttcagatttcgcctattcacccccctctagacgactttcaatatgcaccgatgtacattatctagcatcttagatatttttaaaactaatttaaatgcacattatcagttacctacgaagtactaatctgcacggatgtatatcgtagatatttttaaaatagtctagagggcccactacgatnagttcgcctagggcccctnaaaatcataggaccgagactgcccgtcgctagtgaggtccaacattgctaaaactagattcaattttgagctactccctaaatattataaactattaaagaccaagttatttttttattcacaatagctatttagcaacttgttaaatatgagtgtaagaagatttattttagagaactattagagttgctcttgcacagacatcgcataagagttctttttcaggaaacaaagaaaaatcttgaaccgcttatacaccgcgtgagaacgtgtctaataaaagttccctaaaaattaaaatagatacattttataaaatttatggcatcaaccaaaaattaagctctaataataaaccctaaattaagtgattaattgaaatctgttaatctactctgtatgtctaaagtatatttatggcagtctaataggtgacctatatttttgacaattttttttataaaacaggatactgttggtgcagttttttttagcttgagctatataatttagtgccgtttggcagagctctcaaaaggcgatgtgaaaatcggctctagagctgttttgagtgttgagagccggagctaaggaaaaccggctcccaacggctccgcatcgctctcgtgctttttgccactgacagctacatgcggatgggggctgtgcttcgtgaagatctcggcggcagcggcgggtcacatctcgacgccgacagcaacgggggcggcgtggagaagggtagcaagaagccacggacataggcagctccatcccgatggtgcacaagactggccttgtacgtgagggaggcagtaggagtgtggccattaagaagacgcgcattctagctcccgcgcgtagcggtgctgcatgaaggtgatgttgtcgcaaaggcgctgtcaaggaacgcggaggcctgggacagggcggcggtcatggctcattgcaggcgcgtcgcgggatacgtgcataaggtgatcgtggaaatgtctaaaggggaaggagttgttttgctaaacagtttgtcctataaagaagttacttccgtagaggagccggagatggagcctttttatgaggagctggagctctgcgaaatagacccttagtttaggacactgagtccttgttcgtttgtatcagattggagggtcgaaactatttctagccggattgtttctctaatttatataaactttgattagctggaacgattttaggtgtaatctgatgtaaacgaacaaggtctaagacaaatcagtgttggagatgcttatagcaagctacatggtgaacttatcatcgttcactccatcagacaagccagcagtgatacctatatagctttcttatgtggacgccgactcccatttgcttacacaaacgccgccgccaccccctccccccgccaaaaaaagagaaagaaatgtcctcgttttgaaaaggaaaatgatgggtccgtttcaaaattaaaagggatggtccatggacggcatgacgattagcttttatatgtgtcacccaataattaatccgcgtatacaaacatggatacggccggactggtccatctctctacatatagagtttatttgattagaaggaaattgaaggggagaaattaattcatttagggctagtttgagaacctcaattttccaaagaatttatattttcctataggaaaatgaattaatttttttttgaaaaattagggttcctaaactagcccttatcactcaatccattccaaaccctttcttagaccaaacaaccatagtacg

SEQ ID NO: 12005 - DNA, 1872 bp, Zea mays
aatcgtgaaatacgggcacaacagtaccacgcgacgttaaatacgggcacaactcgtgaacgacggcggcgcctagcggtgacatcgtcccctcgactcctcctccatccccgacgcggcggcgccagcctgcagattagcttattaccaccatgggtaaaagaaagcggtcgtcatgtcaacgagataaccataatgattctctagccagcaaaataatgagaactagaatcccagatcttcctgaggacatttggtctcatgtacattccctaatgccaatgcgtgatgctggccgtgctgcttgcctatctcgtgcctttttacgttcctggagacgtcatcctaatcttatctttaataaggatacgattggcatgaaaaaaaattcatatggagagaatttccaccacaaaattagccgcattctcaggaatcactctggcattagtttgaaaacattcaagcttgactacagtggcatgtgtgggttcgatggaactagttatcttgacagttggcttcaggctgctcttaatccagggattgaagaagtcaccctctggttgttccatacaaggagaatatatgaattcccatgctcacttttatctgatggggttcgaaattcacttcggtaccttaaacttcgttgttgtgctctccgtcccacagttgaacttgcccccatgagaagcctaacaagtttacatttgtcctttgtgagcattaaatggaatgggttaaagcgcctcctttccaactcccttgctctggaggaattagagctagtatgttgtgacaagatcgtttgcctcaagataccttctgccctgcagcgtctcaacagccttaatatttatggatgctcgcccctcaaagtgctagagagcaaagctccaaatctctctagtctttctcttttacattttggaggcaggctagtcttctcacgtgtgaaaacattgcaaatgaagaaactaatcactgaaagtactgtctatgatgctcgtaccaggctgccatccattatgcccaatcttgaaactcttgtcataaactcatttgattgggttgttgatgcaccaatgctgcctaccaaattcctctgtcttaagcacctgaccgttcgcttgtcatcaggaacaaccattacccaggcatttgactatttctctttggtttctttccttgatgcgtctccttccttggagacttttatattaaatgtgagtgggaaaggcatgatccatgaatcgatttctgcacatccacaattgaggcacacacctgagcaccaccatggccacctcaggagtgtgaagatatgtggtttcagctctgagaaaagcttatttgaactaacacgttatattcttgagaatgcggtgtcactgaaatttcttacactggacaccttttatggggatcggtgtggtcagggtaagtgtacaagttgtttacccacgcctgatgtttttatggatgtttccaaagcgatctcaggtatcaagacatacatcgagaacaaagttccatccacagttaaactaactgttctggagccttgcagccggtgccatgttagaagagtaatttagacaccatcctagtcatgctacgtcacttccatttaatttaatttgagaagaaccatgcttgtttcctggattatttatagctgtgtcccgatgcacagcaaatttaatctctgatgatggaccgtgcttgtgtttcctgaattaatacatgccaactgtttagttttgtagtatggcatgtggatttatttaagacaagttgacaaatcttgtgtattcggtccgatgctgatatgttaattgtagtgtggctgtgctgtggacttgagag

SEQ ID NO: 12006 - DNA, 2520 bp, Zea mays
  misc_feature (1)..(1): n is a, c, g, or t
  misc_feature (32)..(32): n is a, c, g, or t
  misc_feature (82)..(82): n is a, c, g, or t
  misc_feature (167)..(167): n is a, c, g, or t
  misc_feature (182)..(182): n is a, c, g, or t
  misc_feature (209)..(209): n is a, c, g, or t
  misc_feature (240)..(244): n is a, c, g, or t
  misc_feature (261)..(261): n is a, c, g, or t
  misc_feature (290)..(290): n is a, c, g, or t
  misc_feature (310)..(310): n is a, c, g, or t
  misc_feature (316)..(316): n is a, c, g, or t
  misc_feature (318)..(319): n is a, c, g, or t
  misc_feature (321)..(328): n is a, c, g, or t
  misc_feature (1940)..(2191): n is a, c, g, or t
  misc_feature (2193)..(2520): n is a, c, g, or t
naagagaaataaagagaggtggagagaggaanagtgggtgaagtaaagaaggtaggtgtgggagtaatagttgttataattnataatggatgtaaatagagggaggggagtaataggagaagagagagatagagaaaatagggaataggaaagatttcagaataagnaatagctgttgtggnttctaagtgtgcggaaggggggggggncgaaaggcggcgggggcgtcgggggggcggnnnnnggggtgcgcgtgggccngggggggggggggcgcggggggcggggcncgcgcgcgcccgcggcgccnccggcncnngnnnnnnnncccccccccccccccccacagcatccaagttttcagacatctcattcaatacaagagctagtgcaatcaatacaagacacaattcaatagaatcaaagcctctccaagtcctaactccactccaaacacctagtgactagagagagtgttttgcccgtgttctttgagctcttgttcttggatcgctttcttcttcctcattcttgttcttcaaagcacttgtaatcaaagcaagagacaccaattgtgtggtggtccttgtgaggggtctaagtgacccatttgattaaggagaaagctcactcggtctaggtgaccgtttgagagagggaaagggttgaaagagaccggtctttgtgaccacctcaacggggactaggttctttagaaccaaaccttggtaaaacaaatcacagtgtcatccgctctatttctttggttgatttgttttcacctctcttttggactaagttttatttctaacactaaccccggcttgtatttgtgctttaagtttataaatttcagtttccacctattcaccccccctctaggcgactttcactaccgaagccatcaagcattcccgcagcgaccccaaggaaaaggagaatggctagtgtgctagatgctgttctggagtccgtaaaaacattagctcctgcctctgccgaagctcttagcacgcaaggtaaagattaaaggaaaactagcgacgccagcacggtccacactcttgctgaagttggaccttcagaagctcctgccgaagctagaccttcgaaaaccgcaccgataactctggagaaagagagtgttcctgagaaatccaaatctccttctcctgaagcacccactagagttcattgttcgacatgcttcgagaaagcagctatcagaagagcaggttgtcgaagtgcaacactatgccaaggatctgaagtacccccgatggtccttggtatatggtggcagtgacgaagatgacttcctttactgtttgccagacaataaagagatacatgtatgccgagaaatgatggacaatatatgatattcgaagtttgaacttggcctatctgccatgtcgaaagatcagcttgcagacagtcttgcttacaatagtctgaaggtgtgtatactttgacttgtgtaaagtaaattatttttatgatttttcttgttgtcgttatgtgctcactcttcgttttctagggcttaatcctaagcaaagctctaaaagcccagaaggaagcagaagatgagaactaccgaatagctcttgggaatcttcgctcaaaagttatcacactaaggaacgaagctctttaaaaggataagatattactttccttagtggataggctgagatctaacgacgctaaacttgttgtacaagccgaagctcataaagctaaagtggatgaactaaaaaggaaggttgctgaagcaaccgaaaaatttgaagttgaggttgtgaagcacgagatttgcgagatcgagaggtcaagagcacaaaacaacaccgatgagcttcgtgcttctaaagaaaggtgttatgaatatccttggaatgtgctaggaaagggaggggggggggggactagtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12007 - DNA, 972 bp, Zea mays
gggacgggccctccaggccccccgggccggaaatacgggcacaactcgtgaacgacggcggcgcctagcggtgacatcgtcccctcgactcctcctccatccccgacgcggcggcgccagcctgcagattagcttattaccaccatgggtaaaagaaagcggtcgtcatgtcaacgagataaccataatgattctctagccagcaaaataatgagaactagaatcccagatcttcctgaggttgttgatgcaccaatgctgcctaccaaattcctctgtcttaagcacctgaccgttcgcttgtcatcaggaacaaccattacccaggcatttgactatttctctttggtttctttccttgatgcgtctccttccttggagacttttatattaaatgtgagtgggaaaggcatgatccatgaatcgatttctgcacatccacaattgaggcacacacctgagcaccaccatggccacctcaggagtgtgaagatatgtggtttcagctctgagaaaagcttatttgaactaacacgttatattcttgagaatgcggtgtcactgaaatttcttacactggacaccttttatgggtatcggtgtggtcagggtaagtgtacaagttgtttacccacgcctgatgtttttatggatgtttccaaagcgatctcaggtatcaagacatacatcgagaacaaagttccatccacagttaaactaactgttctggagccttgcagccggtgccatgttagaagagtaatttagacaccatcctagtcatgctacgtcacttccatttaatttaatttgagaagaaccatgcttgtttcctggattatttatagctgtgtcccgatgcacagcaaatttaatctctgatgatggaccgtgcttgtgtttcctgaattaatacatgccaactgtttagttttgtagtatggcatgtggatttatttaaggcaagttgac

SEQ ID NO: 12008 - DNA, 1125 bp, Zea mays
  misc_feature (858)..(858): n is a, c, g, or t
  misc_feature (930)..(931): n is a, c, g, or t
  misc_feature (933)..(933): n is a, c, g, or t
  misc_feature (954)..(954): n is a, c, g, or t
  misc_feature (962)..(962): n is a, c, g, or t
  misc_feature (967)..(967): n is a, c, g, or t
  misc_feature (990)..(990): n is a, c, g, or t
  misc_feature (995)..(995): n is a, c, g, or t
  misc_feature (1000)..(1000): n is a, c, g, or t
  misc_feature (1004)..(1004): n is a, c, g, or t
  misc_feature (1006)..(1006): n is a, c, g, or t
  misc_feature (1020)..(1020): n is a, c, g, or t
  misc_feature (1022)..(1022): n is a, c, g, or t
  misc_feature (1047)..(1047): n is a, c, g, or t
  misc_feature (1068)..(1068): n is a, c, g, or t
  misc_feature (1088)..(1088): n is a, c, g, or t
  misc_feature (1091)..(1091): n is a, c, g, or t
  misc_feature (1101)..(1101): n is a, c, g, or t
  misc_feature (1112)..(1112): n is a, c, g, or t
  misc_feature (1122)..(1122): n is a, c, g, or t
  misc_feature (1124)..(1124): n is a, c, g, or t
taaatctatcctaactgggcacctcagagtaagctgggaagaattgctctcgtggataccatcgctaagcagatacgtaaacggatgaaagttcgtctgccaaatttgttgaccggacttcagggtaaatcccaggtagtgcaagatgaacttgcaaggctaggagaacagatggtacaaagtgctgaaggaacaagagcagttgctctggagctatgtccagaatttgaagataaatttcttgctcacattacttctggtgaggggtccggttggaaaatagttgcaagttttgagggcaagttcccagataggatcaaacaacttccattggacaggcattttgatttgaacaacgtgaagaggattgtgttggaagcggatggctatcaaccctatttgatatctccagagaagggtttacgttccttaataaaaggagttcttgaaatggccaaggagccatcacgactctgtgttgaagaggtacaccgagttttgttagacatagtaaatgctgctgcaaatgctacaccaggactaggaagataccctccattcaagcgggaggtcattgcaattgcatctaatgcattagatgctttcaaaagtgatgcaaaaaagatggtggttgcacttgttgatatggagcgagcttttgttcctccacaacacttcatccgattagtacagaggagaatggaaagacagcgccgtgaggatgagttgaaaaataacagatcatctaagaaaggacaagatgcagagctatccaagatgaaccgggcttcaagcccctcaaactgggatccgatgaagctggggggaacctggaaatcaatgaaggataaatccaanaagcaagataatgatacaaaagagggaccccaatttgcaaggttgctgggcctggcggccgaaataactgcnngnttaccttttgaagaaaagggnaaaaaaanaatgnatggagtaaaaggggggttttgntctanacganaaanangtgggaaggtttgngnttttccctaaggaaggaaggagggngaagacaatttttcgaagggngaattgttcctggggggaantgnaaaccctggnaagcagatagnggagggaagngnt

SEQ ID NO: 12009 - DNA, 2034 bp, Zea mays
tcgtctcgaggctgtcaaccctattttatatctctttagaatggcatacgttccttaataaaaggggttctggaattgttcaaggagccatcacgactctgtgttgaagaggtacaccgagttttgttagacatagtaaatgctgctgcaaatgctacaccaggactaggaagataccctccattcaagcgggaggtcattgcaattgcatctaatgcattagatgctttcaaaagtatgataaaaaagatggtggttgcacttgttgatatggagcgagcttttgttcctccacaacacttcatccgattagtacagaggagaatggaaagacagcgccgtgaggatgagttgaaaaataacagatcatctaagaaaggacaagatgcagagctatccaagatgaaccgggcttcaagccctcaaactggatccgatgaagctggtggtaacctgaaatcaatgaaggataaatccaataagcaagataatgatacaaaagagggaccaaatttgcaggttgctgggcctggcggcgaaataactgcaggttaccttttgaagaaaagtgcaaaaaataatgaatggagtaaaaggtggtttgttctaaacgagaagagtgggaagcttggatacactaagaagcaagaggagagacattttcgaggtgtcattgtcctggaggaatgtaacctggaagagatagaggaggaagagatatcgaagagttctaaggattcgaagaaggcaaatggacaagagaaaggcccaagtcttgtttttaagattactaacagggtttcctacaaaactgtcttaaaagctcacagtgccgttatattgaaggctgagagtatggctgacaaaattgaatggatcaagaagataaaaggtgttattcaaagcagagggggctctgttaagggtcccactgaagatggtcctatgagacaaagccgttcagatggatcccttgatacaatggctcggaggcctgctgatcctgaagaagaacttcgatggatgtctcaagaagtccgtggttatgttgaagctgttttgaacagtttggctgcaaatgttccaaaggctattgtactttgccaagtggagaaatcaaaagaagatatgctaaacaaactgtacaactcaataagtgcacaaagcaatgcaaagatcgaagagctactccaagaggaccacaatgctaaacgtaggcgggaaaaataccaaaaacaatcatccctcttgtcaaagctcactcgccaactcagcattcatgacaatagagcagcttcatatgggaacgatagttctggagctgagggtagcccccggtctcctggccactctggtgaggattggaagtctgccttcgactcagcaacaaatggctctgttgaccggtccagttcacagcatgagacaaggtcaaaaagtgctgacagtcgaggccggcgccatgaaaacggggatgccaactctggcagccgacgcacacctaaccggttgccaccggcaccaccaaatggggggagatactaagtatgttgattgatcattacctgtgaccaatcatcatcatatgctcttgccaggttctcatcctctactgatactggttattggtggaagaaaacatatgggaccggagaacggaaagcttactggaagatttggatggacggtgtgtatcaagagaaccaaagttgtttatagaaaattagaatcatataggtcattgatgattgtcatttcccgatcgttttggtgtatttgatcttttggatcctcattgccagtgggattttgttgccacggatcagttaattttggttttgtacgcttcttctgtaagtctccccatcaaactggcaaatgtattctttacacacagtcatgtatcgttgttcttcccattcttttagactgaaccacatgttcagtggttgtgccatactgctgtatgattatattgtacaattcattattgggctggagtacacacatgcttgttgatacggcccacatgtt

SEQ ID NO: 12010 - DNA, 3192 bp, Zea mays
aggcaacacctacattcttgaaagggaaatgtgctagatagacatttctacctgttttggcgattaagtgtccaacacaccacatcaaactaactagtttgatatgagaatgagcacatgttcacttggaggcaaattgatggaactaaattcaaatgagcttatttggaggctggcaagtgccacttgtggtaaatagtaagaacatgaggtctgaatggttgaataagttgcatatgcctaacattatgtttctagcacttcactttgatctctaacttagttctgtgagaaaagtgcaatttggacatagattgagctaaccaggaggccagaaatgcaacttggagtaaaatggtaaatatgtgaggtttgcaccattagacatgttgcgtaggtccattacaatatttctggcacttgtatttggtgtctaacttcttttgtagagaaaagtgcattttggacttggtttggctcaaatcatatgaatttctttttcgtcataccatttgaactttacagaacatattattgagttgtatggtatatggtcggaaaagctaacagtgaaaggtcagtagctagcatgcatggaataagaaagaacggagcagcatacgccagggatcaaagttagagttaggacgcaactatgccagtgacatacagttgtctgtaagcatcttcctttttgatctatatgaaaaataaaagccgttgttctctccaagtccatacaaatataccatccaatttgctgcccctatatatatagccatcccccgctcccggccggaagtcaagctgagcacaagtgatcgaacaactacagtacatacactctatcgatctctgtgaattaatttagttattaactcgatcatggcgcgcccccaaaacaaccagaaccccagggtgttcctggtcctcaacatcggcggcgtgacggttggccgcgtcgtcatcgagctgttcgccgacaaggtgcccaagacggcggagaacttccggctgctgtgcaccggagagcgcagcgtggggaagtggtccggcaagcgcctgcactacaagggcgcggcgttccaccgcgtggtgcccgggttcatgtgccagggcggcgacatcacggcgggcaacggcacgggcggcgagtctgcgatcggtgacgcccggtacttcgccgacgaggcgttcggagccgtccggcacgatggcgccggcgtggtgtccatggccaacgccgggcccaacaccaacggatctcagttcttcatcaccttcgccgacgcgccgtggctggacggccgccacgtcgcgttcggccgcgtcgtggatggcatggacgctctgcgtgccatcgaaaaggccgggtccatcagtggcaggactatgaggcatgtcgtcatcgccgactgcggcgagctcaagcactaagccgccatgtcctaattattcaggatcatacttactctctaccaaatctgacactatctagtaggtatacgtatacttatatattattatgattgttgtttgttgctgctgctgttacaagatgcgtttgagactaggtagatgatgagcatatatgcgtgattattttcgggtcttgatataaattctcaagtgtgagacaggttaattctgtgtaattgtaataccatggttaatgaagttgctcgctgttattgaaaaaaaaaaaaaaaaaaatccggatcttgttctttcctctgcttgtactggttccagaaactgtcattacacccaactgggcatggaattatatacgaagcagtgtattactagctggaatgatgtagagacgagcacaggtaccatggatcagtgcacaagtgattatgacaagcactgcaatcgagtcaaggtcagcaggtttctctgctgcaagcagcgattccagacagatgatgcaccatgacagatcggaatcaaaatcaaaatcaaaacctgatgatatttcaacctagttattaatgtaagaaaagacaattgaagtgatagaaccagcttagaccaaatctaaataaattatttttattcagatagcaccttgagcgtatacgcgagttggagtagcacatggcggatttatccaaacaaatatgcagaaaatacggattgaacatggtagtattcagaattcactaacgggtttggaacttggaagtataaattaaatttgtacgaaatacccaatattcaggaactagatgaatacagaggtttctaaaaaacgaaatgcttggtaagtataattccttgaacggcgatagttcaaatccattagttaccaaaaaaacacgaaaattctaattgtcctagatggtgattttttacttctcttttgcccaatagcgtaatccgaattaacaagcattatctcgtaggcaggcgtcacaacaaacaagggccaagcctttaggcaacctaataattagaacgcacaacaggaaacggaaaacttacgacggccgtgttattccaacgatacgagagacagccgtccgaaataacacataccgccgacagcttcaaatgaccctcggacataaagctatatctgattgcctatctatcagctctcgaacataaagaatttttagcaaaccagcgcatgatcgcatcgttcattttcctcccattcctgtcttcactcctctcctctctcctctctgccaccgccactcctcgctgccgccgccgctcggcgggggaccgctctacctcgccttatgttttcttatctacatctcgtatgatcttatattaaccttcatattatttgttgatatttcccgattacgttacccagtcaaacataaggtaagcacaagtaccttgcaggtgacaataaatcacccaacttctatcgtctaagtagacctaagcatttaagcatacctaatttactcaggtgacaagggtagggataaacaagggtagagataaacaaaggtaatcaagggtaaatgcaacaattgtttccaaacaactcctagatcctaatgcaacaatcataggctggtaggtgaataaaacaattattgcaatccatggaaattagatgtcggagcttgcttggaatccaacactaggtttagtgtttttgttagacgatgcatgcttaaagtgaaggattatggggaggatacactagcgcaaaaggcg

SEQ ID NO: 12011 - DNA, 830 bp, Zea mays
  misc_feature (816)..(816): n is a, c, g, or t
  misc_feature (819)..(819): n is a, c, g, or t
cattgggtacctcgaggccggccgggaccaaccaccgtggccccggcaaattactcaaatttgcccttcctgtctcggttccctcttcccggcgcaccagcctacctcgccgacgccaggccgccacgccgccggagacatgaaccagcccgtgcagaagaacaccctctacgtcggtgggctggcggaggaggtggacgagaagatcctgcacgccgcgttcgtgccctttggtgaggtcaaggacgtcaagacgccgctcgatcagtccacgcagaagcaccgctccttcggcttcgtcaccttcctggagcgcgaggacgccgccgctgccatggacaacatggacggcgccgagctcttcggccgcgtgcttaccgtcaactacgccttccccgagcgcatcaagggaggggagcagggatgggctgcccagccaatctgggccgatgcggacacttggttcgagaggcagcagcaggaagaggagatgcagcggctgcaggcagagcaccgtgcagcgatgcaggcagcagagaagctgcacagggagaaactggccgctgaaagggaaggcgagaaagaagaagatcccatggctgccgcagaggcccaggctgtgaaacaaagttcttaagaaccggatatcaactcataactcatgtgctacgttgctgcctgtttgtcagatatgactaaacgaatcttgcgaatgctgtttgttttgctgaaagaaccctatttctcacctgacgtgggattcttattggtttatcaaaaaaaaaaaaaaaaaaaaaaaaaaaaaaagaaaaaaanaanaaaaagcggcc

SEQ ID NO: 12012 - DNA, 1182 bp, Zea mays
actcctatgggcgattgggggccccgcggcccccccggacatcggctcacacaagccctgcatctcctttctcccgtgcgcttcccagcctcgctccctctggcgctgtgggcccgacatgcaggcgtggttctcctccggctccgggccctcctcctcgtctgcggcgtcctcatcgcagccgtcgctgctcgcagagtggaactcctacgctgccgcccgctccgctgaggacgcgggcgatggcttcgggatcgacatcgaggcggccgtccgctccgccaacgaccgcgtcgccggcaccttcggcgtggtctcaaaaggtgttaaagggttgccaggcagctttaagtccacaacaagcagtgttccatctggcagatctctcatgtatttcggtctgtttcttggtagtggtgtattcctagttttcatcgcattcacgatatttctgccagtcatggtgataatgccacaaaagtttgcaatatgtttcacggtgggatgtgctttcataattggatcattctttgcgctgaaagggcctaagaatcagctctatcatatgatttccaaagagagattacctttcaccatgggatttgtcgggagcatggttgctacgatctacgtgtcaatggtgcttcatagctacatactttctgttttcttctctgtgcttcaggtccttgctctagcatattatgccatctcatacttccctggtggatctgctggaatgaagtttctatcttccgccgttgtgtcctcagtgttgagatgctttgggcgatgagttcacctgactgctgctttcctgtgctgattgcagtatttctagtggatgatctagcacctttgtggctttgtcgtttagcctgtgcggcttcattaatttcagaagtttgatgccagttgaagcaccgaggtgaactgtgaggaaaggatgttgtggacccagccaacgcttggtaggggcaaaaaaaaaatgtactgtagtacattgggaacaacagcttagtctaaaaagtacattgtgcaaaacatctcactgaacactgggccacaatctaatgctcaagtcatggcgctcatttctttcatcttttctgttgtaaaagggaaaagaaattgccagcacggtttcgtaaacaaaaaaaaaaaaaaaacgcagagtgcggc

SEQ ID NO: 12013 - DNA, 1527 bp, Zea mays
atccccggcccccgtaacgggccacgtcacgtcacaaggctcgcgaagcacggcacggccgcggacacgaccgggtcccctccgcgtccgggtcgcggtcgccgaagaaccctcgctcgagaccgaagaagacaaaatcgcatctcctcgcctcctcccctcctcccgagatccgggcaaagcgcgccgcgcgagaaccaggatatcgatttaggtatatggacaaggtgtctgaaggtactaagtgagatggataagaagaaagcgaccgatggcaccgaaccaggaccagctccttctcgtgccgtcgacagatttggttttataaagccagaacaaggcaattcacctgatggaattccaaaaggcaagtctatacatgagcgtgaaagggaggaaagaaggataagaaaatggaggaagatgataggtgttggtggtaatgactggaagcattatgttagaaggaaccctcatgtggttaaaaggcgaataaggaaaggaattcctgattgtctcagaggacttgtttggcagttgatttcaggcagtcgggacctcttactaatgaacccaggggtttacgagacactggtgatatatgagacatcggcctctgaattggaaattattcgtgacatatcacgcacatttccatctcatatattcttccaacaaaggcatggtccaggccaaagatcattgtataacattttgaaagcatattctgtctatgacagggatgttggatatgtgcagggaatgggatttttagctgggttgctgcttctttatatgagtgaggaggatgcattctggttattagtcgcattgctaaagggagctgtccatgcaccaatggaaggcttgtatcaggctggtttgccgcttgtgcagcaatatttgtctcagtttgagaaattagttattgagctcatgccaaaattgggacaacactttgttgaagaaatgataaacccaagcatgtatgcaagtcaatggtttatcacagttttctcatattccttcccatttcatctaactcttagagtttgggatgtgtttctttatgagggtattaaggttgtattccaagttggattggctctattgagactctgtcacgatgatttagtcaaattaccttttgagaaactgctctatgccttgagaaatttccctgaggaagcgacagatccagatgtattattgccgcttgccttttcatttaaggtatcgagtcgtctcgaggagcttcagaaggagtatcagaagcgacaggagggcaccagtgaaacttcaagcggcgagcggctacagcccctcgtatcgaagacgatgagcagggtcggtagccgtgttgtgtcgaacttaacgaccgctgacagaaaatgacagacacgttctcttgtttgtttgtaactcgcatgtacactgtacagaaagaacggccttataatccatccatctaacagtatttgttcaaaaaaaaaaaaaaaaaaaaaaaaaactcgagggcccgcggcc

SEQ ID NO: 12014 - DNA, 2314 bp, Zea mays
tggtttctcaaaaaagccaattgaagtgcatggtgtagtcggatgcatgacactaatgccacccgccgcccctgttatatcagtcggtataatgttatagcgagtcagcgacaaataatcagccactatattgatttacagtgactttttaggacctgtttggatccttgtagcaaaccccagctaattttagcacattaacctccaaacagatcggctaacaaattcggcaaacaaattgactaattgttagcccggctgcccgttagacatttgactttgctaatagattatataaagagaaaaaaaagacatctattgcctaagtttctaaacatactctggcttatttttgttagctaattatttacctaacaggggtatccccgccgccgcatctagaaatcagttctctaacaggggtaacagatgaaacatttaagtaattttgtagatatgaaaaaaaaagcaatgtccattcgaatcactttttttttttttttttaaatagtgaccaaattaaaggttaagatttcgagaaggtactgtcgttcaaagcatcaagtattcatgactagattgtagccctacacatcacacaagaaataggcagaggcggaaccaatcgtttttcatgcaacgctacgttcaagttcttcaccattagattttatcacacggacatcgttgtcacacctgagacatccttatccaccattgcaactgcagccatgtccgaggccccagtgcgtactggtgtagagatgcaggatcatgctgacctgccattctcctgctgcatcacggtggacgccttgattgacttgacaggggaagtggcgtcatctgctctcacggtttccttggcttggatcacaccaccattggtgcctgcagctgcctgctcttcttcagcttccttagcaatctcgccatcctcagctggctcaatgatgcatgccgtggatgcagtgttcttcgtttgtgacacttccaacgacggggctgattctgcttcttcgttggcagcggtttttgcttgtgccgccgccgattctgcctccacgttgcctttggtaggctttgagccgatgttttcttgggccccatcagccccggcggtggcaaggacacacaagccattgtttcctccggcagcagcgagtgtgatcttgcgcttgtgcttcttcccagacaggtgagaccgcatgacgatctcagatggtgcctttgcattgcagctcaggcagacgaggaagccatccacccgccgcagagggtgcaacacaccgtctacttccatggccagtgagtcagaatcacagacattgttgacctgagccccagcagaagttgcactgcctttcatcatttccgttccaggagttgcagtactgtcgtccccagtggcgacgcgttcctttgctgctgccacagtcgtttcttgcagcccaatgtcatcaccgtgctttggttgcaacgacttattcgccagtagcgctttcgcctttgctgccatgtcgtcagagatgacaaccgtgtgatttgtgtctatcggctgtgcttcggcttcttcctttccacctatggctatggagccgttgacggaggcatcagatgagctggtactcgccttcttctcgtgcttcttccctgacaagtgttgacgcatgccattcatcgatggggccctcacgtcacacagctcgcagagcagaaagccttccaagcggcgcacggtgggtggcagctccacactgtaatcctccagagccagctttacatcaggatcagcactggcaatagccactcctgatggcctgctggaaagttcatgcttcttctggtcattagagatgtgtttgctcccttgtatgtggcacatcattgtaacacggtcagacgtccgcacattgcacagctcacagaggaggtaaccgtccatctgtatcacttcgttcagcgctcctgctgtcgtcgccatcatgaacttggtgggtttgtaatctctcaatgtctccatcgccattgcctcttcctcccctgtctcgagccccctctcctgctctgtctctggcactggctttggcagctccggaagtgctaccaacttcctcttgtgcggcttcccattgaggtggtcttgcatgaccttctcgctgtttgcggttatgccacacaccgtgcaggttaaggtgctcttctgcttcttgctgcttggcgccaaagatggtgtggatgttccggctgcatgatcagggctcttccgcttggtcggcgcatttgctagtgcgtttgctttttggtgggcctg

SEQ ID NO: 12015 - DNA, 2114 bp, Zea mays
attgggacctcgagccggccgggaggcacacaccacaaccataaccacgaactacctgaacggctgaacaattcccttcgtcccatcttcttcctctcgtctcttccaccccccgacccgaccgggcggcctcctccccgaaccctagcccccctacaaccaccgcgtcctgcctcctctgggcggctccgccccagatccagcacagcaggttaaaaagggggcgggcaggcgttggatggacgggccgaagcggtcgcagctgcgggtgcgcctccgcgtcacggcgcgccggcgtggtgccgatggcgacggcgccgggggcgctgccgggcctggggggcgtaagcgccggatggaggcccccgtccgcaactccgtcgccaagctgcagcgccgcgagatcgggggccgccagctcgccgcgcgcggcggcggccccgccgccgccgtgcccgagcgcttccggaacatgcagctccaggaggagttcgatacatatgatgaaaatgctcacctatttgtgaagctgcagtttcttaaaagaagatccaaaattattgagattgttgcagcaaaggatatcatatttgcccttgctaattctgggctttgtgctgcttttgaccgagtaacaaacaagcgcatagccttcttgaatttgagcccagatgaagtgattcggagcttgttttacaacaagaacaatgattctcttattactgtttcagtttatgcggctgacaaattcagcacattgaagtgcagaacaaccccgattgagtatattagaaggaatcagttagatgcagggtttcctctctttgaatcagagtctctgaaatggcctggatttgtggagtttgatgatgtgaatggaaaagtactcacatattcagcgcaggatggcatatataaggtatttgaattgaagaactactccttcctatattcaataccagatgaaaacgtgcaggagataaagatcagtccaggaatcatgctcttgatatatgataggacaccaagttatgttccattgaagatactatcaattgaagatggaaagcaactgaaatcttttaagcacttgttgcatcgcaacaagaaaattgatttcatcgagcagttcaatgagaagctccttgtcaagcaagagaatgaaaacttccagatatttgatgtgcggagttctgagctaattgaagtcagtgtctccaagtttatgaccccttcagcattcatttttctgtatgagaacaacctcttcttgacattccgaaacagaacagtcgctgtatgggacttcagaggagagcttgtgacttcatttgaagaccatttgctctggcataatgattgtagcaccaacaatatttacatcacgagtgaccaggatctcattatctcgtactgcaaatccgaggcagtggctgaggatggtacagttgttccagttggatccatcaacataagtgagattatgacaggcaggtgtatcgccaagattactgccaatgatccttccctaagtgtacccggacgcagaaatggttacagcaagcggtcctcggactggagcaccgttccagaagctctggaggacgtcactgcactgttttatgatgaggacaggaatgagatctacaccggcaacagccatgggctggtgcatgtgtggtctaactagatagtagcatgtacatacatcatttcgcccttttgatttgacttggttagctttactgcatgctgtataatccctggctcgggggctcacctagcttttctatttggcaatagaatgtgtttccttgagcaattgtgattgcatagtgttcttgtaaatatcttttgttcagctaccttgttcaagtaacatagaaataggcctgccaaatgtaactttgctggatactgccagccaagtttcgggcagcaagagagtgaagacctgcagttctgaccatcatgttattgttattttcaagtgtgttgtagtgttcgttttgtctgtaagctgctgaattatcgtatctgaagccttggatgaaccacctttaattatcagttaatctgtacatgattgacctcaaaaaaaaaaaaaaaaaaaa

SEQ ID NO: 12016 - DNA, 1849 bp, Zea mays
gggtacctcgaggccggccgggaacctttccttcgtctctccgctccgctcctcgaccccgaaccccgacgcccgccgcccggcttcccaaatcctagcccccccccaccctagcaccaccgcggcctgccttctctgggcgggtccttcccagatccatcacgggaggttaaaaaggaggcgggcaggtggtggatggacgggccgaagcgacacctgcgggtgcgcctccgcgtcactgcgcgccggcggggcgcctacggcgatggcgctggaggcgcgttggggcccaggcggcggaagtgccggatggagacccccgttctcaactccgctgccaagcttcagcgccgcgagatcgggggtcgccagctcgcggcacgcggcggcggccccgccgccgccgtgcccgagcgcttccggaacatgcagctccaggaggagttcgatacatatgatgacaatgctaacctatttgtgaagctgcagtttcttaaaagaagatccaaaattaatgagattgttgcagcaaaggatatcatatttgcccttgctaattctgggctttgtgctgcttttaaccgagtaacaaacaagcgcataggcttcttgaatttgagcccagatgaagtgattcggagcttgttctacaacaagaacaacgattcccttattaccgtttcagtttatgcatctgacaatttcagcacattgaagtgcagaacaaccccggttgagtatattagaaggaatcagttagatgctgggtttcccctctttgaatcagagtctctgaaatggcctggatttgtggagtttgatgacgtaaatggaaaagtactcacatattcagcgcaggatggtatatataaggtctttgacttgaagaactactacttcctatattcaataccagatgaaaatgtgcaggagataaagatcagtccaggaatcatgctcttgatatacgacagaacaccaagttatgtcccattgaagatattatctattgaagatgggaaacaactgaaattttttaagcacttgttacatcgcaacaagaaaattgatttcattgagcagttcaatgagaagctccttgtcaagcaagaggacgaaaacttccagatacttgatgtgcggagttctgagctaattgaagtcaatgtctccaagtttatgaccccttcagcattcatttttctttatgagaacaatctcttcttgacattccgaaacagaacagtcgctgtatggaacttccgaggagatcttgtgacttcatttgaggaccatttactttggcatcatgattgtagcaccaacaatatttacatcactagcgaccaggatcttattatctcatactgcaaatcggaggcagtggctgaggatggtacagttgttccagttggatccatcaacatgagcgagatcatgactggcaagtgtatcgccaagattactgccaacgatcctgccctaagtgcgccccctcgcagaaatggtcgcagcaagcggcggtcctcggtctggagcaccgttccagaagctctggaggacgtcacggcactgttctatgacgaggacaggaatgagatctacaccggcaacagtcatggactggtgcatgtatggtctaactagatggtaacatgtccatacatctcgcccttttgatttgacttggctagcctgactgcattctgtataatccccggcttggggctcacctagattttgtatttggcaatagaatgtgtttccttgagaaattgtgaatgcaaatcgttataaatatctcatgttcgtctaccttgttcgagtaacatagaagaaattagcctcc

SEQ ID NO: 12017 - DNA, 1180 bp, Zea mays
cgggcatcatttaaaaagcactgacgggagaagcttgagctagctacgccaatggctatagggcacaagaacaccaccaaagtggcgctcctagttctgctgctgtcattgatgctctctttgacagcgtcagtggcgcgcaatctccaatggcgactgtccgtcgctacggctgtggaggtgtgcgtgaaggctgctgtcggggctcctgacaagcttggcgactgtcccttctcacaaagggtgctgctcactctggaggagaagaaggtcccttaccggatgaggctcattgacctcagtaacaagcctggatggtttctgaagatcagcccagagggcaaggtgcccgtgtacaacagcggcgatggcaaatggattgctaattctgatgtgatcacccaagtcatcgaggagaagtacccagccccgtctctggcgacgcctccagaatacgcatcagtgggatcgaagattttcccatccttcgtcaagttcttgatgagcaaggatgccagcgacgacggttcggaagagccacttgtgcgtgagctgcaggcgctggaggagcatctcaaagcccacgggcgtccctacatcagcggggagagagtaacagccgccgacctcagcctggcgccgaagctcttccacctggtggtggcgctggagcatttcaagggctggaaggtgccagaaagcatgtccagcgtccacgcctacacccaggctatgttcagccgcgaatctttcatcaagactaagcccaccaaggagcacttgatcgcgggatgggcggcgaaggtgcccaagccgcccaacctcgtcgtgccttgctggctcatctgatcagtcgcagtcggtggtgcgttgctggttcattatgattgggttgggatacaacaataatgcagcgtgccatgttccgatcacttcccagttgtggtggccatgtttctatatcacctaacgctgccggttaggttcgggaccgtgggcatctgcatcgatctttttcttttcttttcttttaagattacacaccataacatggccttgtgcatctgcactcgtgatgggcatatttgtgacgtggaaatatcttctttcttaagcgcgcgctagtgagaatgttgggcgcaaagtaggcgcgcattacatggtgtggtcgtttgtgccc

SEQ ID NO: 12018 - DNA, 2033 bp, Zea mays
tgtagagttattgataaatgtaaagggcattaatgtaatcttgcatgggctgcgacccgtgcctataaataggtgaacagtattcccgtactgttcacgctgacttggcattcacttttgcgccacgcctgtattttctttccttcaagccgaaggtacatttgtaatttatctttgtttacacaagtaatacaaatagaaataaattaataataatgtttatagaaattatgttactttctgtattttgtttgaatgttccccattttttatcgtgatcatgagggtacatccttcatgaccttcgtcctaaattcgttatatccgaagggaaataatgatttgaaggacgaagggctttggatatttaacactttatgttgccttgttcttgattcatagcatttgagaacaagtccccaacattggcgcccacctccggtgaactcacttccattttttgagtcttgaacactttcggcaagcatcaccttcgtcatgccgccgaaaaaagcttcagcgacaggggctggtactttacagccgctggatcccaatcaggacgtcctttctcttagagaggcccgaagccagaagaggaaggctgttagtccaacacctccggaggatgacttggatcaggagatccaaaacctggagatccttcagcaacaggtgcagcgcaagaaggagaagatggctcgtctagctgaccttcagagacagatagacgaagcttctgaagaggttcgtcatcttgttcaagatgatcagagccgaaggcctccacgcagagagctccatcaggaaggcttccacaatgaggacgactggtatgaagatttccatcatggaaactttgctttcgatgatgcttctcctctctcaacagaattgcaggctacaccatggccccagtcttacaagccaccccagctccccatgtatgacggtcatacagacccgaagcaattcttgatgagctatgaagcaaccatatcttcgtatggtggcaatactgcagtcatggcaaaatcttttgtcatggccgtcaagagcgttgctcagacctggtactcttctcttcggccagggacaatcacttcttggcagaagttgaaggatatgctgataactagcttccaagggtttcagacgaagccagtcactgctcaagctttatttcagtgtacccaggaccacgaagaatacctccaggcgtacgtccgaaggtttctgcgtctgagggcacaagcgccaacagtgcccaatgaaattgtcattgaggccatgattaaggggcttcggccgggaccttcagcgcagtactttgccaggaagccaccacaaacgttggagaagctgctccagaagatggacgaatacattcgagctgacaatgacttccgccaaagaagggaggaagcattcaggttctctgaaatgaccaggggcttcggaggaagatttcacccgaggcacgttaggtcaattcataactctgctcaaactgatgatcgagggagtcagcagcaaaggccacaatactcttcacaagcttcgggccagcagcaaagttcttttcggccgccagcgccaaggggcagaggcgccaggggcttcgggggaaggtttggagatcagccaagaaaaatttattgcctattctgtggtgaagacaagggccataccaccaggatgtgtcacgttaccatccagaagcagaaggagatagcagaagcagctgcgcaacaaagtcagccgaagcaggtcatgcatactgcttcgtatatatcattcgccttatattccagaatacgtaggcaaccaccccgcagcttctgttgcttcggcaagccaaccccaagcatcttggcagcagcccccaccaccaccgccgacgcagcgagggcagcagccagaagggagtcagcacaatcaccttcagagggatttcagagaggagtccgaagctcgcacagtcaacagtactgtgccagagtcgaagcacatttgttgataaatatcctacc

SEQ ID NO: 12019 - DNA, 2741 bp, Zea mays
agcttgcttagtcttgtccaagattacaagggactgactgccccaactattggggatggaagaaccatccttttctgggaagatatgtggaataggggcaccccggctcatcaatatcctgagttattcttctttgcttgtaacagcaaacttaccgtcaaagaagctatccaaaaggaacaacttattgaaaattttcagcttcctctgtcggtgcaagcctatgaacaatttcttgacttagacgcaacctgggggcaaatcatggtagccaacacaaatgatgcttggaaactcatttggggagctgataatttctctacaaagaaaacttatagacatttgatgggtcaggctcaggttcactagatcttcagatcgctttggaaaaataagtgtcaaccaaaacataaggtttttttggctttggctaaagaacagactcaatacaagagatatgctgaggaggaaaaacatgaatctagagtcttacacttgtgagaattgcatctggcaaaaggaggaaaccctttatcatcttttcctcaaatgtaattatcgcgaaggcttgctggaattctattggtatgacgcccccaagaattactaatcctgtggacgctgcagtaaatctaatgcagcagctcaatgtttccttctctatggaaattgtcattctcatgacctggagcatttggaaatgtcgtaatgcctggctttttcaggataaggacccaacagtgcagcattgtaaaaatgagtttgcaaaggaattatatctggtcacgcttagagctaaaggacgattcgattcgacaatacctgaatggcttcagcattggcagtagatctcgtcaatttttcccttttgtaattttgtaatttataatttactttcctgtatgcttctaactctgtcgttttaaaattttaataaaatttcagtaggggcttgcccctcctgtcctataaaaaaaagttgacgtgaatagatttcattaagaggttggatgttagtgggatgacatgactattagtaggacgagatgatgtggaaagttagtgggagatgatatggatagtttttgctttcatcgaaaggttggaagttagtatgatgacatggctaatatagatacatagatatagactaccaacatggctgcatgcccccaagctctcccactatatatatctctggtagcacaggctcggaagggacaatgcttacaaaaacccatccatcattttagctgttgatacaaaagagctagaagggagatggccgagacaaatccagagttgagtgatcttatggcgcaaacaaacaaaaaaatagtaccaaagttcactgaaatcttccccgtggaggacgtgaactacccttacagcgccttcatcgcgtcggtccggaaagacgtgatcaaacactgcaccgaccataaagggatcttccagcccgtgctgccaccggagaagaaggtacccgagctgtggttctacacggagctcaaaactaggaccagctccatcacgctcgccatacgcatggacaacctgtacctcgtgggcttcaggaccccgggcggggtgtggtgggagttcggcaaggccggcgacacccacctcctcggcgacaaccccaggtggctcggcttcggcggcaggtaccaggacctcatcggcaacaagggtctggagaccgtcaccatgggccgcgccgagatgaccagggccgtcaacgacctggcgaagaagaagaagatggcgacactggaggaggaggaggtgcagatgcagatgcagatgccggaggccgctgaactggcggcggcggcggcggcggctgacccacaggccgacacgaagagcaagctggtgaagctggtggtcatggtgtgcgaggggctgcggttcaacaccgtgtcccgcacggtggacgcggggttcaacagccagcacggggtgaccttgaccgtgacgcaggggaagcaggtgcagaagtgggacaggatctcgaaggcggccttcgagtgggccgaccaccccaccgctgtgatccccgacatgcagaagcttggcatcaaggataagaacgaagcagcgaggctcgttgcgctcgttaagaatcaaactactgccgctgccgctgccgctactgctgccagtgctgacaacgacgatgacgaggcctgatcatcgacacatcatgatctgctgctgcacttaatatgttcgtatacaaataaatacaccccgcgtacgctgttccttatataaattttagactacataaataaaataaaataatgttttttttaaaaaatcttaagtttagcaactaaactttagacaagagaataaaacaggccatacgaagttttgaatccgagaagagaataatgagaatataaaccaggatcgagttgccatgctccttcgcaattcagatagaagtagttcaattgttcaaagcaatcattttcctcgtttgagcttgtccatgcacatagaaacgcatgtaggccatataagtagtcatataagtagtcgttgaataagcaaatactgcatctgttccaaaataaaatctgttgtacctttttatactagattcatacaatagttaatgtatgtgttatatgtctaggttcataatcatccatataaatatggatataaaaatctagagataaaatgacaattattttaagacggatggagcacaaaatacataccta

SEQ ID NO: 12020 - DNA, 2262 bp, Zea mays
  misc_feature (2262)..(2262): n is a, c, g, or t
ttatatccaggggaaataatgcttcgaaggacgaagggttttgatatttaacattttatgttgccttgttcttaatccatagcatttgagaacaagcccccaacattggcgcccacctccggtgaactcacttctatttttagagctttgaacaccttcggcaagcatcaccttcgtcaggccgccgaaaaaagcttcagcgacaggggctgccactctgcatgcgctggaccccaatcaggacgtcctttctcttagggaggcccgaagccagaagaggaaggccactagtccaacgcctccggaggacgacttggattaggagatccaaaacctggagatccttcagcaacaggtgcaacgaaagaaggagaagatggctcgtttagctgaccttcagagacagatagatgaagcttcggaagaggttcgtcatcttgctcaagatgaccagaaccgaagcctccgcgcagagagcttcatcaggaaggcttctacaatgaggacgactggtatgaggatttccatcatggaaattttgctttcgatgatagcttttattaagaggttagaaattagtgggatgacataacttttagggctaatttgagagctacaaaaccggagggattggaggggctagaatccctttcttattcaatagaattttagcctctttaatccctttcggttttgtggctcccaaactagcccttagtgggagatgataatggatagttagtggaagatgatgtggatggcttgctttcattaaatggttgaaacttgaaagttagtaattgtgtttagcgaagatgacgtgaatagatttcattaagaggttggatgttagtgggatgacatgactattagtaggacgagatgatgcggaaagttagtgggagatgatatggatggtttgctttcatcgaaagggttggaagttagtatgatgacatggctaatatagatacatagatatagatagattaccaacatggctgcatgcccccaagctctcccactatatatatctctgctagcacatgcatcccaatccgggacaatgcttacaaaacccatccatcattttagctgttgatacaaagagaagggaatggccgagataaccctagagccgagtgatcttatggcgcaaacaaacaaaagaatagtgccaaagttcactgaaatcttccccgtggaggacgcgaactacccttacagcgccttcatcgcgtcggtccggaaagacgtgatcaaacactgcaccgaccataaagggatcttccagcccgtgctgccaccggagaagaaggtcccggagctatggttctacacagagctcaaaactaggaccagctccatcacgctcgccatacgcatggacaacctgtacctcgtgggcttcaggaccccgggcggggtgtggtgggagttcggcaaggacggcgacacccacctcctcggcgacaaccccaggtggctcggcttcggcggcaggtaccaggacctcatcggcaacaagggtctggagaccgtcaccatgggccgcgccgaaatgaccagggccgtcaacgacctggcgaagaagaagaagatggcgacactggaggaggaggaggtgcagatgcagatgcagatgccggaggccgctgatctggcggcggcggcagcggctgacccacaggccgacacgaagagcaagctggtgaagctggtggtcatggtgtgcgaggggctgcggttcaacaccgtgtcccgcacggtggacgcggggttcaacagccagcacggggtgaccttgaccgtgacgcaggggaagcaggtgcagaagtgggacaggatctccaaggcggccttcgagtgggctgaccaccccaccgctgtgatccccgacatgcagaagcttggcatcaaggataagaacgaagcagcgaggatcgttgcgctcgttaagaatcaaactactgccgctgccgctactgctgccagtgctgacaacgacgacgacgaggcctgatcaatgcaacgacacatcatgatctgctgctgcacttaattactatgttcgtatacaaataaatacacccggcgtacgcggtgttccttatatggtctaaaatgtagccagtaaattttaaactactttatttcttgaggctctataaacaatagatttaaagtgttatgtaaagtttagacaaccttatataaattttagactacataaataagcttaaataagtttttttaggaggn

SEQ ID NO: 12021 - DNA, 2009 bp, Zea mays
ctatagagttattgataaaagtaaagggcattaatgtaatttcatacgggctgcgtcccgtgcctataaatagatgaacagtattcctgtactgttcacgctgacttggcattggcatcacgcttgtacccttactttccttcaagccgaaggtacatttgtaatttgtcgtcatttatataagaaaaacgaataggaataaattaataagtagtgtttaaagtagttatgttattttccttattatgtacataaatcttttcttaatcttttattatgattatgaaggtatgaccttcataaccttcgtctgaaattcattatacccaaggggaaataatgtttcgaaggacgaaggactttaatatttaacattgtgtgttgccttgttcttgattcatagcatttgagaacaagtccccaacattggcgcccacctccggtgaactcacttccatttcttgagctctgaacaccttcggcaagcatcaccttcgtcatgccgccgaaaaaagcttcagcgacaggggctgctactctgcagccgttggaccccaatcaggacgtcctttctcttagggaggcccgaagccagaagaggaaggctgctagtccaacgcctccggaagatgacttggatcaggagatccaaaacctggagatccttcagcaacaggtgcaacgaaagaaggagaagatggctcgtttagctgaccttcagagacagatagatgaagcttccgaagaggttcgtcatcttgttcaagatgaccagaaccgaaggcctccgcgcagagagctccatcaggaaggcttctacaatgaggacgactggtatgaagatttccatcatggaaattttgctttcgatgatgcttctcctctatcaacagaattgcaggctacaccatggccccagtcttacaagccaccccagctccccatgtacgacggtcatacagacccgaagcaattcttgatgagctatgaagcaaccatatcttcgtatggtggcaatactgcagtcatggcaaagtcttttgtcatggccgtcaagagtgtcgctcagacctggtactcctctctccggccagggacaatcacctcttggcagaagctgaaggatatgttgataaccagcttccaagggtttcagacgaagccagttactgctcaagctttattccagtgtacccaggaccacgaagaatacctccaggcgtatgtccgaaggtttctgcgtctgagggcacaagcgccaacagtgcccaatgaaattgtcattgaggccatgattaaggggcttcggccgggaccttcagcgcaatactttgccaggaagccaccacaaactttggagaagctgctccagaagatggacgagtacatccgggccgacaatgacttccgccaaagaagggaggaggcatttaggttctctgaaatgaccaggggcttcggaggaagatttcatacgaggcatgtcaggtcaattcataactccactcaaagtgatgatagagggagccaacagcaaaggccacaatactcttcgcaagcttcgggacaacagcaaagctctgttcggccgccagcgccaaggggcagaggcgccaggggcttcgggggaagatttggggatcagccaagaagaatttactgtctattctgtggtgaagacaagggccataccaccaggatgtgccacgtcaccatccagaagcaaaaggagatagcagaagctgcagtacaaaagagtcagccgaagcaggtcatgcacactgcttcgtaccattcgccttacatcccagaatagagatggcaacgggtccaaacccgtcgggttttgctatcccaaacccgtacccgtgaaaaatatttacacccattaaaaacccgtacccatgacgggtttgaaattttgcccaaacccatacccatcgggtttgcgggtacccacgggtttttatctccaatatgcttattctttttataatcaataagtatcg

SEQ ID NO: 12022 - DNA, 1896 bp, Zea mays
tctgcacactctaatttttaggattgaatatgaactaatgtagatgtatgttttatttatttaataaaataaataaaaggagaaccttagagatttaaacttgtttaagcttgtgagattaataatatgtattacataagttcatctctgttctaaattttaggtcaccataaaataaattgacctatgattatgtacttgtaaataacacttagggaaataataatctatttccaaatgaagttaatgtatgccatagttcatgttatactttgaattcattatcccttatgtagtattgtgtctttttaagatgtgttccaatgtttgtacatgtttggtgtgatgttcatttgtactttccaaatgtattgaatgcatgctcgctttatttagacaacgagcagtccgaggttcctgagtgtgttgttagagacctccctgagcaacaacctggtgaaggcaagtgtcctctgacctattatgtcctacatactttatgattcactatcccgcattaccatatgaaacctaaggattgactagtctgtatttacttatccttgtttacctttttgggttatcatggttagcattttgctattgccttaactttaatcaatgaacatgatgtgaccatttatgatacgatactgttatcatgattatgttgatgatcttgtgatactctagggggctcaggcctttttcctgagtacctctccgtaaggacctgttcgtggagtgaccacccgggataacagtgcaaccatgagggtggaatgggaagcccttagctgattaattagataaacctagggtgtagttggctttgccggagggccgtcaatgggggccggagcgtattgctcgctcttccaaggttggggtgcagaggttcatttgatttggttttgttagtcacccaccttggggaggtgtactgcgtttgtatgactagcgaaacctaacgagcagctatgcaccaggggagtctttgtaaaggctacatagtgaaaccttgctgagtcaccttggtagtgtttgagggtttgatcgacccgaggcataaagggatcacgacttgtgggtaaagtgtgcaagctctgcagagtgttagaaactggtatatcagccgagctcacggttaagagtagccttgggatcctctttgattaaaagaactttggatacttatatgatcatggttaataatgatgttataaaatctgatctctggtatttcctcttttgaggaggtacttctgggtaattattgggtttattactaaaactgggctctactaataataataaatatttgaccaactaaaagtaactgcttaacctcaactccatatacagctagtccactttagccaaactggacatttgctgagtacgttgatgtgtactcacccttgctttacacaccaccccaccccaggttgtccccaatgtactcaatgctcaggaggtgatgctggtaacatggatgacttcgaggagttctaggaatatgacgagttttagtttactttagtggcaacccccaatcagctgcctgtgtaggcttagcatctacgtttcgtatttccgcactttgataattatgttaaagacaatggttatgtaatagactctgtggatgtcttggacatcttgatgtaatcaagtacctttccgctatttattttgagcattgtgtgatgatgtccaattatgtaatcgctgtgtacgtgtgtttctgatcctggcatgtacatggttcgcattcggtttgccttccaaaaccgggtgtgatagctacattatattatgggcagttcgttgcttcacgagaggccatgctgctatggcgactgaaatctggttctgcctccgcaccttgcagtt

SEQ ID NO: 12023 - DNA, 602 bp, Zea mays
gtaataaagcatgatcatgggccataaagaattattttcaaatggcttgttgtgcttgaccaaactacacaataattcatttgcatgcaaggtgtgaggtaacaaactagggcaacctattagatcccatcaaatttaacctgagcatgtcacactgattatagagaacattattggataaagaagagtggtcaaggacacaactttccttcagcgagctcctgctcagtatcttcaacctgtggtgctccgggctcctcgatcacttgctcgtccacggagttcaagcggtggctagggctagcctcgatgaggtacggacgcacgtcggaggacaacgtcggagtgcaattcccgggatctccgacctcgaatctgcccggcatcgccacaagcacgtctgccgaagccctgcgaagctcctaggaaccaccctaggttggaacggcgacatgaccccgtgtcaacagtggcggcccggcctcccttcgttgcggcctctctctctctctctctctcccccgacgacggcgactgacgtggtggtttagcgcgtgggaaattgaaggggaaggtcgcagaggccctacatttatccccca

SEQ ID NO: 12024 - DNA, 2195 bp, Zea mays
agcctatttcacgcatgctccccgtgacaatgaccttggccgtgccagttacagctacttaaagatctagcctccaccacactttctcgttgacaacccggtcctacaacccggtccttcccttgcccacactccgcagagccggtggtccgcgatctcgagtaacaaaaagtaaaagccgcccctctgcggtgccgattattcccgagattacattattatatatatcttcccgcgcccgagattccccgtggatgactcgctgacatgtgggccctctctgcgaacctcgccagcactaatcgagccgccactggcagcatctgaagagaataaaagacagccccacacgcagctcgaatcccggcacgtgagcggcggaggcagggacggccatggcatgcagtgggtgcagctgcgaggcggcggtgggggcgatggcgtcggaggcgtacctggagggggcgccggtgcgggaggcgcgggagctggtggcggagctctgtcggcacttctacgcgcagggatgggtcacgggcaccggcggcagcatcaccgtcaaggtcaacgaccccgccgtgccgctcgccgaccgcctcatcgttatgtcaccctccggtgtgcagaaggagaggatggtagcagaggacatgtatgtgatggctgcagatgggaaagtgctttctgcgcctgtagcaaagccatggccaaacaagcctcctaagtgcacggactgtgctcctctgttcatgaaggcgtatctgatgagaggagctggggctgtcattcacagccatggaatagagacttgcatcgcaacaatgctcatccctggtgcaaaggagttcagagtgacccacatggaaatgatcaaaggaatcaaaggtcatggctaccatgatgaattggtcattcctattattgagaataccccttatgagtatgagctcactgactccctaagtgaggcgattgcagcatacccaaaggcaactgctgtgcttgtaaggaaccacggaatatatgtatggggggagtcttggatcaatgccaagacacaggctgaatgctaccattatcttttagatgcttgcatcaagctctatcagctaggtattgattggacaacccctgaacatggttcaataaacaatccaaggagaccgcacagcattttgagccctgaaatttgtaatggatgtcatgctgctgattcatcaaagtgtgttgtactagacattgaggggacaaccactccaatatcatttgtgactgatgtcatgttcccttatgctcgtgataatgtacgaaaacatctgacttctacatttgattttgaggaaactaaagaagacatcaaactattgcgcatccaaattgaagatgatctacgaaatggagttgctggggctgttccagttccacctgatgagggtggcaaagaagaggttatcaattcattggttgccaatgttgaatcaatgattaaagcagaccggaagatcacatcattgaaacaacttcagggtcatatttggaggattggatttcaaaagaaagagctacagggagttgtctttgaggatgttcctgtggcgctaaagaactggcatgctagtggcataaaggtctacatatactcaagtggaagtagagaagcacaaaggcttctatttggcaatacaacatacggtgacctgcgaaagttcctgtgtgggtattttgataccacaactggaaacaaaagagaaacaaggagttattttgagatctctcagtcactcggcgtggacagtccatctcaaatcttattcatcaccgatgtcttccaagaagccattgctgctaaaaacgctggttttgaggtgataatctccattcgcccgggaaatgccccacttcctgacaatcatggtttccgcactatcaaatcattcagcgagatctgaggaatctggtgatctggacatgtctagatatatgtaattcgcgagtgctttagcccgcggaccagttcatgcagtagaagcattatagcaccgcagcatgtcaaaacgatgtgacgtaacaataagttacatggcgaaataaaaactttggttcgttgtgtaaaaaaaaaaaaaaaaaaaaaaaaaaaaaaaaataaaaaaaaagatcccgggggggggccggggcccccaattcccccttagagg

SEQ ID NO: 12025 - DNA, 1893 bp, Zea mays
gcacgagaccattacctagaacatcctagtcggcccactcgttagtcgttactcccaacaccgggaatccatggagccggcctatgtcgtcaccctctccttcctcttcctcttcttgctccaccatctcctcggccgccaccgccgcaggaccaacggcaagaacaagagaacgcagctgccaccgagccctcccgccatcccggtcttgggtcacctccacctcttacggaagcctatccacgcggcgctcgctcgcctcgcggagcgctacgggccggtgttcttcctccggctcggctcgcggcaagccgtggtggtgtcgtccgcggcttgcgccacggagtgcttcaccgagaatgacgtctgcttcgcgaaccgcccgcggttccccacgctcctgctggtttccttcggcggcgccacgctcccaatgtgccgctacggcccgtactggcgcaacctccgccgcgtcgccacggtgcagctcctgtccgcgcaccgcgtcagctgcatgctccccgtcatatccgccgaggtgcgcgcaatggcgcggaggatgtaccaatccgccgccgccgcccccgccggcgccgcgagggtcgagctgaagcggaggctgttcgagctctcccacagcgccctgatggagaccatcgcgcgaaccaagacgtcccgtgccgtggcggacgacgacacggacatgtctccggaggcccaggaattcatgaaggcgctggacgtgttccttccgcttctcagcggggccaacgcgtgggactacctgccggtgctacggtggctcgacgtgttcggcgtgaggaacaagatcctgcgcgcggtgagcgcaagggacgcgttcctacggcggctcatcgacgcggagcggcggaggctggaggagggcggcgagaacaacgataagaagagcatgattggcgttctgctctcactgcagaagtcagaaccggaggtgtacacggataccatgatcatggctctgtgctcgagcatgttcgctgggggttctgaaacaacagcgacgacggcggaatgggcgatgtcgctgctgctaagccaccccgatgttctgaagaaagcgcaggcggagattgacgcgtccgtggggcactcccggctgctcggcgccgacgacctgccgcgcctcggctacctccactgcatcgtcagcgagaccctgcggctgtacccggtcgtgccgacgctggtcccgcacgagtccaccgccgactgcacggtcggcggccaccgtgtgccgagcgggacgatgctcctcgtcaacgtgtacgccatccacagggaccccgcgatatgggcggacccagccgcgttcaggccggagcggttcgaggacggccgtgccgacgggctgttcgtgatgccgttcgggatgggaaggcggaaatgccccggagaggccctcgcgctgcggacgctggggctggtcctggggacgttgatccagtgcttcgactgggacacggtcggcggcgccgaggtcgatatggccgaagggggcggaatcacgctcccgagggctgtccctctggaggccatctgcaagccgcgccatgctatgcttggcgtcctcaagggactgtgagcgccatgctatgccttgatacataagtaagctttttttctttagtaaagcagtcatcttgcgtctcaagcagttgcttgctttattgcttgaaactcactttcttcctggagtgtagccgccgcagtgtaagcgcgcggggttcaaatgttatttcattcacagccatcagccatgtatatgttgaactagcaatgtgaatgtgacccacgtaaaatcgcatgggtttactagttttttttttcagttatagcatttgtgttttttta

SEQ ID NO: 12026 - DNA, 1918 bp, Zea mays
actatgggtacccccgggccggcccgggccggagaactgagaaagcccactcgttagtcgttactcccaacaccgggaatccatggagccggcctatgtcgtcaccctctccttcctcttcctcttcttgctccaccatctcctcggccgccaccgccgcaggaccaacggcaagaacaagagaacgcagctgccaccgagccctcccgccatcccggtcttgggtcacctccacctcttacggaagcctatccacgcggcgctcgctcgcctcgcggagcgctacgggccggtgttcttcctccggctcggctcgcggcaagccgtggtggtgtcgtccgcggcttgcgccacggagtgcttcaccgagaatgacgtctgcttcgcgaaccgcccgcggttccccacgctcctgctggtttccttcggcggcgccacgctcccaatgtgccgctacggcccgtactggcgcaacctccgccgcgtcgccacggtgcagctcctgtccgcgcaccgcgtcagctgcatgctccccgtcatatccgccgaggtgcgcgcaatggcgcggaggatgtaccaatccgccgccgccgcccccgccggcgccgcgagggtcgagctgaagcggaggctgttcgagctctcccacagcgccctgatggagaccatcgcgcgaaccaagacgtcccgtgccgtggcggacgacgacacggacatgtctccggaggcccaggaattcatgaaggcgctggacgtgttccttccgcttctcagcggggccaacgcgtgggactacctgccggtgctacggtggctcgacgtgttcggcgtgaggaacaagatcctgcgcgcggtgagcgcaagggacgcgttcctacggcggctcatcgacgcggagcggcggaggctggaggaaggcggcgagaacaacgataagaagagcatgattggtgttctgctctcactgcagaagtcagaaccggaggtgtacacggataccatgatcatggctctgtgctcgagcatgttcgctgggggttctgaaacaacggcgacgacggcggaatgggcgatgtcgctgctgctaagccaccccgatgttctgaagaaagcgcaggcggagattgacgcgtccgtggggcactcccggctgctcggcgccgacgacctgccgcgcctcggctacctccactgcatcatcagcgagaccctgcggctgtacccggtcgtgccgacgctggtcccgcacgagtccaccgccgactgcacggtcggcggccaccgtgtgccgagcgggacgatgctcctcgtcaacgtgtacgccatccacagggaccccgcgatatgggcggacccagccgcgttcaggccggagcggttcgaggacggccgtgccgacgggctgttcgtgatgccgttcgggatgggaaggcggaagtgccccggagaggccctcgcgctgcggacgctggggctggtcctggggacgttgatccagtgcttcgactgggacacggtcggcggcgccgaggtcgatatggccgaagggggcggaatcacgctcccgagggctgtccctctggaggccatctgcaagccgcgccatgctatgcttggcgtcctcaagggactgtgagcgccatgctatgctatgccttaatacataagtaagcttattttcttcagtaaagcaatcatcttgcgtctcaagcagttgcttgctttattgattgacactcagtttcttcctggagtgtagccgccgcagtgtaagcgcgcggggttcaaatgttatttcattcacagccatcagccatgtatatgttgaactagcaatgtgaatgtgacccacgtaaaatcgcatggtactagtttttttttcagttaaaaaaaaagaaaaaaaaaaaaaaaaaaaagc

SEQ ID NO: 12027 - DNA, 1041 bp, Zea mays
  misc_feature (1007)..(1007): n is a, c, g, or t
tcccgggggccccccggggcccgccggagaaccctaccctagcgcccgtcctgccgccgctgcagccgccatcgcacggccatgggtatcgatctcgtagccggcggccgcaacaagaagaccaagcgcacggcgcccaagtccgacgatgtctacctcaagctcctcgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtgatcagatcgccgtgattgtgggcaccgtgaccgacgacaagaggatcagcgaggtgccggcgatgaaggtctgcgcgctcaggttcactgagacagcgagggccaggatcatcaatgctggcggagagtgcctcaccttcgaccagctcgcgctccgtgccccacttgggcaaaacacggttctgctgaggggtcctaagaacgctagggaagctgtcaggcacttcgggcctgcaccaggagtgcctcacagccacaccaagccttatgttcgctcgaagggtaggaagtttgagaaggcgagaggaaggaggaacagcaggggcttcaaggtctaagtggccactgccttgccaatctagtgccgttttgctcgtgtcagctcaatattaccgttttggtgtcatagttgtaatgttttagttgtcggaatctcgtgtcattatcggatatcgaaccaatcaaatttcgctccttttttgtttttgccatgagacttgcccgtcacgaagatgctcacatatcattgtgggccgtaactatgtgaaagtctagctgcccttttgctttgctcgtctaccttcacttgtcagcggccccttttaatccagcgccttcacaattttttaacagtgaggccgcctgaaacgaactatactgatacagtgacattatagtccgttattttggttgcacagcncaaaaaaaaaaaaaaaaaaagggcggcgctcgcg

SEQ ID NO: 12028 - DNA, 2260 bp, Zea mays
  misc_feature (2232)..(2233): n is a, c, g, or t
ccggccgggatccgctgaagaaactcttgaatctgaactatataaaaaaactgagaaatgcttctatattcggtaatcggtattgtgtttgacccgttgcaattgtttccaggtaatctcgcatcagcaaacagcaccgggctccgttcaccgccttgccttctcttctccggttcctcccccgcgcgttcgctcgctctcgtggcgcaactcgtagaccgccgccgcctccgctctacgccaggtgcctaggtctagcttcgtcggtcccttcgccaacgacgagcacccacccgaagttcagctaggagtgcatcttgtttacctgttgcttaatcatggacaactctcagaatcaaccaccaccacctggtgttggaacatggccgcaggcacctcctagtcacccgccacaatgccatgctgatccacagtcttatcatccacaatttgctgctagacctgacaatgctagtgccaataatagtggtagttcagcaaacattgagtcagctgtccaggaggctgttcttcacgcgcaggacattgagactcagcaagtcatacagaatcaaagacatgcaaacacaacaagtgaacctacaaaatatggggaagacttactttcgaaccgccgtgaccctaatgcattgaaggagcatttactaaagatgacagctgatcatcgtgcagagatggcaagcaaaagggggaagccacttcatccaaacaatggcaactgtgaaattggcaatggctatggtgtacctggaggcggtgcttattatgctgcaaacttgccaagtcctcaaatgaataaacctagagatgaaactgataaagctaaatgtgcaaacgatctccctgattttttaaagcagaggttaagggcaaggggaattctcaaagatgagactacaaataagaattacacgagtacgcagactgtggattctcaagaaatcgagaacaaatctgcacaagagttgcctcctggttggattgaagtgaaggacccgacaactggagcgccatacttctacaatcaaagcactggagtgagtcaatgggatcgccctgacagtgttgtgaatatcatgcaacatcaagtttctccatccttgccagagaactgggaggaggcaattgacaaatcaacaggccacaaatactattataacacgaagacacagaccacacaatgggaacctcctacttctgtgaacaccagtgttacacctccagcttccaccaacactgcagttgagccagtcgctcaagctgcagatatttggaactctcaaatgcagagatgtttgggctgtggtggatggggagttggtcttgtccagccttggggatactgcaatcactgcacaagggttcaaaatcgtccttttcaacagtacccatcttacacaaataatacgatgcacgccagtggtaacaatgctcccaaaactcagggaaatgtttcagctaagaacagatcaagctcaaagccacctttagggaaaccaaacagaaaagaccaccgcaaaagaaatcgccccgaggatgatgaacttgacccaatggacccgagttcttactcagatgctccacgcggtggctgggttgttggtttgaagggtgttcaaccacgagcagcagatactaccgcagctggacctttgttccaacaaagaccatatccctcaccgggtgctgtgttgagaaaaaatgcagaggtagcaacccatggcaagaaacgtggtggtatggctccgataacaaaaagaggagatggcagcgacggacttggggaggcagattagtcttttggtgaactgaaatgttgtgctatccgaatctccttggtggttgtctctggagctgctaaactatcattgcacgcttgaagaaaatcgaaaaaatattggctgccagatctggaatgaggaaactcactacagttcgcgagtttttgcagcgattaacgctagtgtactcgctggacctcgaggctagagcaatgcgagctcaccccggcttgctgatgacacattcactgagttcactgcggtttgccgatgacattcaatgtgcccttggtgtgaattttatatgaaaatgaactataatctgtaattggaaagagtgatttcaatgcaaggaattaacttttgtggggtgctggcccaaaaaaaaaaaaaaaaaaaaaaaaaaaaaagaaaaaaaaaaaaaaaaaannctcgagggggggcccggtacccaatcg

SEQ ID NO: 12029 - DNA, 713 bp, Zea mays
cctaaaacattttctttttgccctgcgtggcgttctccactctcctctccctctcccgagcacctctccttcctccactttctccccaactccggtgagcgagagtgtggtcacgacacaatcatggcgctgcccgtggggccaatcgtcggtgcgcgagctccccttcggggtgagcatgtcaccgtcgagcgacctcttggcggtgccctagtgtcctgtgcgtggcgttatgtaccggtggctgcgttgtttctacccagtcgtctgcaaacaagattagcaggaatggacgaaatggtttgagttggttctctgagcaggttgacaagtgaggacctctattaagctgatgctaacatttacagagcaaaaggatctatattagagcagtatagaagggtggatgtgaggcttacattggttgtgagcttgaaagggaatttgttgtttggctggtgaggttcttttgacttctgatgcaacgaggatagctgaaatagcaatcttcttcaatgtcttattatgcgggagcttgaaaatacttcaatttataagtttataggttttcatgttggagcatctttgtcatggtagcatgtaggttgctaaaatagtcagtggaataatgagacaatgtctaagaacacttgtcttttttttaggacagtataataagaactgacgtttccatgtccatatggacgttccac

SEQ ID NO: 12030 - DNA, 5123 bp, Zea mays
  misc_feature (633)..(633): n is a, c, g, or t
  misc_feature (2745)..(2745): n is a, c, g, or t
gctccgcgatagccaattattgtggtagttggattatccaggaatccagattctcagaaaagctcttcagagaaagctatcccaaacaggtccttaatctctctaacccacactttgtttcaatagcttgggccactgttttagaagagcctttttgtccaccttagggatcacatcttttttctcgaaaactgttgggacaggaaactgcgggcccaaacacttgaacgcggtgagacaggtggcacgacaaaacagtgagctgggagcgtgtaatgtcttgtcaagtgtgtcctgtgccggggtcggtggacgggggtatttatatgggtagcctgggtcagtggacctaagtacgataatacccccggctaaatgatttatctctcatatctcagctgctagatgctttttggtcatgcctctggactacggactattttcagtaaaagctcgatgactccccttaattgtactgatgctgattcgcttctcctttctgggctcatcgattgcgagatcaagggctttccttgcaaataccttggagtacctctcacaattcagaaatcgacaaaggctgatctgctgccattgatagataaaatagcagctagcctcccaatttggaangtttctgtgttgagccgagctgggtgtctggttgtggtccgtgctgtcttcactgccattcctatccaccatatgatggctatggatctccctaagtgagtcattagagcaattgttaaacttcgatggggattcttaggggcaggccgccaaaatgctaatggaggtaattgccttgtctcttgggaaaaggttcagacgccgttacagtatggtggtcttgggatactcaaccttgaatcaatgggatgggccttgcgcatccattggttgtggctacaaaaaacggattcttctcgaccttgggaagggctgccttttcaggtaccccgtaatgcccatgctctctttgatgttgccctggagaccaaggttggggatggtgaggccactaaattctggacagattgttgcctgcacggttgccctgtaggtgagctggcccctaatctctttcaggtaattcctaaacgagcaaggagacaacgcactgtttctcaagcgttgggctgcaggtcttggactgctgatatccagggtgccctcactgtgcctcactgtacaggtgcttgtcgaatacttgaagctctgggaagtagttgatgattttaccttgcagccggctgtttcagatcagcacatatggaagctaacaaatccagggctgtacacttttaaatctgcttacaacgccttctttgtgggttcagttaagtttgcaccttggaaaaggatttggaaaacttgggtctctctttgatgcaagttcttcatttggttagcaatcaagaacaggtgttggacagaagataacctgtcaaaacatgggctgctgcaccaccgtctttgcctcctttgtgatcaagatgtggagaatatacaacacaaatggaaaaataaacagaataactgtgtggcactgtttttaatcgagattcggtctagactactttggctggcctgccaattcttttctctcccccgcaagcgcattaggccgaaacttgggctgggctgggccatgaaagcctcctttgcctgggctgaaatggctccaatctccctacgctctcggatcggaatcggacggtcatccctcactggtattcgtcctggctaggtataaaacatgttatttttggtcgagggaaaccctaaaacattttctttttgccctgcgtggcgttctccactctcctctccctctcccgagcacctctccttcctccactttctccccaactccggtgagcgagagtgtggtcacgacacaatcatggcgctgcccgtggggccaatcgtcggtgcgcgagctccccttcggggtgagcatgtcaccgtcgagcgacctcttggcggtgccctagtgtcctgtgcgtggcgttatgtaccggtggctgcgttgtttctacccagtcgtctgcaaacaagtaagctcttaccctttcccctttttcctgtttgtgtgctcgtggtatagggttacggttggggttctgggaaaaaacagtgatggttctctcttcactgtcttcctctcgttttctaatggatgaatgtgaggcttttggaggatttgttcgggttcacccctaaaacgatggtttagacacatcaagggttaaggttcgggcaccaacctcgctttggtaccattgttggatcattataagatcttgtacataaaatctagctactagatacctaagaactcataggtatacattcggggttggatgctgacaccattagggtgatgtagcttctctctgaggcgtcgaggtagggtggtggtctttttcttcactaaccgcgtaggagatagatcgagacttgctagaggtgtacgagagaggaggctatggtgaacctatctgttaatatacgcaggtgtgaaagttggagtccagatcgatctcttgaccaaaccggatgagatcaacctaagggcctgttcgcttctcccggaatgaaccaggattcgttccagctcatcaaaatttatataaattagagaagtaatccggctaggaactattccagagcttcaatccgtgagaaccgaacagggcctaagggcctgttcgtttactccggaacggttccattgcnaccgttccggttggaatgatatgtttatttgtactagtattgattagttggaatagttcctagccacaatccgacccaaccgaacagggccataatagatagttctagaaaattatagatatggaaaggtgtatgacatgctactaaattttctttttaaacaaatacttctatttatttctcaaggatctaattgatcctcacaatgtactgcagattacatgatggattagcaggaatggacgaaatggtttgagttggttctctgagcaggttgacaagtgaggacctctattaagctgatgctaacatttacagagcaaaaggatctatattagagcagtatagaagggtggatgtgaggcttacattggttgtgagcttgaaagggaatttgttgtttggctggtgaggttcttttgacttctgatgcaacgaggatagctgaaatagcaatcttcttcaatgtcttattatgcgggagcttgaaaatacttcaatttataagtttataggttttcatgttggagcatctttgtcatggtagcatgtaggttgctaaaatagtcagtggaataatgagacaatgtctaagaacacttgtcttttttttaggacagtataataagaactgacgtttccatgtccatatggacgttccacaaaaatcttatttgctgtcatgatgggctctattcatctggtggtggccaaacctctgccaaactttacttctgtaggagaaaataatttgttgctccttgtacttttctattgatgaaacggaatttggtgccccttgtttgccttgatctgtgccaggtcaaattgggctgttcaagttgccgagtacctgactgcagccttgcagctgctacttctgtactgtaactagtagtatattaccaagtgttggcgcagagaatattcctccggagcctttttttttctctggaagaaacattcgaccgtaccacatgtcctcggctcctcgcttagtatattgttatgctcctgcccacgatctaccatgtgcttcaggccccggttgattctgccgtggaatccttcgttacttttacacgaggtcaaagaatatgtcaggacctaccggtttgccaattactgtattgtagtgtcgttccatcacgaggcatcagatcagagacccgaagtttggagtttggaagaagctgagtcaaagggggctggtacacatggcctgatgacgtgtttaggtttctttagatctttgaagaaatggtctcccttgcattgacggcttcccgtttgcgtacagttcgtcctctctttccctgctggttatcgtacgatgaaagcatgtattttatgaggtggatgtggatccgagcctggagctgaccccatccacacataaaggcgatgagtaggatgaagcgttcctccggaattgggacttgggagcacccggaatatgccgtctccgctcagcacagtcacccgggccacttctcacttgagctttatcgctttttacgatgctgaaatctaactggcctttacccataatttcttcctatttcaccttctcgtgcacaggggccccaacgaatgagccagcctaccaccacagtccacactccacaggtcaaggtcagtatagtagtaagcagaacggccgcggacacgtcagcaagtcactgttgagtgttaactcgaatgacaggaatgagatgggttggtggcagcgagacaccttcctggcttcctccagatggcaagcacgcggaacccgagcgacgcgccacgggctcacgtcgccgtggggtcgggtcgtattcggcgtagagttttgtcaagcactcgagctgctttggcgcgttgctctgctcgtgcgggatcaggcgaccgtatccgtgtcaccgaaccaccggaccgggtcggcactcggcagggcacgaactaggcaagttgttggtcttgagcaaatcgtagccgtcgcagcagccgacgcacctcgcagctccgctattgtagctatttttttttagctgtagaaagacccgatcagcgggggtgcggagctgggttaggtccgtgagcggtgagccggtgctgtcatgctcggccgccgaacgaatttccatgtcgttgcacgcctcctcgccaaacttctgacttctgaccaaacgcacccgtagatcttgtagtctttgcagctcgttaggattaatgatcgctacgagtaggaggctactggttttaaaattttgtatgctcgtacttatcttagtaagagctagtttgggaacaccgttttcccaagggattccaattttcccaagggaaaatgaactaatttcccttgggaaaatggaaatctcttgggaaaacgg

SEQ ID NO: 12031 - DNA, 4845 bp, Zea mays
gacgcgttagaatttttagggatagatggtggaggcagttggaataggtgatttggtatatcgaacgaatccacccttttttatgtagatgttatgtattagtaatatactactatatagtctatgttaacgctacgatcttagggaggagaggggtcgacggcgggggcaacaacagcgcgagtgaggggagggggatggagtcatggagaggctaggggcgccaagattgtgagagaatgagaaggagagggatggtagaggatccaaagaatgttgttcactagatttgagcgtgtgagactatcttcagcagcttacccatctcatatccatattcaaactccaccctataaatagtgtagtctagagtgtaaaacaatgtaaaacagtgttttggatgaccatatggggtaaactgctggaaacaatctaagggagagagggttatccagcgatctgaaccattggttttgatgatatgtgttaagtctagtgcaatttgtttggtgaatttagtggaggttatgagtgcaagggtgatttggttgggtggggttttcaaagtttaaattggtggtttatatagtgatatagataatgatagagagccgatagcctgccttttttagacactagattttagggttttcctctgaggatacgacatataactctttatttgagaaaaaatattttatgcgaaaatatgccatgtcagctggagcgagtggatattatgaattgtgaagtttgtgaacttaccaacttataaactttgagtctgtgaacttgtgatctctatgaaccgaacttgttatactattaacttgcgatctttgtgaatttattatattatgaatttgtgatctttgtgaatttgttatattgcgaatggagaacttgtggtctttatgatctttgtaaacttctttgtattgtgaacttgttatactgagatattttcatattggtatcttttccgattgtattttagatttcgattgttactggtatatttttcgtaccgaactttcgttttcgatgtttccgaaataccaatattgttttctgtagtaatcattttcgatttcatgttctataaaaaaatataaaaacggtattggtactgtttagaccgtgtccatcaattcatccatatgattatttaaaatattattttatactgttttgtactgtagactgtattattcgtagagtaaaatttaaatatagatacgaggatgtgtaagctagtatacacctccatcatatggtataaattaaaccacgacatcctcaagcaagggcgagcctgaatttgttgtgctgggctagacagaccggctcatgttggcaaaatattctgggccgtatcatgttggcaaaaatatactgactccggtccgcaactccggatgtgtcggcgaccaggcaaagctccgtgtcctctcgtctcgtgtgactgacgaccaggtgggagggccataaggcctttagcgcggcggcggcaatggcgcccacggcctgcctccggacccccttcttccccgcccgtgcccgatccaccaacgccaccccgttctcgccacaccgccgcttttctctcaaatgcagcgcctccaacggtgacaactccaaccccaactccatctccatctctcccacctcgccgcctcggctaacggtgtcggacggcgtcgagtctgtggacgttaacgggttgcgtcgcccgccagcgcccgcctccgtccccgccgcccgcgatccccactggctgcctcgtaagtcgcgcggacgcgacggtccttgcgtttgctaatctcgggtttgattaatcaaacggtgctaatctgtgatctgcgtgttttttttttggctgtgtttaggtccgctcacaagtgcggacgtcatggaggtggacgggaaggggctcaaggttgcttaccaggtaggtgctcgacgaaacgcgtctcacgggtgctgtttcaatttccttaggactgtgcttgtgtgtttcagataatttaagggagtttggttatggtgttaaacttagggttgtgctggagcgtacagcgaagcagcagcaaagaaggcgtacccgaattgtgagactgtgccctgtgagcacttcgacactgcatttcaggtaacaaagggtgttgcctgttcagcacatcctagttactttacttgactcatgttgcgattttggtaggataccagattgcaagtggttaaatgttgtcttacgaaacctattgagaagtaccaaggctgaattgcagtggcgtacctaggattttagtgacgggtggtctaactagatttttttgactatataaatgcaacacatcggtttctaaataaaaaaattaccaaatacaatataatcaaataaaaaggtcttataatcatctaacatattaaaaataaaagtataacaattataccttacatactaatgatgatagtttaagaaaaaatataattctactttttttgttggacctacacctcttaatagccatgaaagtatttatgatatcatcttcacccacttataagaaaatatatcgttcgacaaaaaatgacgagacaatcatcaaaagactatctccatcttatttcttaatttattcttgacaagtattattgcagaaaatactctatcaacacgtgttgttgcgacgggtacaaacaatactcgtttgacggggatagtgacaacaggctaattagctttgtcggttggagcctttacaaacgtgaaacgtcaagtcgtacttgtacctgctgcctgctagactgcagcttgccgccagggttgctcacagttgcgtcacagagatgcctacagcctatggccacgtccgctgccccgtctgcagtaaatttgttgaagtgtcgctccatccgattgtcccaattgtagacttgtatggactttggttgtactgagcgcatggtggtccgtggcccacaaggaccaccatgtagctccgccactgctgaattggactggctccatattgcttttgtttaacacactaattggtagaaataatcatcactaacacataatatgcattaaatgcttcccatgctgtgttagaaaaaacaagctctagccagcaatgttgttcataccattttttgggggggctattgctcatacgaatttatcgtgcttgcggaatgtaaaaaatgccacatatctgctcttgtgtagttgtgttctttgaaaattgagatagatgaggctaaatttacttatcatgtcaatttcctgaaatagactataagggaagcacatttttgtgacttggtagcagtagggtaatatttttttctagcacaggagagatttgtaccattgcactaaaagtaggttaacatgtaacataattttttttcttctaaaactatttttcagagaggtatatgtgttttgtcttaaagatacacttctctagttagtgtattgatgtgacttttgttttatctcatgttctcctttgacaggctgttcaaaactgggtagctgatagggccgtactgccacttgagaattcattgggaggtagcatacataggaattatgatcttttgcttcggcatagtttgcacattgtaggagaagttcgccttgcggttcgccattgcttattagccaatcctggcgtgaagattgaaaacctgaaaagtgctatgagtcatccccaggtgaactgcttggttgatctgtctttactactctcattactgcttgttttcatcggaggtaatcttgcaaccatatcatttatttccaggagccatccccaggctcttgcgcaatgtgaacacacattaacaggactaggaattgaacatagagaggctgttgacgacactgctggtgcagcaaagattgttgcagaacatatggtccaggatactggtgctattgctagttcattggctgctaaactctatggattggatgttcttgctgagaatattcaggatggcaaaaataatgtcacccgttttatgatgctagctcgaaaacccaacattcttcgcaatgatagaccatttaagacaagcatagtcttttcactagaagaaggacatggacaactctttagggcgcttggtgtattcgcacagaggaaaatcaacctcacaaagatcgaaagtcgtccacacaaggagaggcctcttcgagtatctgatgactgttcctcactcttaaagaattttgattacctcttttacgttgaccttgaagcatcaatggctgatccaaagattcagaatgctcttggaaatctgaaggagtttgcaacctttttaagagtcctcggaagctatcctacaaatgtgaatgaaccttagaaaacactgcagattacatgatggattagcaggaatggacgaaatggtttgagttggttctctgagcaggttgacaagtgaggacctctatgaagctgatgctaacatttacagagcaaaaggatctatattagagcagtatagaagggtggatgtgaggcttacattggttgtgagcttgaaagggaatttgttgtttggctggtgaggttcttttgacttctgatgcaacgaggatagctgaaatagcaatcttcttcaatgtcttattatgcgggagcttgaaaatacttcaatttataagtttataggttttcatgttggagcatctttgtcatggtagcatgtaggttgctaaaatagtcagtggaataatgagacaatgtctaagaacacttgtcttttttttaggacagtataataagaactgacgtttccctgtccatatggacgttcccc

SEQ ID NO: 12032 - DNA, 1743 bp, Zea mays
cctcgaggccggccggaaaatatactcactccggtcccgaactccggatgggtcggcgaccaggcaaagctccgtgtcctctcgtctcgtgtgactgacgaccaggtgggagggccataaggcctttagcgcggcggcggcaatggcgcccacggcctgcctccggacccccttcttccccgcccgtgcccgatccaccaacgccaccccgttctcgccacaccgccgcttttctctcaaatgcagcgcctccaacggtgacaactccaaccccaactccatctccatctctcccacctcgccgcctcggctaacggtgtcggacggcgtcgagtctgtggacgttaacgggttgcgtcgcccgccagcgcccgcctccgtccccgccgcccgcgatccccactggctgcctcgtccgctcacaagtgcggacgtcatggaggtggacgggaaggggctcaaggttgcttaccagggttgtgctggagcgtacagcgaagcagcagcaaagaaggcgtacccgaattgtgagactgtgccctgtgagcacttcgacactgcatttcaggctgttcaaaactgggtagctgatagggccgtactgccacttgagaattcattgggaggtagcatacataggaattatgatcttttgcttcggcatagtttgcacattgtaggagaagttcgccttgcggttcgccattgcttattagccaatcctggcgtgaagattgaaaacctgaaaagtgctatgagtcatccccaggctcttgcgcaatgtgagcacacattaacatcactaggaattgagcatagagaagctgttgacgacactgctggtgcagcaaagattgttgcagaacatatgctccaggacactggtgctattgctagttcgttggcggctaaactgtatggattggatgttcttgctgagaatattcaggatgacaaagataatgtcacccgttttatgatgctagctcgagaacccatcatacctcgcactgataaaccatttaagacaagcatagtcttttcactagaagaaggacctggacagctctttaaggcacttgctgtatttgcactgagggacatcaacctcacaaagattgaaagtcgtccacacaaggaaaggcctcttcgggtatctgatgactgttcctcgctcttaaagaactttgattaccttttttatgttgaccttgaagcatcaatggctgatccaaagactcagaatgctcttggaaatctgaaggagtttgcaacatttttaagagttcttggaagctatcctacagatgtgaatgaaccttagattgaaagtactgcagattacatactggattagcaggaataggcaaaatgagtaaaaggatctactctagaccagtagggaccggtgcattcgaggctcacatttggttgtgatatcgagaggaaagtctgatgttttgctggtgatttttctgatgatttaagtcttctccaatctcctatggataccaaagggttgaatattcggaaatacttcaatgtacaaggtttatatgtttcatgttggagaatctgtgtcatggtagcatgcaggttgctaaagcacagttacagtgaaataatgggacaatgtctaagaacaccgccctttttttgtgacaatataataagaactgaataactgatgtttccatgtctgggcgattgggccggcgttcctcaacaaaaaggaaagagggg

SEQ ID NO: 12033 - DNA, 2381 bp, Zea mays
taaggatggtgacgactgatttcaaataaatttgctgtcatcgtagaattagaagaaagtactatgtggatttacaggagctgttcctcgaggccggccccgcgcggaatttaatgcaggtgtttatttgttagcatggagtcagaaaagggaggatgttgtaggtctgaaagctcccaaaaaggagaagcgagtgaagaaagaaaatagaacacaacctcctgtagaagcaccatatgttgcaccaaaaacgaagatatctatcaaacctgtaccagataaaactgttgagatttttgacgggatgactttgcttgacctttctaaacgaactggtgcgtatattagtacacttcaaggcatacttgcagatcttggtgaaaaggttgaatctgagtttgactctatcagcattgatcttgctgagttggttactatggaacttggcgttaatagcagaagaatgcacactggtgaaggcaagaatgagccacgccctgctgttgtgacggtaatgggacatgttgaccatggtaaaacatcacttttggatgctctccgtcaaacatctgttgctgccaaggaagctggtggtatcactcagcatataggtgccttcgttgttgagatgtcgtcaggagcatctataacattccttgatactccaggacatgctgcatttagtgccatgcgggctaggggcgctgctgttacggatattgtagtccttgtggttgcagcagatgatggtattatgcctcagacactagaagctatgtctcatgcaaaagcagcaaatgttcctattgtagttgcaataaacaaatgtgacaaatctggagctgatcctgagagggtcagaattcaacttggttcagaaggtttacttttggaggatatgggtggggatgtgcaggttgttgaaatctctgcagttacaaaatctggtttggataaattggaagaggctttgctccttcaagctgagatgatggacctgaaagccagaatagatggccctgctcaggcttttgtggtggaggcaagggtggacaggggcaggggtccactcgcaacagctatagtcaagtatggcacattagttagtgggcaacacattgttgtgggagcagagtggggaaggattaggtctcttagagacacagcagggaatataacgcagtctgcaaaacctgcaatgcctattgagattgaggggttaaagggccttccaatggctggggatgatgttgtagttgttgattcagaggagagggcaagaatgctaagtcatgggcggaagaagaagcaggagaaagacaggcttcgaaaaattgatgaggggatggcagaggagctagaaattaaagaagagactcctgaaagagttgaaatgaccattattgtcaaagccgatgtacaaggcagtgttcaagctgtcacagatgctttaagaagtcttaatagcgcacaggtattttcttgtagatatttaatgccttatttccttcttctggagttagtgtcacacaataagacactatgcagttcttaagttaaattcccaagtggcagctgtaaatctcttgctggttattctgtttacatcatcccatcttttttcaatcgtaagtttgtaaattaatacatagtatgtcctctgcaggtgttcgtgaatgttgttcatgtaggtgttggcccaatcagtcagcatgacattgatctggcacaagcatgtggagcatatatagttggtttcaacattcgcagtccacctagtcctatcactcaagcagcagcaagagccaacataaaggtaccatgttcatgaatcactacttctctaatgctagttgtgattatatggttcaagaaactttgttttgtttctttgagttctatgttatcattgagtttcagactttcagcgcatctttggcttaatgttccattttccattttggaaactcttggttttgtgcacagatgctagaatctagaccatccatgctctgtttttcttttgtcatggtaaaccaaatgaacctttatatttagatgttatggaatcctttgggaggatggtattaagaattatctctgactcgggggaatgaggatataactaccattggattgaacacagcaatgcggtctgtagattcaaaactccagtacttaatacagacgtgatgatataatggcttgttcctttttctttttggtgtgcaaatcgatagaacttcagttcatgcgtggaaattgctttgtggatttgaataatagcccgagcttcaaatctgcttgcttcttgctgtattgcttcagcacctcatatgcatttattctaacattaagtgggagtcttccccaagaaacgt

SEQ ID NO: 12034 - DNA, 1583 bp, Zea mays
aacaaaagaatgttagaacgggaaagagagaagaaggcactggaactctgaagcgtcgcagaacgctcctccctctaaggctccgacctccgtgcctcgcgcgccctcgcccttgccctcgccctcccccaccaacccaaaacccgatccgttgctcgctgctcagggtccactactgatccgctccacgcgagctcccttgtccccgcgtcacactcgcgcccaagcaagcggttgctgcaaaggaagcctcccctgatggctctcgtgacctcgggctcgggtgccgaccaggtgatcgccgaggtggcgatgaacggcggcgccgacccaagtgcaaccaccgtgcgtgctactgtcgtgcaggcgtccaccatcttccacgacacgcccgccactcttgataaagcagagagattgatagcagaggctgctgggtatggttcacagttagttgtctttccagaagcttttattggaggctatcctcgtggatccacatttggtttcgggatcagtattagtattattaatccaaaagacaagggaaaggaagcattccggaggtatcatgcatctgctatagatgtgcctggtccagaagttacacgcttggctgctatggctacaaaatataaggttttcttggtcatgggggtgattgaaagggaaggttacaccctttattgttccgtgcttttctttgaccctcttggccgttacctgggtaagcaccggaagctcatgcctacagcattagagagaattatatggggatttggggatggatcgactattccagtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactatcctcccccaccggagtatgagtttgctggtttaggtgaagagccatccgcggacactgttgtttgccctggaggcagcgttatcatttctccatctggagaagtcttggcaggtcccaactatgaaggagaggcactgattacagccgaccttgacctgggagagattgttcgagccaagtttgatttcgacgtggtgggccactattctcgacctgaagtccttagattggtagtgaacgaccaaccgcagctccctgtgtctttcacgtctgccgctgagaggactccagctgccaagagtgatatcgatactaagtcttactgattgactggtcatgaaactgtgttgcgccgaacacttggtgatggtcgctcagctcctctagtttgctgttgtgtctcgtggatgggagttgggagttgtagctttgaactaaaaaaaaaaactcttgccttcccaacgtaaaaaaatggtggccgcagttatgttccttgtgaaagctgttcgcttggctttaatctaaaactgtttctacttttcctaaccaagcaagacgaatgggt

SEQ ID NO: 12035 - DNA, 912 bp, Zea mays
ctcgaggccaaaaaaatagagttcacacgcacaacccgccgccgcacgccgggatctcgatagactctggctgccgcggaaagcggaaagaaggcagggatcgtggccaagatgcagatcttcgtgaagacgctgtcgtcgacaaggacgatcacgctggaggttgagccttcggacacggtggcggacgtgaaggccaaggtgtacgagtcggagggcgtcccgccggccgagcagcgcctcatcttcgcggggaagcagctgcgcgacggctgcacgctggctgactacaacatccccaaggagacgatgctgtccttgtgctgccgcctcctcggaggcggccccaagaagcgcaataggaagacgttcaccactcctaagaagggcacgcacgagcacaagaaccccgggctcgacgccgtgcttgggcggtacaggatcgatgaggccacggggaaggtggagaggctgcgcatgcagtgccctaacccggagtgcggcccaggcgtgctcatggcggcgcacgccgaccggcacgtctgcggcaggtgcggcctcaccttcgtcatcgagaagtagagcgcggcagatagctaggtcgcttcgtaccccctccatttgcaatggcaaagcgtttttacctttctagatatgcacttatgtctagatatgcacttatgtctagatacatagattatcttatactcacttcgttctttttgatttttcgtgttttagtttaaaaataaactaatcgacaacaaatattcgaaagcgaagatagcattttaaattagagtatgttttaggagtccataatagttcgatcagatttttttttcctgtttttcaagcatattcttttttccgccttttgtctttccttataaaactaaagtgatttctgac

SEQ ID NO: 12036 - DNA, 851 bp, Zea mays
gcacgagaccattacctagaacatcctaatcgaaaaagctcgcatcaaaagaaaaagaaaagaaaaaaaactagttccaactagtccctcccccaaccaccatggccgcttctgatgaccatgacccgaaggcgctgctgcaggtaagggtgagcgatgaggatggtgcgctggtggacgcgctcaaccgtcgagctgctgtttctgccgccgcccccagcttcttcgaggggttcgcgctccacgggatccgcgtggagagcatccgcccaggccacatcctctgctccttcacggtccccgcacgcctcacctccggcagcgatcacatagcccccggcgccgtggtggccctggtggacgagatcggctccgccgcctccgtgtccgacggccaccacctcaaggtctccgtcgacatgtccgtcaacttcgttgacctcgacgccgccgcgcccggggacgccctccgcatcaccgccagggcgctcggccacaagggcgcctactccggcacgcacgtcatcgtcgccaacgccgccacggggctggtggtcgccgaggggaggcactcgctcttcggcaagatgaagatcaggagcaacatctgaattggagcatgtgtgcacacagtgctgtgtttgttgtcgtgtgctctgcttctcgactccttgtcaggaatgtaatggcagcagcttgcttcttcagtaaaaaataaaaaaaaaacagctccattattatgtttaaaaaaaaaaaaaaaaacaaagcgcccgcccgcacttcacacacagtgatcgttaccgatcagtcagtacaaggaaaaaaaaacgaaacattaaatccatcccaag

SEQ ID NO: 12037 - DNA, 1404 bp, Zea mays
ggagggcgggcaggggggcggacgaaggcgagccgacccgacctcctgcggcgtgtaggtggagagagagagagagagtgaccctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactacctcgagtgcctccaccactccaaggagttccagcgcaggaacaggatctacaaggaggagcaacgtcagatcagagctgctgctcgtaaggccaaggaggaagctgagggtgcccctgctgttgcagcacaccattagtctccctgtctattttttgtgttgttgttttctgttaactcatctttggttcagttatgatgctaagggcaaggcaataatctccagctgttggactacacagattttttcccccatgacttaaatatcaagactcattttgtgctaaaaaaaaaaaaaaaaaaaacccaaacaagatcaatcacacccccggtcgcctcgtccgcccaaaatagcttgagatatcatttgatggttataaaaaaggcaatgtatcaaatgcacatgattcatctggtgcacatatgcacattaaatctgaaccctttgtctaaggatcaacggcttaggtgcgaaggattttttttttttgcaaatatacagctacacgcggatgagttaagtgtcgaagggtttttttttttaatcaaagcacgatgtcatataaaataaaacaactgtcgttttttagttcggatagtttgtctttcctgcgttaatcgcctttctagccttacctgtttattgaaatcatagcacttgggatgtaattgaatcagatacagatcaatattactgaatattactcgttcatcgctctatatttgatttcatatttcatctttgaatttggattgaatattatcgagttgtgtcggataaaatttgaatagatgtcgatatcttaaatattcaattttaagtatacggatacagttcagatatgaatcagatataaatacccaaacttagatatggatcggatctcatgtcccttagacgaatcgaatggatagataatatttattacatctctttatagcagtctttcagattcactcaaacagagatagagacgtaatcaacctgaactcaaatgtggatcgaatctgacctcaaatgtggatcgaatcgaatcttagcttcgaatttgaatacagagatcaaatttgaatacagacagataatatttataccattcatatccctactagtctttcagattcactcaaacagagagagacgtaatcaatgcattgcag

SEQ ID NO: 12038 - DNA, 4694 bp, Zea mays
atcgcctttggtgaggtaggctcgttcatcactaaccaacattgttgtatttatgtgcgatatttcatttagtatactccaagtggcttgcaagtaatatcatctagctactatatatatagataggacaactaaggagtgtttttatatggtttaattttcccatgtcgatctatgatagcatgtccggctcttggaatgtatgatgtcctatgtatatgtcaaggaagaaaaagacaccatgtccaaacaaaaggaggtgtagtatgaatacaactaggcatatcaggtctttcttgtcttgcaaaacaagatgcaagtggaattaatcactccacacacaacgtcactttaacctatgaattcatgcacatggggtgttgtttggtttttagattggtaaagctagcatacatacataaagggcactactagtatatacagtagctttttgcagcgggtgtttggagtgtctgactaagtcatgcgttaaccaagttttctaaagtccgatgtcttccgttaataccatttgaggagattggcattttaagatgtccggctttgttaatggtctcaagaaacccaaacatttagggtctgtttggaagcacccaatttttaagaaactggtttatagaaagtgaggattctaaaatatttagggtctgtttggaagcacccaatttccgttaatacacatattacctctctaccacaaccatagactcattttccgttaacatttggagtcatctagaaattcaaattttataaatttataacatatatttgagactctaagcgactttaaattaaaaaaaaactttcagctataaagctgtagactctatgataatacaactttggtatagaccatatcaatatctaagattaatttatcttctaaaattttaaatttcaacatttttgagcttacaacaatatttgaggattctaaaatattttaattttttaaaaataacaaatactgagttgtaaatcatgttaagagatacacctttcgttcttttttatttgtcatagtttaatttaaaaataaactagaggacgacaaatattcgagaacgaaggtaatataatttgaatataaagtctatatgatcaaatagaggaccggatatatctgtctctcggattggatgtgtgcatgcatattactacaccaaaaatataaactttctatggttttttttaacttcctacatcttttatataaactgtagaaatatacgtttacatgggtgattttgtgtgcgattatgtgtgtgtttatatgatatcgatgttatcgttgtcaagagtgatttccataaacttttactgtatttttatttcacagtaaatgaccatgagcaaaatctttctattattctgatttcgaaacgtgccttccaaccattcggcccagtcctactaaacttgctaaaagcttaggtaggcctaatgggataggccgtgggctatatgtcagtaaggaaagaaaagagaaagtatccagccagccagcccgccagcgagcaactgaccagtgggcccgatggacgacttcgatccagtcccctccgactgcgacgacggcgatggcggcgtcgccgccgcctcctcctcctctcccggccgttccatctgccacgccggctgtggccgcccgtcccgcgtctgcctgtgcccgtacctccctgcctcccctctccagacctccacgaccatcgtcatcctccaccacccgcacgccctccggcggaacccgctctcaacgctgcccctcctcgcgcgctgcctctccaacctccgcctcgtcccgggccgccgcctcctcccctcctccaccgctcccgccccgggccccgtcctcctgctctacccgtcgcccgccgcctccgacctcgtctcctggtgccggtccacgccgcggcccgcgcgcgccgcccccaccctcctcctcctcgacggcacctggaggcaggccagggagatgcacgcggccagcctggccgtgctcgcgtcgctgggcgcggtccccgtcgccctccccgtcgacagccgcgccgacggggacagcatgttcgagtccgacctcgtggtgaggaaggagccgcgcaaggggtgcgtcagcaccatggaggccgtggcgagggcgctgcggctgctggagccggagcgggagggcgccgtggtcgaggaaaccatgctcggtgtgctccgcgccatggtcgccttccagaccgagcatctgctgcaccggacggtgaagcctagagcgaagatgaggaagaagaaggaactcaggagggagcaggagatgcagagggatgctgtggactgatgcggcttgctcgtggtgctgtgtggaatttcttgccttggaatctatcacaaaatccaccagactccagcagtgaaggtctgattttacccaggcatatcgatggtctcttcacttaggatgcattgttgcttagcataaccggatcatgttggttctagctcaaaatgcctatgtctttccgatgttgtaagctgggttcatgttgattctagctcaaaaggattctgtgacgcaattattctcctttaatcatatgttcaactaattcgcaattttttttcagatcagtacatagcagaggttcacagcttcttataatcttcatcaagctggatccgtagctaaattcttcatcagtagaagaaaaaaaaactaacaaatgagaaacctgaaccaacatatgagttgtctgaaggggattggatggtgcgtttgtgatgcgcgcatggatctagtggtggtaccccgcgaacttggaagggggcagggacggacggcagaagaagataccattcaatttcaatgggtttatcatgctggcatgaaaagaccacaacatattaacatgcattgcattgttactatgccctacaaaaatgcaataacatgctaccgaaacatataaaatatctaccttcctctattttggagaaaacatcatatacgttttggaatgtgaagagtacaaagtgtggattagatgagatttggcgagtttaaatctatagcaagttaaaatctccactaactttttctaatcttatctaaaccatgtggcgtaggaataatggaacaaggcattaaatgatttaccatagattttggacaagctggtgatgaagagttttggggcaaatccactccatagtggagaaaaggtattcttgcggtggtcaggagagagaagtgtgtttttcagatcctttggtgtttctttcgttaatagagagggaaatgagttagctcacctttgtgcaagtaaggctgtagagttggctcctgttttattttggctagattgcttctctaattgtcttttgtaagtagctagcgggaattgtaatttcactttgaaccagtaataaagaacttgtgttctacctcaaaaaaaaaaaaaaggagtgagtgtccacggttgtccttttaactgtactactagttggttacataaaattgttgcatgtaaccgttatctaaaatttacgcacctgaaacatagcaacctaaaagcatacaaaaccttggtttagaaaacaaaaaagattctcactcccaagtcgggtttttaactccaaaacaaagattacgttcttatactttgcatggctttacgaaccatctgtcagtgtggagaaagacattacctcagatgctgttaaaaaaattccaaaaactacattaataagagatatatacatatgaactcggcttgatgctatcccttgggccctgggttttgggggccaactcccgtgttggccgggcccctggtgccataagatgagggctttatatacatgagtatcttggctcttctaaggctattttcagcggtttcctctacatttggctcactatatcctatttttgcatcacgctgttaagatttcaacacgagatgagatcaaggaaaggggaacacgacacagccagagggagagagaacataccagccgaacagggggggggggggcttttaggtgccgccgctataggtagggaaggaggtctcctagtagcaaccgttgaagttagcctaagacaccctgaggcatgatggtcttgtatagggtgtaaactgtacgaatattaagcatccaaccattcgaaagaggacaaaccatggatatatacctagttaggttattaataaaatagtatagattagaatgaggggtgtttaaactcactagagcaaataattagttggctaaaaaattactggtgaaattaattagttaactattagctagttttactaaaaaataattaatagttaaactattagttaagttgttcggatgtcttcagttaattttggcaactaactaacatgaccacaaatatttacaagaggtttataatgagccaagtaatggaccaactacgacttgctaaccatacctctcgctctcgaatagacattagttgttagctgctctaattcaatcaataatttattagttgattaatatttagttctagaggtttatcgatcatcatggtatgtgtctatcacttgttggctggttgtctcgtgggaagaaattgagtgaacgagcggtcctatccgtagtttaaaattgtaattgttcctaaaatttctgtcattggtgtcggc

SEQ ID NO: 12039 - DNA, 2455 bp, Zea mays
caagattttgacttggcagcttttaattctggagatccctccaaaaaaggcgttgctcatccctaaacgctaaaaagatatgccacatattgtatcctggggatgaatcactagaggggaaagttctccgcttgaagcaacaatatacattgtgttcagcctcactacaggacatcattgctcgttttgagagtagagctggcgagtctctcaactgggaggacttcccctccaaagttgcagtgcagatgaatgacactcatccaacactatgcattcctgagttaatgagaatactgatggatgttaagggattaagctggagtgaggcatggagtattacagaaagaaccgtggcatacactaaccatacagtgcttcctgaagctctagagaagtggagcttggacataatgcagaaacttttacctcgacatgttgagataatagaaacaattgatgaagagctgataaacaacatagtctcaaagtatggaaccacagatactgaactgttgaaaaagaagctgaaagagatgaggattctggataatgttgaccttccagcttccatttcccaactatttgttaaacccaaagacaaaaaggaatctcctgctaaatcaaagcaaaagttacttgttaaatctttggagactattgttgatgttgaggagaaaactgagttggaagaggaggcggaggttctatcagagatagaggaggaaaaacttgaatctgaagaagtagaggcagaagaagagagttctgaggatgagttagatccatttgtaaagtctgatcctaagttaccaagagttgtccgaatggcaaacctctgtgttgttggtgggcattcagtaaatggtgtagctgaaattcacagtgaaattgtgaaacaggatgtgttcaacagcttctatgagatgtggccaactaaatttcagaataaaacaaatggagtgactcccaggcgttggatccggttttgtaatcctgcattaagtgcattaatttcaaagtggattggttctgatgactgggtgcttaatacagacaaactggcagaactgaagaagtttgctgataatgaagatctgcattcagagtggcgtgctgctaagaaggctaacaaaatgaaggttgtttctcttataagggagaagacaggatatattgtcagtccagatgcaatgtttgatgtgcaggtgaaaaggatacatgaatataagcggcagctgctaaatatccttggaattgtctaccgctacaagaagatgaaagaaatgagcacagaagaaagagcaaagagctttgttccaagggtatgcatattcggtgggaaagcatttgccacatatatacaggcaaaaaggatcgttaaatttattacagatgtggcagctaccgtgaaccatgattcagacattggagatttgttgaaggtcgtatttgttccagactataatgttagtgttgccgaggcgctaattcctgccagtgaattgtcacagcatatcagtactgctggaatggaagctagtgggaccagtaacatgaagtttgcaatgaacggttgcattcttattggaactttagatggtgcaaatgtggaaatcagagaggaggttggagaggaaaactttttcctttttggtgcagaggcacatgaaattgctggtttgcggaaagaaagagccgagggaaagtttgtgcctgacccaagatttgaggaggttaaggaatttgtccgcagtggtgtctttgggacttacagctatgatgaattgatgggttctttggaaggaaatgaaggttacggacgtgcagattatttccttgttggcaaggacttccccagctatattgaatgccaagaaaaagttgatgaggcgtaccgagatcagaagttatggacaaggatgtctatcctcaacacggctggctcatccaagttcagcagcgataggacgattcatgagtacgccaaggatatctgggatatcagccctgccatccttccctagaccaggtggatatcaggttctttcgcctatatttctgtgaaccctcaggatcaaggaacagttggtgacgacattaatttgcctcagccccttagcaggaagcgctggtcacctcagttttgtgtagacaaaatctaggcatcgataaatgatgggggactatgcatggtgttttggcagcactgttcagtaccttgccttctaaatctggtttttggtgtgtgtgtgtaagctaataaatgtcgaggcaggattgtaggaacaccattgatcatttggctcgctggtgacctggtgacgtatggtgtaattagtagttgtttgcctcctggagcttgctggcttctgtaatggtattttcgtaacgaaaatggcgggaaagtacgggggccgctagtgctattgtgacgttaaaaaaaaaaaaaaaa

SEQ ID NO: 12040 - DNA, 1749 bp, Zea mays
  misc_feature (602)..(602): n is a, c, g, or t
tttggtagggccttaatttatttatacttcaaaaatgaatagaaacaaagtccgatcctaatccgattcgatctttaagttttatagtataaaatttgaggcccattgtcagccctacgcgagggcgactcggtcggttacgcgtgcggggcgctgtgtcggttccaggtgatagacccctgatctatcaccctaggtgatatatatctaagcttgtaattatatttatctaatattacaaatatttttttagaaatgtaaatatttacattttgatataatttgatagctattctgaacttgtatttttttatggacggagaaagtataggctagccgtttctcctgccatgtttatagacaaaatgaaatcaaaaccgagcactcctatacgccaattgccaggaaaacaaacataaaattatagacaaattggtaaaatccaaactgagagtgccagccacataaatcagcagcagcttgcattggctaggacggcgactccgaccacccccgaatcttctccgcaatatgctagaaacccctcgccccgtttcgtagctaccgaaaacacccctcggtgaccagcccctccgcaggangcacgcgtcgtgaatacggcaaaagcgcaggggtattccaggacaagaagcctaatcgccacggccacactactccacctccgcgcggcgatgcggagcagaagcaatggaggtgctcagctccagccgcttcgctagggcactcctcccgaacctcctcgacccggccatcaggctcctcagcaagcccccttgccgccgccgccgtgccgttcagaccctagcatccaacgcccacgcccccaccgccgcgccgtcgccgtcgccctcacttgctctgctcctcgccaccgcgctgcggggcggccgcacgggaggggagctacccgacctcgcgaccgcggccactggcggggccgggataggaacgctgctgatgagcaccacggcggcggcggtgaccaaggcacgggagagcccgtacctgctggcgctggccgccaacccgaccttcgtgtcggggctggtggcgtgggcggtggcgcaggccgccaaggcgctgctcacctccgtcgtcgagcggcggtgggacctgcggatgctcttcagctccggcgggatgccgtcctcgcacaccgcgctgtgcaccgcgctcaccgcctccgtggcgctctgccatggtgtcagcgacgcgctcttccccgtttgtctcggtttcagtcttatagttatgtacgatgccacgggcgtcaggcgccacgccggaatgcaggccgaggtactcaataagatcgttgaggacctgtttgaaggccatccgattagcgaaagaaaacttaaggagttgttaggacatactccgtcacaggtctttgccggagcgattttaggcatcctggtggcatggtattgctgccaaggctgtatcgttcccatgtgacgttgttatagtatgaatgatccagaaatggaactgttccatcgcgtggattttgctgcatgtagtgtgactagtgttctggaaagtatttggtcttgactagtttgatcattggtaagatggcaactattgccccttcttgtctgggatttttccggtatatatgtaacctgatagtatgaaacaatcaagatatccatcctttaaaccttaaagtctcaatgccaagttgagactcaatttatccgtgtctcaattgtcaaaaaa

SEQ ID NO: 12041 - DNA, 1576 bp, Zea mays
gcatggaggaaaacatttcccctctttttcactgttcgcgtcacaatggcaccaccacacatttctcaatctataattggcccactaaggtaccgcagcccatgtctgtttctcgtgccaagcactcgtacgtactggactggagttgataatataaaattcaaatcaaattcatgcaggcgaaactgaagcccagccacctgtaccagcttccattggccgcgaccgcgactccgaccagtccccacaatcttcgccgaaaataatatgccagaaaccccctcgtcccctggccgcttcgtgtgcaggcgtgctaccgaaaacgcccctcggcgacagacctctccggcgccgccacgcgtcgtgaagcgcgggggtatttctgtacatggacgtgttgctcgtgacccttgcccagtccccccggcccgcgccgccgcgcagcgatgcggagcagaagcaatggaggtgctcagctccagccgcttcgctagggcactcttactcccgacaattctctacccggtctccaggcacctcagcacgcccccgtgccgccgccacgccgtccataccctagcctcaggctcagcccccgttcccgccgccgatgccgccgcgccttcgccgtcgctcgcccggctcctcgccgccgcgttgcggggcggccgcgcgggtcgggagctccccgacctcgcggccgcgaccacgggcggcgccgggatagggacgctgctcatgagcaccacggcggcagcggtgaccaaggcgcgggagagcccgtacctgctggcgctggcggccaacccgaccttcgtgtcggggctgctggcgtgggccgcggctcaggccgccaaggcccttctcacctccgtcgtcgagcggcgctgggacctgcggatgctcttcagctccggcgggatgccgtcctcgcacaccgcgctctgcaccgcgctcactgcttccgtcgcgctctgccatggtgtcagcgacgcgctcttccctgtttgtctcggttttactctgatagttatgtacgatgccacgggcgtcaggcgccacgccggaatgcaggccgaggtactcaataagatcgttgaggacctgtttgaaggccatccgattagtgaaagaaaactcaaggagctgttaggacatactccgtcacaggtctttgctggagcaattttgggcatcttggtggcctggtattgctgccaaggttgcattgttcccgttttatgttgttattactgtatgaatgacccagaaacgaaactattccatcacgtggattttgcatgtagcgtaaccagtgaccgggaaagtatttggtcttgactgtaaaaaaaaaaaaaatatatgtaacctgatagtatgaaacaatcaagatatccgtcctttcaaatgtcaatgccaagttgaggctcaatttatatgcattcggatgtatgatacgagctcttctatcaccgtttgtgtacttgaacaagtacacatctgtacatcaggaacttgtaattttggtgatgtgctgcttttacatatgatgaagtggactctgctttcagttaac

SEQ ID NO: 12042 - DNA, 4431 bp, Zea mays
  misc_feature (995)..(995): n is a, c, g, or t
  misc_feature (1077)..(1077): n is a, c, g, or t
  misc_feature (4383)..(4383): n is a, c, g, or t
cgtagatctaaatataattttttgaaaaaaaatcaatatttcaactatgattaaaaagattttgaaatcgatgaaaaaaaataaatttggcgttaaattttgaagaaaaaatttgtccgtattttaattacagatttttaaaatatatcaaatttaaattatttcaaaattacaattaaatgttactgtatcgattttggtagtcaggcgcacgtgtagaatagcttgtagtgctaatgttttatgtagtgtttgttgcttatgtattgaatcgaaataattaactaattaagagcgataaatgacgcgctcgtgcacaaaaagggaactatacttgcaatagaagatagcagagaataccaaagcagtggccaactgccaaacccaacgttggaggagactggaagaggtaagctggtgcgatgcgaccgttcgttcgttcgggtgatgggtgccgtgaagcgccgtttcgcccatagcggagccgtgtcggccggcatctcacgcaagctttgtgggcgcgctgggcggcggcaaggcgtgcgcccccatcactatctcggcgcactatgcctgaatcatgatccgcagggatccgtccatccagactcgcgcgcgcactgggcaagtaggtgacgcccaaaggggaatgcggccgccgagggatctagaggcgaccaccgcacaccgcaggcccaggcatcaggcatcatatcatgcacttcttcttcccgacctgtaagccgatgatgcgcatgcatcatatcatgcaccggccggcccgttggtggcgctcgcgtcacggttacacctgcacgtctccatgtacatgtcgttggtcggtcggtcggtccatgcatggatggaatggaacagacacaccggcctctgcaaacctgtgcgacgcatgtggcttttctcccgcccattcggtgcgtgctgggcggcgagactgatgatgatcaattggtcatgctaccaacgcgtacgtctcngatccgtgactgtttgtagctagcaagcagacttgatctatcccaaagtagtctagccgagatatttagaaaaaaaatgcangtatggctttgtcaaaatgcccaccaaccacacaactcgatgataaaccgtttgctacaatgcatatacttcttcatatcttatgtttgtaaccgtatatagaccaaaatacacttctcatatgcacacacaaatagaagtctaaaataaaatataccgtgttttaattaattatcatcaacatagtactcataaacataaaaaaaccaaacattattatcaagctagcaattaataataattatcggttttcaatgtcaatttcgctacagctaccaaagctagctagctagtagaactaatataaacactcgagatcgtacagtacgttttacctgttgaatgatgatgatgcgcccagaaaagcgagaatacagtgtacactgaccccggcccttaattagatatacccgctgttagtaccatcgacacttgtttttttccccgctcctaggtactagctcactagctagtacgtactagcatgttgcatagattttggaatttggaatcaagaacacacggcccgtggtccgtgaaagccagtacgttgcatttgcatgttgcatgtcacattgtcatttgcccgtgtgagatgcgtgcagctgtggggcatatatgcatggccgatcgatcgaccacgcgcgcgcacagccactttgctcagccactacacgcccggctactttataaacacacatacaccgatcgatacacgacacacacgtacatacagaacagagcgcacgcgcaggcacagcccatccagccagcagggagggacacgggcgggcatggctgctggtggcgctggtgcagctgttgcggcggtgctcacgacggccgtcgctgcagtcctcgttgcggtgttgacgacgacggtgtccggacaggacgacccagcgccagagccagcgccggcggcggcgtgcgcgcggcggcccgtggtgttcgcgttcggggactccaacacggacacgggcggcgtggcggctgggctggggcactactacccgctccccgagggccgcgtcttcttccgccgatccaccggccgcctctgcgacggacgcctcgtcatcgactacctctgtgagtgcccctgctagcaccttgctatacacctctctgtgagtcgcctacaaatgctgaggacactcacgcacgcacgcactctgagggcgacgcgcgcagctggcggcgtatccatgttcaatttgcaagcgtgcgtcctctgcattggcgtatagggatagatgatgtgctttcttcttctggttggtggcaactgatggtgacggacacacgcttaatggtcgcaactagagcaggccgtcttttatttgtaaataatgataagcagcgcgcgtgcacggccccaccatcgcaagaaaatgacaaggaatcgcgcaccaaccgcgagttttcattccatctttcttcatcctcctttggttttctactggcatgcataccaccagttgctactgtacttgctagtagcgacttataaaaagaaacggagggagtacttgctagtgtgctacctatcgtgcacttccacagtctgttccacatttgtgacctccattatcttcttcctcatcaattaatttaccgtggagcagtcaagatgagacgtgacggctgcactgatctgcaacaagagacggttgttattacagccgtccgtctggtggtgcatgccagccagcagcattgaactgagtcctttcatccctgactgatcgaaccggcaccgcgccgcgttggatcctgctgatgtcgttgccggccgtacacagcagcagcagtacttgagtcgattgccacttcgccgcggcgcctcactagctatgctgcgtgtggtggacctcctcccgaattaaccactaataagtaataatgcaatgcgcaagcaggggtgagcctgaacatgagctacctgagcccgtacctggaggccgtgggcttcgcacgacccgacttcacgggcggcgccaacttcgccatctccggctcctccacgctgccccgcaacgtccccttcgcgctccacgtccaggtccagcagttcctccacctgaagcagcgctcgctcgacctcgccgcccacggcgggacggctcccgtcgacgccgacggcttccggaacgcgctctacctcatcgacatcggccagaacgacctgtccgccgcattcgggagcggagcgccctacgacgacgtcgtccaccagaggatcccggctatcgtgtcagagataaaggacgctatcatggtacgtctgcaaatagtatcaatcaaaatagattaaaaattcaacgtacggcgtttgcagactctctactacaacggcgccaagaacttctgggtccacggcaccggccctctgggctgcctgccccagaagctcgccgcgccgaggcccgacgacagcgacctcgactacaacggctgcctcaagaccctcaacgacggcgcctacgagttcaacggccagctgtgcgctgcctgcgacggcctgaggtcgcagctgcgcggcgccaccatcgtctacaccgacgtcttgctcgtcaagtacgacctcatcgccaaccacaccgcctacggtcagtgacggcgtctcatcgatgacctccgatccatgagtgcatccaggaggcctcgctctcatcgatcgatccacggtttcagggttcgaggagccgctcatggcgtgctgcggctacggcgggccgccctacaactacaacgccaacgtgagctgcctcggcccgggcttccgggtgtgcgaggacggcaccaagttcgtcagctgggacggcgtgcactacaccgacgccgcaaacgcccttgttgccgcgaagatcttctccggccaattctccacgccccaaatgcccttcgactacttctgccaggcatggaccatcgtacgagtacgacccagcatagctagctgagcgattcagctgttgcgagagagaatccattcgtgtaactaagaaatgtaacaagcaccgcagatcatatcatgctgaataattcgcgattgacctatttgtcacgcacgctacctgtgagactcaagcgctaacgctagctgggctttagatgaagtgctatggcctgttaagggtttgtttgcttggtggcctgttaagggtttgtcatagctttctatataagcagttgtttggttcgcggcaagggccccgattaccctgaatttggtccagaaacataatactcctcgacgtttcgacccaaagaaataaatctatgcaacttgaaatctaatcntgtgttatgttagttgcaatttatttcttcctttcctcttctaagttc

SEQ ID NO: 12043 - DNA, 1387 bp, Zea mays
tcgaggccgggacacacgtacatacagaacagagcgcacgcgcaggcacagcccatccagccagcagggagggacacaagcaggcggccatatggctgctggtggcgctggtgcagctgttgcggcggtgctcacgacggccgtcgctgcagtcctcgttgcggtgttgacgacgacggtgtccggacaggacgacccagcgccagcggcggcggcgtgcgcgcggcggcccgtggtgttcgcgttcggggactccaacacggacacgggcggcgtggcggctgggctcgggcactactacccgctccccgagggccgcgtcttcttccgccgatccaccggccgcctctgcgacggccgcctcgtcatcgactacctctgtgagagcctgaacatgagctacctgagcccgtacctggaggccgtgggctccgacttcacgggcggcgccaacttcgccatctccggctcctccacgctgccccgcaacgtccccttcgcgctccacgtccaggtccagcagttcctccacctgaagcagcgctcgctcgacctcgccgcccacggcgggacggctcccgtcgacgccgacggcttccggaacgcgctctacctcatcgacatcggccagaacgacctgtccgccgcattcggtagcggagcgccctacgacgacgtcgtccaccagaggatcccggctatcgtgtcagagataaaggacgctatcatgactctctactacaacggcgccaagaacttctgggtccacggcaccggccctctgggctgcctgccccagaagctcgccgcgccgaggcccgacgacagcgacctcgactacaacggctgcctcaagaccctcaacgacggcgcctacgagttcaacggccagctgtgcgccgcctgcgacggcctcaggtcgcagctgcgcggcgccaccatcgtctacaccgacgtcttgctcgtcaagtacgacctcatcgccaaccacaccgcctacgggttcgaggagccgctcatggcgtgctgcggctacggcgggccgccctacaactacaacgccaacgtgagctgcctcggcccgggattccgggtgtgcgaggacggcaccaagttcgtcagctgggacggcgtgcactacaccgacgccgcaaacgcccttgttgctgcgaagatcttctccggccaattctccacgccccaaatgcccttcgactacttctgccaggcatgatcatcgtacgagtacgacccagcatagctgagcaattcagctgttgcgagagaatcacattcgtgtaactaagaaatgtaacaagcaccgcagatcatatcatgctgaataattcgcgattgacctatttgtcacacaaaaaaaaaaaaaaaa

SEQ ID NO: 12044 - DNA, 1000 bp, Zea mays
  misc_feature (990)..(990): n is a, c, g, or t
acttcgtttgagcacaggaaaaaaatgcttttcgaatcctaagacttgggcccactgtcagcctcgccagatagcactctgactactccactcccctcttcactcccgtcggtggattccatgtccaaccgcgtcgccggaggccggaaccatgaagcctgtcagtgtcgccgaacacaacaaccaccagcctcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgatccgctcatcgacgaacttgatcccctggagatggagcaaagagaaaagctagtgcgccggatgtgggatgtgtacacacgcacagataatcatgtacggctaccacggttctggcaagaagcatttgaggctgcatatgaggagcttgctggtgatgatacgcttactactgatgcagctatatctgagattgctcgcatgtcaatccataggcctgaggttgagcaatcgtcgaataaggattaggagatcagaggaacaggacagatatttggaagggtggaactggtacgctgaaggtgaagaacgttaaaaatggtgccgtcccatctaaagacggagttgcaaagtctgacccttagcgccgcagcaatttaaggagatgtttggtttgaataatcaatctattttagatgaggtgatgtatcataagttcattccacaaatttggtggaataaatttattcctcatattatgactaattattaacctatgaggaataaaattatggtggatcaacctattctattatttaaaccaaaagtaaggagtaagaagatggactatctcatttctcaaaacaaaaacncggctttgag

SEQ ID NO: 12045 - DNA, 934 bp, Zea mays
ctcgaggccggccggggcctttcgaattctaagacttgggcccactgtcagcctcggtaggggtcccactcactagtccactcccctcttcactctcgtcggtggattccatgtccaaccgcgtcgccggaggccggaaccatgaagcctgtcagtgtcgccgaacacaacaaccaccagcatcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgatccgctcatcgacgaacttgatcccctggagatggagcaaagagaaaagctagtgcgccggatgtgggatgtgtacacacgcacagataatcatgtacggctaccacggttctggcaagaagcatttgaggctgcatatgaggagcttgctggtgatgatacgcttactactgatgcagctatatctgagattgctcgcatgtcaatccataggcctgaggtcgagcaatcgtcgaataaggattaggtatgaactaactgacctatttgtgaacttagtggctgaatgctgtctccttttcttaggatgtgccatcaaatcttaatgcagcatcttttttaaaacatatatgtagtgcaaacctatatgtttgcaccttaggaatatgtagtataaacctatgcagcaaaatattttgtctatttatgcttggtttgccttgtgagcacctcgttctgataattgattatcagcaataaagtcgcatcatattgtaaacttcagaagttaacgaaaaaatataataaagttactgcttctgcag

SEQ ID NO: 12046 - DNA, 2065 bp, Zea mays
gcgcctcccaaagctctcttgttcgttgctcatccccccccccccccccccgtgctggttaatcatccgttcgatttcgatcacatacatataatctccctcagctatcgcggccgcgcgcctgatcgacgtacgaccggtctggtacgtacgtgtgctcgcccgccatggctcgcggcgacggcgagctggagctgtccgtgggggtccgcggcaccggcggcgcggcggcggcggcggcggcggaccacgtggcgccgatcagcctcggcaggctcatcctcgccggcatggtcgccggcggcgtgcagtacggctgggcgctgcagctctccctcctcacgccctacgtgcagactctggggctctcacatgccctcacttcattcatgtggctatgcggtcctattgctggcttagtggtccaaccgctggttggcctgtacagtgataggtgcacagcaagatggggaagacgcaggccatttatcctgataggatgcatgctcatctgccttgccgtcattgttgttggcttctcgtccgacatcggagctgctctaggggacacaaaggaacactgcagcctctaccacggccctcgttggcatgctgcgatcgtctacgttctggggttttggctccttgacttctccaacaatactgtgcaaggtccagcgcgtgctatgatggctgatctgtgcggtcatcatgggcctagtgcagccaactcaatcttctgttcttggatggcgctgggaaacatcctaggctattcctctggctccacaaacaactggcacaagtggtttccgttccttatgacaaacgcgtgctgtgaagcctgcgcaaacctgaaaggcgcgtttctggtggctgtggtgttcctagtcatgtgcttgactataaccctgttcttcgccaaggaagtgccctacagaggaaaccagaacctcccaacaaaggcaaacggcgaggtcgagactgaaccttccggcccactcgctgtgctcaagggcttcaagaacttgcccacggggatgccgtccgtgctcctcgtaactggactcacctggctctcttggttcccgttcatcctctacgacaccgactggatgggccgtgagatctaccacggcgaccccaagggtagcaacgctcagatctcggcgttcgacgaaggcgtcagagttggctcgttcgggctgctgctcaactcgatcgttctaggattcagctcgttcctgatcgagcccatgtgccggaaggtcgggccgagggtggtgtgggtgacgagcaacttcatggtctgcgtcgccatggcggccaccgcgctgatcagcttctggtcgctcaaggactaccacggatacgtgcaggacgccatcaccgccagcacgagcatcaaggccgtctgcctcgtcctcttcgcgttcctgggtgtccctctcgccatcctgtacagcgtcccgttcgcggtgacggcgcagctggcggccacgaagggcggcgggcaggggctgtgcaccggcgtgctcaacatctccatcgtcatccctcaggtgatcatcgcgctgggcgcgggcccgtgggacgcgctgttcggcaagggcaacatcccggcgttcggcgtggcgtcggggttcgccctcatcggcggcgtcgtgggcgtgttcctgctgcccaagatctccaagcgccagttccgcgccgtcagcgcgggcggccactgatcgcggccgccgcgccggagcacggcacggcggcacagcccagccgtgctagagctgtatgttttgaaagttgaaacagaataagaagcgggcgaaacgagaaaaccatgcatgtgtgtgcttttgttgtgtgtgggggggccaagcgaggcgaggtgtggaggtgaagtgaaggtgagcatatccagcaccagctggtaccaaggtcgggtctctgtgctagtgctattagctagtgtaaggacccagtaggtcagttaaggctggtgcgtcgtgagggctgtcttgtgtcagacggctcatcaggggagaaacaaaaggattattcgtgc

SEQ ID NO: 12047 - DNA, 2090 bp, Zea mays
gcacgagacactcctcacctctcctcgctccacgcacgcgctctctcacccgctggctattagtcgtcgtcccttggatttcgacactctctctagcgggcgcctgttccgccgccgtccatcgatcctagctagctagctagctagggcgcgaccgtcgtctcggtggttgttgacaggtcccgtacgtgtgtgctcgccatggctcgtggcgacggcgggcagctggcggagctgtccgcgggggtccgcggcgcggccgcgggtggtggaccacgtggccccgatcagcctcgggaggctcatcctcgccggcatggtcgccggcggcgtgcagtacggctgggcgctgcagctctccctcctcacgccctacgtgcagactctggggctttcacatgcgctcacttcattcatgtggctctgcggccctattgccggcttagtggtccaaccgctggttggcctgtacagcgacaggtgtacagcgagatgggggagacggaggccgtttatcctgacagggtgcatgctcatctgcgttgccgtcattgttgtcggattctcgtcagacatcggagctgctctaggggacacgaaggaacactgcagcctctaccacggtcctcgttggcacgctgccatcgtgtacgttctggggttttggctccttgacttctccaacaacactgtgcagggtccagcacgtgctatgatggctgatctatgtgaccatcatgggccaagtgcggctaactccatcttctgttcttggatggcgctgggaaacatcctaggctactcctctggctccacgaacaattggcacaagtggtttcccttccttaaaacgagcgcctgctgtgaggcctgtgcgaacctgaaaggtgcatttctggtggccgtggtgttcctagtcctgtgcctgacggtaaccctgatcttcgccaaggaggtgccgtacagagcgaacgagaacctcccgacgacgaaggccggcggcgaggtccagactgagcctaccgggccacttgccgtgctcaagggcttcaaggacctgccccccgggatgccgtccgtgctcctcgtgactgccatcacctggctctcgtggttcccgttcatcctctacgacaccgactggatgggccgggagatctaccacggcgaccccaaggggagcaacgcccagatctcggcgttcaacgaaggtgtccgagtcggcgcgttcgggctgctactcaactcggttattctagggttcagctcgttcctgatcgagcccatgtgccggaaggtcgggccgagggtggtgtgggtgacgagcaacttcatggtctgcgtcgccatggcggccaccgcgctgatcagcttctggtcgctcagggactaccacgggtacgtgcaggacgccatcaccgcgaacgccagcatcaaggccgtctgcctcgtcctcttcgccttcctgggcgtccctctcgccatcctgtacagcgtcccgttcgcggtgacggcgcagctggcggccacccggggcggcgggcaggggctgtgcaccggcgtcctcaacatctccatcgtcatccctcaggtgatcatcgcgctgggcgccggcccgtgggacgcgctgttcgggaagggcaacatcccggcgttcggcgtcgcgtcggccttcgccctcgtcggcggcgtcgtgggcgtgttcctgctgcccaagatctccaagcgccagttccgggccgtcagcgcgggcggccactgatcgaacccggccggggccggccgccggcacgcagcccggcaagagctgtatgttgttgagagttgaacagaaaccatgcatgtgtgcttctgtagttctgttgtttgtggtcgatcgatgggcgttgcgtggcagcgtgggcaagcgaggcgaggtgcgcggatccaaaaaaagggccattcgatcaatcaatgtgtagtagagtacaactagacgatgatgttcacatcatttgtctttaatacataccggtttctattgtctttacaaaaaaaaaaaaaaaaaaaaggcgaccacaacgaaaaaaaaaaaaaaaaaaaaaaaaaaa

SEQ ID NO: 12048 - DNA, 1124 bp, Zea mays
  misc_feature (17)..(18): n is a, c, g, or t
  misc_feature (26)..(26): n is a, c, g, or t
  misc_feature (30)..(30): n is a, c, g, or t
gtaccctcgaagggccnnggccgggnaaanatttaaaaaaaaaaaaaaaaaaaaaaaaaaaaaaaaaaaaaaaaaaaaaaaaaaaaaaacctcgacgcgaggcaggctgggagacccgtcaaatccaagcaaaggccaccccggccggcgacgacttccccttccacaccctcctcccccgtccctccctccccgcaccctgatcccccggcatccatccatggcgacgaacagcgcggtgattgtgctcctcctcgtcgctgctgccgtactcgcctgcgcgggcggtgcgcgcgggttctacctcccgggcgtcgcccccgccggtttcctcaagaaggacccgctcgccgtgaaggtgaaccagctgagctctatcaagacgcagctgccctactcctactactccctccccttctgcaggccgggcacaatcgtcgatagcgccgagaaccttggcgaggtgctccgcggcgaccgcatcgagaattcactctacgtgttcgagatgatggagcctaggctgtgccagatcgtgtgcaagattgctccgacccaagatgaagcgaaggatctgaaggagaaaattgaggatgagtaccgcataaacatgatccttgacaaccttcctttggtcgtcccaattaagagattggatcaagaagcacctactgtgtaccagcaaggcgtgcatatcggcatcaagggacagtactcagggagcaaggaagagaagcatttcattcacaaccacttcacatttctggtgaagtatcacaaggatgacacaggtcttgccaggattgttgcctttgaggttaaaccatacagtattaagcatgaatttgatggcgactggaaggggaatgctacactccttaaaacctgtgacccacactcaagacgccttgtcgtagactctgattcacctcaagaagtagatgccaacaaagagatcattttcacctatgatattaactttgaggaaagtcctatcaagtgggcgtcacgctgggactttttgtctatgaccaaccttaatgcactatgacagaagtctccactgtaaacctacagatagatggtatgttttttccttgagaatttcagatgcattttttagt

SEQ ID NO: 12049 - DNA, 1354 bp, Zea mays
gctgcaggaattcggcacgaggcgcaccctgatcccccggcatccatccatggcgacgaacagcgcgggattgtgctcctcctcgtcgctgctgccgtactcgcctgcgcggcgggcgcgcgggttctacctcccgggcgtcgcccccgcggttctcaagaaggacccgctcgccggaagggaaccagctgagctctatcaagacgcagcctgccctactcctactactccctccccttctgcaggccgggcacaatcgtcgatagcgccgagaaccttggcgaggtgctccgcggcgaccgcatcgagaattcactctacgtgttcgagatgatggagcctaggctgtgccagatcgtgtgcaagattgctccgacccaagatgaagcgattcatctgaaggagaaaattgaggatgagtaccgcataaacatgatccttgacaaccttcctttggtcgtcccaattaagagattggatcaagaagcacctactgtgtaccagcaaggcgtgcatatcggcatcaagggacagtactcagggagcaaggaagagaagcatttcattcacaaccacttcacatttctggtgaagtatcacaaggatgacacatgttttgccaggattgttgcctgggaccctagcccacccgccgggaagcatgaatttgatggcgactggaaggggaatgctacactccttaaaacctgtgacccacactcaagacgccttgtcgtagactctgattcacctcaagaagtagatgccaacaaagagatcattttcacctatgatattaactttgaggaaagtcctatcaagtgggcgtcacgctgggacacctaccttctgatggcagacgaccaaatccattggttttctattgtcaattcactgatgatagtcctcttcctctctgggatggttgccatgatcatgctccgaactctttaccgcgacatctccaagtacaaccagttagaggaccaggaggacgcccaggaggagacaggatggaagcttgtccatggagatgtgttcaggcctcctgtcaacgctgacctgctgtgcgtatatgtcggtacaggcgtacagttcttaggaatgctgcttgtcaccttgctgtttgccatcctcggcctcctttcacctgcgaatcgcggagggctcatgacagcaatgctcctcctctgggtcttcatggggctgtttgcagggtacgcctcctcgcggctttacaggatgttcaagggctcgcagtggaagaatgtcaccatcaagaccgcgctgatgttccctggcaatcggtttgcaatttttttgggtctggatggcctcaatctggggcgagaaa

SEQ ID NO: 12050 - DNA, 2164 bp, Zea mays
gagtgggtttaatctcgaacaagtcaaaatctttcataaattttttcaatcacatccaatatatatgggatagtaataaccgaacaatgtctaacatggaaaggtccctacttatggctaatttgttcatcttaattgaacgtgattgagtgagttcaaatccctagcaattccatgtgaaatgagaatatcccaacaagatcttacaattgtgaggacctaactgtatgcaatcagaatcattgtagaggagattcatccagagcatgctccattatcgttcatgtagcttatgtctacaacaagtaggcaaacaaacgtatacttagataaaatcaacgtatacggttatccataataagatggtgtatgcaatgaatccgacgagttgtaatggctgtgtcttattggcactcctcttaggttagctcctgatgctgtcgatgttgagaatcgtacgactcctccacgtgttcttccgaataacatctctacaccctgggtttagatttctctcggggtgaagtggcctccgcgtaatttcacttgccccaactccgtgcttgtttggtgacaatgctggtcggtagccactgccgccgcgattgcttgccgcagcttgcgccttggggcttgccatgccgcctcgtccagattccgctgcaaaaaatttccacgtgctggtggcaagttttctgccgttggcgcattctgccgctccggtgtgggcgggcatcaatcttctccgggacgctttctctctggtgactcggacaatcgcgatcgcgacgaccgacgagcacaagctagcttggttgtcggcttgtgtgtgttggtagaagagcatttctacacgtactcatttggctgccccgacagagaaaaatgtcgagtcaagaacttttctcccccgttcgcgcagcacagtcggccactacacacacgccgcccaccaacaccatggacgccgccgcgaaggaggcgctgatcctggacctgcacgcggtggaggccgtgaagctgggcaccttcgtgctcaagtccgggatcacctccccgatctacctggacctgcgcgtgctcgtctcccacccgcgcctgctcgcctccgtcgcgtccctcctcggcgcgctcccggccacgcgcccctacgaccttctctgcggcgtgccctacacagcgctgcccttcgcggccgcgctctccgtcgccgcctccgtgcccatgctgctcagccgctacgacaccaagcgcgtcgagggcgccttccgcgccgcccagaccgtgctcatcgtcgaggacctcgttaccagcggcgcctccgtgctcgagaccgtcgccccgctccgcgccgaggggctcgtggtcgccgacgccgtcgtcgtcatcgaccgcgagcaaggtgggcgcgagaacctcgccgctagcggggtcgcgctgcactcgctcatgaccctcacggagatgctcgccgtgctggcgaggcacgggaaggtcggcgaggagaagatcgcggaggtcaggcggttcctccaagccaacaggaaggtggcggtgcccggggtgcctgctgggccacccaagccgtcggctactgctcggaggaagtcgtttgcggagagggcggggttggccacgaaccccatggggaggaggttgttcgaggtgatggaggcgaagcagagcaacttgtgtgtcgcggctgatgttgggacagccaaggagctacttgagcttgctgacaaggtatgtatacacacatatatatgctactagttattgtgtatttgcgatgctctcctactatttgctaacattgttttgatttgtttgccccacttgtttaggttggtccagagatttgtatgctgaaaacacatgttgatatcttgtctgattttacaccagattttggggccaaccttcgcacagtatgttctcttctgacagcagtttccttatctttttgttgtagtgttactgatcataaggatgtcagtgtccataatcgcccagttagagtcctgaagttgtactttgtttcaaatcagatgtcggtgctttcattatcatgtatacacagtatcattatgtgtaatcggaatgggttgtccataaatgaaaggcaaaatccctataccaggccaatttacttggttctttt

SEQ ID NO: 12051 - DNA, 4475 bp, Zea mays
  misc_feature (3893)..(3893): n is a, c, g, or t
gctgaattccgtgctgtcgccaaaacagcttttccagctcacagtccatgacagttttttttcacacggcccaaacaacaaatcagacaagttgtaatgtctgtgttgggttagatcacattgtcttattggcgctcctcttaggttagctcctgatgctgtcgatgtagagaatcgtacgactcctccacgtgtgcttccgaacatctctagatcgcgggtttcgatttccctccggggtgaagtggcctccgcgtaatttcacttgccccaactccccgtgcttgtttggtgacaatgctggtcggtagccactgccgccgcgattgcttgccgcagcttgcgccttgcgggttgcggcctgccatgccgcctcgtccagattccgctgcaaaaaaatttccacgtgctggtggcaagttttctgccgttggcgcattctgccgctccggtgtgggcgggcatcaatcttctccgggacgctttctctctggtgactcggacaatcgcgatcgcgacgaccgacgagcacaagctagcttgggtgtcggcttgtgtgtgttggtagaagagcatttctacacgtaccactcatttccacagagaaaaatgtcgagtcaagaactcttctcccccgttcgcgcagcacagtcggccactacacacacgccgcccaccaacaccatggacgccgccgcgaaggaggcgctgatcctggacctgcacgcggtggaggccgtgaagctgggcaccttcgtgctcaagtccgggatcacctccccgatctacctggacctgcgcgtgcccgtctcccacccgcgcctgctcgcctccgtcgcgtccctcctcggcgcgctcccggccacgcgcccctacgacctcctctgcggcgtgccctacacggcgctgcccctcgcggccgcgctctccgtcgccgcctccgtgcccatgctgctcagccgctacgacaccaagcgcgtcgagggcgccttccgcgccgcccagaccgtgctcatcgtcgaggacctcgttaccagcggcgcctccgtgctcgagaccgtcgccccgctccgcgccgaggggctcgtggtcgccgacgccgtcgtcgtcatcgaccgcgagcaaggtgggcgcgagaacctcgccgctagcggggtcgcgctgcactcgctcatgaccctcacggagatgctcgccgtgctggcgaggcacgggaaggtcggcgaggagaagatcgcggaggtcaggcggttcctccaagccaacaggaaggtggcggtgcccggggtgcctgctgggccacccaagccgtcggctactgctcggaggaagtcgtttgcggagagggcggggttggccacgaaccccatggggaggaggttgttcgaggtgatggaggcgaagcagagcaacttgtgtgtcgcggctgatgttgggacagccaaggagctacttgagcttgctgacaaggttggtccagagatttgtatgctgaaaacacatgttgatatcttgtctgattttacaccagattttggggccaaccttcgcacaattgctgggaagcacaactttctgatctttgaagaccgcaagtttgctgacattgggaacacagtaactatgcaatctgaaggaggtatattccgcatcttagactgggcggatattattaatgcgcatatagttcctggacctgggattgtagatggcttgaagctcaagggtttgcctaaaggaaggggcctacttttgcttgctgaaatgagctcagctggcaaccttgcttatggagactacactgctgcggctgtaaagattgccgagcaacatcctgactttgtaataggatttatatcagtgaatcctgcatcttggtcaccagcaccgtcaagcccagcatttatccatgccactcctggggttcagatagctgctggaggagatgcccttgggcaacaatataacactcccttttctgtcatcaacgacagaggtagtgatataattatagtcggacgagggattataaaggccagtaaccctgtagagaccgcgagacagtatcgcatggaggggtggcaggcgtatcaatccggcttttcttgaggatgtttaagcaactcgccaaacgtagccggaggacattcgggcgagtgttgatgtgataagagtgcgccccatctatgatctatgtatgcaactgcgttctttcacttttacctgcccatcattgccacgcagtgattttcagtaatggttctgactgtacccccggatgctataatttgcaataaggtaacgccaaatcttagctgaactttcagtatgtatgtctctcattggcaagcagtgatagtattacctgttttgatcggagctctgtagagcaatttcatgtttctagatttgaattaagccaaactttcttaattttcattgaaaatatcattgatgtctgcaaataaatattctaaaaatatattttctgtaattaatctaatatttattatcgtaaatgttagctttttccatattttaaatttaaaaactttggcttcttgagaggtaagaattacatcattgttttggatagatggggggaatattttacagtaattttcaggaaaaatgtctcttttaaatctccgattcctcggctgaccattgcgatgtgtgttgctttgttgcttgcatactccatctctctgtcttcctgcatagagcaggataaagtagtgaaagatgttattcacaaaatatatagaacatcgaggaatgttagatttatgataggtaattacgattaaatatgtgcactgtgtacaccaacctctcatgaatcatgatagccggccttttctgcttcggcttcctgtcatcatcagtgccggcctgcgtcgctctcccgcctccttatccgcacaggcagcccgcccttcatcctcagcgtcaccgtcacctcgtacggcggaggcgcctccatgcttgccgcccgcaccgtctccacggcgaacctcctgaccacggcggccacaacggccttcatctgcacatacgccatctccttaccgaggcacgccctcgggccggcgtggaacaccgggtacctcgccgcgtccaccgccacgaactcgcctccgccatcgagccaccgctcggggcggaactcgcggcagtcgtcgccccacagctgcggcatcctccccatcgcgtacgcgcagtagtccgcgaaccagccggcgcgcaccgtcgtgccatccggcagcacgtcccccgcggccgccaccctcgagttgatgggcaccggcggatacagccgcatcgcctcggtgagcgccgcgtgcaggtagtgcagccccctgagctcgtcgtagccgccttcgtcgtcgacgccatatctgtggagcgagagcgacgccacctcctcgtacacgcgccgctcgcagcgcgggttggcggcgaggagccagaagaaccatgtgagcgcggaggacgtggagtccttcccggcgagcacgaagctgacgacgatgtcccgcaggaaccgccgcttcgcctccggcgaccggaacatggcgccgagttcgctcccctcctcttcctccatcgccgccgcgaaccgcgacagaaggtgctgctcgtcgcagccgcctccgtcgccgacgccgcgcgaccgctcctccgactccatgatcgccgcgacgtgctcgtcgacgatgcggatggcctcgcggagccgcctctcgcttccgacgccagcgagctgcatcgccttccacacgacggcggtcgggtggagcatgcgcgcgaaggagatctcgacggcggcgtcgaacgcctcgaagaacgtgtcgtgccggcggggtcgtcccctgccccggccgccggcntcctcgagctcgagcagcgtcgagccctcgactccgaacgcgacgccgcagatgttgtcgaaggcgaagcgcttgagcacgtcctgcaggtcaacggcctcgccggagtcagccgcactcgcgagaagaggaaggagccggcggtgcaggtggccccggaggacgcgccccgaaaagcggcgcagcgagcgggacgagaaggagtaggacgcgagcttgcgctggaggctccacaggcggccgtccgcgaggaagatgccgctgccgaggaggtcgccgaagggccccgcgaagcgcgcgcccttaacgtagttgggaaacctcgcccgcagcatgtggttgacgacgcccgggtccgccgtggcgacgccgcggccgaggccgagcgcgccgcgcacctctatggtggaggacggggcggccgtgagctggtcggtggcccagtcgaggaagcggtgcaggttgcggaccaggggcaccacgttgccgagcacggggttcgggtaggggcagtggttgcggtggcccccgcgccgccggaggcccaggaagagaaggacggcgactgcgaggagcggcgcg

SEQ ID NO: 12052 - DNA, 1011 bp, Zea mays
  misc_feature (715)..(715): n is a, c, g, or t
ccgagccgtttcgagttctgctgagcattttttttccagccctgtgctggccccttcctccccccaagtgaacctcgtcccgaaagtaaacctcgtttccgcatgccgaccgtaaacgtgaaatggcagaaggaggtctttccaggcatagagattgacactagccagcctccgattgttttgaagagtcagctatacacactaactggtgtgccacctgaacgccaaaaaattatggtgaagggtggattattgaaggatgatgcagattggtctactttgggagtgaaagatggccaaaagttaatgatgataggcacagctgatgagattgttaaagctccagagaaaggtccactgtttgttgaggatctaccagaagaagagcaagtggttgcactgggtcacagtgctggtctttacaatcttgggaatacatgctatatgaattccacattgcaatgtttgcattcagttccagagctgaagtcagcgctgctaagctattcagatactgtaaaaggtaatggcattgaccaagcttctcataatttgactcttgctactcgtaacacctttggtgatcttgatcaaagcgttcgccctgttacacctttacaattcttacagacactgcgtaaaaaatacccgcaatttgcgcagcaacataataatgtctacatgcaacaggatgcagaagaatgctggacacagnttggtgtatacactttctcaaactcttacctcagattcaagtgaatctgcagttcttccaatgaagcaactatttgggatagatctcgtgagcagggttcactgtgcagaaagtggtgcggagagcatggagacagaattagtttattcccttaagtgtcatatatctcaagatgtgaaccatcttcatgagggaattaagcatggcttgaagacagaacttgagaaagcttcacctacactgggtcgaactgcagtttatactagagaatcaagaataaatgagctgcctaggta

SEQ ID NO: 12053 - DNA, 1866 bp, Zea mays
atcaaagatcggctgcctgtccgctgttgtctttttaattgcctgtgcctgtgctgcccccattcctttctcctccagcaagtaaaccccgtttccacaacgtcaccgcaccgccgtcatgccgaccgtaagcgtgaaatggcagaaggagctctttccaggcatagagattgacactagccagcctccgattgttttcaagactcagttgtacacactaactggtgtgccacctgaacgccaaaaaattatggtgaagggaggaatattgaaggacgatgcagattggtctactttgggagtgaaagatggccaaaagttgatgatgataggcacggctgatgagattgtgaaagctccggagaaaggtccagtgtttgttgaggatctaccagaagaagagcaagtgattgcactgggtcacagtgctggtctttataaccttgggaatacatgctatatgaattccacattgcaatgtctgcattctgttccagagctgaagtcagcgctgctaagctattcagatactgtaagaggtaatggcattgaccaagcttctcataatttgactgttgctactcgtaatacctttggtgatcttgatcaaagtgttcgccctgttgcacctctacaattcttgcagacactgcgtaaaaaatacccgcaatttgcgcagcagcataataatgtctacatgcaacaggatgcagaagaatgctggacacagttggtgtatacgctttctcaaactcttacctcagattcaagtgaatctgcagctcttccgatgaagcaactatttgggatagatctcgtgagcagggtccactgtgcagaaagtggtgaggagagcatggagacagaatcagtatattcccttaagtgtcatatatctcaagatgtgaaccatcttcatgagggaattaagcatggcttgaagacagaacttgagaaagcttcacctacactgggtcgaactgcagtttatactagagaatcaagaataaatgagctgcctaggtacttgactgtgcagttcgttcgcttcttttggaaaagggaatcaaaccaaaaggcaaagattttacgaaaagttgattacccactggaattggatgtttatgaattttgctctgatgaactgaaacagaaactccaagcacctcggcagatgctgagagatgcagaaaatgcaaagtttggattgaaagcacaagggaaagctagcggctttaaagaaaatgagggatcatccagtagcgctggggaatcatccagtatggacattgacaaagctgagtcttctctaccaaagaaacaattaactggcgtctatgatttggttgctgtcttgacacacaagggaagaagtgcagactctggccactatgttggctgggtaaagcaagatgacggaaaatggatcgagtttgatgatgacaacccaaacatccgcaaggaggaagacattttgaaactatctggtggaggtgactggcacatggcttatatctgcctatacaaagcccgcatggcggagttgaagagttaggccggagtggttctacatttctgtgccgcgaacgcaacattagtttttctgcccatgagtgatcatggtaattattttttccagttcgtaaagtggttactgtcgaatttgcttcaatgcggttggccattattcactgggatatgtatttttaggatttcaaatctagtacattttgtgttgtcaaaatatagaacgaagaaattcagaggaaagcttctgccttgacagtggatctgattgatttgcaccaagtggtttcatccgtgtcttcctaataatagtgtatttaaaaaaaaaaaatcaaaact

SEQ ID NO: 12054 - DNA, 1640 bp, Zea mays
ctcgaggccggccgggaatccgtccatttcccaggttctcaccggttcctcaaaccctaaaacctccaaaccccagcaatggcggattccccttcgttccgtcgctacccgctcgcctcctccgtcgacctcgtccgctggctcccttcctcctccatctccccttccggtcgcctcctcgccgccgccgtccacgatcccacctccggctccttcgcctccagcatccgccttctccccctctccgaccctgtctcccggctcgcctccgtcccgctcccgtcccgcgccacggcactccgctgctccaatgctgcgctcgccgctgccacctcctcgggctcgctccacttcgttccctcctcattcgactcggacgccgcagtgtccgtccccggcggcgcgggcttccatgtcggtcctgtccggggcctcgactgcggcggggaggagtgggtcacagcgggagaagacggaagagtgcatgtggtcggcggtgtagctgacgggagagtggtaacgaggagggtgtgggacgggaaaggaatgtcagggtatgaagctgccagatgggcttcgccggtggagtttgccacgggtggagccggatgtggtgttcagtggtgggatcggaggaaaggggacgccatcgtggcgcagtgtaacggcatctggggccgtggcatagttactggcatggtgcattccattgacattcatccatcaagaaagcatatctgcgtggtgggaggttcatcggggaccgtatttgcctgggatctgcggcagccacaggagctgataccaatctctgttctaggtcttaatgaaacagctgagcctgtgtgtgaaagtgaggtttgggaggttcttttcgacacttacactaagtcttccgatatcatctcatctgcatctgcaagaatattgccagtgatgatgtgttcagaggatgggatccttgcagtcgtcgaacaagataagagaccccttgaattgcttgctgaatcttgtgccatcaactccttcgacatagatcctcagaacccctctgatgttgtttgcgcattagaatgggaatcggtcggtgtcctaactcgtggtagagatgcaatgtcagaagaatgaaaattttcatcacccagggatctcaatcagatttttttccaaggtggatgaaactgctatcagaaagaatcttctgaattctgagggcttccatattcagtcaccattctaatgcccgtgaccatgggcaacggtagaaggaataaagcgtgcatgacgaatgccttttcctgtctttgcatactaaccaacactgtcttgtaccgttggaagttttactctgttgtcatgggtagttgcagattgcagaaaccttttctgggctagcttcaagatgtgtaattgctcttggatgccaactgctgacagtttgaaggagtggtcacaaacaattcaatccttttagctgggggctgatgaactgaagctataattagtttcataatgtttgcttgtggtattaaattggctcctgaacaatatggactccgatacatattttatttatctggcttaccatttagattccaaaaaaagcggccgccaccgcgcgggggggggcccggtaccca

SEQ ID NO: 12055 - DNA, 1189 bp, Zea mays
ctcgtggccggccgcccccgcgatcccggccattactcggccacgacttgccgactacgatgccagcgccaagcctccgccgcccagctaaaaatcccccaggcgttcctgagcacccgtttatcatcacatgaccggagtcggccagaatttgccgtagctctcgcccccgctcgccgtgcgcttctcgtcccattcccccgggatcgtagattctcgagctgagctgagctgagctgagctgagcgatggatcgcgagctcagccccaggggcaatgctccagggagagggagcggcggcgcgtcgtcatcgaagcacaagaacggcggcggcggcaagaagccgatcaaggtgctttacatcgccaaccccatgcgcgtccagaccagcgccgagggtttccgcgccctcgtgcaggagctcaccggccaacacgccgatccctccaagtacagccccggcgaccttgactccggcgctgccgcacagggtctgagccccagggccagggtcgcggacgtttcgtcggaaaccatcgtcgcaagccacagccctggcagtaaggccgcgccgcacggaggggactactacgacgtcgaggaagacgaagatgacgtcttcaggtcgcctcacatgctgctggagaacaattatacggtgttctcgccgccgacgctactatatgaccatcacccgcacagcaaggctacttctgaatcggaggctgggttcgcagcggagcatgacaatttctggtccaaatgaagctgaacaagttaatacgactatagctacgaatggtttcagtgaggagcatagcacaagacaacactggtacaagagactataagcatgaatacgaagatggctacgtacggcaatggtggtgaaggctacgatgaaaggattgcggcgatattacggttgatgaatggcatgatgtataattttcttgatggacaaaaggatatatacacctccgatctgttttgtccattgagcagcaatctatgtaatcttatgcctaatgaacaggctaaggatgttttagacacaactactctagttggcacaatgttggattcggaagggaaacattgtaaaacgttggttgcttccttgtgcacatgttgcgcgcagcattatattaaaaaaaaaaaaaaaaaaacttatgtctattgtttgtc

SEQ ID NO: 12056 - DNA, 1480 bp, Zea mays
acatcagtcaatccacgcccgccgccccgcgcggccacacgcggccgcgctgggaacgagacttggtcgcagtcgctcccggctcacggctccttgctgcacgccgtatgctgtcgcccgcaccacaagtccacgaccagcactcccttcatagacccccctccggcgaatccctcaccaatccagcgttcacacgtccttcttgcttcagtccactccaaggttaggtggacaatatgtcaagctctaaccagatgtgttctgatggcaagtttgggagaggtcctcgggagcttagtggtgctgtggacttaattagtcgctacaagctgctgaatcatcatagtttcttttgcaagaagcctttgccattggcaatttcagatacaaattaccttaacaatgttgtgggtgacacagaaattcgtaagggggaagggatggagttggaccaactctttcagaactcatgttcaagtgagaagactgcttacattcagccatttgacatggaaacactaggacaagcatttcagctgcgagaaactgcaccagtagacttgccttctgctgaaaaaggtacaccaaccatatctgggaaatccaaggtcaagtccaaggataaagtgaagaaacataagaaacacaaagagaaagatagagacaaggagaaggagcagaagaaacacaaacatcggcataaagatcggagtaaagataaagataaagataaggacaaagacaaagaaaagaaaaaggacaagagtgggaatcatgatttaggtggtgatcattccaagaaacatgagaagaagagaaagcaagaagtaactggaagttcagcaaatgtccaaaatcacaagaaaacacaaaagcacaaaattcagtgaaatttatgatggacttcgttaattgtcagcagtgcatgtttctattttagttcaactccatttatgttgttaatgagtggctctgaagtgttccttttccatatcttttctggcaaagacgcagttatcacagatggaaaatatttaatactacgactgctacagaggaaacaagatacctgtactgatggaatatgagtcgtgtattattccttgggaacttgaacttatcatatggagttgtaaattattttgtcatttcgacttatgttcacttcatcattgccttgtatgatcatgtaattcagagaccgcagagcaaaggtgggctggggcttagggcttatttggaaacaaagtattttaaaactatagttttggaataatatggttttaagatgttatgacataatcgtagtatattttacatgactcttaacaatacatatttgtagacaaagtatttcaaactatgatatttagcacacatgtgcaatgctagttataggcaaaaactttgggttggaatgaagtttcaagtgtcatggtatctacaaaaccatgatatttaaaacagtgttttataatgt

SEQ ID NO: 12057 - DNA, 1992 bp, Zea mays
cattgggtacctcgtcccccccccccacggccccaccggccattgtccctccggccctcgcgagtcgcgacctccactgcaaccgcaccgccatgatgaaaccgccggcaccggcggttccgtcgcctgagccgccgcgcctcgccggcggtgggcgtgggccgcgcggcctccgatccctgcccgcgctctcctacaacacccaccgcgccctcgtcctggggctcaccttcctggcctacgcgctctaccacgcctcccgtaaaccgcccagcatcgtcaagcgcgagctcgcccggtcgtggccgcccttcgccgacccggcgctcctcggcgccacggacgtcgccttcctcacctcctattccctcggcatgttcgtcgccggccacctcggcgactgcctcgacctccgccgcttccttgccttcggcatggtcaccagcggcgccgcggtggcgctcttcggcgccgggtacttcctaggccagcattcgctcgcgttctacgtcgtcgcccaggtgattgcgggcctgctccagtccacgggctggccctccgtcgtcgccatcgtgggcaactggttcagcggccggaggcgtggcctcatcatgggcatatggaacgcgcacacctcggtggggaacatcaccggatcgcttgtcgccgcagccatgcttgggtacgggtggggatggtcgttcgtggtccccggtggtctcattgcgctcggtggcgtcctcgtgctggtcttcctcgcgccatacccccagtacgtcggcttcggccccgtcgccgattgaagaacctgtcactgacgagagcaccgacggggaggacattagtgccgcagatggcgctgggaaggacagacgggatgccgtcggaatttttaaggcactggccattcccggtgtcgtcatcttcgcgctctgtctcttcttcgccaaactagttgcatacacttttctgtactggctcccattctacttgagccagactgctattggagacgagcatatgtcagctgcatctgcaggatatctatcagttttgtttgatgtaggtggaatagccggccgggttcttggccgccttcatatctgaccagcttaatgctagggcaaccactgctgcagttttcatgtacttggcgattccatctcttttcctctttcatgcatatggtagtacctcaaaagcgacaaacattggcttgatgatgatcagtggcctgtttgttaatggaccctatgctctgataacaaccgctgtttctgctgatttgggaactcacaaatctcttaaaggagattctcgcgcattggccacggtaaccgcaattatagatgggacaggatctcttggtgctgcactaggaccattcataacgggcttcatttcaagaaaaggatgggatttagtattcacaatgcttgcactctgtgcactggttgctgctgtgctgttgtcaagtcatgtgaaaacagaaattcctcagatcatccagaagtggagagatcgctcgactaacgcgcagaatggaaatgcagatcctggtgttcagccacttctagtggacgaaagttgacggggagatctttcggtgcggctcctagtgcgacacagttttgtagtgttgttgtgaggcagtgtgatggttctggagaaaagacaaatcagacgatgacgaggaaacggtttctgtccctaatgcttattgatctgagcaaacaaacatgagcgggatacaatctattttctcaaaaatgatggtatagtccattgtagatttgcagtagaatctttagatacaccaatctgttgtgtaagaatatactgtgtatctttacgcatatcagctgtacttcgggggtttagatgaacctaggaagatggaacaatgacttgacagtgaaatactgatgaagactctgtgcacaatgtcaatgatatttgtgttttttttacccttgagggtgactgtcaacc

SEQ ID NO: 12058 - DNA, 1487 bp, Zea mays
gcttggtacgtgcccacacacgtaccaaataaacgtacactgaccgacgtcgtcgtttcacgttgcaagattgcatcttgccgatcatcgcaacgtcggctagctctgtgacaatggcgaagagcagacgggagatctcgtttggtttggccgtcgtcctgtccctaacggccgccgcactcgtgcgaaccggacacggcgccgacgccgccttcgcgagggcgagcgggacacgtttcacgatcggtgggcggccgttctactcgaacggcttcaacgcgtactggctcatgtacatggcgtcggacccggccgaccggagcaaggcgacggccgcgctggacgaggcggcccgcctcggcgccacgctcgtgcggacgtgggcgttcagcgacggcggctaccgcgcgctgcaggtgtcgcccggggtgtacgacgaggaggtgttcaggggtctagactatgtgatatccgaagcaaagaagcgcgggatccatttaatcctgagcctggtgaacaactgggacgggtacggcgggaagaagcagtacgtgcagtgggcaagaacccaggggcacagcctgaattctgatgacgacttcttcacggacagcgtgaccaaagggttctacaagaaccatgtcaaggcagtcctcacgagagtgaacaagatgacgggagtggcgtacaaggacgagcctgccatcttcgcgtgggagctcatgaacgagcctcgctgccagaggcgacctctccgggaagacgctgcaggcctggattacggagatggccggctacgtcaagtccgtggatcccaaccacatggtagagatcgggctcgagggcttctacggcgagtccacgcccgaccgcaagcgccagttcaacccgggagggtacaccgtcggcaccgacttcatctccaacaacctgatccccggcgtcgacttcgccacgatccactcctaccccgaccaatgggtgcccggcgcgagcgacggcgcgcaggtggcgttcatgcggcggtggatggcgtcgcacgccggcgacgccgcggcggtgctgcggaagccgctgctggtggcggagttcggctggtccgcgcgctccaacagctacacggtgtccatgcgggacgcctacttccgcatggtgtacgaggcgatctacgcgtcggcgagagcgggagggccgctcgcggggggcctcttctggcaggtcatggtgcccgggatggagagctggaccgacggctacgacgtcgtgctcgaccgtagcccatccacggctgccgtcgtcggccaggagtgctcccggatgaccggactcaactaggtgtcctagctagtagccagtagcggtggactgattcgtgctggttcaaatgttcaaggcagccacggagagccggagacatgaccaatggatgtgctctaataatttaaagtaataacaaaaaaaatatctttacattaaaaaaaaaaaaa

SEQ ID NO: 12059 - DNA, 3737 bp, Zea mays
gagctggaggaggcctgcgaggccggggactttgagagggcagaggggagcggcgactccctcgccacgctcgagaaggagaacgatcggctgtcgacggcgctgcgtggtgctgagcttgactatgattcagtggattcggagttgcaggaggtgcttgagtctcgcattgctgcagaggaggaagctgctgccctcatggagcaatttgcgaaggatgccactgaacacgctaattcagcgagcgagcacgcacaagaattatcctcgaaagaaatagaagagtggcaaacttcattggagttactagaaacaaagaagttagaaatggaagttgaaacacggttggttttagaagcacgttctgggttggaagggtcaatagagcatttggttgaagaagacaaactggagaaggatatgcttagtaaaaaaggagaaatcctcactaaggagttagctgagcttctagagttggtgaggttgaaagaagcagagatagctgaaaacaatgcccggatccatgaagttcaagaaagaatcagtgcagtggtctccagattccatggttctcagtcagatattgacttgaagctcagttccttgaaggaagaccaaagtaaagtggatctagagactgaagcacttttgttgaagaagaatgaaattgataagttcattactttaacagatcaaaaggattcagagttgagggacataattggtgcttgttcctctgaagcaaaagcttgtcgacaatcagttgaaataagaagaaagcttgcatcatcgatcttgaagtcaagagaggatagaattgggttgctaaaaatggaggaggaaattttgcaagtcattcaaatgcaaaggcaaaaaattaccgatgcaagaagtactcttcaggtacatcaactcttcttttattttattttttcgatatttatattatttaaatactgtgatttatgttttgttttggatgtaagctattctaaatattttatactggattttatgttttgcaggaggtatcttcaaggcgaacaagcatacagcaagaaacggaagcactgaagcagaagttgagtttcattgacaaaagaggccctgaactagaggctgaaaagaaagttgctgccgcctcaagaaactttaaggaagcaggaaggatagctgcagaggcaaaagctcttaactccgaaaaggacgagctgtatggtaagttggagaaagccgctactgatctagagacaatagaaaaggatattgtagcaaccacgaacaagatacaggaatgcgaagggcttattgaactcaaaggaagagagtcagcgttgacaagttacagaagactacggttagactgtgctgctgctagagcagaactgactgctgcagctgaaacagatgataacgaagaagctgagatactacgtaaggaggctgaagctgcagagtctaaagcaatggaactcaaaacatgctatgacctccaggtggtggatgatgagttcgtgtttcagcctgtagtccctatagcattcataacgaattcaacagggcagcacttggcagaaattgcgtcttcacttggcctatctcctcagaaatgaaatctggcagtggatttgtacagtgccaaggtctgtcggttgcactgcgattcaagtcctgccagtgccgtgcctgcgcgtattgaggggaagatctccttccaggatgtcctcctcaaggacccccctttatctcgcagcatttggaaattggaatctactcctaaacagagtaaagatcctagtgaggatttaagtgtaaagaatgtaattcttttgttgtgccagttttgattgaattgcagtgacatgccatcatcatcaaccagtacgtaatcatatttttgttttgagaaaaaaaaggatgtaatcagaagaaaatgtccaggaatgaagcttttcatgcatttgcctcactctgttggtgacagctgccattggaataaactgaccagtaacagtaacagagtaacttgaactgtgccattagaaaactgaacgtctctcatgtttgcagcttcagagaagtcttgaacattaggtactttagcaggaggaaatgcaccgagcacagaggtagccatgggccggcccatgggccatacgggcctattttgcctcctcgttgtgggagtaagaccggatgcatgcaacagataatcagcgctagctatcccctcatcgtcttctcttatcctcactcgcgtagtcgcctccctcctcttctcttccgcggcctggtgcaagaccaaggtgagtgattactgtcggtaatactttgtctacccttagcgcacgtagcgtgatgcatctcgctcccaattctctgcggctagggtgtcgttcattggcactctaattcgcgcgcgtgtcctgttcgatggaatctcagaaagagttccggtctttcgacagagggaggaggaggccacgatggccggcagcgtcagcaacggcagcgggaagagcctggcgcgctggctgcgggagaacgggttcgacgacgacgccgtggcgcgcatgtccaggcggtgcaggaacctgcacagcctcgacgccggcgaggccccgggcgtgtgggactacctcctgaccggcgtcaagatggagcggcggaagctgcggcacgtggtggccaagtgccccaagctgctcaccctgtccgtggacggcaagctcgcgcccacggtgcagtgcctcgccacgctgcaggccaggcccggggaggtggcgcaggccatcgccaagttcccccagatactgttccacagcgtcgaggagaagctctgcccgctcctcgccttcttccagacgctcggcgtctccgagaggcagctcgccaagctgctcatggtcaacccgcgcctcatcagctacagcatcgaggccaagttctcgcagaccgtcggcttcctcgccggcctcggcgtcgacagggaaggcatgatcggcaagatcctcaccaaggagccgtatatcatggggtacagcgtcgacaagcggttgcgccccactgccgagttcctcaagtcggaagtcgggttacaggggccagatctccagagggtggtcatgaccttccccgatatactgtcgcgagacgtggataagatcctgcggcccaatctggcgttcctacagagccgcggattcagcagggatcaggtcacggcactggtagctggttaccctcctgttctcatcaagagcatcaaacattgcctggagccaaggatcaagttcctggtcgaagagatggggcgggacatgggcgaggtggtaggttacccccagttctttcgccatggcctcaagaggagcctggagtaccgccacaaggtgcttaagcagatgaactcgagctgcagcctcagcgagatgctagactgtaaccacaagaagtttgccatgaaattcggtttggtcgcagcagtttaggtactcaacttttctctagtccaatccaaggtagtttgttttattctcaggtgaatctttccgtttgtaccgtcaggttgtgttgttcttttgaacatttgggcaatgataactaataattcaaggtcctttacaagtatcaaaaggtatctttgacaccctaagtacataaaatctctatggtctgtttgagagctgacaaaatgcaaagcatgtggggcggcctctcttgataccttagcaaca

SEQ ID NO: 12060 - DNA, 3338 bp, Zea mays
ttgggggcaccaacaccctagcaattgtatgtgttgaactaagcaaccaaatcacaaggtagcatttgcatatgtattgacctgagcaccagatcacaagctagcggttggtcctacactcctgctaatatatatattttcttgaagagcacaaggcgctgtgtagatgaagcactgattaagtgagcaagtttcatcacagtatgtccattgatttggtgttctaatgcattagatttgtgctatgatggcagacctcttttgtacatcctagtagccaaatatcccctcctagacagctccaacttcacgtggagtctgctccacctggagttgtgaagtggagcagaaatctatagagttggagccatacaaaaaagaccaaaatactcaccgtaggtgtttagaattctttaattaattgctagactagtttatgggaaatgccaattgatctaacatatattgcctcttattccttctgttctagattataaggtattttttaacgtttattaaagaattataaattatcaaatttaatcaaaattataaatataattttaaaatttatgatattgagtaggtgtactattaaagtataattgatgaagaacctatttagtaaccataaatattattatcttattatgtaaatctagttgaacttgacatacttgaactctaaaaattaaaataaattacaaataattatttagtttgcattgatagctattaccatagatattttttaaaacttccgttacatatactcctacagatataaatttagtcttatgagatagaaaatataaagagagcagacggcagcgcactgctactctgctagcgtagtagcgttcgactagcgaagagtgcctgccctcttccacgctccacctaccaccgtccaccgctgtgcctgtggcgtgccgtgccttccatgtggacctcacaccaagcgttttccacgcgtgggtagcgtcgcccaaaatacagccgttgcgacagccgctgcagccctgccgagtgacggtctctcgtgtcgtgccattggattccactccacaggtcccaaggctagtaaccgatactatgccactagacagatttcatgtgtgagtgtgacactgacacccatatcacctgattttaggacccactgttgagcaccatcaacgtttcgtgggacccaaggttcagcatcatcgacgttttcgtgccggtaaggctgtcttcagcgtaacagaggacgcataactgttaatgatacgataatatttgataatatttatatagtgaagtttaaaatagataaaggatggctgaaaagttcaccggctgaaatgaaatccctctgtttttttctaaataaatctgtaccgccagccgcgggccccgcagccgcacattttccttctccgggcactgtacgcttctgactgcggctgaatcaggccacaggggggctcccacttcttcctcctcgacagtcctcagtcctccgtgcgaaatctgttcgcactcgcagtcgcagtcaccactgttctccagggatggcgccgtgttgcctgctccagatcggttggtgtctcgagcgcccccgtggctttcgcctcgccgcggcgctgtgcgcggctgtggtcgcgctggcgctggcgcccgccttggatgccacgtcggcgtcgcttctgggcatcaactacggccgcgtggggaacaacctcccgccgcctcagtccgtcatgccgctgctcgagggcctcggtattggccgcgtgcggatgtacgacgccgaccccaccgtgctgcgcgcgttcgcccggaccggggtcgagctcatcgtcggcgtgcccgacgagtgcctggccgccgtggccgacccgagcggcgcggcacagtggctcaaggagaacgtcgcgcctttcctgccggacacgaagatctccgtgctcgccgtcggcaacgaggtgctcaccggcgccaacagctccacgctgtcgcgcaccctcctcccggcgatgcagtccctgcacggcgcggtggccgcgctcggcctcgacaagcagatcaccgtcacctcggcgcacaacctcggcgtgctcgggacgtcgtacccgccctcggcgggggccttccgcaaggacctgctcccgtacctctgccccatcctggactaccatgccaggaccggctcgccgttcctcgtgaacgcgtatccctacttcgcctactccagcgaccccaggggcgtgcagcttgactacgcgctgctcgacccgggcttcgccggcgtgcaggaccccaactccaggctgcactaccccaacctcctcgtggcgcaggtggacgcggtgtaccacgccatcgcggcggccaataccgcggcgtcgcgggtggtggaggtgcgggtctcggagaccggctggccctccgcgggggccgccaacgagacggccgcgacgccgcagaacgcggcgcgctacaacagcaacgcgatgcgcctggtggcggaggacaagggcacgccgctcaagcccggggcgccgctccgcgcctacgtgttcgcgctcttcaacgagaacctcaagcccgggttggcgtctgagcgctactacggcctcttcaagcccgacggcacgccggcgtacgagctctccttcaagctaccgcgcgacaactccacgtttggtcacggcgataccggcaagggcggtggcggaatcggcggtaacggcaatggcaatggcagcagctggaacaatagcggcggcggaaacagcggctactatgacatctcggcttcagcacgtgacactacgggtcactggcggatgtgggcgcaggcggccatggcaggagcagtagccgtcctgacactgtagcgccaagggtaggatcaggaatggagcggagttgccgtcctggggcagcggcctgatttggtgctcctcgtatgctgtagtttctgagaccgacctgtgactgtgagtgaccttgtgcttccggaaatctggtggcatctaaagcactcctagttttaagcagcgctggatcaggtttgcctgcctgcttgaaatgaaaccctttccaaatactggtagcaccctggtaaaaatcctctaaaatagtgctgcgctgcttcgttttagacaacgctgttaattccggtctttaaaaaaaaaaaaaaaattggtaaaactagtagcatcttctagatccgtgagactaacagatcggatttaagattaagtaaagaagtcaaaatgacgatttaatgatgcggttttccgactttattacatcttaattgattggattttttttacaattttgtt

SEQ ID NO: 12061 - DNA, 1988 bp, Zea mays
cattgggtacctcgaggccggccgggaggagacggctgtactgtactgatcactcctggcctctgcgaaggaaagaagaggtgggggaggctggtttggtggcctgtaccgatttgcagcagctgatggcggcgcctctgctcccctcttccgtctccgtgctcctctcgctccacatcgcgctgctgctggtcctctgctccagccaggtaggagattcctgctcctcagtgcgggactgcggcacgggcctctactgcggcaactgccccgccgcaggcaggaccaagctctcctgcatcagggacctagccatccagcccacctccattgtgaaggggctacctttcaacaggtactcatggctcgtcacccacaattccttttccatcctcggggagccgtcgcgcactggggttgagagggtcacgttctacaaccaggaggactccgtcaccaaccaattgaggaatggtgtcaggggattgatgcttgatatgtatgacttcaacgatgatgtatggctctgccactccctgcaagggcaatgctataacttcactgctttcgtaccagcagttgacacactaaaagaggtggaagcatttctctccgagaatcccacagagatcataacaatatttattgaggattatgttcattcaccgatgggactgagcaaggtctttactgctgctgacttgatgaagtattggtatccaatctcggaaatgccaactagtggcaaggactggccaagtgtcacagatatggttgcaaaaaaccgcaggttgctggtgtttacttctgatgcttcaaaggaggctagtgaaggaatagcttaccaatggagctacttgctagagaatgaacctggagatccagggattgtgcctggttcttgtccaaacaggaaggaatcgcagccactgaactcaaggccggcatctctatttctgcaaaattacttccccacgatccccgtgcagaacgaagcatgtaaagagaattctgggctaccacaaatggcccaggcttgttatgccgcagctgggaataggatcccgaacttcatagctgtgaatttctacatgcgaagcgacggtggtggtgttttcgatgttcaagacagaatcaatggccgcaccttatgtgggtgtgacaccattgctgcttgccaggctggagcaccaatgggtgcatgcaaggacacgggggcaccaaatcagactacatcgccctctgtaaatggaaatgtctattcaggaactatagaattcaagacgcattccactagtgctgctagcaataacaacatccggagtagatctgtttttctgctaaggctgcagttgactttgctgctctttttctctttcaggctctagttttcatatatctggacctttttcccacctactgtatagctgaaagtaacatcagcttttgttgtgagcttgctttctctattgggatgacggttagtgccttgctagctttataatctatagttgggagggggtgtggatcaatgttaatgaaagaatgggtagagatcttcctctgttctccgaggaggagtaatacggctacaacctacaaagaaactgatgagtggaagttcatgctggttatgtgattactagatatatgcatgcgtgttgcacctagaccgaaattttgttcacatcaatggaaaccgcgtcttctctgtgccctctactgacgggtgggtcaccacggtcagcgaccatggcggtgctaccaaggctgacgggtggggtcaccacttaccttactcaaattaaatagactattatttagatcatttctcattcctctcctactgcgagctcgtcacctttagcctccctttctccctattggctaccactaacgtcaacgccttctatggtgtcgtcgatgtcgaccttttatctcttctctctttgggatcctaatgttaacccgtgctatatgataatact

SEQ ID NO: 12062 - DNA, 1067 bp, Zea mays
cctcgagccccgccgggcgccctggccctcgattattttctgatggagcaatgcaccccgttccgccttcataccttgctcgtcagcccggataagataacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgctcgtctctctgccgccctccctttcgcctccccactcgtttcaggcgggtacgggacctgggcggcgacttcaatctcgtccgcgggaaggttgagacggcgggggctggaggtggtgtgcgaggccacgaccgggcggcggccggactcggttaagaagagggagcgccagaacgacaagcaccgcatccgcaatcacgcgcgcaaggccgagatgcgcactaggatgaaaaaggtcttaagagctcttgaaaagcttaggaagaaacctgacgcgcagcctgaagaaataattgagatagagaagctgatcgctgaggcatacaaagccatcgacaagacggtgaaggttggcgccatgcataggaacacggcgaaccatcggaagtctcgactggcaaggaggaagaaggccatcgagatactccgtggttggtatgtcccaaacgctgaacctgtcgctgccacctaggattcttgagaaatcgctatcatgtgtcagcttttcatttttgggcgactatgctattcacgggtctcaacagcttgccaggttctctattgaaatggtctgttcataccttttctgctatgcgtttgctctgtactagcagtttgactactggctagaatgggcagctcttctcccctgtttctgttgttattcgcctcaacgttgtaaaactaattcagaaaattttaaatatagctgtcatctggtaaaaaaaaaaaaaaaaaaaagaccaaagcccatcagtagtcagtatgcatagtgaaaacagagtgcagatgatgttttcgat

SEQ ID NO: 12063 - DNA, 4890 bp, Zea mays
aatgcacttttgctacacaaagagttagagcccaatagcgagtgctagaaacattgtaatggacctatgcaacatgtctaagcgtgcaaacctcatagatttatcatttcgttccaagttgcatttctgacctcctatttagctcaacctaagtccaaattgcacatttctcacatgattgagttagagatcaaagtaaagtgctagaaacatagtattaggcatatgcaacttattcaaacactcaaacctcattttcttactattttaccacaagttgtactttgtagcctctattttagctcaatggacttagtgccttcaattaaacctatgctcgtactcatattaatgaggtgtttggtttgagaaataagctagtccatcttctcactccccactttttgtttggtttgtggaatgaaatgagttgatccatcaccaccccattccttataattagttagtactaatatgaggaatgcggtcattccattaaatttgaagaatagactcatgatgcaccacctcatcttgaatgtagtgattcctcaaaccaaacactccctaaacttattagtctaaagtggtgtgttgaacatttaatcaccaaaacagataaaaatgactatctagcacattttcgtttcaatgctgaatgtctaatcacgccgatgtctaggtggggcgatgatgaaatagaagttgtctgccatggttagggagaagaaatgagagaggcacaaagcttgattatgagttagacgaagtgttgacaaccgaaaattatattctattctatttttcattttattaaacaaccaaatggtattataacgtatggatcaagttttatgatggtattccagaaagctcactcgatagatagcaaagttacaaaactcaacttttatagtgacataattccaaatttcttagaactcgttcacaaccaagaataacgaaaaagattgagggaccaaaattctttactattaaaattaaataataaaagtttttgtccttcaattccctccattacatttcccaaacaaagtctctgccccctcgagtattttctgattgagcaatgcaccccgttccgccttcataccttgctcgtcagcccggataagataacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgctcgtctctctgccgccctccctttcgcctccccactcggtacgctttctccggcacctcaggtttcaattcctcgacggcttgacaatatctctgcgcttacctatcggttttgtgtggggaatggcagtttcaggcgggtacgggacctgggcggcgacttcaatctcgtccgcgggaaggttgagacggcgggggctggaggtggtgtgcgaggccacgaccgggcggcggccggactcggttaagaagagggagcgccagaacgacaagcaccgcatccgcaatcacgcgcgcaaggccgagatgcgcactaggatgaaaaaggtacctgcgtgaatgagtgatgcttagtggcagcgcgccagcgactatatatatatgacctctctccttattggcttattgcttataatttccccagtaatttaaccgcattgtgagataaaaattctcgagtggcacgatgtagttagaaaggaagtttagctttggagaagctcttgcaagattgtagtgccagtacattttgttgaattagttttgtcttgaaataagcatgtcaatcagcttgttagaagggctccatttgtgaatcatacagcccaatctacgtgttgagtttgttcttggctgacgttaagtaatttttttgggttactttggcagattggctggctgctttatgttagccagtatttatcacgggctaatgtgttttgatttaggggcatggaggacaggggagctgaacagattctgagtttttttagtctagcggtatcaaaaaacaaaaaatgtgtcttgatttgtatttagatgaatattagaatgtcaggtcattattttagtataagtggaagtcaatattttgttattatttatgaatcattgccctcaaagggaaaaaacagcccaaggaaaagaatagacatagttaatgaatttcattccatgactagtgactatcctcagtagacccgtaaaacactattttgtattgtagactctactgtttataaagtgaagtttaagataggatgtagaataggaagtctgctagagtggagatagcattgtcttttgcgttaacaacagtttcttttgtgttgatgtaatgaatcttctgacacgaatgaaactgataatggtcaatggggacgagaatacgaaattccacttcttatgcggcaaccagtatcatcatgatttttgtacacagtttaagcatcgcatactctgctctatgaaaaacagtcataaaccgtttgctcttccatcaggtcttaagagctcttgaaaagcttaggaagaaacctgacgcgcagcctgaagaaataattgagatagagaagctgatcgctgaggcatacaaagccatcgacaagacggtgaaggttggcgccatgcataggaacacggcgaaccatcggaagtctcgactggcaaggaggaagaaggccatcgagatactccgtggttggtatgtcccaaacgctgaacctgtcgctgccacctaggattcttgagaaatcgctatcatgtgtcagcttttcatttttgggcgactatgctattcacgggtctcaacagcttgccaggttctctattgaaatggtctgttcataccttttctgctatgcgtttgctctgtactagcagtttgactactggctagaatgggcagctcttctcccctgtttctgttgttattcgcctcaacgttgtaaaactgaattcagaaaattttaaatatagctgtcatctggtaaaaaaaaaaaaaaaaagggccaaattgtatcagaagtcagtatgcatagtgaaaacagagtgcagatgatgttttcgattgtttcaaggtccacacttttttttttgaaaggtccgattacccggcttgtcattaataataagccccgtttaactccttagaattgaatcccactctaataattgtaatttaggcacaagtgaattaatctaatatcgttttatatagaatatatttgtatactactgttgacatatgcggctacatttctactattagctacatttctactattagatagtgagtcgaagagcatgctataaattatagagtacaaatatagtccggtgaagtggtgatacataaaattgatttccatctttcacctttgaggctttgaggatgtttggttctcataactaaagtttagttcgtagcacattgaaggttataatgtcaattataagtattaaatatagcgtaattacaaaactagttacatagatgaaaattaaatgatgatatgaatttattaagcttaattaatcctagattattaaatgtttttaatgtagcattacaaaggtgaatcatagcctaattaggcttaatagagtcacattaccgtatagtctttatttatgtaattatactagatttaatatttctaactggcattcaaacatccgatattacaggactaaaattgtctcctaatccaaacgagctcttagtttccctcgtaccaagaaccaggtataaaaaacagactatctttagaagcctcttacatttcgtttcaaactccactcgataaatgtctacaacagtgttttacatattcatatacacaatctgatggccaatgcctaacaacttacatagtcatatgcacaatctgctggccgaaggtccatactacctggtctccttgagtttcctataaattgagctgggtcgtttgtattgtacttcaaaaaaggactagaaaagattagcatacatgtttcgcaaggcttctcagccaggacagtggaccgcaggagccaagaggcatatagatattgaacggaagataacattctcgtagtcactgcagctagagaaacacatggtttgccaagggcaaaacgcccgaacatcataacaaccagcaaagctcgtgcacaagcttccgaatctgagctataatcaatgtagttaatacatagcattatatatgagaataatctacctgacctaataacccgctaggcgcaaaaaggggcaaaatttgcaggttaaagcttcaccatgccagaaaggcagccttgaagacgaggtcaagttttcgtactatatatatatatatagttatatacctacacatgctgatggctgtgcaaagggaaatgatcgtatcattcgtcactttcaacagatcgaccacttccccgatcatctaatgaagcgtgcccaagtagctagcttttttttacgctattacacctgatggcttcaaggattgatacatcgtcgtgcaaggtgaatggtacgctgaaaaattgagtggaaagtacatacgggttaggaccaagacacgttaatttggagggagcatcagttttgagttctggtagtaccagttgaagtccaaaccagcaaactttgagttttctgagatctcaatctccacccttgcttttctggatgcctgctcataaataaatgctactgttagtacctactagactatcaaaaatttcagtgcgttcttaaaattattataagcttgctgtagtgtgagccctttcgggtgcatgcataagcataagtc

SEQ ID NO: 12064 - DNA, 1413 bp, Zea mays
ggtaccccccgaggccggccgggactccaattccaaacactcgcccgtccccgtcgctccccatcccacaccaaccctctgtgcctcggtccctccgcccgtacgcgcgacgagagacacgatgcggcggtccctaccccttctcctcgcgcggcaggtggcgcggcggcggcggctgagcaacgtgccggagtccaccgtctacgggggcccacgcccgcaggagtcctcggcggcgcggcgcgtgacggtgaccacactccgtgggaagcaccgccgcggggagcccatcaccgtcgtcaccgcctacgactacccctcggcggtccacgtcgactccgccggcatcgacgtctgcctcgtcggggactccgccgccatggtcgtccacggccacgacaccacgctccccatcacgctcgacatcatgctcgagcactgccgcgccgtggcccggggcgcgccgcgcccgctcctcgtcggggatctcccattcggctgctacgagtcctccgccgcccaggctgttgattcagccgtgagggtcctcaaggaaggtggaatggatgcgatcaagctggaagggggtgccccatcgaggatcactgcagccaaggctattgtggaggctggaatcgctgtcatggggcatgttggcctcacaccgcaagctattagtgttctcggtggatttaggcctcaagggaagacggttgacagtgctataaaggttgtggagacagcacttgccttgcaggaggctggatgcttctcggttgtgttggagtgtgtgcctgctccagtggcagcagctgcaacatcagcattgaaaatcccaaccattggcattggggctggaccattctgtagtggccaggtcttggtgtaccatgacttgttagggatgctgcaacacccacatcatgccaaggtcacaccaaaattctgtaaacaatttggtaacgtgggcgatgtaatcaacaaggcgctatcagagtacaagcaagaagtggaggctcaggctttccctggtccaagccacacaccgtataagataactcccacagatgttgacggctttgcagatgcactgcagaagatgggtttgagtgaagccgcagatgccgccgccgctgctgaaaacagggagaaaggtggagaaccaaaaggagagtagctaatctaataatgtctgttgttttcagcagatgcacctagacctaaagtagagaatgtgagggcagattacctagcatattaacggtgtcctgcactagaacaatttttgccagattgcagccacataaagtcagacagactgcaggtcatacagaatcgtttggctttggatagcctccgaaagtcagaactgtcgacaatcgaatgtttcatacgaaaaaaaaaaaaaaaaaa

SEQ ID NO: 12065 - DNA, 3432 bp, Zea mays
catgtgagtaatatactgacaagtaacaattactatgtcttgccctagctttattgttttcaaatgaacctcttattttcaacacagccagtatttttatactgcaaatataatcataatcaaacatgaaaaacctttcctttaacttcagcagttcagcactgcagtagctttattgttgcatttggccggcttgtatggccttgtagcttagtctatcagattcgggtttttttttcactaaaaaggacttgatggaagcatagaataatttattgtgatgtatcatcacaacacgttatagaatagaatagcagatgtggagcttttagatgctccatagtgcatacaagtgatctcattttattttaatcttaaactagtaaacttcagcaatccttttctgacttttgtactatgagccatctcttctctactatatttaagttattaatttcttcgtgcgtcgccccagcgagcgcaggaaatagccaaaaaaatggggtatggaggatttgaaccctgttcgcttggtataaaatgcttggcttctacaactgcaactcatgtctatttgtgttatattaagaagagatgttgcatgttgtaaatatatacatatactaataatttgaaaataaaaaatataatcatgcttgaataaatatctgatttaagcaaggtctacctatatgtacaggcaactaactagttttgcttgaactgtgatatgtggtcttgttcagctaccatgaatcgcatgactgactgaatgagtattttttttttcggtttcaggaggctgtagctgcacggtccaccgttgttcatgaactcgagactcctacagtatctagacctgaggtatgttaccattgacagattcaacacaaacttacatttcttatgatgttatcatagttttaagataagattaaaggaaagcacgtgcatacatattgcttattaagcagattctcctgccatttagtaactgcatttctcatcatgatgctgtcaatggaacatcaaaatatctgttccaccgatgtgtccagctgaagctgaactatgctagcacctacccctgtttaggagagcagacctaagccacctacaaagaggagccagcctgcgctcctgaagaacataataatttccgtgaagccgcatgccaagaaaccaaaggttgagacggaagctaaacctgctcccgaggagcggcggccttcagataggcacggctcagatcagaagcaaccagacgacacaaaggcaacgcttggctctctagtggcttatgacgacgacgacgacgaaagtggtgaggacgttgactgacagtggcggcgtttgagaattcagctgtggataacccgcaagatgatggataactgcgttcgagtgttcaggtatggatatggataccgcaagaggttactgggagagatgctgcagccttttgggttttcctcgaggagaggcacttctattgcattctaaaaatcggaagcctttacagaaattttcttgtatgtattgtacaatttgaaaacgagccgggaacattactaatggttggtacgtacgttggtaccacgttgtttgacgaaggaactctgtagatagttgttgtagtttatctgatgagcgcattttgctttcacaaggacgtttagaaaactcgaacgcatcattctcgtctcagagtatgtttcgttggacagtctgtttggttgtggtgcgtggctatgtaaaaagctgcttgggctgtgagttgtgaaaatactctgcttttagctattaaaaaactaaaaactgattggtagaagccactaatggccgttaaaagtttttcatatatttttttacagttttatctgagagccactaaaaacaaaaacaggtttatatatgctttcaattttatactataagaaagttaacttttagaaaaatcagaagaaaacacacctcaaattttttttaatatatccatatttctcttctttttgtttttctacaatatactttttttttacttttgtctaattttttatgtccaaatctaaaacgtcaactattttactgcccagggattacgattatgtaaacaaattgtaacaggcatcaaaaccagaagaaaatggtgtaacatttcccggcttatatctcgaaacaaagcggtacccgaactgattaggacgtctacgtatctaccttatttgtaatatatatttggatgtctacgtatccatctgaattcatatgtgtcacagtaatttggtgaggcaggtacatattcgttgaaacagtgacagaaatcaaaatgggagacttgatgcagtttgccggattggtgacgtgcctttgacaaaccgggaggaggaagatgtacggcatggccgctgcttgcggtacgtactggcgggggcagccgggcgtctcacatggtttgggtgtgttgcattgcagtacgagttgtactgacgaaacaaagccagcgaggcctgcttctctagcggtactgtactgcactgcgctgcggcaagttaattctttgctgcgtgcgtgtatatatagatctccaatggcccgccgggccgggacctttagcgttagcacagacacacacaggtaaggagagcgagaggtgggttgggtttgatcggagacagggacgaggcagagcatgggtagggggccatcaacagaattccaaatttgatttctgtttgctcgctcacaaaatggagggactcaccacaaacacactcaggcgttgttgctccctcccctgcactgcctcttccctggctcctcaccgtctcccatccacctatcctctctctttctctctctcgttatggttttgtataattttttttcctgcattcttttctcagtacaagtcctacactaatttggctgtctttgcaccagtactaataaacaccgcaggtccctgcaatagggtttacaacaattctattgtaatgactgctgtaaaacatccgcatcatttaattcaactttccggtttcagtcagccctgcaaaagtgctcctccgttcgtccgcgtttggtgttggcttctgcggctccggtgcccagagttgctgccggcggaggccgagcaggagcgcaactaacaagagcggccaaggcgccagtgatcctcaccatggacaggagatcgatggagatgagcgtgagcttccgatgcttcggtacccgaagaaaagaacgggaacaaaggcgagaaacatgatccacctctatgcttttttggcaacatatcctatgcttaaacagttatggtgttcaaatgtacacattaatagagcgtttggtttgaagaatcacaccatctaaattgaggtggtgcatcatgaatttattccttaaaaaaaaaaaaaaaaaaaaaaaact

SEQ ID NO: 12066 - DNA, 1019 bp, Zea mays
cattggggcctccccgcggccgcggccgggacaaagagcatggccgggaaggagatgacgccgaactcgaaggcggcggcgccaccggcgacgatacgcctcgtgaacttcatctccgaagaccagcttgacgaggtgaagcggacacgaggggagcgtgtggaggacggcaccgcgcagcgcgacaaacccctcttccagatcctacaggagaacaaggagaagaaggacgccgagttcaatgagcgtttcaagcacagacctccaaaggctttggatgaggatgagacagagtttcttgataaattggctttgtcaagaaaggaatatgaacagcaggtggccaatgaagaagcagaacagctccgcggtttccatgaggctgtagctgcacggtccaccgttgttcatgaactcgagactcctacagtatctagacctgaggagagcagacctaagccacctacaaagaggagccagcctgcgctcctgaagaacataataatttccgtgaagccgcatgccaagaaaccaaaggttgagacggaagctaaacctgctcccgaggagcggcggccttcagataggcacggctcagatcagaagcaaccagacgacacaaaggcaacgcttggctctctagtggcttatgacgacgacgacgacgaaagtggtgaggacgttgactgacagtggcggcgtttgagaattcagctgtggataacccgcaagatgatggataactgcgttcgagtgttcaggtatggatatggataccgcaagaggttactgggagagatgctgcagccttttgggttttcctcgaggagaggcacttctattgcattctaaaaatcggaagcctttacagaaattttcttgtatgtattgtacaatttgaaaacgagccgggaacattactaatggttggtacgtacgttggtaccacgttgtttgacgaaggaactctgtagatagttgttgtagtttatctgatgagcgcattttgctttcacaag

SEQ ID NO: 12067 - DNA, 1700 bp, Zea mays
atggggacctcgaggccggccgttctctagactccccttcgtccctttctctctcttcacactcgcctcgccattaaagctccaaaaaagaaaaaaaggctgcgaaaaaaatcatcttctcttctcctaaaatcttccacctttaaccgtccctgtccgcgaatttctagatgccccgatcgcttccgattttttcctggatttctccgattttttgaagtatttttccttggggacggtttcattgccattcctcgacggggttagggtttgcggggatgagggtgcacggcgaggtgtcggacgatgaggcggccgtggctgtggttggggaaacggtgccctcctcgccgcctcccgcctccgtggtgcagccgctggtggtggggtacgccctcaccaagaagaaagtcaagagcttcctgcagcccaagctgctcgcgctggccaggaagaaaggcattcatttcgtatcaattgatgagacttgccccctctctgaacaaggtccatttgacatcattttgcacaagcttactagtaaggagtggcagcaagttttggaggactatcgtgaagagcatccagaagtgactgtcctcgacccaccaaatgctatccaacatttgcacaatcgccaatcaatgctacaagaagttgctgatttgaacctgtccaatggttatggagaggtttgcgctccacgacaactagtcatcatgaaagatccgtcttccatacctgatgcagttgccaaggctggactaaccttgcctttggttgccaaaccattggtcgctgatggtacatcaaaatctcatgagctatcccttgcatatgtggaagcatcattgcctttgcttgaccctcctttggttctccaggaatttgtcaatcatggtgggatcctatttaaggtatatattgttggtgaaacaatacaggtagtccgcaggttttcacttcctgatgttaatacgtatgacctgggaaacaatgacggtatctttcgattcccaagagtttcttgtgctacaaataatgcagaagatgcagatgttgacccttgtattgcagaacttcctccaaagccacttcttgagaaacttggccgggagcttcgacgccggctgggtcttagactgtttaacatagatatgattagagaacatggaagaaaggaccggtactatgtcattgacatcaactattttcctggatatggcaagatgccaggatatgagcacatattcactgacttcctgctaagcctcgtgcaaagcaagtacaagaggctaagtgggagctgaagcgtagagaagatttactttcgatggagactattaacagatgccagctagcctggccatataacagtggggcagctagaaaggtcttccaggttgtacatagcaagggggtgggtcttagcatgaatgcggtgtttgggccggggccttgactgaaggcgcatagcagaactaagacaaaaaatgcagtgtttgggccggggcagtatctgaagaaaggttttggctccgtgcccagcctactgtgtaattcgtttgaccgagtggccgacctgtgtaaatcgttttaccgagtgccgacctgggcttctttagtttcaaaaacaaacaaacaaaacctttgcttcgtttttacaaaaaaaaaaaaaaaaaaaaaaaaaaaaagcggcc

SEQ ID NO: 12068 - DNA, 1384 bp, Zea mays
tggccaataagcacgaggcccgcgagcccgacacgaagcctgttgtttgggtccggtccgaacccggcataacccggttctatgcgggcccgggtcggcctggcacgaataagtgggccgggctcggacaggaaactaggcacggtgggctagtccggcacggcccgtttacctctaagcccgttaagctcttttttttgcattaaaatatgtttttcggctcgcttagcccacttttcggcccgcttttttcgtgctaaacgggccggcccgttccgtttaggtccgctgcgggccggactcgaacaaggaatcgagtccacgggcttagaaggcatagcccagttttctaaacgtaccaccgttaacggtaagcttaatagctcacagtaaaactatctacaacagcttagagcaactccaaccgtctttgtaatttgattcgattaggtaaaaaaaaggccactgaaaaacgcatccaacggtctcgctttcttcctctcttctctatctcggtcggtttttcctccccttcgctggtcatctttgccgagggcctgcgtctcgctatctcttccctccgccctcctgctctcccgccgttgtagaaatttccctctcccacgcgtcctcccgctcccgtgcacttgtcactgcgcctagcccgctcgctcgctcccactcccgtacccatgtatcctctcaaccgtgaccagcctgtgtcgccacgttattgcctctgcctcgtcgcgccatgtacagagcgaccccattcaacgacgggtgaagaaattgggttgtggaatgcatctgcagagattcccctttcgcagttagcgtcaggaaggctagatccggaggcacaccgcccggagggagagctggaacaatccaacgtcgattagatgcatcggggtgtgcttcctcccataagattcgaagtccaaatgccagaggatctgaccaattctactcaaatcgacggggaggaggcgtagatgggtgagatgctgattgcaatgattatattttttcttgttgattgttcatttcgaactctgcaatctacatttgatgtacgctttcgttcagttctttagagctagcaaaaatctgtgtgttttttgtaattgatacgtttatatggtgttccaaatgcactcatgccgcttaggatgtctaaaaagcaaaaaaaaaaagaaaacatagttcagaattaaagacagaggttgttgttcggtagccctactttacagcaacggctgctgtaggccactctcatacgatggcttacagacaccagaagcaactaaaaaatagttgcagcgattggtgtgtgctaatggtgatgtgaattatgtaggttggtgtgtgctaatggtgg

SEQ ID NO: 12069 - DNA, 857 bp, Zea mays
ccggccggggaattacctagtagatcgaatgccagccctattccaactcaattcgccgcgtcacctcctccgctgctttgacgacccggccacgccagccatggacgccctgacgcgcctccaccgctccctcgtcggcggcgacgacgaggatcagtcggaggactccatccttgctgataccgaggacctctgctccctctcccccctccagaggatctacgccttcgcggcatgtttggtggccggactcaccctcatgatcttgtcttttattgtcttcgcaagacctatcaaattcgcagtaatgtttacatttggaaacatattggcagttgggagcacagcctttgttatgggccctcaaaaacagctaaggatgatgtttgatccagttcgtctgtatgcaacggctgtttatgttggatgtgttgttttggctctaatctttgctctttggattcatgacaagctgctaacactgatcgctgtcatatgtgagatctgcgccctattttggtatagtttgagctacattcctttggcacgaaggatggtttccgacctgatggtgaagttctgtgacactgaactttgagctgctgcacgcaataacaacaacaacaaaattcttctgtgtctgaaacctgataaacctatgggttcttctcatttgtccatttcctttgggtttaactttattttgtaaacaaaacgagttaatatgtactttttttttgtaaatgtatgtcagtgtatttatctgtaaatgtacactgcatctttgaatcagatattctgatcttgtagtgctgcaaaacgatgagttcacagattgggggactaatcacgggtac

SEQ ID NO: 12070 - DNA, 1992 bp, Zea mays
acgcaaaatgacattgggacatgggtaggatatgggatgctgggaccaaccccctggatcaattcttgggtaccctctgtcgagctgccgagaactgtagcaccagccgccgctggggacactggacacgtagaaacatacagcacgtcccggaaacctatagccattccgtgaccttactaccagccaagccggcgcccatctcatggctcaatggatctgagtcgtactctacggatacacacagagggaagaacaccgtccacttagggcctagggattccgctaaacacggggccaatctagtgcttaatttatcctaagctttcaatctgaatacggatttgtcttagcgattatccgcgatgcagctcggtaaacctccaaatttgccagcgctgtcaccatggtgcgcagcgccgcctgccaaaattctgccaaagtctcgagccagcccacgggttggcacataccggccgccgaccatgggcgatttctgcccgtgcgcgcatgcatgcatgtgttatctagtcacggcttcttgtcctatccgggcccgtctcccgaagaacagcatgcaccgtgctctattgcttcccgctccagtctcctgcactgcaccttgctttgctttgctgatcgctgattttgcccgacctaccctacgctagtactttgaagtagtaggagctagcgagatctccatatatataaagcgaccttctttgcactcagctcgtagatccacacctgcagctgccacagcgggtggtgcttagcttaggctagcctagctgcgcctgcgcatgctcgtgaccaatggcgtccagcaaggtgccactgttcctcgtcctcaacctcctgctcttcgcggcggccaacgcctgcccttactgcccgggcaacaatggccacggtagcagcgggcaccatggcggcagtgggcatggcggcggtggcaccggcggttccggtggcggcagcgggccaggtgggggcagcagcggcggagggtacggtccgatcggtggtggtggtggcagcggcggcggaggagggtacggtccgatcggtgatggtggcagcggcggtgggatcggacccatcggaggcggcagcggggggatcggacccataggaggtggcagcggtggtgggtacggccccatcggtggcggtggcggtggaggtgggagcggtggcggtggcggtggcaacgatggcacgagcggctggtacggccattgcccgacaaacgcgctgaagctcggcgtgtgcgccaacgtgctggatctgatcaaggccaaggtcggcgtgccggtgaacgagccgtgctgcccgctgctgaacgggctcgtggagctcgaagccgccgtgtgcctctgcacggccatcaaggccaacgtgctggggctcaacctcaacatccccgtcaacctcagcctcgtcctcaacttctgcggcaagggcgtccccacgggcttcaagtgcctttaaccatgcatgcacatcatgtgtgcgtgcgtgccgtacgtacgtagtatccaagaccacgcgatgcgtgagtatgacgaagaatacgcgcgtgcgccatgcttgccggccggggatacggtgtttgtggtaatgctgttagtttcgtttcttcagtgtagtatgtagccagggcatgcatgtgtccaagtccaagttcgactttgggttgcttgtacttctccatttcataattgaaatcatatttcagatttgagttaaaaaaaaaaaaacaaacctctgcagctgcaggcggcgccgcgcgtttctctatctaatctttctctcactgtccacgtgttaaaccccctagatttttggccacaaaaggggttcaaactaagcacccaacactgagtttcaggttcttagagtactgttccaagtctaaaattcaaaattatgctaacctcactttggatgtgttttgtactagattccattgggttctagggtaag

SEQ ID NO: 12071 - DNA, 2740 bp, Zea mays
  misc_feature (2655)..(2655): n is a, c, g, or t
ggggtggggggtgggggggggaggaagcagcaagggttaggtagagcagaggtacttgtgagccgacattaaaggtgctgagcttctggcgggaaagtgagcagacgaaagagacacagagcctgtgtgaaaatggaaggaggcatgaattgatgggggagaggtcggaggtgcagatcggcaggcagaggttggatgtcggaggcatgagttaacaaagtggaggtcagatatgaaatcagtggaggctgtggagcagcagctagaactgtgaatcaacgtgcagaaggggcaggagcagccatggattggcgggcagaggttgggtgtcagaggcatgagttgacagtgatagggcggaggtcacagattggtcataggaggcgaaatcattggaggctgtggagcagctggatggaggcgggcagttgttctccccctctcttctctcttcccttctacctctcaattggtgagttgcagggatggggcatgttctcctgggggctggggactaggtggataatttcccctctgcgctaagctcccctgggagcacattgcgccgcgcatccctgtgtaaccgccttttcacacatgcggcatcagtagatgccttggtgacaaattttcatgtgaggctatgctatacacacgcaggtaggttgtggcagatatggcgccttccattcgaaagcagccagacatatctaggcgggcatggttgggagcaataagttgagaaagatagaaaactagggctgagatcgatctccaactacgaccagtattcatctgtctgagataatatcgagatgggcaaaaaagttggaaaaaacaactttattttatatgtaattaaaagtttgtgagcaacatttaagtgtcattcgccgccgtcctccgcgtctcgcgacctccgcccgctccaggcgagcttcgtcgtgcgcggccgcgtctggtgcgacaactgccgcgcgggcttcgagacccccgcatccacctacattgccggagctaaggtgagagtcgactgcaaatcgaagaccaccggggcaaatacatgcagcttcgaggggcatactgaccgcaccggcacctacaacatccttgtcattgatgagcatgagcatgagctctgcgagtccgtccttgtgagcagcccggacaaggggtgtgccaatgttgtggctggtcgtgagagggcccccgtcttccttaccagcaacaacggtgttgcatccaacgttcgtttggcaaatgctctggggttccagaaggacgttgcccttcctagatgcgcgcagatcctcaagatgtaccaggatgaggatgaccgtgtctaattacgcctgagtttagatgtacttggcgagttacaatatatttatgtggtgtctgaaatgttctagaacctctaaatctattactaagagcaacgatattgtcgcttcttaaaccttagtactacggatgttatgagctaataaatatatttcgctaatgtgatgcagttaaaaaaaagtctggtaatgcggccgttatgactgtctagttttgatgatccttgagaaagcatgatactattgcaggtgcttttagctatacaattgtttttcatttgtaatatgataaatacaacatatagttgaatcagtacaagttatattataggatgtataattcatacaaaagacagtcaaaattgcaacagaaaaaataaaataaaagaatattatggcctgtttggattcattcattttggttgtattgcactctactatctcaacgtttagatgctggcttgtgtcaaatttgcaaggtgagaaacagaaacagcttctggcaacctccacatggatacgccaacatgttggatttgtatctagatagcccagcctctggcgaccgatgctagtcgcgttcgtgcctcgcaccaagtcgcacgtcgtcacagcatcacgctcgtcgtcacggccatgccgccgctgcactcgcttacgcgtatcacgcccgtctattatcccctagatatcgccgtctgcccctaaaacccgtccgacgacccctcccctgtgcacgtgtttatgccgctcgcctcgcttttggccacgctgagctgtcgcgcgtgtcgttattttttgctcgtatcacacgtgcatactgtgcacgtcgccacgcatcgaccgcatgcaatgtcgcacgtgcccgtgtgttgcgttgttcacacattgttcatgcacaccgtttctgtgcgtcacgcgctttgccgcgcgtcaatatttcacttcacttagaatcacttgttttaaataaatcacatatttaaacgatgattattcgagtagcaaatcaatcaaagctaaataataatcttatttatgcatatgataaatgcctgctaatatgactaggtcgaattaaatattttaattcatattcacttagagtaaacgcgatgtctctcgaccgtagctttgaccgtcgcagttccttttcttgcgtaatcgtaaatgcgaattctacgtcatgttgtatatttaatcgatctattcttttgtatgatgtattgtttctttctttttcaagaacgttgaatgtatgtttgcattcgtatagacaacagtccgtttgcgaagtccgaaggagttgcangaaaagaccatgtgcaacagctgtttgatgaaggcaagtgtcatctgactcatttatgtcttattcacatgatggttcatttacc

SEQ ID NO: 12072 - DNA, 877 bp, Zea mays
gtgccgcgctcggggcgaccattattcctcttcacgcttcacacgcaccgcccgcaggccgtcatcccacgcattcgcatccttccccgctctcgctctctcagccgcagagccactcgtgtcggtgacggcggcgaaggcaatgtcatccctccgcccgtccctcctgctcgtggtgtcgctgctcgcggcggctctgcttgcagcggcgccgtcctccgcgtctcgcgacctccgcccgctccaggcgagcttcgtcgtgcgcggccgcgtctggtgcgacaactgccgcgcgggcttcgagacccccgcatccacctacattgccggagctaaggtgagagtcgactgcaaatcgaagaccaccggggcaaatacatgcagcttcgaggggcatactgaccgcaccggcacctacaacatccttgtcattgatgagcatgagcatgagctctgcgagtccgtccttgtgagcagcccggacaaggggtgtgccaatgttgtggctggtcgtgagagggcccccgtcttccttaccagcaacaacggtgttgcatccaacgttcgtttggcaaatgctctggggttccagaaggacgttgcccttcctagatgcgcgcagatcctcaagatgtaccaggatgaggatgaccgtgtctaattacgcctgagtttagatgtacttggcgagttacaatatatttatgtggtgtctgaaatgttctagaacctctaaatctattactaagagcaacgatattgtcgcttcttaaaccttagtactacggatgttatgagctaataaatatatttcgctaatgtgatgcagttaaaaaaaaaaaaaaaaagccccaaaggcccctcgagctccgcgtgc

SEQ ID NO: 12073 - DNA, 985 bp, Zea mays
  misc_feature (951)..(952): n is a, c, g, or t
  misc_feature (954)..(954): n is a, c, g, or t
  misc_feature (968)..(968): n is a, c, g, or t
ctcgaggccggccggcacgcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtccaccacttcgtcgcccggctcaaccaggacgtcctccagtgcgccgtctacgactccgacaagccctcggcccgcctcatcggcgtggagtacatcgtctccgacaccatcttcgagggcctggccccggacgagcagaggctgtggcactcgcacgcgtacgaggtgaaggccgggctgtggaccgacgtcggcgtgccggaggcgctgcagagctcggagatggcgagcctcgcaaggacgtacggcaagttctggtgcacctggcaggcggaccgcggcgacgcgctgcccctcggcgcgccggcgctcatggtgtcgccgcaggccgccgagcccggccgcgtgcgcggcgagctggtgcgcggccgtgacgagaggtacgggatcgacagctcggcaggggggctcaaggcggcgagggtggagatggacgagccggagtggatcaacccgaacgccgactactggcggctgcacggcaaggggttcgcggtagacgtcgtcccggccgagatgaagcgccacgcgcccttcccgtgagctgcctgccggtcttcgttgttgtgacacgtccgtaaggagcataaagatcgttcttgtagccagaggcgtattttgaagaagaagaaaaagagcttgtgttgcgtgccaaaaaaaagaaagggggggggggccgnngnaactagaaactagntctagttctagatcgcg

SEQ ID NO: 12074 - DNA, 2925 bp, Zea mays
  misc_feature (2601)..(2601): n is a, c, g, or t
ctcagcatttgacccggccggccgattccgatccacgcccactactctagttgtctagcatagacatggaccatggacatggccatgatgggcttcgatgaggacctagaccaggtgctggcggcgatgggccccaccgacaactcggcgacgtcgtctgcgcccaacgccgccgcaccagcaccaccactagctgtcgtcccagcaggcagcagctaccatgaggaggaggccgccgcggatagcgccaacgaccttcgtaggggcccctggacggtggacgaggacatcctcctcgtcaactacatcgccgcccacggcgagggccgctggaactcactcgcccgctccgcgggcctgaaacgcaccggcaagagctgccgcctgcggtggctgaactacctgcggcccgacgtgcggcggggcaacataaccgccgaggagcagtgtaatgttacatccatacttactttttttttgtaggagacgagaaaatgcagttgggagagttacgatgacaaagcagaggtgatgtttaagtcctagctcggcgccaagatctgtggcgccaagctaggtgccacggtagccgacgcgtcagcaagctcgaagtcgagccatgttagctccgcgtcacagctcatggcgccgatctttagggctaaaattgcatttaagtgttttatggtttaaacgtaaatatttctcgaaaatagaactgaaaaaaaaatcgggcataattctcgcgtcgtttcctgtgacctgtgtgggctggtggcaatcacctacttttgcttggccatctgacatctgtgaggtttagttgcatgcgagatgccacgttcttcatctaggcggcacgtgttggacggctggctggctcatgagccgcgagcccgacaatataaagccacgttcattcccgcagagcccgtccgacgcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtccaccacttcgtcgcccggctcaaccaggacgtcctccagtgcgccgtctacgactccgacaagccctcggcccgcctcatcggtacgcgccgccgccgccgccgcgcgcccgttattacaggattattacagctgcgtgactgcgttccgtcccctcacgtacgcaggcgtggagtacatcgtctccgacaccatcttcgagggcctggccccggacgagcagaggctgtggcactcgcacgcgtacgaggtgaaggccgggctgtggaccgacgtcggcgtgccggaggcgctgcagagctcggagatggcgagcctcgcaaggacgtacggcaagttctggtgcacctggcaggcggaccgcggcgacgcgctgcccctcggcgcgccggcgctcatggtgtcgccgcaggccgccgagcccggccgcgtgcgcggcgagctggtgcgcggccgtgacgagaggtacgggatcgacagctcggcaggggggctcaaggcggcgagggtggagatggacgagccggagtggatcaacccgaacgccgactactggcggctgcacggcaaggggttcgcggtagacgtcgtcccggccgagatgaagcgacacgcgcccttcccgtgagctgccggtcttcttgttgtgacacgtccgtaaggagcataaagatcgttcttgtatccagaggcgtattttgaagaagaagaaaaagagcttgtgttgcgtgcctgctgttgcttctctgtttgcagctgcagtctaaaaagagcacctgcgtggctgcgtcaaccccgattttagctattggctttgattaatctaccactcgtcgtcgtcgattataggtgtcaaaagaaaaggaaactaaagagttaatcttgcgataattttaagaatcttatgcaagaaaaaaagaaccagaagacaacttcgacctcaagaagcaagaaaactgcttatgagaaattgttttgctagcaggtgacttggggaaaggaagcaaaggtttcatcaacattttagctatcgacttatcattttttaaaagaaacgatagtactcacagagcaaaggtacaagcaagaaaacaggatgagatcctctctcgcctctgttgaaccctcatctcccactttaggccttagtcccctgttggtaggtccatgtactcgggaacgggtcttagtactcgggaaagagacacgtggtcaaacgggtccaagtatgaacgagtcctagtactcggaaaagagacacgtggtcaaacgggtccaaatatacgagaaagaggggaggttccaagtatacgaggaagagggacacaagtatacgaggaagagggacacgggaaagagtctgttgaaccctcatctcccactttaggccttagtcccttgttggtangtccatgtactcgggaacgggtcctagtactcgggaaagagacacgtggtcaaacgggttcaagtatacgagaaagagggttccaagtatacgagaaagagggacacgggaaagagtctgttgaaccctcatctcccactttaggccttagttccctgttggtaggtccatgtactcgggaacgggtcctagtactcgggaaagagacacgtggtcaaacgggtccaagtatacgagaaagagggttccaagtatacgagaaagagggacacgagaaagagtctgttgaaccctcatctcccactttaggccttagtcccctgt

SEQ ID NO: 12075 - DNA, 1642 bp, Zea mays
ctcgaggccggccgggtcggacctggcttcaggccccccgggctccgcgccgggccggcggaaccaaagccgccaccgttgccgtagccgtgttcttggactctgttacgtgctgccattttgccaaggctagccccctcctcctcttcttcctcttcttcttttcgcgacgatcagagaagaagatgacgatcaccattgaacagccccagctcgatgcggtggcggagaggaaagtccccggcggaggtgaccccgcggagctggtgctcgacgccggcttcgtcgtgccggacgccaacgccttcggcaataccttcagggactacgacgcggagtcggagcggaagcagacggtagaggagttctaccgggtgaaccacgtgaggcagacgcacgagttcgtggcgcggatgcgggcggagtacgggcggctggacaagacggagatgggcatctgggagtgcatcgagctgctgaacgagttcatcgacgacagcgacccggacctggacatgccccagatcgagcacctgctgcagaccgccgaggccatccgcaaggactaccccgacgaggactggctccacctcaccggactcatccacgacctgggcaaggtgctgctgcacccaagcttcggggagctccctcagtgggctgtcgtcggtgacaccttccccgtcggctgcgcatacgacgagtgcaacgtccacttcaagtacttcaaggagaaccccgactaccacaacccgaagctcaacaccaagttgggggtctactcggagggctgcggcctcgacaaggtgctcatgtcatggggccacgacgactacatgtacctggtggccaaggagaacaagtgcacccttccttccgcggggctgttcatcatcagataccactcgttctacccactgcacaagcatggagcctacacgcacctgatggacgatgaggacaaggagaacctcaagtggctgcatgtgttcaacaagtatgacctgtacagcaagagcaacagcaggatcgacgtggaggaggtgaagccctactacatgtccctaatcgacaagtacttcccggccaagctaagatggtgagaaggggcggcctggcctggacctggatgatagatggaaccccaaggccccaccaagagctgtcgttccaagtgtccatgtaccatatacatatctctactactctataagactctattgtagaccatccgtgcaccgcggttctgccactctctgttccgcccaccaccggtcgtatgacaggtgggtcccatgtgtcagtccatcacgcttccgtccgaccgtcatccagatttccgtgatacagccgtctccacgacgagattggcgacgtcctccctgcgcccgcagcccccccccccccccggctgccgcacgcatgcccctgcttcactcacgcccggctcctccctcttcgctcgactccccacacggtcgtcggtcgtcgctcctccttgagtagaactagtatatagactacgaatacagtatgtgtgccatgtacggtcattttttacagagttgagaagagtacccatgccgtttcgaataaaagttgcctgcgtttgttccttcaaaaaaaaaaaaacaagccgccc

SEQ ID NO: 12076 - DNA, 1283 bp, Zea mays
gggaccctcgccgcccgccccggaaccaaagccgccaccgttgccgtagccgtgttcttggactctgttacgtgctgccattttgccaaggctagtctccttctcctcctcttcttcttttcgcgccgatcagggaagaagatgacgatcaccattgaacagccccagctcgatgccgtggcggagaggaaagtccccggcggaggcgaccccgcggagctggtgctcgacgccggctttgtcgtgccggacgccaacgccttcggcaataccttcagggactacgacgcggagtcggagcggaagcagacggtagaggagttctaccgggtgaaccacgtgaggcagacgcacgagttcgtggcgcggatgcgggcggagtacgggcggctggacaagacggagatgggcatctgggagtgcatcgagctgctgaacgagttcatcgacgacagcgacccggacctggacatgccccagatcgagcacctgctgcagaccgccgaggccatccgcaaggactaccccgacgaggactggctccacctcaccggactcatccacgacctgggcaaggtgctgctgcacccaagcttcggggagctccctcagtgggctgtcgtcggtgacaccttccccgtcggctgcgcatacgacgagtgcaacgtccacttcaagtacttcaaggagaaccccgactaccacaacccgaagctcaacaccaagttgggggtctactcggagggctgcggcctcaacaaggtgctcatgtcatggggccacgacgactacatgtacctggtggccaaggagaacaagtgcacccttccttccgcggggctgttcatcatcagataccactcgttctaccccctgcacaagcatggagcctacacacacctgatggacgatgaggacaaggagaacctcaagtggctgcatgtgttcaacaagtatgacctgtacagcaagagcaacagcaggatcgacgtggaggaggtgaagccctactacatgtccctaatcgacaagtacttcccggccaagctaagatggtgagaaggggcggcctggcctggacctggatggatggaaccccaaggccccaccaagagctgtcgttccaagtgtccatgtaccatatacatatatatagactacgaatacagtatgtgtgccatgtacggtcattttttttacagagttgagaggagtacccatgccgtttcgaataaaagttgcctgcgtttgttccttccaaaaagaaaaaaaaaaaaaaaaag

SEQ ID NO: 12077 - DNA, 1652 bp, Zea mays
tcgaggccggccgggagtcagacacggcgcgcccgcccgcccgcccgccagaaacctcacaccgccatcaccatcgccatcgcataaactagacgagaagagagagagagggagagaggggaaagttgattctctctctgacccgcccactccctccttccctgctccggtcgcactccgtcgttcctccgcgcacgtacgtacagcagccagacacgagatcgagtggtacagggcccgccagaaacctcacgagctagctggttcctgatcggcggcctgtgccgcgcgccgatccacgcatggcgccgccgctcctgcccgcgcgcttcgtcgccgcctccgtcgcgctgctcgccgtcgccttctcctcctctctaacgcgtccgtcaggtgcatacgatccgctcgatccgaacgggaacataacaatcaagtgggacgtgatacagtggactgcggatggctatgtggccgtcgtttcgctatacaactaccagcagtaccgccacatccaggcgccggggtggaggctaggctgggtgtgggcgaagaaggaggtgatctgggcgatgaccggcggccaggccaccgagcagggcgactgctccaggttcaaggccagcgtcctcccccactgctgcaggagggacccggaggtggtggacctgctgcccgggactccctacaacacgcagaccgccaactgctgcaggggaggagtgctcgcctcgtgggcgcaggaccctagcaacgccgtcgcatcgttccaggtcagcgttgggcaggctgggtccaccaacaggaccgtcaaggtgcccaggaacttcaccctgctggcgcctggtcccgggtacacctgcggagccgctaagcttgtcaagcctaccaagttcatgtctctggatggcaggagatcaactcaagcgcacatgacctggaacgtgacgtgcacgtactcgcagttccttgcccagagatctccaacctgctgtgtctcgctctcgtctttctacaacgacaccattgttagctgcccagcatgctcctgcggctgccgccagaacaacagcagcaccgccgcgccaggaagctgcgtagagtaagtttattttgcatccacggcgatgctatggggcatcaagtactacaacgatctgctcatgacggccgggccagacgggaacgtgcagtccgagcttctgttccggaaggagccgtccacgttcaccttccacaaaggatgggccttccccaggcgagtctacttcaacggagacaactgcgtgatgccgccgccggacgcctacccgtggctgcccaacgccgcctccccgcggctgtcgccttcgcttctcctcccgctcgttgcggctgcttggacagcattcgcagtcctttcgtgatgtcccatgacgagttctgacctgattcggcgttgctgcttgctgctgatcattagtctgttgccaagttttatttggtgtcttgaatcttgatccaggaacaggttcagatgtgcagtcacgtactaccaagcatgtacattcccaatacttgtaaatttctgcaaagactgactggcaagtgacagtagaaataatctgtttctctcaaaaaaaaaaaaaaaaaaagggggggcccggtaccca

SEQ ID NO: 12078 - DNA, 2075 bp, Zea mays
ctgcaggcaattcctctcgcacaggaaaaacccttacccgaaaatactcatctgtcgaggtccattccggaaaaccgcgccagcaggcccagctccaaccaccgctcgtctcgtctccttcctcctctgcttcctcccgtctcgtctccgacgacctcgtctttcccccccagccagcctcgcctcaccgactccccgatccggtccctcccttcgccagctatgcatccctcctccggcgcgggggactacgccccttactacccaccttacccctccccggccgcgccgcctcccgccgcctacccgtcggtgtccgccccggcttccgcgcccccgtactcgtcgtaccccgcggacttcgcccccgcgccttcgtaccccgcgtacccgcccgccgacctcccccactacgcgccgccgccggctgcgcccgcgcccccgcagccgtactacccctacgagccggcgccggcgccaccgctgccgccgtccccgcacaacccggttccctctccgtacccgtcgctggatcgggcggggagctacggctacggatccggccctggctccgggtacggccaggagctgtacccgcccaagccggcgggcgggtggtccgacgacggagcgtacgcttacaacggcggcgacgcgccggagccgtacgggtccaggggcaccgcaccgaggccgggctcgggatccgcgctgtttgatgactacgggaggtccattggctcagctgccgataggggtggccgtgggggtagcgcggccagccccaaggtggtgagggccgtgcccaaggcagagacatcagaggacgtcaggggtggggtgcagaagttcagggtcaagctgctgccggagggcgctgggagccccatggatgtgctctgtcaggttggtctggatggaattcggatgcttgatcccaacactggtaggacactaagaatatatccccttgaaactgtaactagatgcgatgtattagattcctctatttttgccttttggtccaagagttcggtggatgttgaaggaaaaagaataaggctgaaatcaaacagctatacatccaacaccattcttgacactgtcacagctgcgactgtgcagttcaaggagatgggtgaaagcagcatttcaagaagtagagcaattgctgatgcatccaagcccgctgagcagcaaaatgagaggaagaaaaatttccttgattggaggaatttaatgaagcctatgaatgaggagaaagatcactgggtcccagatgaagctgtcagcaagtgcacagcatgcgcagcagatttcagtgctttcaaccgcaggcatcactgtcgaaactgtggtgatattttctgcgataagtgcacccagggaagaactcctctgactacagatgcagatgctcaaccagttcgagtttgtgacagatgcatggctgaagtaacgcaaagacttaacaatgcaagggaagtggctaatcgacctattgttcacagccacgaggatcttgccaaaaaacttcaggaagccatggatataaataaaaggtcgtcttcaggaacaaggtcttcagatgtttctggcaagcggatgcgggaggtcgcatgcccaacctgcacggtccatcttcaggtcgaggttccagcttctggttcggagacgatagagtgcggcgtatgtcagaaccctttcctcgtcagcgcccgttgaaccgagttcagcggcttcaggcaccgtgcggcggagtcttctcggattcgcaagcgaagagtcggtcctgttcaatcgagcctggcgctgaattccggctatccctgtctgtctgtaccctaattctgcacggaagtctgtcactgcaagttgttagtaagttatatggatgagttgagtcgtttgcaagttgttagtacagttgtgagttgctttgagaagcaagcagggtcatgtgtttgtactgccaacaactaactttgctgttgttacatgagaaaaaaaaaacggtgtaaactttgctgttgctacatgagaaaagtgcatggatccgaaaaaaaaaaaaaaaa

SEQ ID NO: 12079 - DNA, 1289 bp, Zea mays
gttagtacagatagatagagatttggcacaattctaaagtcgtactgacgtgctactacctttggaaaagtctattcaacgtacgtactgggctggcacgccactataaacccttttcaccagcctttggaagtggaactccctcacttcggattctagagaaagtggcagagtgccagtctatgcatgatagaaactttcctgcgtgcattttttatttcacatagaatttcctatatcctagactctagagcatggatggagactggaaaaaattttaggggagactgaactaaactgttacgcaatcatggagtcgataaaactgcacgaattttaggattagaatatgttttaccgaataattctatgcaataatggagttgataagtgcatgagttttagtgggagttgcattgtatgtgtgatctgactagctagtggcgcacccagatcatggttagcggtctataaatacaaatgcaacattccccgcccggcactatatacgtatatagacgtggtcaggatgacgtcgtcctccgtcttcttcctcctgctcgcttgcttcgccacatgcgccggcgccgccacgttcacggtacgaaacaactgcgggttcacggtgtggccagcaggcatcccggtcggcggcggcacgcagctgaacccgggctcgacgtggactgtcaacgtgcaggccgggaccagcggaggcaggatctggggccgcaccggctgctccttcagcggcggccggggccgctgcgcgacgggcgactgcggaggcgcctactcctgcagcctgtccgggcagcccccggcgacgctggccgagttcaccatcggcggcggcagcaaccacgactactacgacatctcggtgatcgacgggtacaacctgcccatggacttctcgtgcagcaccggcgccgccctccggtgcagggactccggctgccccgacgcgtaccaccagcccaacgaccctaagacccgttcgtgcaacggcaatagcaactaccaggtcgtcttctgcccttgatgtacatgcatgcagcttgccatgagcccatgcatgcatgagagcgtagcggcatatatacactaattgtccgtcaactcacatgcacgtacctactagtgaagttgataaataagacgatcgatatctgactcgtccaatgcagcatgtgtgtacggtgtgatccttatactttcctacatatatggaactttttaaagtgagtaaagtgcactaccaatgattaattctcaaaaccgcggcc

SEQ ID NO: 12080 - DNA, 3191 bp, Zea mays
attatgtttgtctttgctgttcggtccccctgaaccgccgaagccagcatccacccgacgcccgtgagttttttattgttctcgctcatgatgtgttttacccaatagtatatatacgaataaagttgctgagaaacagatttgtcatttcttatcaagaaagcattcatgtagagaaacactttctgtcgttatatagactgccattattatgagggaaaaacacattcttacaagacaaataatcatcgaaggttttctccagcacttgctcaatcgacgtattatttgggccaactgcatgattggaagaattttcgggtacttcgggaatacccgatatccgaatccgatttttcggtacccgatttttcgagttgtatgaaacccgatgtgatttcgggtaacaattcttatagcccgaaatttaaataaatttcatgcaaaggagattttcatcgctaatccgggagaaccgaattggctcttctcactgggcaagtcaagcctcgcctggctaagcaaggccaagcaaaagctggtcgcacatctcatggatcacgtgacccacctggccatcggcatcgccgagcgaccgaatgacggagcactggacagtctggacaggacctccaattgttggtaaagtatgtgctgcgcctgcgctggccaatttcttggagcccagccgtgacgtgagaaatgattccaacgacaaagctagtcacatcatgagaaagagtgagggttctcatcaaatactctaccgcctgcaggtgcagaagattggaacaaggatagcctttcttcctgtgcagccactccagtgcacgccgccgcagcttgctacacgtgccgggcaagggcaatggattccagcagcagagtgatcgccttcgattgcagctccttcaaactctacatggacggccaagtcgagcgtgcggcccaacgcatggaaaccgtgcccgccggcttcgacgcggacacgggcgtggcatccaaagacgtcgtcatcgacgtcgccaccggcgccaccgtgcggctctacctaccaccagtccagggagccacgacgaagctcccagtcgtcgtcttcttccatggcggctacttcatcgtcggctcagcccgcgagcctatgtaccatcgctatgtcaactcgctggtcgccagagcacgcgtcgtcgctgtctccgccgactaccgcctcgcgccagagcacccgctcccggcagcctacgacgactcctgggccgcgctcaagtgggcggtctccggcgcggaccagtggctgtccgaccacggcgacctcggccgcgtcttcctggtcggcatcagcgccggcggtaacattgcccacaacatggccatctctgtgggcgtgagcggcttgccggccgctgaaccaccgcgcatagaaggcgtgatcctgctccacccttccttttccggcgaacagaagatggatgtagaagaagaggagttctggcgatctaacaatagcaggtgggcggtcatcttcccgggcgcgaccggcggggcggacgatccaaggattaacccgatggcggacggcgcgccgagcctggagaagctagtgggtgaaaggctgctcgtctgcacggcgtctttggacccgagggcgccgagggggcccggatactgcgaggccgtacgggccagcgggtggcgcgggaaggtggagtggttcgagacggaaggtgaggaccacggtttcttcgtcctcaaccccggcagccacaaggcggttgaggtcatggatcgagtggttgctttccttgcggaccagtgatgacctcctcagggcacagcaaggtctagcagctcgccgcaaaaccggacgtcctagctacggcgcagccgttctcaggcgattgtttactgtctgtactcccaagagtgtcctagatgagttattggaataaacactacagtcaattcaaaccattcagagatgtgggatatggatatttggttatgttgtggtgcaattataaacatcaagtcaataactttgtttacctgtgaaaagcattaaactgcttataaaatttgttaattgggcgcggagaatgagcttagctaccaagctatgacaataaacatggtatcatggacatgaatctacagacagctgcagagagcaaacagatggacatgaatccacagagcaaacttcttatttggaccgcaataccatctccaaaacagatactgttgtttgtatcgtggtccaaacaaataagtatgaaactgaagagagtatcagattgaaagatgaaaagtaggagggaatagaatcaaccgttggttctcaggcacaagtttgagtcacactgcccatattgtttcaaaggaccagtcaagatgtatgtcgaaactaacttatcaaatggtaaccataactcactgaaattagcacaagaaatttgcacaaccatcagcagcgtacaaatccaccttgcatatgtgaaaccaaaatttcgaacttaagctgctaccccaatatcaggatctgagaaaaaaaaacctaaatggagccaaattacaatgcttagggccattttggattggcaaggactagttagttcaagtaaaaaaataatcgtttaaagtttacaactaaagtttaatttaggggtgtttagatccccctgctgaaagtttatggacacctattagtggattgctcagttaatggactagttattagttgagggctggactaaaagtttaatccacccattactctacatgcttgttcgaactaggattgttttctagctactagttagtccaagtgatccaaacaggtccttagttgaagcaggcatgtagtacaaatagagcagtgcacctattgcagctaccaaatcacagcacaagtacttttcatctatctgattcacatgaaaacaaatcacgggaatgtatttccaacattgttcatcaggtgattccatactgaaatcgaattaaggttaataacggtattgtttgtttccaagttactaaaacccatcactgcaggttggcatgttgccaaaaaaagggatacaaggtggctaagttcattattgcatatggtagaaaaagaatacgaggtattatatcaatccatgtcataaacgtgggctgatagcatgatgcatcctttgataggatag

SEQ ID NO: 12081 - DNA, 1589 bp, Zea mays
atgcttgggctcgtcggcaaccggacaggaggacagcaaggcggaagcgcaaccgggcgtcgctggtccgacgggcggcacgtgtcagggagcgtgacaggggcggcagatccgggacctccacgtccgtatccatatccacatccatccatcaaacacggaagagagagagggagggagggagaggagagattattttggaccagttccaccgcttaatttgcaggaccgccaccccccgcggcgccgacgatcacctcaggcgtgcgcggatatggggcgccgcggctcctccgaccgcctcgaggcgctctccctcgagatcgagcgcaagctgcacaaggccctgatgtccaactcacagcgtcttcagatacttcagcaattgtttgctgacatcgcattgaaggtggatgaccgcgctcgagatgcaattatgagtgagaatgatgatggcattgctccagcagatgaacgggaggatggttggctatgcttctatgagattcttgccaatcattttgttagagtgcctgaaagtggcaggcgtatacttgagttgatagtgcaactctggagccagtccttcgcggccaacatatttgcacttcttttccagaaatggttgtttgaagcccctcttgatgaaaaagaaatatcgctacgatatagctctgctcttgttcaaggtgctacaaatgtattttggattgacatacagacaaatacaagacattttctctctttgtatcattatctccttgaggacgttgctctagtccctgaaagacttagtaaaatatcattacaggctggtagagaccttttccttctgctctctagattcatgttcttctatgatcaagatcacatgctttctagtttcctagagcattttcccaatttcccaaattccttcttggttggtggaccagcagattactttgtaattgaactcgctgatcagcttcaaaagctaaaaattgagccagtactactacactacctctcccgcatgagcatacttcaagggttggaactgaggttgagtacaagcaccagactaaaggcctgcctctacagcttcacttctcctggtggccctacctacccaacacgggcggtgcggcacgcagcctggaacaccttggatttgctgttccctatcggtcgttacccgaggcacgtgatcagcctgttcttccggctgctgtatccgtggtactggccttcctcttgctggaacttcgtgatgacctgtgccatgaccgtgtactactacatcctgaacctgctggtgtcgtgttgggagaacatgaggcggcggcccagtcaccggagaacgcacggtgaatgaagacgcggcggcccatccagtggcaccttgtgttgttgttgttgttcatttttctttcctttgcgcgagtggtgtagtagttagtagcagcggcttatgtgttcgtcgcgaaacaacattccctgtataatataaactgctgtacttgttcagttgttgttcatataggaagagccgaagaggaacggctggtaatggaggggagcgtgtgcatttaaaaaaaaaaaaaaaa

SEQ ID NO: 12082 - DNA, 1478 bp, Zea mays
atatactttcgagttttgcaaatcaaaacaaaaaatcctcagcccgtctcctttccaaatttttcacccggcgtctgctcgcctgcgagacgccgcgaccgcgatcaccctctcgggtttctcggacgcgccgccatcgccactccgccactcgcgggttcgttggatcgacgccaccgtcacctcgcgccgcccagaggaggacgcctgcttctcccccgacgccgacgacccccgccaccgtcttccgcgccaacgccgccgtcgccatcacctcgcgtcgcgccagacgcccaggtctccgccgacgctgtcacacgccaggagctcgagtcttcgtcggtccctttgccagatcttcatcgtgcccttcaccagcgacgagcacccaacagactactcctgctgtttcttattgccaataagcacaagcacacttgagaaccggccatcaccatggagacgagactctttatcgcccttcagtgcgtgcagtgcgccaccatgcaggtgaagcagcagaagaggagcagcaacaagtgggtgtgtgtggtgtgcaaccagcgtcagtctgtgcttcatgtccatgccaggggctatcgtgctgctgatctccgccgcttcgtccaggacaccaaccttgcccgtggccgccgggagttcgcaccgttggccgagcccgacgtggacagagatctggcggcagttgaggagggagatgtgttccctatcgagaagagtcagacggagtggtccgagtatctggacgatccaggggagacaggtaaaggttgtggtggccttggcgcagatgcttcagatggagaatcggatgaaggaattgaggtgataactgaactgcctcagaaaagacctaaagttaggcctcgcaaagcccaatcagatgtagtaggaaagagaaccaagctgtcaacacatcccactttatgtaataagaggcagcagatcaagcaaggatcaagtccccactgtgcaactactactgctgaagcacaaggatcaaaatggaccaagtatttggacacgagccgttttggtgggaggaaatgctccgatacctctggtctgcactggactgaacatgatgaatctgccactactgaggccactactgacgtagtggtggatgatgaggtgcaccctgatttcatctgatctcatgttggtttgaaatgccaaatgctttgtgttttggtagtgtgtagtttggtaggcataaaatgtgctgctggcagcacattgtcaagacaaaggatgtgcagtacttggtatccgagggaagaagactgttgttcccaagatgttatccagtatgatgggcaattcatagtaaaagcaccgtgctagtcaaaatcagcccaagactattgggttgttttatctctgatcaaaacaccagtatagtcaaactcagtcctctaatcaaatctggcttaagaccaaaaaaaaaaaaaaaa

SEQ ID NO: 12083 - DNA, 1627 bp, Zea mays
gcacgagaccattacctagaccaccctagccgcccaaaggggcggcattcagtgattcagccgccagtcccgctcgtctctgccaagtcccgcgcgctcgagcatcgatcagccgctggcgccgcgacgagcgacgacgccgcgccagtcgcagatggccgccgtctcgctcctgcgagccgcggcgctcgggctggttgtcctcgcgtcggcgctgccgtcggctcggccgtggagcaaggagggtcacgtgctcacatgccaaatcgcgcagggtctgctggagcctgacgccgcgcacgccgtgcggaacctgctcccggacgacgccggcggcgacctgtcggcgctgtgcgtgtggccggaccaggtgaggcactggtacaggtacatgtggacgggcccgctccacttcatcgacacccctgacgaggcctgcagcttcgactactcgagggactgccacggccccgacggcgccaaggacatgtgcgtcgccggcgccatcgccaacttcacgtcccagctgctgcactacaggcacggcagcgccgacaggagatacaacctgactgaagcccttctgttcctgtcgcacttcatgggagatgttcatcagccaatgcacgtggggttcaccagcgaccaaggcggcaactccatagagctgcggtggttccggcacaaatccaacctccaccacgtgtgggacagggagatcatacagacggctctcgccgacttctacggcaaggacatggacgccttccgcaagcagctcgagcacaacctcaccaagggtacctggtccgacgatgtatcggcttggacagactgccaagacctctcgtcttgcccaaccaagtacgcgaccgagagcataggcctggcgtgcaaatgggcgtacagcggcgtccgcgaaggggagacactgtccgacgactactttgactcgaggctgccgatcgtgtcgcggcggatcgcgcagggcggggtgcggctggccatgttcctcaaccggatcttcggcgcgcacaaccgcgacgtgccgccgccgtcttcttgattgatggatggacccgatcccgatctgcctgtcgcgtcacagactcgaagtctaatctaatccatgtggttgtagtgtctttgcttctttttaagtaaataagtaattcataattggcagcagctcgtgtcgtgcagtccaagccatgcatggatggccctgtaacctgactcctgttgcgttagtctctgtctgtataccgatatacagttatacacacaaatatacattccagaattctctgctttatacgccgcctgagggatatctcaactgaactttcactacttggatatctcaactgaacttacgtgctagaaacttgtgtaatctacagccggtaaattgctatctgctgtataatgtcaagatatcagcagtagcagttttgcgtagttgcgaggcagtatgttgcctttggtttgaatagagtggcagttttgtgtagtatacttgtagtcacaactattctaggcctttgattagtagtatagttctcgtcgtttatctagattctagcactagcacccgtgtgctgcataagcactgaggtatgctgca

SEQ ID NO: 12084 - DNA, 7601 bp, Zea mays
  misc_feature (1373)..(1373): n is a, c, g, or t
  misc_feature (2105)..(2105): n is a, c, g, or t
tatattctctttttctaaaaattggtgtttactgtttatacgagtagttatacacactaacacacatgcacatatacatcatcatgtatattatattgtttttctggattatattaaaactaaaaataactaaatttctaacaaatactgatagcctgaggcggtagctgtcgcggattgatcgggattacatagaatatatactggaattaatcggtcgggggtccctaaatggcaactaaattaatcagcactcagcaaccgagagcaacgagacaaaacatgcaaaatagtagcagtgtaactatcagctcgttggattcgatcattcgattggtgcatcaggtcatcatcgatcagcatgggacgacgggacgggacgggacgggtactgacatcatgtgatgcatgagctgttcgtccaggattgcaatcgggccctcctggctggggtaggtggagtggagcacggggcgtctgcgcagtccgaaccgctacggtgtgtttgttttttcatgggcatttcatgagagttgtattattattaaacaacatgccacataagcaagcggatgacatgttatgtaatttaattaagagagatataaaagagttttatgagaagagagtataagtactcgagcattcagaatttatgctaactatacgtgtatttagaatttccacgcgatacatgtgaccggaagggttcgtattttttcaaagaaaaataaactaatttctcttagaaaaatagaaattctatgaaagatagagttgacaaattagccataaatttgaaaggtaccaaatatgatgttttataatatactaaaatatatttacgacaaggcttacatctattataaagcattgctctccatacctcatagagacgattggctcgaggagcactcgcatagtagagaaacacaaacacgtcacttgatccacagtctagtatccattcggtgttttttttattgaacgtaaagtaagggctagcgttctgatacttaataaggactcctttgaaaaacaggaatttcacaagaatagtataaaatttcacatgaaattgattcgaaaatacaaaaaaaagaacgtaggattcatgaagttataatcgtaccaaatattttctcgatataattttagatatacgtgtagagctgaacctttaaaaaaaagctatattaataaagcaaaaatgtactggactgcatctaagatttaaaaaatgtccattctgatattaggcaaagcagagagcgagctcggtagtagagtagagtagttgcttggtgcgatggtacccaacaccgtccatgggcctcgcaccgccgacgccgagcatcgccagtgctcatgantcatgcccgtgccggcaactgacacgaatcagcaaccgtaacgaactgaactaaacgctccgaaatgataatgccgaaccgaacggacttgttggtaagctgacgatctacgagccgtcacgagacacaagtgattcggtggagataggcgcatcagcagcagttcagcacttctgctaactacacaacctggttgtgtaacaaggtgcaggtaaaggtaaaggtgcaggtgcaacactagatcagctcgatctctcctgcttgcacagctggctgtcactctcgcgactcgcgaggccatggaccatgtccatgggtgatcggtagggatagctgccgcgcatgctgcacggtgcggggggagatcatgcgggccagaagttttcgatcatgcggttgcgcgtagctgtcgagtgtcgacgcaggatcagaagcagcagcggctgctaccgggaccgggcgctcgcggctgcctgcgtgcacgagcgcaacaggtcgcctctgtactgtaccgcactgcacgctgcacggggcttaatttggtgccagctgagggacatttcgccgtcatgatgacggtgcgacgtggccggaacggcagcgatcatggtggtttcgagagagaagcgcaaggaatatgggccgggtttttttcaccacaagcacagacggccacgatcatggtggtttcgagagagaagcccaaggaatatgggccggattttttttcancacaagcacagcctaaaaataggaggccaaagtacaatccgacacgaaataataaagatcgaggtagcacggtcctaagtatttctcattttttgtttggcctataaaatagaatgagttgatccaatattaacacatttctcataattaattagtattaatatgagtaatgaggtcatttcaccagatctaaagaatagatttataatataccacctcgagtggttttttaaatcaaacacccacttaatttcacctctatcccactgctccccaccttccagctatgcataccctactccattactccgacatatgaccataccaactttgatgtattttcttattttcaattcaattagtttatatattttagaattttcgattattatgtaatctgtagttttaatttgctaaaaatatttcattatgtcatcccatttatttaaaatagagaatataaaatgattaaatctagaagagagaacatgacgtggtggtgatgcggctatggaccaaggctgcagcgtttgtattagaggagcaaggctgaactagttgtactggaattaacttaaatcaagtttaaaaactatatcacggtaccgacttagctgtacactttcacaggccgacacgttctgatcccagcaagcaatagcattcagatttcggtgcatgaatccattggtttgatggatcttgctaatagataaaaccataaacttaaatgaacttaatcttgacactttaacaacaagtcaagatggccgagttggtctaaggcgccagtttcaggtactggtccgaaagggcatgggttcgaatcccattcttgacataattttttaaatttatttttttcagcttactttactgaatgcatcactgaatgtctgaaactttagcgaatacatcaccgaaccattttttatatttattttttcaccttactttactgaatgctccatggaagtctgaaacttattttactgaatgcatcaccaaaccttttgaatataccattttttcactttgctttactgatgcatcactgaatgtctgaaactttagcgaatacatcaccgaaccattttttatatttattttttttcaccttactttacttaatgcaccatggaagtctgaaacttattttactgaatgcatcaccgaaccttttgaatataccattttttcactttgctttactgaatgcattgctgaaacttttcaatgtaccattcttggtattcaatcttttcaccttaccttgctgaatgcattctgaaacttttggatataatttaactttctttgtttagtgtatgtcgtttaccttttgaagtttatttttctcagtttataggccaccttaccttgctgcatgattgaatctttttaatataataaagcttattgtgtttaatatatatgcttggacttggtagaagttcaaacttctgtctcttccagaaactttgcacagcagttgaccttggagaggttttgcagacttgcagttttctttctaggcaacacctgacctgatgtagctttctgtttgacttaaactcgccacatacccggagcttcaccgtaggattaagaagttgtttcgttcagtatagtgcccagctactccttcacgaggagctatggtattcacaccaaacagatcagcatgctgaaacttgatgtgacaaaataaaaggttgcagccggttttgtcgctatgctattcaagaaatgagacagcaaacaacaatgctcaatggggtgaccaaactggcaaactgtgctccagtgtcgaagaagtggaaggccgcaagataaagaaggttgtgaatcacctggatcatatatctatataatatgctgaagaagacatcaattatttaccaacaagatctggacaataccaattcgtcggaggacttcgacaggccacagtctggaaatagatcaaaatatgatgacactaaggaggatgagtttgattcccaaacttttgtgaactatgcttttcaggacataaagtacatggagaatgctcaagttcgttccattggtgagatctgtgacgatatggttggagtctacaagagtgaagggattgtaatatgcaggccgttcctgactttttagggcacaattattcgtgattgaagtaagcacatcgatactgaattccattttttgtgaatgtgtggagaacggagaacaggaagacatgcatggctcatgtgagtgctaaagaacaactataggatattttgacgaagtcactctggcacgcatgttttgttgatattcatggcaagattgggtatcgtcaaaggtcaaataaccgatacatgattaggagaataattgattactttttagtcttagctaattgatagctaactagatactttctttttttctaattgatcgagattggcataattttttttgcggttgtgagcctttgtaattgtatgtttaagcagatcaacaaaatacagaaagacaacagtgtggtttggtagcaataaaactcgtgtgttcttctagtgttctattgagttttgtgagacgtttgagagatagggatcatctgaactagattcactaacaaaaatctaaaatcccaaacaaataagtaaaacaacagaatagatccttgaaattctcgtaccttagatactaatgagtgttgtcatctatataagctaccatactcttatgtaatctatagttaactgtcataatcgtcagatccgcaccggcttttatacaggttatagttggaatcagattttgaggaatgtactgtgcttgtttgttcttgcttgccatgatacgcattttgccacattgcttttatgatctggtcaaggttttttctagagacatgatcgcaccacctttactgttccttgtgcatgttaaagtcttgtccgattgcgtccagttcgaagagggttgagagagctaaatctcattctgtttaattttgactagtagggatttaatctcctttatttctcttttgactcatatgacgagagcattcttttttttctagataaacgggatatagaggccaggtgggttcccatgtagattgtatcagcatatctaaaagatgatataagcaacaaaagatctgtggagagcactggtccatccctagctttagagcctaaaatgacgagtcggagcaccgatgagaagaaccgaggactcacgtgacgagaccaacatcgtggtacaaacgcctggcgggctgggagctggcgtagttgctacagcccaggggcacgtacattaattcccaccgctctaccgtctacctcatttcacgttcagacaccaaagaaaacctcaagcaacgaaaccgtaaacctccgaagaggaaaggtgagggcgagaaaagaccaaaatattccccgccctccagccggccgccaccccccccccgcggccgtccgtcgtcatctacctcactacctgctcctcactccccgctccactggcgagatggggagaggcttgggcgccgctcccgtctcgccgcgcctcgctagtctcggggcagctgcgctggcgctgctcgtggcggcggcgctgccttccccagcagctggggctgggctcaacgcgacggcggtgctctcggcgttccccaacttcgccgacttcgcgcggctgctggcatccactcccgtggccagcgagctggccgggaggtcgtccctgacgctcctggccgtgccgaacgccaacctgccgcagtcaccctcggctttcgtagccggcgccgacatcgccgacgtgctgaggtaccacgtcctgctggagtacctctccccgtccgacctcgcccgcctccctccctccgggaagctcgtgacgacgctgttccagaccacgggccgcgcgccctccgacttcggcgccgtcaacctcaccgtggggcccaactccaccgtcgtggtccgctcgccggcgccgtccccgggatcgagcgccacggtcctcggcgccgtgaccgcggtcccgtacaatctcagcgtgctcgcggtgggtggccttatcgtaccctccggattcgacctcgcggcctccgagagccgcccgccaccgccggtgaacatcacccgggttctcaccgacgcgcgtgggttctacgtggcggcctccatgctgcaggcttccggtgtagcgagcgagtttgaggccgacgagcgcggtgctggcatcaccgtcttcgtccccaccgacgacgcctttgccggcctccccgccaccgaccgcctccagtcactacccgctgagcgcaaggccgtcgtgctccgcttccatgtgctgcactcttactacccgctgggctccctcgagtccatcgtgaaccctgtccaacccactctcgccacagagcacaccgaggctggccacttcaccctaaacataacccgcgtcaatggctccattgccattgacacgggcatcgtgcaggcatccatcacccgcacagtgttcgaccagaatcctgtggcggtctttgccgtctccaaggttctactgcccaaggaaatgttcagccggggcgattctggcagcaccgccatggtaccaccttcggttgcgatggcgcccggcgacgccgggaccgagcagacaccacagacgaggctctcatccccgcctgatctccacggggaagatagcgagtcgtcagctgctttggcgacagcaaaggggacttcttggtggtgtgtaggactcatgtatctgcatctattactatctctggtatgagattctggtcgtgcttgttgctttcttgcttccttgtgctcagtttttgtattacttactgtctagaacgtctacaccgggagggagggattggggagagaatttcgtagatttaaagtagcaaaaaaaattagttgcttcacctgattattctaatttctttccattttgtcatgtggcaaagggaaataatgtcatgtgtacaaatctatgcagtccttttgctctacaatgaatagtattttctgttttggctaaaaaaaaaaaaaaaagccttctctttttatttgtgcttgaactcaattttggaggttgattttgcatcagattagatctaaaggagtgaattcgatatagccagattagatctgtataggtagttgctatctcacttctgcacaggctgagtttttcaatcttgcaatgctgttatggtatgagtactcatgatagaacgaagttaccctaatatgttagaattagatcacttgactattttgactctagcggcagaactcagatatcatgaatgacaagttggttgtcagctgaggtccaaagtgtaaaagcttttttatgggaacttattggcagcagacacctctgggctctgactaccaaagaaatctggtggtgtaaattccatagtcatgtcgagcactctaggtggattcactgaatctcatc

SEQ ID NO: 12085 - DNA, 1917 bp, Zea mays
aggcaaccgcaaccggccccgtccctctcccggccgtcgtcatctatctatctgctcctcactcactccccgctccactgctcctccactggcgagatggggagaggcttgggcgccgctcccgtctcgccgcgcctcgctagtctcggggcagcggcgctggcgcttctcgtggcggcggcgctgccttccccagcagctggggtcaacgcgacggcggtgctctcggcgttccccaacttcgccgacttcgcgcggctgctggcatccactcccgtggccagcgagctggccgggaggtcgtccctgacgctcctggccgtgccgaacgccaacctgccgcagtcaccctcggctttcgtagccggcgccgccgccggcgccgacatcgccgacgtgctgaggtaccacgtcctgctggagtacctctccccgtccgacctcgcccgcctccctccctccgggaagctcgtgacgacgctgttccagaccacgggccgcgcgccctccgacttcggcgccgtcaacctcaccgtggggcccaactccaccgtcgtggtccgctcgccggcgccgtccccgggatcgagcgccacggtcctcggcgccgtgaccgcggtcccgtacaatctcagcgtgctcgcggtgggtggccttatcataccctccggattcgacctcgcggcctccgagagccgcccgccaccgccggtgaacatcacccgggttctcaccgacgcgcgcgggttctacgtggcggcctccatgctgcaggcttccggtgtagcgagcgagtttgaggccgacgagcgcggtgctggcatcaccgtcttcgtccccaccgacgacgcctttgccggcctctccgccaccgaccgcctccagtcactacccgctgagcgcaaggccgtcgtgctccgcttccatgtgctccactcttactacccgctgggctcgctcgagtccatcgtgaaccctgtccaacccactctcgccacagagcacaccgaggctggccacttcaccctaaacataacccgcgtcaatggctccattgccattgacacgggcatcgtgcaggcatccatcacccgcacagtgttcgaccagaatcctgtggcggtctttgccgtctccaaggttctactgcccaaggaaatgttcagccggggcgattctggcagcaccgccatggtaccaccttcggttgcgatggcgcccggcgacgccgggaccgagcagacaccacagacgaggctctcatccccgcctgatctccacggggaagatagcgagtcgtcagctgctttggcgacagcaaaggggacttcttggtggtgtgtaggactcatgtatctgcatctattactatctctggtatgagattctggtcgtgcttgttgctttcttgcttccttgtgctcagtttttgtattacttactgtctagaacgtctacaccgggagggagggattggggagagaatttcgtagatttaaagtagcaaaaaaaattagttgcttcacctgattattctaatttctttccattttgtcatgtggcaaagggaaataatgtcatgtgtacaaatctatgcagtccttttgctctacaatgaatagtattttctgttttggctatccttctctttttatttgtgcttgaactcaatttttggaggttgattttgcatcagattagatctaaaggagtgaattcgatatagccagattagatctgtataggtagttgctatctcacttctacacaggctgagtttttcaatcgtgcaatgctgttatggtatgaatactcatgatagaacgaagttactctaatatgttagaattagatcacttgactattttgactctagcggcagaactcaggtatcatgaatgacaagttggttgtcag

SEQ ID NO: 12086 - DNA, 1935 bp, Zea mays
agaaaaaagaccaaaatattcccctctcatcagtcatcaggcaaccgcaacccccgtccctctcccgtccgtcgtcatctatctgctcctcactccccgctccactggcgagatggggagaggcttgggcgccgctcccgtctcgccgcgcctcgctagtctcggggcagcggcgctggcgctgctcgtggcggcggcgctgccttccccagcagctggggtcaacgcgacggcggtgctctcggcgttccccaacttcgccgacttcgcgcggctgctggcgtccactcccgtggccagcgagctggccgggaggtcgtccctgacgctcctggccgtgccgaacgccaacctgccgcagtcaccctcggctttcgtagccggcgccgccgccggcgccgacatcgccgacgtgctgaggtaccacgtcctgctggagtacctctccccggccgacctcgcccgcctccctccctccgggaagctcgtgacgacgctgttccagaccacgggccgcgcgccctccgacttcggcgccgtcaacctcaccgtggggcccaactccaccgtcgtggtccgctcgcctgcgccgtccccgggatcgagcgccacggtcctcggcgccgtgaccgcggtcccgtacaatctcagcgtgctcgcggtgggtggccttatcgtaccctccggattcgacctcgcggcctccgagagccgcccgccaccgccggtgaacatcacccgggttctcaccgacgcgcgtgggttctacgtggcggcctccatgctgcaggctttccggtgtagcgagcgagtttgaggccgacgagcgcggtgctggcatcaccgtcttcgtccccaccgacgacgcctttgccggcctccccaccaccgaccgcctccagtcactacccgctgagcgcaaggccgtcgtgctccgcttccatgtgctgcactcttactacccgctgggctccctcgagtccatcgtgaaccctgtccaacccactctcgccacagagcacaccgaggctggccacttcaccctaaacataacccgcgtcaatggctccattgccattgacacgggcatcgtgcaggcatccatcacccgcacagtgttcgaccagaaccctgtggcggtctttgccgtctccaaggttctactgcccaaggaaatgttcagccggggcgattctggcagcaccgccatggtaccaccttcggttgcgatggcgcccggcgacgccgggaccgagcagacaccacagacgaggctctcatccccgcctgatctccacggggaagatagcgagtcgtcagctgctttggcgacagcaaaggggacttcttggtggtgtgtaggactcatgtatctgcatctattactatctctggtatgagattctggtcgtgcttgttgctttcttgcttccttgtgctcagtttttgtatttcttactgtctagaacgtctacaccgggagggagggattggggagagaatttcgtagattcaaagtagcaaaaaaaaatttagttgcttcacctgattattctaatttctttccattttgtcatgtggcgaagggaaataatgtcatgtgtacaaatctatgcagtccttttgctcgacaatgaatagtattttctgttttggccatccttctctttttatttgtgcttgaactcaattttggaggttgattttgcatcagattagatctaaaggagtgaattcgatatagccagattagatctgtataggtagttgctatctcacttctgcacaggctgagtttttcaatcttgcaatgctgttatggtatgagtactcatgatagaacgaagttaccctaatatgttagaattagatcacttgactattttgactctagcggcagaactcagatatcatgaatgacaagttggttgtcag

SEQ ID NO: 12087 - DNA, 992 bp, Zea mays
aaaaagaccaaaatattcccctctcatcaggcaacccccgtttcttctcttcccctcgtggcctcgtcgtcatcatctgtctgctcctcgctcctcactcgtcactcccctcactccccgttccactgctcctccactggcggcgagatgacgagaggcttgggggccgctcccgtctcgtcgtgcctcgcgctcggggcagcggcggtggtgctgctcgtggcggcggcgctgccttccccggcatctggagtcgacgtgacggccgtgctctcggtgtttcccaacttcgcggactttgcgcgtctgctggcatccacccccgtggccagcgagctgtccgggagatcgtccctgacgctcctggccgtgccgaatgccaacctgccgcagtcaccctcggctttcgtagctagcgccggcgccgacattgccgacgtgctgaggtatcacgttctgctggagtacctctccccctccgacctcgcccgcctctctccctccgggaagctcgtgacgacgctgtttcaaaccacgggccgcgcgccctccgacttcggcgccgtcaacctcaccgtggggggcaactccactgtcgtggtccgctcgccggcgccgtccctgggatcgaatgccacagtcctcggcgccgtgaccgcggttccatacaatctcagcgtgctcgcggtgggtggccttatcataccttccggattcgacctcgctgcctctgagagccgcccgccaccgccggtgaacatcacccgggttctcaccgacgcgcgggggttcaacgttgcggcctccatgttgcaggcctccggtgtagcgagtgagtttgaggccgacgagcacggtgctggcatcaccgtcttcgtccccaccgacgacgcctttgccggcctcccgccaccgaccgccttcagtccctacccccggagcgcaagcccgtcgtgctccgcttccatgtgctgcactcttactacccgctg

SEQ ID NO: 12088 - DNA, 1009 bp, Zea mays
tttactagcccatgggccatacggctgtctcaggtctcagcacccgatccgagtaaccgctgccgatctctcctcgtcatttcgtcgtcgtctccatctcactttcgatcgacacagaaaattccccaccaaaatctcctccccctgaagtcccgaagctcgcggaagcgccgagatgtaccatcccacgagaggcggcgtccgcggcggcagagatcaattcaaatgggacgatgtgaaggttgacaagcatcgggagaattaccttggtcatagtgttaaggctccggttggtagatggcagaaaggaaaggatctttactggtatactcgggataagaaatccgacacggaagatgctcttaaggaagaaatcaggagagtgaaggaagaggaggaacaggctatgcgtgaggctcttggcttagctcctaagcgcagcaatcgaactcagggtaatcgcttggataagcatgaatatgctgagctgattaagagaggatcaactgcggaggacttgggagcagggcacgctgaagcagcacaagtgcagggtctaggattgtacaaggcccctcgcgatgagggtggatcaagttctttgagccttgaccctcaaatggagcctgagcaggctgaacccctactagcacccaagcaggaggatgatttggaagataataggaaggggaaaaggccacgtgaacgtgacgagaagagaggggagaaggagcggaaacgagacaggcatggtgatggaaaggagaggaggcgggacaagcacgagaggaggcacgacttggaggacagatcaaagcggcaccgcaaagacaagcagaagaggaggcacgattccgattctgattgataacggccctgcgcctgctcctgtatgactactgtatactgcgaaatttcaaacccatggagccgcttttgtttgatgtatgcctacgctttaaattatgtttgccctaatgatgtttaaggataaaaaaaaaaaaaaaaa

SEQ ID NO: 12089 - DNA, 939 bp, Zea mays
gccgggagccgatctctcctatctctcctcgtgatttcgttgtcgtcgccatctcgcttccgatcgactcagaaaattccctcctccccctgaagtcccgaagctcgcggaagcgccgagatgtaccatcccacgagaggcggcgtccgcggcggcagagatcaattcaaatgggacgatgtgaaggttgacaagcatcgggagaattaccttggtcatagtgttaaggctccggttggtagatggcagaaaggaaaggatctttactggtatactcgggataagaaatccgacacggaagatgctcttaaggaagaaatcaggagagtgaaggaagaggaggaacaggctatgcgcgaggctcttggcttagctcctaagcgcagcaatcgaactcagggtaatcgcttggataagcatgaatatgctgagctgattaagagaggatcaactgcggaggacttgggagcagggcacgctgaagcagcacaagtgcagggtctaggattgtacaaggcccctcgcgatgagggtgggtcaagttctttgagccttgaccctcctcaaatggagcctgagcaggctgaacccctaccagcacccaaggggaaaaggccacgtgaacgtgacgagaggggaggggagaaggaacggaaacgggacaggcatggtgatggaaaggagaggaggcgggacaagcacgagaggaggcacgacttggaggacagatcaaagcggcaccgcaaagacaagcagaagaggaggcacgattccgattctggttgataacggccctgcgcctgctcctgtatgactactgtatactgcgatatttcaaacccatggagccgcttttgtttgatgtatgcctacgctttaaattatgtttgccctaatgatgtttaaggataaaatggcccgtatgctcctctccccccc

SEQ ID NO: 12090 - DNA, 1019 bp, Zea mays
ctcgaggccggccggggaaacctcaccaaaacacgcccagtttcctctccggcatcacctatccaaatcagaaacatcgggggaaaaagcgacgagtagaagaccgcttcaccttcccaattggaaccctgccagtcgctgacttgtgggcttcgcttagagcaagcaagcgtccgagcagcagccggttcctttcagaacgcgctcggaaatgttagctgattaggtaaccaagcctcgccgccggccgccgttttcgtatatatccccggcctttttggcaagcatggatgccttggctgcctgcacagtgccgcacagagagcaagcatagcatggccatggcccaagctcgcgtcgttgctctggctctgtgcgccctgctccttgtctccggcgtggcccggagagccgaggctgtctcgtacaacgtcggcaacagcgcggggtgggatctcagcgccgacttgccgtcgtggcccgacggcaaaaccttcaacgtcggcgacgttctagtgttccagtactccagctaccacaccctggacgaagtcgacgaggccgggttcaacaactgcagcgccgcgagcgcgctcctgtcgcggagcgacggcaacacgacggtgccgctgacggcgcccggcgaccggtacttcatctgcggcagccagctgcactgcctgggcgggatgaagctgcacgtgctcgtcagccagccggcgggaggagctccggcggaggccacgccgcagtccacgccgcagacgggctccggggccgcccttgggcccagcaccgacgacgcgggcataccctggctcgttctcggcgggtcccaccgagctacggtgggctccatgctgctgacgtggctgttcgtagccgcaactctgctgcttgtatgaggattgcagaagaggtgttttgattttgttttttttactaagcacggtttgatttgatctttgtaaaaatagattgtgaaccaacgaatccgagcatcgagatcgagacgcact

SEQ ID NO: 12091 - DNA, 1968 bp, Zea mays
gtgtttccagccttccaggcgcctctgctgcctgcgcctgcgcgcgtcgtgaaggcgtgaacggcagctcggctcggcgcaggccccccgcccgcgccggcatcgcgtcgcggccgccgcgcgagccccatgctgcgttgctgccgcacgacacgtcacttcggctgcggcgtggttgtgtggactcctctcgctcctggccctcgccggcgctgcgtcggctgcggatggggcggagggtgagtgggagccgctgatacggatgccgacggcgaaggggagtgacgctgcttctgctccggctgctgaggatgatgaagtggggacgaggtgggccgtgctcgtcgccggatccttcggttatgggaactaccggcaccaggccgatgtgtgccatgcgtaccagatactgcagaagggaggagtgaagaaggagaacattgtggtgttcatgtatgatgatattgcccacaacattctgaaccctaggcctggagttatcattaaccatcctaaaggagcaaatgtttatgatggtgttccaaaggattacacaggtgatcaggtcactactgaaaacttctttgctgtcctcttgggcaatagaagtgctaccactggagggagtaagaaggtgatagacagcaaacctaatgaccacatcttcatctattactcagatcatgggggtcctggagttcttggtatgccgaacctgccatatctgtatgctggtgacttcatcaaggtcttgaaaaagaagcatgcttccaatagctactcaaaaatggttatatatgttgaagcatgtgaaagtggcagtatctttgaggggttaatgcctgaagatctaaatatttatgtcacaacagcctcaaatccagttgaaaatagttggggaacttactgccctgggatggaaccatcaccccctcctgagtacattacctgtttaggtgatttgtacagtgtttcttggatggaagacagtgaaacccacaatctaaagaaggaaaccatcaaggatcagtatgaagtggtgaaaacaagaacctcaaactcaaataagtacaaagagggttctcatgttatggagtatggtgataagaccttcaaggatgagaagctttccttttatcaaggttttgatcctgctaatgccaacattgcaaacatgctgctttggccaggcccaaagggtgcagtcaatcaaagagatgctgatcttctcttcatgtggaagaggtacgagcagttaaatggggggaccgaagagaagctgagggctctcatagagattaaagaaactgttcagcacaggaagcatcttgacagcagtatcgatttcgttgggaggctcgtcttcggatttgagaaagggccttcgatgcttgaggctgttagaacctctggtcaaccattagtcgatgactgggactgtttgaagaggatggtgcggattttcgagtcccagtgtggttcacttactcagtacggcatgaagtacatgagagcgtttgcaaacatctgcaacagtggtatatctgagatgaaaatgagggagtcgagcatcagcgcttgcagcagctacaactcggcgaggtggagcccgatggctcggggacacagtgcttgatggtaaagatcaaatagcaaagccccccgaggtctgctgccccatgtccctgtgagcgagctcgtatcatctggggactgtggacccatcgacggttgtacatatcatgcacttgtgctcgtgcctatgtaaagtagtaataccaactcaactctgatcttcatccaagtaccgaaatgattaaaagatcagatgtgaatgctgttgcgatgggtgatcgcaagtaggccataatcagtggaccgaaaatgatgacccaaatcaaggtagtgctcctctgatcgatagcccaaatctattgctaacaaaaaaaaaaaaaaaaaaaaaaaaaa

SEQ ID NO: 12092 - DNA, 2112 bp, Zea mays
gcccactcacgcgacggacgcgtgtttccagccttccaggcgcctctgctgcctgcgcctgcgcgcgtcgtgaaggcgtgaacggcagctcggctcggcgcaggccccccgcccgcgccggcatcgcgtcgcggccgccgcgcgagccccatgctgcgttgctgccgcacgacacgtcacttcgggtagctttttttaaagccccccacggacccaaccccgccgtcaccactcaccccagtatcccactctctcgcacttaaccgcctgctctctctgtctgacgcgccggcgccgccctcgcgatcgatgatggcagctgcggcgtggttgtgtggactcctctcgctcctggccctcgccggcgctgcgtcggctgcggatggggcggagggtgagtgggagccgctgatacggatgccgacggcgaaggggagtgacgctgcttctgctccggctgctgaggatgatgaagtggggacgaggtgggccgtgctcgtcgccggatccttcggttatgggaactaccggcaccaggccgatgtgtgccatgcgtaccagatactgcagaagggaggagtgaagaaggagaacattgtggtgttcatgtatgatgatattgcccacaacattctgaaccctaggcctggagttatcattaaccatcctaaaggagcaaatgtttatgatggtgttccaaaggattacacaggtgatcaggtcactactgaaaacttctttgctgtcctcttgggcaatagaagtgctaccactggagggagtaagaaggtgatagacagcaaacctaatgaccacatcttcatctattactcagatcatgggggtcctggagttcttggtatgccgaacctgccatatctgtatgctggtgacttcatcaaggtcttgaaaaagaagcatgcttccaatagctactcaaaaatggttatatatgttgaagcatgtgaaagtggcagtatctttgaggggttaatgcctgaagatctaaatatttatgtcacaacagcctcaaatccagttgaaaatagttggggaacttactgccctgggatggaaccatcaccccctcctgagtacattacctgtttaggtgatttgtacagtgtttcttggatggaagacagtgaaacccacaatctaaagaaggaaaccatcaaggatcagtatgaagtggtgaaaacaagaacctcaaactcaaataagtacaaagagggttctcatgttatggagtatggtgataagaccttcaaggatgagaagctttccttttatcaaggttttgatcctgctaatgccaacattgcaaacatgctgctttggccaggcccaaagggtgcagtcaatcaaagagatgctgatcttctcttcatgtggaaggggtacgagcagttaaatggggggaccgaagagaagctgagggctctcatagagattaaagaaactgttcagcacaggaagcatcttgacagcagtatcgatttcgttgggaggctcgtcttcggatttgagaaagggccttcgatgcttgaggctgttagaacctctggtcaaccattagtcgatgactgggactgtttgaagaggatggtgcggattttcgagtcccagtgtggttcacttactcagtacggcatgaagtacatgagagcgtttgcaaacatctgcaacagtggtatatctgagatgaaaatgagggagtcgagcatcagcgcttgcagcagctacaactcggcgaggtggagcccgatggctcggggacacagtgcttgatggtaaagatcaaatagcaaagccccccgaggtctgctgccccatgtccctgtgagcgagctcgtatcatctggggactgtggacccatcgacggttgtacatatcatgcacttgtgctcgtgcctatgtaaagtagtaataccaactcaactctgatcttcatccaagtaccgaaatgattaaaagatcagatgtgaatgctgttgcgatgggtgatcgcaagtaggccataatcagtggaccgaaaatgatgacccaaatcaaggtagtgctcctctaaaaaaaaaaaaaaaaaaaaactagagggggggcccggtacc

SEQ ID NO: 12093 - DNA, 2539 bp, Zea mays
cccaaattttcttacgagtcgatacgtggcatgctgcagttgttcttacatggtcacgggccgtgctccattcgcagctcgcggccgaaagcgacacgcacagcggccgcactcgcactccaaccgcaaaaaagcccaaaagccaccgagtcgccaccgcaccagtcttttggctgccgtcgctttcctgcgctcccaccaggccaccactccacacagtgcagggctccaggcttccctccctcccctcgaggccggccggggctcacccgccctcctgctctaagcccaaagctcccgtcccgagggcttcaggtctgttggcccctactcctcgtccgcttcccgggccgccgcttttaggtgtgacttcctcatcatctgccctgacggggatcgctggtttcttcctccagagatcgcatctctggtccgcgggatccgatgagatgcgggggtgctctcgcagtccgacctcgtagcaggcatggctgaagcggccacttcttcgtcttcgtccggatccttcgccccgcgccgcctccatgacgccggtgtcgtcagggaatcgctcccgtacagtgttctcgccgcacccccgccgccgcctctgcctccggtgcaggtgcaggttgcgggttccggcggcggcggcggagggaagattagccccgcggtgcttttcatcatcgtgattctcgcgttagtgttcttcatctccggcctgctccaccttctcgtgcgcgtcctgtcgaagaagcagcaccgccgcggcggcccaagggacacggcgtcggcggcggcgccgaggactggagtggaggcaggcggggtggacgtggcgttgcagcgccagctgcagcagctgttccacctccacgactccgggctggaccaggccttcatcgacgcgctgccggtcttcgcgtaccgggatatcgtcgtgggcggcggcggcgacggggacaaagagccgttcgactgcgcggtgtgtctgtgcgagttcgatgccgaggaccggctccgtctgctgccgctgtgcgggcacgccttccacctcaattgcatcgacacgtggctgctgtccaactcgacctgcccgctctgccgcggggttctcttcatccccgggctcatgggcgagggcaaccccatgtttgatttcgaggagagactggaggaagggcggttgtccgaggactgtgacgacggatttggattgcctgggctgaaggcttcagggttggcacagacaccggtggctgagaagaaggtattccctgtgaggttggggaagttcaagaatgtcggaacccagggtgcggtggaaggtggcaatgccaatgccagtgtgttgagtagggatcaagtggagagtagcagcagcagcagcttggatggaaggagatgcttctccatgggcacctatcagtatgttcttggcacttctgagctccgagtagctctccagcctggccgtattagaaatggcactggtggtgcaatgatgggaagacctcctggtttaagttcgatcaatgctgatattatggaggggaagaagatctgtacacgcaacaaaggggagagtttctctgtgtcgaaaatttggcaatggtctcatattaagggcaagctacctgctggttcggatgaatgttcggatgccgggagccttccttggatgaagagaggaggtgctgcggatacatcaaacttatgactctgcactagtgtaatgagcctttctttagttagtgatacccacctaattttcacctgtagtcatttttcttatctaattttcatgtgctcattttgattggagtgccaacctcattgggggcttagcttttggtgatcttgccatgttagtatgtttcaccacgtagaattgtagattgtgatgatttatttgatctgattctggtctgcctaatgttttgtgttgggtctgatgtatcatttatccctccatccaaaattatattggtcattgtggctatgcacctagagaagcagtttgtagatcagagtatagttaacattgacctatgatttcttcacttcattcatttgacaattatgcatgggaaaacatatacatctatcatgaattactattagatgtgtgggaaaaaaatgttgtgcaatcgtcatacaatcaaactactaaaagttatagtttttcaacttatagatgtactttattaattactctaccaacatatcaaattttaatttcttttaatttatcatatgttatgagaaatagaaatgagaaaatttgttatttttagaacttgaaatttgatataatgtttgagtaaattatgaagtacatttataaatttcgaaaattcttattgttttttgatagtttgattgcacgacaattgagaaactagttgcactgcacaatttaactgttcatggcttcgtgcgctagtagaagtaatcggcttctttgagccctgtttttctcttcttttgtcccctggcaatctagtcatattttctaatacttagatggaagcgc

SEQ ID NO: 12094 - DNA, 1491 bp, Zea mays
aaacggacaaccgcccttctccatccggtctccaagccaacgactcgagtcgttcaaaactggacacagcagtgaaccggagctgcttgcttgctgtctcgccaagaagcaagagtaggaggagcagctggtctctcgccaagtcgcgcctctccctcctctcttctcttttctccctcgcgtcgcgcgctccacatgctgagcctgaggtcagtatccggctccaactcctcgaggggcatcgccgccgtggtcggcgtcggccccaggctgggctcggcggtggcgcgcaagttcgcctccgagggctacaccatcgccatcctctcgcgcgacctcgagaagctgtcgcagctggcggaggagatcgcgcaggcggccaaggcgcaggtgttcgcgctgcgggtggactgcgccgacgcccggtccgtgcgcgaggccttcgagggcgtgctctccctcggccccgtcgaggtgctcgtctacaacgcctgcgagccgcctgcagccaacgaggacgcgcgccccgcgcccttcctcgccgtcacccccgacgccttccaccgcgccctcgccgtgtccgccggaggggccttccactgcgcgcaacaggtcatcccgggcatggtggagaggggcaggggcaccatcatcttcacgggctcctcggcgtcggtcaccggcttcgccggctactccgatctaagcagcggcaagtttgccctgcgggggctgtcccagtcgctggccagggagttccagccggccggcgtgcacattgcgcatgtgatcatcgacggcgtcatcggcgagaggaggtcgctgacgaggagcagcagggccggcggcgacacggcgggcgcgggcgcggacccggacgcggtggcgcagagctactggcacgtccacgcccaggacaagagcgcttggacgcaggagatggacatccggtcgccgtccttcatgtagcagcagcagctagccgccgctgctgtacgtacggtccctggaatctttagtggactgctaccggccgggcgcgttcccgatcaagcaggagagagggacaagtgggtcttgttgtgtatgtatacgtcgtgccctgtaaatcgtgtgtgcgcgcgcgcggctgcgggccgggaatcgtgtccccgtcccgcgccgcacgttggcgcggctctagctagcccccccttttctcatcatttggtgtgagatgcccgtcgctggtccgaccgcgggttctgtgcgtcgattgcggccgagagcgaccgcgcgtgcgtctccgtcgcatcctgtacccgtcgccgccgccgccggcgaccggcctccggaaagctctcatgtgtgatggatgtgtgcgcccgttgttacacatgagctagtccgtatatgtggaggattgtgcttagtggtcgctacccacttgaattgagcagcatccgtgagactctgactaaaaaaaaaaaaaaaacaccgaatagtgagctc

SEQ ID NO: 12095 - DNA, 978 bp, Zea mays
ctcgaggccggccgggctccggccccttgccacgagtcatcgggcgcgatcgcacggcggcacacacccacgcgcggatttatatggcgaccgcgcgcgccggcccgcgtcgtcacacaccacaggctgtgtagagcgcgcgcctggcatgacgatggctcgttctggggcggctttgccgctgctgctggtcgtggtcggcgcttgctgcgcgcgcctggcggcggcagtgcacctctccgcgctcggcaggacactcatcgtcgaggcgtcgccgaaggccggacaagtcctgcacgccggcgaggacacgataaccgtgacatggcacctcaacgcgtcggcgtccagcgtcgggtacaaggcgctggaggtgaccctctgctacgcgccggcgagccaggaggaccgcgggtggcgcaaggccaacgacgacctgagcaaggacaaggcgtgccagttcaggatcgcccggcaggcgtacgccggcggccaggggacgctccggtacagggtcgcccgcgacgtccccaccgcgtcctaccacgtgcgcgcctacgcgctggacgcgtccggggcgccggtgggctacggccagaccgcgcccgcctactacttccacgtcgcgggcgtctcgggcgtccacgcgtccctccgggtcgccgccgccgtgctctccgcgttctccatcgccgcgctcgccttctttgtcgtcgtcgagaagaggaggaaggacgagtaggccgtaagcggcacacgcgatatataccagggaggcgccaccgtgcgagctagcgcttggtgagccgtcatgttgtgtagtgcagttgtaacacaagtattaagctaagcacaagtcgtaccatgtatccagctccagcatgaatccaaacccagcgtcagtcacaagctgggacctgcatggtgcctgtcaaccaaaattcttcttggatcatactaatactatcgtctacagcg

SEQ ID NO: 12096 - DNA, 1546 bp, Zea mays
  misc_feature (31)..(31): n is a, c, g, or t
ggtaccctccgaggtctcgtgccgggccggnaaaaaaaaaaaaaaaaaaaaacgaaaaaaaagaaaaaataaaaaaacccccactccccgtcgccgacctcacccgcctcatggacggtggccgagccgcagccgtcggcggcgacccctctcccatcgctgctccttccaatcccccggcgctgagcagcaggcccgtcgatgtctcctcgttcacccataccccgtgctactgcgaagaaaatgtttacatgttatgtaacgagcttattagaaccggagtggctgatcctgcgggcactgatctttatgttgttttcatatccaacgaggaaaaaaaggttcctctctggcatcagaaagcaggccattctgatgatggatttatttgctgggattatcacgtgatatgcatccagtctaggcgaagcaaagaagttcttgattttgtttgggatctggactccgatcttcctttcccttccccattcatccaatatgtttctgaggcgattcaaccactatcattcggcaattccagatatgcaagactcttccgtgtggttcatgctcctgtgtttcttcaatcgtttgcctcagacagaagccatatgaaggatcctgaggggaactggattcagttacccccaaaatatgaaccgatcgtggctgaagatggaaccaccaataacctcaatgagtacatcatgatgtctgtgggggacgtggcagacagagaaaggatggctaatgatgtttattgcaacaagcttggtgtggtgctaaatgaaacgatcttccctgaattcttcgcccagctgcctgctccacatacttagcaagcgatctttctgttgtgatgggttactctgtacacttcaatagtgcactcacaagattatgaattaaaatatatgggcactattggacacatggtgcctctaagtagcgtttcagatagatcctggcctgttttggaaagcaaaatgtggggatctcatagttctgttagcctagacatctgaaagcttcatcttgtcccaaataatgatgactaggtcatgtttaacggctttagctttctttggtcattgttcgtcgaaacttatatgaacataacacttctatgtgctcgttgttaccttacaagtaaatatgcaacccataaactttaaacttgcaggctgtcgcacctttttgctcttgctcttacgctcattctggatccttagaattaaaaactattctaataatcataatttagatgtaaatcaattgttgtattgagaatatatttatatagtactgttgctcgctccatagataagtatctttctgaccaatagttgatttacatctaaattatgattattagaatatgtggtcaaaggaaaatgtgagctgtacgtagctggttaggttaactgctcgtcatacatttatctggatttattttaaggatttttatgatgttttttaatattaaaagatatactggttattcgatgatattctttcaatagtagaagatgtaccagggaaatcc

SEQ ID NO: 12097 - DNA, 1407 bp, Zea mays
ttggagtgctgggcttatgctcagccaataaaccccctcccgcgcctcgaggccggccggggccgccctgccgaggacccttccttcctcgtccgcccacgaatttccggccagaccatcctacaccgcccgtccgggacacgcgcccgcctctgccaagaatttcgccttctccggcgccgatcccgcccattcttgtgccgccggcaggccaaggatgcggaaccttctcacggattcgtttgagctcggcaaacgggggcagtcctcaggaaatgtcgacatcgagcttggattgcagggtgacctgactagttctgcgcagccaggttttgagggattctatgaacaggtcaaagaggttgaaagcttgctcaacacattgacaaagttactgaaggaccttcagaactcaaatgaggagtcaaaagttgtcacgaaggcatctgcgatgaaagaggtaaaaaaacgcatggagaaggatgtcaatgaagtgacaaagattgcacggctggcaaaatcaaaagtagagcaactgaacaaagataatgctgtgaacagaggaaaaccaggatttggcaagggatcgggtgtggaccgatcccggacaacaaccactgtcgcattgacaaagaagttgagagaacgtatactggagtttcagacattacgagaagaaatccagcaggaatatcgtgacgtagtggagcgtcgtgttttcactgtgacgggggagcgtgctgatgaagagacaatcgacaagctgatagaaacaggcgacggcgagcaaatctttcagagagcgattcaagagcaaggggcgaggaagggtactggacacgctgcaggagatccaggagcgccatgatactgtgaaagagattgagaggaagcttcttgatctgcagcagatcttcctggacttggctgtgttggttgaagctcaaggtgagatgctggacaacattgagacgcaggtcacaggtgcagctgaacatattcagaccggaacaaaccttctccagaaagcgaagaagctgcagaagaacacacgaaaatggacctgcataggcataatcatcctcctcataatcattctcatcattatcctctccttgaaaccatggtcctggggtaaataagcagcaaacaagaagcgtcgttcccatgttggttttggttgatgatattacctatagtattcttgttatagctgtgcatatgtcagaaggtgctgtacatcgtattgcaatctttgttttttttttccttttggaagagaaactttgggtgtgaactttcagattttgcttgattcgaatttgctgtattggttgtgcaactaaaggcctacacatactggtttcttgggaaattggtaactctgtctacgtagacagtaagcct

SEQ ID NO: 12098 - DNA, 1860 bp, Zea mays
ctcgaggcccggcccctcgggtacaagtagtatagaacctgcctgccctgccctgccctgcgctccgatgaccggaggcgggttcgccgtggcggagggcggccacgcgcgcgacgactacgggggaggcgtcacggtctccgtcgtggtcacctgcctcatggccgcctcctgcggactcatcttcggctacgacattggcgtctcaggtggcgtgacacaaatggagtcgttcctggcgaagttcttcccggaagtgtcgagcgggacaaaggacgcgaagcacgacgcatactgcaaatacgacgaccagcggctcacggcgttcacctcgtcgctgtacatcgccgcgatgctgtcgtcgctggtggcgagccgcgtgacgaggacggtgggccggcaggccgtgatgctgatgggcggcgtcctgttcctcctaggctccgcgatcaacgccggcgccgtcaacgtcgccatgctcatcctcggacggatgctgctcggcttcggggtcgggttcaccacgcaggccgcccctctgtacctcgcggagacatcgccggcgcggtggcgcggggcgttcaccgcggcgtacagcatcttccaggtgctgggcgcgctggccgccaccgtcactaactacctgaccaaccgcgtcccggggtggggctggcgcgtgtcgctcggcctcgccgccgtcccggccgccatcgtcgtcctcggcgccctgctcgtcccggacacccccagcagcctcgtgttgcgcggcgacgccgacggggcccgggcctcgctgcagcgcctccgtggcccgggcgcggagaccgacgcggagctcaaggacatcgtccgcgccgtggagcgcgcgcggcgggacgacgagggcgcgtacgggaggctgtgcgccaaggggtaccgccactacctggtgatggtggtggccatcccttccttcttcgacctcaccggcgtcatcgtcatggccgtcttctcgccggtgctgttccggacggtcgggttcagcagccagaaggcgatatttgggtccgtgatccttagcctcgtcaaccttgcctcgtcattgctctcctccttcgtcttggaccgcgccggccgcaggttcttgttcatcgtcggtggcgcggcaatgatgatttgtcagttggccatgtcgtgcatcctggcgggccacttcggcaagcagaacgcggtgacgatgccgcgggactacgcggtggccgtgctggtgctcatgtgcctgtacaccttcagcttcggcgtgtcgtgggggccgctcaagtgggtggtgccgagcgagatctaccccgtggagatcaggtcggcggcgcaggcgctgacggtgtccatcgcgctctgcctctcattcgcgcagacgcaggtgttcgtctccctgctctgcgccatgaagcacgccatcttcctgttctacgccggatgggtcctcgtcatgactgccttcatcgccgcgttcctgccggagaccaaaggcgtgccgctggaggccatgcgcgccgtctgggcggggcactggtactggaggaggttcgtcagggacgccaagcaggaggttcaggtgaactgcatgtagggaaaagtaaagagtggtaaaactcaagtgtttgctggtaaattatgatggttcagtgtgccgttagcctcgggctccctcgacacaaaatatcctgtctgcctagagcgcgtgcgcgggagctgggaggtctcgcttcgcctaactgggccacaacggactgtcgtgagagcccaattaaagttttcggccagcgtaacgattgcaggattatcttggctgtttttaatatctttttcctactgaacatc

SEQ ID NO: 12099 - DNA, 1994 bp, Zea mays
tgggtacccctccccgggccggccggagaacagaggttattcgttttggctacccgttttgaagacgatgatgagtccggcgtcggagcgcagcctcatcatccagagcgacgacgacgacgacgcccgatccggccacgacgtggaggagccggagccagagcaggagcaggactccgactcctcgtcgtcgtcctcatcctgcgccaccccacgccgcggcccaagctcacccccctacatccagcaatggccgcagagttacaggcaatcgatcgacattctcagcagcgtgcagtcacccaacctgagctttctggggactccaactctgagcaggctgtcgaactcattcctcgccatcaccgattctttccggagcaaggcccccgaaacgatctctagctttatcaagccactccttggccccacgccaagtgacgatcagcagcggcagcatgaaggcacccgaaagagttccgagtaccttgtgccctcgagaagatcatctctgcagcagatcccagaggatcaaaagccacctgtaggtggccatggggcgtctcatgaccagaactgctcttacacccagggagtgatgaatggaataaatgttctatgtggtgtggggatcctatcaacaccttatgccatcaaacaggggggctggattgggctggcgatactctgtatatttgctcttctcgcatggtacacaggtgtgctcctgcgccattgcctggacagcaaggagggcctcaagacatacccagatattggccatgcagcctttggcagcacaggccgcatagttatctcgataatactgtacgtggagttgtatgcatgttgcatcgagtatttgatattggagggtgacaatttgtcaaaattattccccaatgctcacctgaccattgggagcatgacactgaactcacatgtattttttgcaatcttgactaccatcatagtcatgccaaccacctggctccgtgacctgagctggctgagctacatttcagctgggggtgtcattgcatcaatccttgtagtcatctgcctgttcttggttggggttgtcaatgatgtcggctttgagaatgaagggactgcactgaacgccccaggaattcctattgcaattggattatatggttactgctactcagggcatgggttttttccaaatatctattcttccctgaagaatcgcaaccagtttccttcaattctttttacttgtattgggctgtctacctttttgtatgctggtgctgcagtgatgggatacaaaatgtttggtgaagccacagagtcccaattcacactcaacttaccagataattctgtcatttctaagattgctgtttggacaacggtggcaaatccaataaccaaatatgcattaactattattccattggctatgagtttggaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcgtgttttttggcgatcctcaagacaaaagtggggtggcatcagatagcagcttgttcgttcatcatagttgtcggggtttgctgtgcctacgtgggaacatactcgtccctgtcgaagataatccagaactacgcatagcacagctgttcctgtgatcctgtatatgcatgtatatgcatctgcccgacaaaatcatgtgtgtgctatatgggccaaacatatgtacaagatgaaagtttaccattcaattcactcgatgtataataaattattggtgccttatcatagggctcaatgatttctactacgattttaaggttgtatggtgcgtgagtaacattgttccttatggtgagaaaaaaagttgatttggtcttcttctagc

SEQ ID NO: 12100 - DNA, 2006 bp, Zea mays
tcgaggccggccgggaaagagaacagaggttattcgttttagctacccgttttgaagagaagccgattttggaggagacgatgatgagtccggcgtcggagcgcagcctcatcatccagagcgacgacgacgacgacgcccgatccggccacgacgtggaggagccggagcaggactccgactcctcctcgtcgtcctcatcctgcgccaccccacgccgcggcccaagctcacccccctacatccagcaatggccgcagagttacaggcaatcgatcgacattctcagcagcgtgcagtcacccaacctgagctttctggggactccaactctgagcaggctgtcgaactctttcctcgccatcaccgattctttccggagcaaggcccccgaaacgatctctagctttatcaagccactccttggccccacgccaagtgacgatcagcagcggcagcatgaaggcacccgaaagagttccgagtaccttgtgccctcgagaagatcatctctgcagcagatcccagaggatcaaaagccacctgtaggtggccatggggcgtctcatgaccagaactgctcttacacccagggagtgatgaatggaataaatgttctatgtggtgtggggatcctatcgacaccttatgccatcaaacaggggggctggattgggctggcgatactctgtacatttgctcttctcgcatggtacacaggtgtgctcctgcgccattgcctggacagcaaggagggcctcaagacatacccagatattggccatgcagcctttggcagcacaggccgcatagttatctcgataatactgtacgtggagttgtatgcatgttgcatcgagtatttgatattggagggtgacaatttgtcaaaattattccccaatgctcacctgaccattgggagcatgacactgaactcacatgtattttttgcaatcttgactaccatcatagtcatgccaaccacctggctccgtgacctgagctggctgagctacatttcagctgggggtgtcattgcatcaatccttgtggtcatctgcctattcttggttggggttgtcaatgatgtcggctttgagaatgaagggactgcactgaacgccccaggaattcctattgcaattggattatatggttactgctactcagggcatggggtttttccaaatatctattcctccctgaagaatcgcaaccagtttccttcaattctttttacttgtattgggctgtctacccttctgtatgctggtgctgcagtgatgggatacaaaatgtttggtgaagccacagagtcccaattcacactcaacttaccagataattctgtcatttctaagattgctgtttggacaacggtggcaaatccaataaccaaatatgcattaactattattccattggctatgagtttggaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcgtgttttttggcgatcctcaagacaaaagtggggtggcatcagatagcagcttgctcgttcatcatagttgtcggggtttgctgtgcctacgtgggaacatactcgtccctgtcgaagataatccagaactacgcatagcacagctgttcctgtgatcctgtatatgcatctgcccgacaaaatcatgtgtgtgctatatgggccgaacatatgtacaagatgaaaagtttaccattcaattcactcgatgtataataaattattggtgccttatcatagggctcaatgatttctactacgattttaaggttgtatgttgcgtgagtaacattgttccttatggtgaggaaaaaagttgatttggtcttcctctaaaaaaaaaaaaaaaagggcggc

SEQ ID NO: 12101 - DNA, 1942 bp, Zea mays
ctcgaggccggccgggaagcaaaaaagcaaaacagttgactctgaactcgcattgcaagccccttcctgacgaaaatggcagcacttgttcctctgctgctcgcccacctactcctctgcgtccatggcgccaccgttacctcggtcgccacgcctccgcctctcccggtcctgcccgtcccgtcctacgcgcagctccggtggcagctctccgagatggcgctcttccttcacttcgggcccaataccttcacggactccgagtggggcaccggccacgctgacccctccgtgttcgctccctccgcactcgacgcgggccagtgggcgcgcatcgcggcgcagggcgggttcggccgcgtcgtgctcacggccaagcaccacgatggtttctgcctgtggccgtcggcactgaccgagtactcggtggccgcctcgccgtggcagggcggggctggggacgtcgtcgcagagctcgccgcagctgcgcgcgcggaggggcttgggctgggcctgtacctctcgccgtgggaccgccacgagccggtgtacggggacaccatcgcgtacaacgagcattacttgggacagatgacagaattgcttaccaggtatggagatgtagaggaagtttggctagatggtgcaaaaggcgacgccaagaagatggattatatgtttgatgcctggttttcacttatacatcagctacaagaaagggtagttatcttctcagatgctggaccagatactagatgggtgggagatgaggcaggagtcgcaggctatacttgctggtctcccttcaacaagagctctgtgacaattgggcataccactgctgaatactcatccagtggggatccttttggtcaagactgggttcctgcagaatgtgatgtttccatcagaccaggttggttctggcatgcctcagagaaaccaaaaaacgtgacaactctgcttgacatatactacaaatcagttggtagaaactgtctcctcattttgaatgtccctcccaattcatctggcctcattgccgatgaagacatacaagtcctccaggaattcactgagattcggcgtgcaattttctctcagaactttgctgccaatgccactgttacagcaaacagtgtgcgtggtgagcaagataatctgcagtttgcaccatccaaagtgcttgaagacgggatatactcctactgggctccgcaggaaggccaaacctgctgggaaatgctcttcgatcttgggcaatctacttccttcaacttgctccagctccaggagcctatacaactggggcagcgtgttattgagttccatgtggctatccttgtagatgaactgtggcaaacaattgttgaaggcacgacaatcgggtacaagaggctgctactgtttccagtcactgaatctcggtacctgaagcttaccatcgacagtgcgcgtgcagatccacttatctcgttctttggtgtcttcatggatcccttctcgtccatacatagtttgcagaatcatgtcaaaccaccccggacaaatagtaacgaagttacaatgttgaggatggcccatgcttctgtcaacaagagtattgacgcaatgtagttgttgagtgtacatctgtcagtattacttctagtctgccctggtcatttcaacatgccagaatcacttgcacgttgatttgttctttggactggagaagggccactcgatggtgggcaatgtgtgtatatcttcagatttgcttgccaaagctactaatacgagaactactctttctgcaatcatgcatggatatgttgttcccaagatcagctgttgaaacttcatgtagtctgtactagtgtctgttgaattatgtgccagcaggaagtctggggtttgaatgaagtgaacgtgcactctctaaaaaaaaaaaaaaaaaaaa

SEQ ID NO: 12102 - DNA, 1408 bp, Zea mays
gctgccgggagaacaccttcttgacccgaattcaatccgtgcgcacgcaccctccgccggcgacggctcacgcatcgctcggcgcccgccccgcgtccccgagacgacgaccggcagagcgcgccctcgcggcgctacccgacacctgcgacgaaacgccccgagtccactagtcgaggagtgcgtcgacgcaggggctcgggaacgcggtgtcgccatcgcggagccctagcgagatcgtcgggaaggtccgaaggcgagcacgtgtttgtgtaacctttctccccttcttccctttgccggccggcccttcagcggcgacaagtgcccaccaggcggtggtttacgttgagctgaggagtgaggaagatgtctggaaatccagtcggcgtcgacaacacttctaggaggaaatttgacaaggaagagtacttggagagagctcgacagagggagcagagggagaaggatgaagctcggaaaggcaaggaaaggggtcctcctgtgcaaagacagcctttgaaacacagggactatgaagttgatcttgattctcgtcttggcaagactcaggtggtgaccccgattgcaccattgaatcagcaggctggatactactgttctgtatgtgaatgtgttgtcaaagattcagccaactatttggatcatataaatggcaagaagcatcagagagcactgggcatgtctatgcgtgttgaaagggcatcacttgaacaggtccagaaaaggtttgaggcacttaagaaaaggaaggatccaagtgcctttactgaagaagatttggatgagagaataatgaaacaacagcaagatgaggaggaacggaagcgtcagcgcaaagaaaagaagaaagagaagaaaagagaacaggcaacccaacatgaacctgaggacgttgatcctgacatcgctgccatgatgggttttggtgggtttggttcctcgaagaagtgacagctctgtgttggccgcatccctttggtgaccttctgccctgaagatattgctcaaccccataaacacctgtgccatgaaaaatcgtttttgccagaatcctgataagatttgaacgaagtgcactggatgcaaggatactacgttttggcactgggatactgagctgcgtgtatgggagttgattatcaaaaggaatatctaagggtgttttggataaacctgtttatttgctacttcgggtgttcctgccatagaaacagctgatggtcgtgattgtttgttgtgacttgtgggaatgcagatgtgcgaagtggaacaaaccaaaagaattgccgtctcattttctagaggaataaacttgtgtattgcagttaacagctcccttgattctgaatcttaatttccagaaaaaaaaaaaaaaaaaaaaaaa

SEQ ID NO: 12103 - DNA, 1452 bp, Zea mays
  misc_feature (77)..(77): n is a, c, g, or t
cggacgcgtgggcactaaccgttcagcggcagagcccgttatttcgccacttctgcgcccccccctggccggccgcngagcagtagaaggtagaacaccttcttgacccgaattcaatccgtgcgcacgcaccctccgccggcgacggctcacgcatcgctcggcgcccgccccgcgtccccgagacgacgaccggcagagcgcgccctcgcggcgctacccgacacctgcgacgaaacgccccgagtccactagtcgaggagtgcgtcgacgcaggggctcgggaacgcggtgtcgccatcgcggagccctagcgagatcgtcgggaaggtccgaaagcgagcacgtgtttgtgtaacctttctccccttcttccctttgccggccggcccttcagcggcgacaagtgcccaccaggcggtggtttacgttgagctgaggagtgaggaagatgtctggaaatccagtcggcgtcgacaacacttctaggaggaaatttgacaaggaagagtacttggagagagctcgacagagggagaaggatgaagctcggaaaggcaaggaaaggggtcctcctgtgcaaagacagcctttgaaacacagggactatgaagttgatcttgattctcgtcttggcaagactcaggtggtgaccccgattgcaccattgaatcagcaggctggatactactgttctgtatgtgaatgtgttgtcaaagattcagccaactatttggatcatataaatggcaagaagcatcagagagcactgggcatgtctatgcgtgttgaaagggcatcacttgaacaggtccagaaaaggtttgaggcacttaagaaaaggaaggatccaagtgcctttactgaagaagatttggatgagagaataatgaaacaacagcaagaggaggaggaacggaagcgtcagcgcaaagaaaagaagaaagagaagaaaagagaacaggcaacccaacatgaacctgaggacgttgatcctgacatcgctgccatgatgggttttggtgggtttggttcctcgaagaagtgacagctctgtgttggccgcatccctttggtgaccttctgccctgaagatattgctcaaccccataaacacctgtgccatgaaaaatcgtttttgccagaatcctgataagatttgaacgaagtgcactggatgcaaggatactacgttttggcactgggatactgaactgcgtgtatgggagttgattatcaaaaggaatatctaagggtgttttggataaacctgtttatttgctacttcgggtgttcctgccatagaaacagctgatggtcgtgattatttgttgtggcaatgcagatgtgcgaagtggaacaaaccaaaagaattgccgtgtcattttctagaggaataaacttgtgtattgccgaaaaaaaaaaaaaaaattctgaatcttaatttccagg

SEQ ID NO: 12104 - DNA, 2751 bp, Zea mays
ttgggctaacgctatgacttgcaataatcacaaaaaatgatgataagcattataaacacaagtaacctcctagtttagtgcattaaattttgctatcatcgtcttcatgttaatgtgtcatagttttaacatttgtcagatcagagagcactgggcatgtctatgcgtgttgaaagggcatcacttgaacaggtattacatttgagcctcacattggatctgcagttgaaagtcagcaattatattctcgttatatttacttatttagtagcagacccaacttgtcatacattggctcctttggcacaacttctgcttgtgcggaatccagcttataggaataactggtgagaagcagaagttcaactccagccctcataagccgctttagaatctagctgtttggtggcactttgccttttctttttcctgttagatgatgaagtagaaactatggcaaagaggcacatcatctcgtgacattatgcttaatttcttattgagtttgctagtgagaagccgcttggatagttaggtttgccatcctattttcagccagcggtcttcctttcaccatgtgctatttgttttcactcagaattttctggtggctgcaggtccagaaaaggtttgaggcacttaagaaaaggaaggatccaagtgcctttactgaagaaggtgagaaaaacaaaattcttcatagggagcataataaattactggaaaatcatcccctcgtttttttaaatgtttacagatttggatgagagaataatgaaacaacagcaagaggaggaggaacggaagcggcagcgcaaagaaaagaagaaagagaagaaagtaagcgcagtcttgcaacacaaatccccacctgtatttatttttcaactgaaaattataactgaacagtcctgtgggttttgagaatcagtagaagcgtcagcgcaaagaaaagaagaaagagaagaaaagagaacaggcaacccaacatgaacctgaggacgttgatcctgacatcgctgccatgatgggttttggtgggtttggttcctcgaagaagtgacagctctgtgttggccgcatccctttggtgaccttctgccctgaagatattgctcaaccccataaacacctgtgccatgaaaaatcgtttttgccagaatcctgataagatttgaacgaagtgcactggatgcaaggatactacgttttggcactgggatactgaactgcgtgtatgggagttgattatcaaaaggaatatctaagggtgttttggataaacctgtttatttgctacttcgggtgttcctgccatagaaacagctgatggtcgtgattatttgttgtggcaatgcagatgtgcgaagtggaacaaaccaaaagaattgccgtgtcattttctagaggaataaacttgtgtattgcagttaacagctcacttgattctgaatcttaatttccaggaataatatgcatgataaacaaaaattgtttgtttatgctcaactctgcactaatgggtaggcaacatatgcatgataaacgtgcgtctaggctaggaagcactcctcgctctatcctttgttcacctatcatctcaggcaccccgcgatattctaatgtcgttttgtgagtgaattcacttttttattcaaatggcagaaatcgagtggtaaccaaatttgctatcagctaatagccagtgttactttgagtccaggaagtttatcacacaaattatcacaaagtaagcatcagtgtggattcttttgatggaaaaaaaactttagtggcgacatgcaacgtgttcattccgtcgaacaaaagtactgaacgcaacttttttcagcagggaagtcttcatggctgaaccaacaaaatcgatcagtgtcaagaatccatgcatgcatcacgcttatagctacttgctgccttaatttggttgcccagttttgcgcatcaagttcatatggtaggcaaaccatcgcactgcacgcgtgcgaggtgtgcgaatgaagctcacgcgcgtgcttcgttggggaacttccatgcggagtcagctagcctaaacaatctagtagtattaaatatgcaccagtatttcaagatccaacttagatcagcagcaccaacaatgaaatcggtagggaatataatctcgctgaatttaaccacatactgaaggaagcagtaaaaatagaatgatgctcaactactgtgttttgtagaggaaacttaggttggatgaaaccaatacacaattttgttgatctcaagtcagactaagactaaccttacctactttctattgctgattaaaacaccataagtccctaactgacagcagctttatgcaattctccatgtcaatataaaaaatagagcaaatctaatttatggagaattaatctagtcctcaacctaatattaatcaaaatcagaacactacagggttaaaggtagctgagagtacagtgacaagtaccaaacactctaaatggtagggttaaagatagctctagcaccacacagatgacaagtatatggatcttacacactgctaattaatctaggacagagtacgtggatcctacacattggtgtcacagacataggtggtctataccacagagcgatggagctcgcagtcccaaacccaaaggaagctggcgcgattccctcacacggcagacacaatatctacaggcggtacaagcgtacacccctacagagagagaaacactggca

SEQ ID NO: 12105 - DNA, 2074 bp, Zea mays
actactagctagtagttgaacaacttgaacaaaactaactctcgcttatagcctataaataaatataccgttagcaccatgttatgctcataaccaaaacagcagcgggtgtgcatggagaccctccgcgcttacgatgagctgtttccatgggccctccttgtcctcgttaccaccattaccatcctctacctgaagcaactgttggtcgcagcgttcaagagacgcgccaccagctctccttctctcccatgcccaagaggcctcccgctcatcggcaacctacaccagctgggcacggtcccgcatgacgccctcgccgcgctcgccgccaagcacgcagcgccggtcatgctgctccggctagggtcggtgcgcacgctcgtggtgtccaccgccgacgcgctgcgcgccgtgttccagcccaacgacagggcgatgtccggccgcccggcgctgtgcgcggccaccaggatcacctacggcctgcaggacatcgtgttctcgcccccggacggcgggttctggcgcacggcgcgccgcgcgtcgctgtcggagctgctgagcgccccgcgcgtgcgcagcttccgcgacgtccgggagcaggaggccgccgcgctcgtcgccgccgtaacggacatgtccaggagcggctctcccgtgaacctgagcgaggagcttatggcgacgagcaacaagatcctgcggcgcgtcgcgttcggcgacggcggcggggaggaagagagcatccgggccagcgccgtcctcgaggagacgcagaagcttctgggcggcttctttgtggccgattacatgccgtggctggggtggctggacgcgctccggggcctccggaggcggctggagcggaacttccatgagctcgacgcgttctacgagaaggtcatcgacgaccacctcagcaagcgcggtgacgacgacgatgcctccaagtccaagggcgaggacttggtggacgtgctccttcgcctgcacggcgatccggcttaccagagcacgttcaacagccgcgaccagatcaaaggcatccttacggtacgctagcttgcatgctacgtgcgttttcacaagtttcttgatcgacaataaccgtccgtgtgcgtatttcaggacatgttcatcgccgggacagacacagcggcggcgacggtggaatggacaatgacggagctagtaaggcacccggacatcctccccaaggcgcagaaggaggtgcgcggcgccgtggtcggcagagacgacgacatagtccgcgagtccgacctcccgcggctcaagtacctgaagcaggtgatcagggaggcgatgcgggtgcacccgccagtgccgctgctggtgccccgggagaccatcgagccctgcacggtgtacggctgcgagatcccggccaggacgcgggtgttggtgaacgccaaggccatcgggcaggaccccgacgcgtggggcgccgacgcggcgcggttcgtgccggagcggcacgaggagatcgcggacctcagcgaccacaagccgtggcacgacagcttctcgctggtgccgttcggggtcggccggaggagctgccccggcgtgcacttcgccacctccgtggtcgagctgctgctggccaacctgctgttttgcttcgactggcgcgcgccgcacggcggggtcgttgatctggagcaggagaccgggctcaccgtgcacaggaagcatcccctcgtgctcgtagctcgaagggtacgcgtgcaggcgccaagcgatgatgagctcgacggacgtttctccgccatgcattccgttcctagctagtttatttttaacgtaactaaaccggagggagtataatatacttgcatgttgctgtgatccaagtgacgtgtatatatatatgctactatctctgcgtttgtttgttctgttgtgaaatgaatatgttatcttcgattggaaggaacgatcgattcgctatcccatctagtgtatgttttgacaaaatcctgataaaactatgccttcgagtagcgcgcgcgcgcgcttgtgcgtgtgtgtatcgttttattttgaattt

SEQ ID NO: 12106 - DNA, 1821 bp, Zea mays
ccgaggccggccggaaaaaaaggccggccgggagttgctacgccgagcccggcccggataaccaaaacagcagggtgtgcatggagaccctccgcgcttacgatgagctgtttccatgggccctccttgtcctcgttaccaccattaccatcctctacctgaagcaactgttggtcgcagcgttcaagagacgcgccaccagctctccttctctcccatgcccaagaggcctcccgctcatcggcaacctccaccagctgggcacggtcccgcatgacgccctcgccgcgctcgccgccaagcacgcagcgccggtgatgctgctccggctagggtcggtgcgcacgctcgtggtgtccaccgccgacgcgctgcgcgccgtgttccagcccaacgacagggcgatgtccggccgcccggcgctgtgcgcggccaccaggatcacctacggcctgcaggacatcgtgttctcgcccccggacggcgggttctggcgcacggcgcgccgcgcgtcgctgtcggagctgctgagcgccccgcgcgtgcgcagcttccgcgaggtccgggagcaggaggccgccgcgctcgtcgccgccgtaacggacatgtccaggagcggctctcccgtgaacctgagcgaggagcttatggcgacgagcaacaagatcctgcggcgcgtcgcgttcggcgacggcggcggggaggaagagagcatccgggccagcgccgtcctcgaggagacgcagaagcttctgggcggcttctttgtggccgattacatgccgtggctggggtggctggacgcgctccggggcctccggaggcggctggagcggaacttccatgagctcgacgcgttctacgagaaggtcatcgacgaccacctcagcaagcgcggtgacgacgacgatgcctccaagtccaagggcgaggacttggtggacgtgctccttcgcctgcacggcgatccggcttaccagagcacgttcaacagccgcgaccagatcaaaggcatccttacggacatgttcatcgccgggacagacacagcggcggcgacggtggaatggactatgacggagctagtaaggcacccggacaccctcgccaaggcgcagaaggaggtgcgcggcgccgtggtcggcagagacgacgacatagtccgcgagtccgacctcccgcggctcaagtacctgaagcaggtgatcagggaggcgatgcgggtgcacccgccagtgccgctgctggtgccccgggagaccatcgagccctgcacggtgtacggctgcgagatcccggccaggacgcgggtgttggtgaacgccaaggccatcgggcaggaccccgacgcgtggggcgccgacgcggcgcggttcgtgccggagcggcacgaggagatcgcggacctcagcgaccacaagccgtggcacgacagcttctcgctggtgccgttcggggtcggccggaggagctgccccggcgtgcacttcgccacctccgtggtcgagctgctgctggccaacctgctgttttgcttcgactggcgcgcgccgcacggcggggtcgttgatctggagcaggagaccgggctcaccgtgcacaggaagcatcccctcgtgctcgtagctcgaagggtacgcgtgcaggcgccaagcgatgatgagctcgacggacgattctccgccatgcattccgttcctagctagttttttttttaacgtaactaaaccggagggagtataatatacttgcatgttgctgtgatccaagtgacgtgtatatatatatgctactatctctgcgtttgtttgttctgttgtg

SEQ ID NO: 12107 - DNA, 2455 bp, Zea mays
ggggccgcttctatcgtcgccgacgacttcccccctcggccttcccccggcttccacagttccacttcctcttcctcctgcccggcgcgctcccacctcctctcacaatcacaagccacacccatggcgacgacggcccatccggcgctcctcttgctcatcgtcctagcatgtgccggcgccgccagcgggttctacctccccggcgtcgcccccgccgacttccgcaagaacgacttgctcgccgtgaaggtgaaccagctgagctccatcaagacgcagctgccatactcctactactccctccccttctgcaggccggacaccatcgtcaacagcgccgagaacctcggccaggtcctccgcggcgaccgaatcgagaactcaccctacgtgttcgagatgatggagcctaagctgtgtcagatcgcgtgcaaggttgttctgaccgagcagggggcaaaggacatcatggagaaaatccacgacgagtaccgtgtaaacatgattcttgacaacctccctatggtcgtcccgattgagagattggatagagacgcgcctccattctatcagcaaggtgtgcacgtgggtgtcaagggccactacgctgggagtaatgaattcaagtatttcatccacaaccactactcatttctcgtgaagtataacaaggatgcacaaacagatctcgctaggattgtggcctttgaggttaaaccgttcagtcttaaacatgaattcgatggtgattggaaggggaatgcaactcgacttaaaacctgtaatacacaatctgagcatctaatagtgaactctgatgggcctgaagaagtaaaggcaaacaaagagatcattttcacctatgatgttaactttgaggaaagcagtatccagtggtcatcccgctgggacacctacctccgcacgcctgacgatcattggttttccatcgtgaattctctgaccacggtcctcttcctgtctgtgatggttgccatgatcatgctccgaactctgtaccgcgatatttccaagtacaaccagctagaggaccaggaggaggcccaagaggagtctggatggaagcttctccatggcgatgtgttcaggcctcctgccaatgccgacctgctgtgcgtgtacgtgggcacaggtgtacagttctttgggatgctgctggtcaccttgctgattgccatcctggggctcctgtcaccttcaaatcgtggagggttcatgacagccatgatcctgctctgggtcttcatgggcctgcttgcagggtactccactgcacgtcttcacaagatgttcggggggctggaatgggagaaggtcgccatcaagacggtcttggtattccctggagtcgtcttcgtgatgttctttgccctgaacatgctcctctggggcgtgaaatcatctggggctgtgccattcaccaccatgttggcactggttttcctgtggctcggaatctcaatgccactcgtcttcgtcggcagctaccttgggtttaggaagcctgccatacaggccccagtgaggacaaacaagatcccacgcctgataccgcagcagccatggtatatgaacccagccgtctcggtgttggtcggaggtatcctaccctttggtgcagtgttcatggagctcttcttcatcctgacaacgatctggatgcaccagttctactacatcttcgggttcctgttcctcgtcttcgtgatcctgatagcgacctgcgccgagatcaccatcgtgctttgctatttccagctgtgcagtgaggactaccagtggtggtggaggtcctacctgacacccggctcgtcggctctgtacctcttcctgtatgcagcattctatttcttcacgaaactgcagatcacgaaggcggtctccggcgtgctctacttcggctacatgctcatcgcggcttatgccttctttgtactcaccggcaccattggcttttatgcctgcttctggttcaccaggcttatatactcttcggtgaagattgactaggaagctagaatgccatcgtttcatggtcggcaagagaaatcagaggtcaaagttgtgaaagaatacatgaaaatgtagcatggtttatgcacaaaagtaaggtgtccatagggtatctattcgtctgataattcagttacacttttgcgttcagtaaaacttgaggtatgtgcgcgcattattatcacgcagtttacagaattgagatggtacttctagcctgaaatgctgagcatctcatgttgacatgttgtactccttctctttcatacaaaaaatgagtcgtcatttggggcaggggcatggccacagtccacaaaagataatactttcactatgttttctatgaggaagtaacatttcaattaaaagactgtacgctattgtaatatttttcaccataagtctagtaaaaatgatt

SEQ ID NO: 12108 - DNA, 1905 bp, Zea mays
ggcttcgccgagtgcttccggcactcggcgaagctattgattccggtagtgatgtagtatccttattaaataaaatagaataactagtttgttttgaggatgttcaaaagaaggagacctacaatatagtacgtagatatgttggtgtttagtatacatattttccaacgggaacggctttactctctccacaaatgtttttcggttatgccataagttttgttttgttggattgctttatttttgccgaccggccattatcaactgagaatataactttgtacgttgagtgcatggaccattattacatcggctagtcggtatccggtgtgggttggccaagaatcagttcttccaccgaaatgctaggcggatgcctatgaatcaccagctagctagctagccaggagttttggtattccggcatggcatccaggaggagagcagacagaggccggggcggcgagatccgccgcttccgcccaacgggaagcccagccaccaacgcaacgcatgccactcgtcgtctggtataaattctcccacctctcgatcaagcaatcccaagtcccaagaagcagaggagaggcccaagcagagtaatggccaaggtctacccaaacagcgcagccgtcgcggcagagcccgccacccgagccgctgccggcgaccaacaacctgaaccgccgacggtgctgacggtatggcgcaagtcgctgctcttcaactgcgacggcttcaccgtgtacgacgcccggggagacctcgccttccgcgtcgactgctacgccacctcccgccggcgcgccgaggtcgcgctcatggacgccgcgggggcgccgctgctcacgctccaccgcaagaggctcagcctggcggagcgctggctcatctacgaagacggcgccggcaccacgcagccgcagccgcgtcgccctctcctctccgtccaccgccacgtcggtctccgcgcctccggcgggaagacgctggcgcatgtcttcgcgccctcctcggccgcccaggaggcgttcgtggtcgaggggtcgtacggccgtcgtgactgcgccgtgcgcgacgcgcgcggcgacgtcatggccgaggtccggcgcaaggaggccgtcggcgacgacgtgttcaggctggtggtcagtccccgcttcggcgcgccgctcgccatggggcttgtcatcgtcctcgacgagatgttcggcggccgcagctcgtggtcgtggctgcacagagcgtgctaggattggataggcagtagaggccctcccccagttgtcagcgtcagcagagtttataatgcaggctgcggctgggccaaccccctaaaaactagaacgccctatcaccaattacgaaatagtgagaacaatgcaaaagcaaaaaggcacatccaattattttggatatggatgtcagttgattattttgtaatgtcatcagtcatctactgattgttttccgcaaaaaaaaaaaaaaaaatcagccaaacatttgtgttactgcataaacaacagggtgtttgagcgacaatcaggcatgcacaggttcgaaagtaaatagtctactcactttttgtttgggctactacccatgtatttgtaggaatggatgcttgcactgtagaaaacagagaaagatccacaatgtggttgttaaaattcagtgacagatcagtcagttatacaatgctgaaagggaaattaagctgcagtatcggttgaaagttgacacacaacaatttcaaagttctcattcaagttgccatccaccacctaaatttgagttatttgaaatagtgtgtgttctgatgcaataaagattaaggatatttctgccacctataagaaccataccaagcaatacaaatctaacgaaaacaaaaacaacatatac

SEQ ID NO: 12109 - DNA, 1380 bp, Zea mays
gccagggatggatgctgaggtcagcgagatggtcacttgtcacccagagagcagagcgccatcttctccgcgcggccgggtataaatcccctccgcttctcctccagccccgccccacccgctccaccccaagcgcaatggctcatccttgcttaattaccaaggtacctttgcagctgcaggtaggtaggtagctagccgccatagcaagctaggccgaagcagaggagtgatggccaaggtccaccccaacgccgcggagtccgtcgtcgccccagcagtagcaccagtaggctccgcccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagacgcggctcggcttagcggagcgctgggtcatctacgacggcgacgccgacgccgacgacggcacgacggccggggccacgccgctgctgtccgtccgccgccgccgcataggcgcgtgctgcaagacgctggcgctcgcccgcccccgccccgccgccgcgggaaccgacgcaccgtcgtacgtggtggagggctcctacggtcggcgcgcctgcgcggtgcgcgacgcccgcgggggcgccgtcgtcgcggaggtgcagaggaaggaggccgtcggcgacgacgtgttccgcctcgtcgtggccgggcaacgcctcggcgcgccgctgtccatggcgctcgtcatcgccctcgacgacatgttccgcggcggctggtcggcgcggtcgctgctgcgcatgagctcgccggcgtagtactttcactagctatagaagccacgagatggagtggagcccatataccagggactctccctgttacacgtgtaccgttacagtgaccccgggcccagttgtcagcgtcagcagagtttataatgcaggctgcagcaggggcagggctaacccaagcaatatttagatactagaattttcagttcgaatgcgtaaaacagtcggttctctgccaaatcaatcaaatatgaaaaaaaaactatatgtttgcaagatcctgaaaggaataatcaggggaagatacgatgaagggttcgggtttttttagataggaatagtaatacacctactaaaatattagttacacatctagaaaaagtatttattacataaattttgtaactagataaaaattagaggtagaagtgttttttttgtaagcgatccggataaaatactttgctacccattag

SEQ ID NO: 12110 - DNA, 1631 bp, Zea mays
cagagattaggagagatcacacgtcaaatagtggccgacaagccagtagccattcagttacgccctcgtcgccgtcgccgaccactcctcccgccgcgtcaccgagaatataactttgttggcccacccaactcaagcaaattgacctggacggacgaactgatgaagagagtcgatgtgggcggtgaggaatcaggttcctccacctcttccctcccccacggcaaatgcaaatgcaatgctgcctctgcgtatatataccttgtttattatagttatcctgattcacgccggaaaaaatgtattttttttcagttcaaaattggaagacaggaaaatatgggaaggaaatatgcgccgccgccaacttccctttcggtgctcgccgtccggctccggccagggatggatgctgaggtcagcgagatggtcacttgtcacccagagagcagagcgccatcttctccgcgcggccgggtataaatcccctccgcttctcctcccccgccccgccacccgctcgactccaagcgcaatggctcatccttgcttaattaccaaggtacctttgcaggtaggtaggtagctagccgccatagcaagctaggccgaagcagaggagtgatggccaaggtccaccccaacgccgcggagtccgtccaggcagaggccgagggagagctgcccacggtgctgacggtgtggcgcaagtcgctgctcttcaactgcgacggcttcaccgtctacgacgcccgcggcgacctggccttccgcgtggactgctacgccggctcgttccgccgccggcgccgcgccgacgtcgtgctcatggacgccacggggaagccgctgctcaccgtgcgccgcaagacgcggttcggcttagcggagcgctgggtcatctacgacggcgacgccgacgacggcacgacggccggggccacgccgctgctgtccgtccgccgccgccgcataggcgcgtgctgcaagacgctggcgctcgcccgcccccgcccccgctccgccgccgcgggaaccgacgcaccgtcgtacgtggtggagggttcctacggtcggcgcgcctgcgcggtgcgcgacgcccgcgggggcgccgtcgtcgcggaggtgcagaggaaggaggccgtcggcgacgacgtgttccgcctcgtcgtggccgggccacgcctcggcgcgccgctgtccatggcgctcgtcatcgccctcgacgacatgttccgcggcggctggtcggcgcggtcgctgctgcgcatgagctcgccggcgtagtactttcactagctatagaagccacgagatggagtggagcccatataccagggactctccctgttacacgtgtaccgttacagtgaccccgggcccagttgtcagcgtcagcagagtttataatgcaggctgcagcaggggcagggctaacccaagcaatatttagatactagaattttcagttcgaatgcgtaaaacagtcggttctctgccaaatcaatcaaatatgaaaaaactatatatttgccagatcctgaaaggaataatcaggggaagatacgatgaagggttcgggggtttttttagataggaatagtaatacacctactaaaatattagttaca

SEQ ID NO: 12111 - DNA, 1227 bp, Zea mays
caggacaaaagaacgaagaagtgatagacattgcaaaagactaaggcccctgcagagcgtgccagactgcatgtcttaaacctgcgcagcaggctcctgtggtggaaggattccgcagaggtccatcagcgcttgcagcaccaaggacgacagtggacccttgaagaggttgatgcaggtctccagcgtggcacttgcagtagcctgatcagacggctggccttccttaggcagcaagcccaggcgctttagcaggacctggcgtgcgcgttcctggatgttcccacacggccatgcgacttgtgttctgttctaggatgatgtggctataaacaagcggaggtttatggagctaaaggaacatatgcaaggagatttcggtgctgaaaatgaagcatatgagaggtatacacagaatgttgggttactggaggaaacatggtgtcccatggaagatgttgatgttgagcctgaagctgaagcagcttttcttcagaggaaggaaggatgggcttgctggttttggaggcaaatgtgaggttgaagtcggataatgaaaattgccaatggcttcaactatcttggagcagaagttgaagaaattgccgatgaggatgacaaaccatctgatccaaatgaggacgatcatctaaacccaataaagttcagcacaaagcatatcagctatttggaaaggagaagccgagaagggttcctctatagacaggtcaactggaatggagatgaagccgagcgatcaagagtcagctgcagcagtagcatggccttactctatcccagagttgtgcactagatggaggttgatgaagactttgctgcaaagatcgatgatgaaatcacctctttgaatcaggtggcacagctatgaatctggaatctgacccaatcgccatgtgactaattctgtttaaattacctttttcaaggagagagctcttttatcttcaagaaaggtagcatactttggcacaatttgctatggaagtggctagagaatcacaactgaggaatgttgaaggatgaattgaagcagaaaattaagtattggtggtgaggatgttgaaatctgcatggaaatttcctcaaaacctgagagcttcaaatgttattggctgcttcacgcgctctttgtttttcaaccatactgtgacttgtgttttgttctaggatgttgtggctataaacaagtggaggtttatggagcta

SEQ ID NO: 12112 - DNA, 3890 bp, Zea mays
  misc_feature (2340)..(2340): n is a, c, g, or t
caaatgtgaggttgaagtcgggtaatgaaattgccaatggcttcaactatcttggagcagaagctgaagaaattgccgatgaggatggaaaaccatatgatccaaatgaggacgatcatctaaacccaatgaagttcagcacaaagcatatcagctatttggaaaggagaagccgagaagggttcctctattgataggtcaactggaatggagatgaagccgagcgatcaagagtcagctgcatcagtagcatggccttactctatcctagagttgtgcactatatggaggttgatgaagactttgctgcaaagatcgatgatgaaatcacctctttgaatcaggtggcacagctatgaatctggaatctggcccaatcgccatgtgactaattctgtttaaattatctttttcaaggagagagctcttttttcttcaagaaaggtagcatactttggcacaatttgctatggaagtggctagagaatcacaagtgaggaatgtaagttcatttagtggtataataatggcatttgccttgccccttcagtataaatcattcctcaacatctttcatgatagaattatataaaagtgcttaaactgtagcttttgttgaacttgtatcacctgcaggttgaaggatgaattggagcagaaaattaagtattggtggtgaggatgttgaaatctgcatggaaatttcctcaaaacctgagagcttcaaatgttattggctgcttcacgcgctctttgtttttcaaccatactgtgacttgtgttttgttctaggatgttgtggctataaacaagtggaggtttatggagctaaaggaagacatgcaaggagatttcgttgctaaaaatgaagcatatgaggtatacacaaaatgttgggttactggaggaaacattgtctcccatggaagatgcagacgttgaagcctgaagctgaagcaatttttcttcagaggaaggaaggacagacttgcttgtttcggggggcaaaggtgaggctaaagttggataacgaaattgttggtgccttcaactatcttggagcagaagctaaagaaactgcttgagagtcaaagcgcagatgaggatgacaaaccatctgatccaaattaggacgatcatctaaacccaatgaagtttagcacaaagtagaagatggagagagaagctgaagcttaaatgagctgcttggtaagctggctaggacacggattgaggacgacctgaagccttgccgtgatcttattgagcagctgtttggaaaggagaagggttgacagatcaactggaatggagatgaagccgagcgatcaagagtcagctgcagcagcagtagcacgaccttactccatcctagagttgtgcactaggtggaggttgatgaagactttgccgcaaagatcgatgatgaatttctcgtcgttgaatcaggtggcacagctatgaatctggaatgtggaccaatcgtcatgtgactaattctgtttaaatcacttttttcttctaggagagagctcttttatattcatgaaagatagcctacttactttggcacaatttgctatgaaagtggacagagcatcacaactgaggaatgtatgttcatttaatggtataataataatggcatttgccttgtcccttcagtataaagcagatatttctagcttcgtaattataaagatggtccatgccatatcttattatatatttcatttttaccatttctcagcaacttgtagatggaaccaaaagattaagtactagtggttgaaatctgtatggaaattttatcaaaacctgacagcttcaaatgtgcatgtctagataagtgctctaaaaaatatgccagcgagaactagaaacttctaccagccttctctggacttggtggggaccagaaagatttcaagaaaacctattcacttgacttgggaaaatcagcaacacccatattcctcggagctcctcgacccggcaggactgcgacacggcctctgaggacgggagcaagaggttcgtcgacgcctctgtcgcatccgcgaccacaggggccgagtcgttcaggaaggaggagaagctcgtcaagatcaaggaaagttaagtgtcacccgtggcctttctttacctgaacctactgtgaactctttgtcagtgctcggtaatgcactcgatcgatgctttcttgttttttgcctcgtcgtcgtcttgacgcagtggcatcgagggctggtattgagggctgtgctttgaacccttcgtgcaggctatcgtccggagcctgtgtcgtgatccactacacggtcccttgcaacgacagcnacgaaggctctgaacgctcggaggagtgacactgctgctgcattggcaaactagtgagggctttacattgcttgaaacatgcattcaactatacgacccattttttcttcctgttttttactttctcccttagaaacattaggccccttatcactgtataagtgcctattataatgtatcatttatgtgtttcacttaaaaagatttctcatgagactgcctggtagagtgtgtaaaatagaggacgacaaacagtttgtagaaacaagtttaaaatctatactactatattaaggctgcaagagggtagcctgcctccactggttatgccttccatgaatctacattgtccatctatatcaacaaatctacaccgtccgtccgtgcgcctcgtccctccgcctgatgcgccaacatcccacgcccgttcgtgcgccccacccccacacacctcaccggctcaccagcccccgctcaagccgcgctcgctcgaccactcggcaaccctagcctcacctgcctccgccgcccgccatggactccctcacctcaacctccacctcactcctcttcccgcaagcctccacatccagaagtcgcgtccggcattgactggttccgctctcacgcacgcctcgaccacgtgctcgcccacgacgacaaccgcatcgccgtcgcacgcgcctcaggagggtccgctccacccgtgtaacatcccaaaatcccatctaaggtttgaaaccctaacctcctatcccccccctactttgacccttctcccttaacctctacccttagaaccccttctcatgtgcatacacttgaaataattagagcacctcacatagactatgtctctcactcaagatcacttagaaaatatttttggtctccaaggaaaaagaaacaaaaagaaacaaaaatagaaaaaggagaagaaaggaattagaattagaaaaaggagggaaaaagagaaactcccccctcccttggctgggccgaatccggcccaaccagcccccgcacgcccgctctcccttcccctctccccggcccaggcggcccagctccgcgcgccgctccctctcgctgacatccgggccccgcctgtcagcgtctcgtccccctccctctcgcgacgcttcctctcgctggcagccagggcccgcctatcagcttcgtctttctcgcccatccctcaccggcgcatccgccgccgagcccccctcgccccgtcgccttggcattaaggctcgcccaacctccgcgacaaccccgccactgtactcgagccgtcccctcaccccccgcctgcccgagccatcacaatcgacgttagtgccattcccgccatcatggcgagctcgccggtgctcgccgtctcctccatccctgtaacacccggatttttagggggtccaaaacccgggcgcgaacataatcaccaggtgtgctgggaccaagtctcacacatatgatgaatcatggcacaggatcgaatgtcacatctttactatataacaggaattctatacaaaataaataattac

SEQ ID NO: 12113 - DNA, 2054 bp, Zea mays
cattgggtacctcgaggccggccgggacgggcgcgaacttgacacgcgccccctgccccgccgccgcagttctcacctcccacggccacgccggcacgtccgctcgcgcgcacactgtttttttggtaaagggccggcggccgggcagataatcgtaaaggaaggcgaggcaatacacccaccgagagagaagaactaagctttggacacggaagatcgcaagagcctcaaccacactattcaggtggcctaggactctacgagggacgttcgtcgtgcctcggatgagatgggcggcggaggaggaggaggaggcgggaagtccgagaaggcgcggcgttcgtcggcgcgggtgaggctgtgggtcgcgcgcgccagcaccgtgctgctctggacgtgcctcgtccagctcgcggcctaccgggagctctgggcgcccagcgtgctctccaggtggcctggctgcctcaaccagccgcacgtcgcgcggaggccatcggagcgtgtggcggacgccggccagacgcaggcagcgcgcgcgttggtggtgctcccacccaaaagaatctacaggaacaacggctatctaatggtctcctgcaacggcgggcttaaccagatgcgagcagcaatttgtgatatggtaaccatcgcaaggtatcttaacgttactctcatcgtaccggagttggataaggcttcattttgggctgatcccagcgatttccaagacatatttgacgtggactacttcatagcgtcgctgagagacgaggtccggatcctgaggcagctgccgccgaggctcaagagaagagtggagatgggatccctccggtccctgccaccagtcagctggtccgacatcggctactaccgccgtcagattctgcctctggtaaagaagtacaaggtcgttcacctgaacaggacggatgcccggctcgcgaacaacggcctgcccgtggagatgcagagactgcggtgtcgcgtcaactacaatgccctgaggtttacccctgaaatcgaggatctgggcagacgcctggttcgagctcttcgccggaacgggccctttgtggtccttcacttgcggtatgagatggacatgcttgccttctccggatgcacgcacggttgcagcagcatggaggctcaagagctcacgaagatgagatatgcctacccatggtggaaggagaaagtgatcgactcggacgccaagaggaaagacgggctgtgtccgttaacgccggaggagaccgcgctggtgctgcaggcgctcggcattgaccgcggctaccagatctacattgccgcaggcgaaatttacggtgggcagagaagaatggctgcgctcacctcggcttatcccaacgtggttagaaaggagacgctgttgccttgggaagtcggcctcttccagaaccactcctcccagatggctgcgctggactacatggtgtccctggagagcgatgtcttcatacccacctacgacggcaacatggccaaggtcgtagaaggccatcgcaggtacctggggtttaggaagacggtgctgctggaccggaggcgtatcgtcgagctcgtcgacgagtacaggaacggcacgttgagctggaccgacttctcgtctgccgtcatggcgtcgcacaccagccgcatgggcgaaccgtccaggaggcagacggttcctgacagacccaaggaagaggactacttctacgcgaacccgcacgagtgcctgcaccagccggaagatgtctcggccttgtgatacaggccctgccgcggtacagtacagtggatgatgcgcgggctttcggaatccagaaccacatgtatatgtaatagcgcattcgacagcgttgcgttggcagaggataaacgtaaacggacgaggatgtgagttaggtttcggtacagattcatggaacggtggttcgccgattcttttttctgttcagaagaataagcagaccccttcgttgttgttcttgtacagcagacgaagtcgtgaagataaaaacaacagcagcagccacgtcgtg

SEQ ID NO: 12114 - DNA, 1564 bp, Zea mays
agaacaacatgtcatggttgttccacagtatatttccagcaaggatttggcttcgaatgcttctgaacaaaaggatactattgtgctacctaacctccggccgcccgcgctggtacccaaaagtagtgctggtaaaaaaagtgggcgcatcttgcgagctgtcatttttgtgcatggttttcagggccaccatttggatttacgtcttgttagaaaccaatggcttctattggaccctggagctgattgcctaatgtctgaggctaatgaagataaaacatctggagacttcaaagaaatgggtagcaggttggccggggaggtaattgccttcctgaagaagaaaatggataagctttctagatatggaggctgcaaagagctgaagttaagttttgtcggccattccattgggaacatcatcattagaagtgccctggcagaacctgcattgcagccatacttgaagaacctctacacttacatgtcaatatcagggcctcacttgggttactggtacagttcaaattctttgttcaattctggactctggctgctgaaaaagctcaagaatgctcaatgcatccatcaactcactttcagtgatgatcaagacccccacaatacatacttctataagctttgcaagttgaaaacattggagaacttcaaaaatatcatattgttatcatcaccacaggatggctatgtaccatatcactcagcgagaatggagctctgcccagccgcatcatcggacacctcaaagaagggtcaagtcttcacagaaatgctcaacaattgcttggatcagatccgtgcgccctcatctgacacccggacgttcatgcgctgcgatgtgaattttgaccagtccaaccacggacggagcctgaacaccatgattggcagggcagcccacatcgagttccttgagaccgacatctacgccaagttcatcatgtggtccttccctgacctgttccgatgacagacaacgccgctcgtctctgtaatgtctctgtaatactgctgcataccaaacctacaaaccgatagcgcacactactgagtactgaccaggcaaggaaaagtaagcttgcataaaggctcccccagaatccaacaccgccacaggcagagtagcgctgtaaagatcctagaagcaacggtttttccagcttgctagatctgattctgtataaatagttgattctttcgtcattccattcatagtgctgtagatgtgcacctttgctgtgaatttataatcctttgtcggcttgtgtatctaacgcttcggtttaggatgtgctgacaatcagtgagcttatgtccaaataagccccctttcttaatgtttggttttagtcaccttggtctttgtgctgctgtaaatccaagcgtgttgtttctgtttggtgaaatgactgctacaggaatatctggttctggcatcctgccatagctggatcttgcttctgctaaggttattcctatcaggggtattggataggattggaaaaatatatgaaagattttgatttgtttggtatttaacccc

SEQ ID NO: 12115 - DNA, 1832 bp, Zea mays
aggccggccgggccggggtcccccgaaactggcaaaggtgtgggacagttggctggaattttacatgacttcttggagagacccaacgatatggttaatggtacagatgattctttattgtatactcttccccatgaagagctgtttgaactgtttctaactctgagtggacagctttcacttctatggaatgcattcttgaaatttcgtaggctaaataaaacaaagatattggactacttgcacgatgcttgggctattggcaggaaggcagaatggtcaatatggactattcactcgaaaattgagatccctcatcgctatctgcagagtatgagtgatgactcaccccaccgttattctcttagagtttctggctcaaggaagttccatgatgaccatgtacagagctctgcttcacgggcggaactacacaggaaaagcatagcacaaatgaagattaatccacattatgttcaagatatgcatatatatggtgatccttcacgtgttcctgttgttcttatagaacaacatgtcatggttgttccacagcatagttccagcaaggatatggatcaaatgtttctgaacaaaaggatactattgtggtaccgaaactacaaggagagcctctggtacccaaaagtagtgctggtaaaaaaagtggacgcatattgagagctgtcatttttgtgcatggatttcagggtcaccatctggatttacgtcttgttagaaaccaatggcttctattggatcctggagctgactgcctgatgtctgaggctaatgaagataaaacatctggagattttaaagaaatgggtagcaggttggctggggaggtagttgccttcctgaagaagaaaatggataagctttcgagatatggaggctgcaaagagctgaagttaagtttcgtaggtcattccattggaaacgtcatcattagaagtgccctggcagaacctgcattgcaaccatacttgaagaacctttacacttacatgtcaatatcagggcctcacttgggttactggtacagttcaaattctttgttcaattctggactctggctgctgaaaaactcaagggtgcgcaatgcatccatcaactcactttcagtgatgatcaagacccccagaatacatacttttataagctttgcaagttgaaaacgttggagaacttccaaaatatcatattgctgtcatcaccacaggttattccctttcctcatctctaatagcaatttacttgcgtgtggaatttgttttgctgcaataaataactgggactctatagtccttatagcagcatgtcatgacttgtgagctatgccctatgcacacctttgtgttcttccaggatggctacgtaccatatcattcagcgagaatcgagctctgcccagctgcatcatcggacacgtcaaagaagggccaagtcttcacagaaatgctgaacaactgcttggaccagatccgcacgccctcgtccgacacccggacattcatgcgctgcgacgtgaatttcgaccagtccaaccaagggcgaagcctgaacaccatgattggcagagcggcccacatcgagttcctggaaaccgacctctacgccaagttcatcatgtggtcctttcccgacctgttccgatgacgacgacgacaccgctcgtctttgtaatactggcacataccaaaccaataacgcacactacccagtactgaccaggcaaggaatactaaagctcgctccaccagaacccaacaccgagacaggcaggaagcactgtgaaggtcctagaagcatggtttttccagcttgct

SEQ ID NO: 12116 - DNA, 1336 bp, Zea mays
ctcgaggccggccaggattctgctctccgcctcccgcagccctacgcgcccgcaggtctgagcccgctacgcctgtaccctagtccctacgaagtcctcttcgacccctatcccctccccagcggcgagaaagaacgggcgcgctcgtcttcgcctcctctgtgcctgtggatcggcgcggcgaggggatccgtccgggggtttggatcggtttcttctccatctccatcttcacctgttgttgaactttgagttaaagacaatggacctggagacagagaatcgtcttgcttctttgctaattgaagaggcgcggagattgcagttagaggctgacagggaaggtgttcatgcatatcttcgaaaacctaatgttaggcatcgtccaaattcaaggtttctcacagccacagttcgtggagttcagcaagcaaaccgtgttgtggaggttaatgaaatgtggcgtgccagggcaaaggaactggagttggagtcaaagatgaaaagcagaagtagcagaagtaacaatcgtgatgattttagaggagagaagcgcaaaagtgatttgagaaatcatggctcaaggtttgaacaagaagggaccacttatagtaattcttactcagaccgggaggatggtctcagtgatgatgagattgaaagatttcttcattcaagggcgaaacgaggacgtggggctattggttctaggatggacgagcctggtccatatcttgattctttgtcccgacatcaggacaacggacctagtcctgacatacgtgtggaagaaaaatgggaacgccaagtacaaggcccagagaagccttcatttttgagacccaagtcttctgatagtcattggcataaggatacttcggatggaagggcatcaagctctgaaccactgaataaaaaggaaaagaaaaagaagtcggagaaaaaagataagagagagaaaaggaaggaaaaggacaggaagaaatacaaacatcgccatcaccgcaatcacaaaagccgaagacgggagtgaattgggtgatggtagctggtagttagtggtggtaatggatcatgatccaaatgtttttcacactaagttagggtccttaattaattttagttctaaagtgaatagaaatagagctcgatcctaatccgattcgattctttaattttatagtgtaaaatttagagtttattaccacctttactgataataggacagaaaaatgtagctagcatattatgctctgtaacttgaaacatgcattgtatggaaatctcgatattgtgtagcaatggagtatggttcttacaaaaaaaaaaaaaaatg

SEQ ID NO: 12117 - DNA, 1334 bp, Zea mays
tgccctacgcgcccgcaggtctgagcccgctacgcctgtaccctacgaagtcttcttcgacccttatcccctccacagcggcgagaaagaacgggcgcgctcgtcttcgcctcctctgtgccggtggatcggcgcggcgaggggatccgtccgggggtttggatcggtttcttctccatcttcatctgttgttgaactttgagttagacaatggacctggagacagagaatcgtcttgcttctttgctaattgaagaggcgcggagattgcagttagaggctgacagggaaggtgttcatgcatatcttcgaaaacctaatgttaggcatcgtccaaattcaaggtttctcacagccacagttcgtggagttcagcaagcaaaccgtgttgtggaggttaatgaaatgtggcgtgccagggcaaaggaactggagttggagtcaaagatgaaaagcaaaaatagcagaagtaacaatcgtgatgattttagaggagagaagcccaaaagtgatttgagaaatcatagctctggctcaaggtttgaacaagaagggaccacttatagtaattcttactcagaacgggaggatggtctccgtgatgatgagattgaaagatttcttcattcaagggcgaaacgaggacgtggggctgttggttctaggatggacgggcctggtccatatcttgattctttgtcccgacatcaggacaacggacctagtcctgacatacgtgtggaagaaaaatgggaacgccaagtacaaggtccagagaagccttcatttttgagatccaagtctcctgatagtcattggcataaggatacttcggatggaagggcatcaagctctgaacccctgagtaaaaaagagaagaaaaagaagtcggagaaaaaagataagagagacaaaaggaaggaaaaggacaggaagaaacacaaacatcgccatcaccgcaatcacaaaagccgaagacgggagtgaattgagtgatgttagctggtagctaggggtgtaggggtggtaatggatcacgatccaaatgttttttacattaagttagggtccttaattaattttagtttaaaagtgaatataaatagagtttgattttaatccaattcgattcttcaattttatagtgtaaaatttagagttcattaccacctttactggtaatagaacagaaaaatgtgcgcaacggttgtgccctaaaacgagctagcagattgtgctctgtaacttgaaacatgcattgtatggaaatctcgatattgtgtagcaatggagtatggttcttacaatactttgttgttgtgaaaaaaaaaaaa

SEQ ID NO: 12118 - DNA, 1178 bp, Zea mays
ttgggtccctcgaggccggccggaaaaaaaataaaaaaccagcttccactccaagtctgcctggctgctcacctctctgctccttccttcggcctttccttccttccctccctccctccctccagagtccggagcagagcagtcaaccgggctgtcgtcgccattggtgcggtacgtgcgagcccgagcggtgcgacgcagggggggaggggccagtgagagagacgacacgcgagagcgaagccaagcgaaggaggagcttcctggcgcgcgcggatcgcggaggctgtatatatatagtcgggggccgcgcgccccgccccggtaacgtgtctgcaggtggggggtggcgcagggcaggattaggcagggcagcgccgcgccggccggaccgcccgtccaggagccagggactttcggccatgggggacggtggtgctgacgacgcctcctcgccgccgccgcatgacgggggcttctcctacctcgccgtcttccacaactaccccctcgtcgccgccctgctcggcttcgccgtcgcgcagtccatcaagttcttcctcacatggtacaaggagaacaggtgggatcccaagcagcttatcggctctggtggcatgccatcatcacattctgccacggttacagcactagcagtagcgattgggttgcaagatggctttaactgctccctctttgcaacagcaactatatttgcaagtgtggtaatgtacgatgcttctggtatcagattgcatgctggaaagcaagcagcggtactgaaccaaatagtttgtgaacttccttctgaacatcccttgtctgaaacaagaccactgcgagaacttttaggccatacaccaacccaggttgttgctggcgcattgcttgggtgtacgatagccacagcaggacaattattcgtttgaactccgaaggtgcaggagaaatgttgtagcatttgcatcgcggggacttgagaagaagtttctctagtgttctgctactttaggtattggtaagattttcaacttggtgctgtagtgttgtcgaatgttgtaagctctgatggaacgtgattatttgtcaaggtgatgttcacaggattgttgtacagaacatttgttcgataatgtcatggttatgattgatgtaaaaaaaaaagtgattagaatagt

SEQ ID NO: 12119 - DNA, 1251 bp, Zea mays
aaaagcggccgagctgctcctctcgcccacgcccgagaccgagaggccgcgccggcgcacccaaataaacccgaggagtgcctacctggcctgggcgcctggttgagcggtaaacaaatccgtgggcgtcctgcggctgcgattagaatagagtagttcccgcctccgggtcgccgtcgccattggcgcggtgcgtgtgcgagcccgagccgtgcgaagcaggtgaggcgaggggacagacgggacacgggagcgaagcaaagcgaaggaaggagtttccagtgagcgcggatcgcggaggcggtttatatagccggagggcgcgcgctccggtccgctaacgtcctgcagggagggaagggcaggattaggcagggcagcgccgcgccggccggaccgcccgcccgcccgcccgtccacgagccacggactttcggccatgggggacgctggcgctgacgcctcctcctcgccgccgccgccgtccgggtccttctcctacttcgccgtcttccgcaactaccccctcgtcgccgccctgctcggcttcgccgtcgcccagtccatcaagttcttcgtcacacggtacaaggagaacagatgggatcccaagcggcttatcggctcgggtggcatgccgtcatcacattccgccacggttacagcactagcagtagcaattggattccaggatggctttagctgctccctctttgcaacagcaactatatttgcaagcgtggtaatgtatgatgcttctggtatcagactgcatgctggaaagcaagcagaggtattgaatcaaatagtttgtgaacttccttctgaacaccccttgtctgagacaagaccactgcgagaacttttaggccatacaccaactcaggtggttgctggtgcattgcttgggtgtacaatagccacagcaggacaattattcctttgaactacgaaggtgcggcagaaatgttgtagcatttgtatcgcagggacttgagaagaagtttctccagtgttctgctactttaggtattggtaagatttgcatgttggtgctgtagtgttgttgaatgttgtatgttctgatggaatgtggttatatgtcaaaaaggtgacgttcacaggattgctgtacagaacattgttcatggttatgattgatgaaatctaaaatgtgattgaaacagctgcagaactaagggagtgtttggtttgatggacagcaaaaaaaaatgtctgtcgtgtttatcc

SEQ ID NO: 12120 - DNA, 1329 bp, Zea mays
tcgggcactgcgacgccgcccgcccgggcaagtgcctgctcacaattagcagtgtacgtagttgacaccacacagctgcgccattaacatatagcaggcctagcagtgccgttctggaaagggcgggagaggggatgaggacgagaggtggcagcggattcgccggcctgcaggtggcgtgcgtcgtcgccgccctgtgcctgctcctgccgacggggagccgcgcccaactgcaggtggggttctacaacacctcctgccccaacgccgaggcgctcgtgcgtcaggtcgtcacggctgctttcgccaacaactccggcgtcgcacccgggctcatccgcctccatttccatgactgcttcgtcaggggttgcgatgcctccgtgctcctgtccgtgaaccccgccggcggcaaaacggagcgtgagtccccggccaacgacccgagcctgcgcggcttcgacgtgatcgacgccgccaaggccgccgtggagcggagctgcccacgcacggtgtcgtgcgccgacgtcctcgcgttcgcggcccgcgacagcgtcaccctgacgggcaacctcttctacgacgtgccagcggggcggcgggacggccgcgtgtccaacgagacggaggccaacgacaacctgctggggccggacagcacggcggagatcctcatcgacggcttcgggaagaagaacctgagcatcgaggacatggtggtcctgtccggctcccacaccatcggccgctcccactgcttctccttcctgtccaccaaccggcagcggctggccaacgggaccataagcccagcgtaccaggcgctgctggaggcgctgtgcccgcccaacccgggccagttcacccccaacaccacggagatcgacgtcagcacgcccaccgtgctggacaacaactacgtacaagctgctgccgctcaacctgggcctgcacttctccgacgaccagcttatccgcaacggcactctcgcgccgttcgccagcgcattcgccgccaacgagacgctctggaaggacaagttcgccgccgccatgatcaagatgggcaacatcgaggttaagaccggcaccaccgatgagatccgcctcaactgcagcgtcgtcaacccgtagtagtcgtcgtccaccgctggggtgatcgagatgctgttccctgcagccgacgaggttgccacgagctcatgactgatcgaaaaaatatatccactcgtgttaataacgcgcgtgcggagtacgtacatatcttcgcctttgtacgtacgtggacctcgattgtttgctgcgcgcacgaaaaaaaaaaaaaaaaaa

SEQ ID NO: 12121 - DNA, 3425 bp, Zea mays
accttgcctcaaggccggccggcaactttcttcctcgctctttctctctctccgtgcgtctgcggtctgccatcggcatcgcccccaccccaccaccacacgtccacctctcccgcaattgggaatttctcctcaccgcctcgtctctgccgggctcgctcgtacgtcgctccccacccgcaatggcggccactttcgccctcctccttctcctgatcctgtcctcgtcggtccgcgccgcccccgacgccgtggtgtcgaggatcgccttcggatcctgcgccaaccagagcgagccccagcccatttggaacgccgtcgcggggttcgacccgcaggtgttcgtctggctcggggacaacgtctacggcgacaacaagcgcccattccgggtcttcgggagggagcgcaccgtggggccctggaagaacgtgccgcgcttctacccttccaccgaggaggagctgcggaggcggtaccagctcgccagggcgcagcccgggtacgccaggctcagggagagggctcaggttcttggaacatgggatgaccatgattatggattgaatgatgcaggaaaagaacttagtgggaaagtgattgctcaaaggcttatgttagatttcttggatgaacctgaagacagtaaacggaggaaacaagctggtgtttatgcctcatacatgtttggccctgaaggaaaacgtgtgaaggtaatcttgctggataccagatatcacagagacccgctattaagtgatggaactattctgggagatccccagtggcagtggctagagagggagcttcatggtccacaatcagagatcaccatcattggatcttcgatccaggtagtgtctaatctttcagccactactgggcctttgttctatgtggagtcctgggcacgcttcccgagggagagagaaaggctgttcagattgattgatagtagtaagagacctggagtgctatttattagtggggatgtccatttcggagaaatcaccagattcgattgtggagctcaatacccatcatatgatgttacttcgagtggtcttacccagtctgtcgagaactctgtgccagaagtgtttcaacctcttatgagacttctggcaatactaacaccaactaccatgcgagttttgagcccaaattgccaatataaatcatgtacaataggccaaccaaattttggagcgattgaaattgattggaacgctgtacctccgcggattaaacttgaactaagagatgttgagggtcattctgttcacagcgtagagttccctatatctgaactgcagccctcggaagcgcatgcaatcaaaagacaaacccatactttccaacgtcactgtactctcgaaacagagctcccatggctaacacgataccggcttgctctgatgttgtttgtcatcatagctgtttttgcggtggttgtggtgatgctagcgatcgcctgcttgtcaaactttaccaagtccagtaagaaaagcaagaaggaatagctgtgagctgcagaggagaaacgaagattcggtccagctataagctggatttcacactgaccagggatcacctatctcaaaccatgcctttgagcaggcaagagccagattgcaccacagtatcaagcagtacactgcgttgtgcaatttgcaaagcgcagattggatagatagatatgatagctaacaaataacttacaaccatgtgcctgcctcgtacagcttcgccttttgttttccgtcttcatgccttccgccctgtttttgttttctggtaagcattacattgactaagaaaaatcttggcggtggaagtgtcccacaagtcagctaactagtctgctggggcccccctcgcacacggatggcatccctggtgctctcggttaattgcagtgtactcagacacgcgttcacatgtaccctgctagggccaatacggcctccagtctcgaaatagaactgatgtgaaacacgtgagcgacggtttatcttcgtatcgcatctatattcatatttaacattaaggactcgtttggtttgagggagtagtttggtttgaaggagtaatgattagttcctttatttttagtcttattcagcctctaagagcaattctaataattctttaaaagacttcataaatcaataatcaataatttagttaattaacataaaaattcctctccaacaacagttatctaaatgaacttaataaatttagtaattttttatctcatctcctctctacgtttggcaactatttagcaactctctaaacaaaaatcttgactacattacatagataatgaaggtaattgatgatatttgtgacttttttatgtggatatatataaaacaaaactacaaaccatatttagagaactattggagaattcatattttttactccccaagttatttagcaacttcttaaatctataatttagagagctaaaatttatataattattggcgttgctctaaattgctaaacggtgggactaaaacagagactaggtccctcaagaggtggctaaaaggaactaaatcatattaattttattttttgcctctcatttattgcactaattgcgggtgatcttcttatgatttatttaatgtgttataaatacttttagtccataccagcaaaaagggtagggacctaactaaatgaaccaaacatgccctaagagctagtttgtattaataacatgtttggtttgaggaatgaggtagtccatcaacttctcaatcattttttttgttttagtttatggaatagaatgagttaatccatcatcatttttccaaaagattcttattttactaaggcctcgtatgtttcgttggaattggatttcattctaataattacaatttagacaaaactaattaagttaatatatttgtctatataatatatttatatattatcctaaatcatacgagaaagatagttatacactatatttatgttatagagaggcaagtagaacaatgctataaattatacattaaaagtagcatgtaaatctataaaatcaattttcatctctcgccccatgaatttgagatagacttatatatacactttagaaaattgtggaatgtcacattctaaaaaaaatagtctattccgttagtcaaattccaatttctcaaaatgaagcgtaacaaatgggccctaagagaaaataaattaatttcctttaagaaaatagaagcaccctgtaaaaatagagtttttaaactaggcctaaaatattttttctcttaatctctagaaatcactttcaaactagctctaaataactaaaatttatgtctatctttttttcttctggtccagcactattctaatttctaaccaaacaacaaaacccgcttccacacccg

SEQ ID NO: 12122 - DNA, 4073 bp, Zea mays
  misc_feature (2411)..(2411): n is a, c, g, or t
gtataaaatattttactgatttctttgggcgattttggaagcctccagccgctttactagcagcgtgtcatcagctagagccctcccctttttatcatcatcctctggcaccccgggccggcacctcgtgtgtctgtttctccggcctgggctctgggctcgggcgtagtccagttgccaccaaccgagccagagagagaacaaagaacgggtgaaagaaatctcggaaaggttccagatttcctcgaggtggaggcctccttttcctcggccgaatcgctcgttcgctttctctctctctttcctcccatcgagcatgcattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggcagcgcgtgcatcttgcgaccccctttccaagaaccagctgcaagctttggccttttccgcctgccgtacccgaaatcccgcaagaaactccacccaagaaaaaagcggcgcccttttggctggctggctgccattcctcacgccccacgagtttggtgaggctttgaaacgagcacagttcacaagacagtgaggctgcggtgggtgtttcctcgtcggagatggagggaaatttgccgccgcaaaccatggtcccaggcggaggccccttcgatctggggcagccgttccacttcgccgtccaaccccaggcgctccaggtttaccaggatgtcttcgctgcccccgccgcgagccagatgccggagctcggcaatgtggtgaaggcctcgctgagcgacgaggaggagggcggcgacggccacctcgaccgcggcaaggcggcagccgcctcccagtggcaccgggtcaagtggaccagcggcatggtcaagctgctggtgtcggccgtgtcctacatcgacgaggacgtggacgcggaccacgggaccagcagcgggaggaggaagcacgccgtgctcaagaggatgggcaagtggaagctggtctcctcggccatgaccgagaggggtttcgctgtgtcgccgcagcagtgcgaggacaagttcaacgacctcaacaagaggtacaagaggctcactgagatcctcggccggggaagggcttgccagatcgtcgagaagccagagctccttgaacagttgagcctatctgggaagctcagggaggaggccaagaagcatctcaactccaagcatctgcactacgaggagatgtgctcctaccacaacaggaaccgctactgcctgcttgatgatcctgtccttcagaggtccctgcggatggcgcttagggctccagctgaacagggaaagcaatgcttgtttggctatgatgacgaggatgatcagatgttgctttctgatgatgatgatgattatgaggatgacgagttgaatgacgatctggaggccggtgctgaggatcatggtcctcacagagttcatgccaccgagaaactgaaacatgatcatgagggacattgtgggtctcatctgtcagaagttgcagccattgacatgaacagaatgaacttcgaaggatctggtggtccatcctctgagaagaatttaagttatatgcgtgttcaaatcgagaggcagcgtctgaaaataaaatctcagatgctgagaattgagcagaggcatttcaagtggctgaagttcagcaaggagaaggacagggagctgcagaaaatgaagctggagaatgaaaggatggcgctggaaaatgagcgattggagctggagctgaagcttaaggaaattgagataggcatcaaaccaaagaggatttagagattgcaggatgcaagtggtagagctagggaacttttagagtttctggtaaccattttatctattgtagtaccttacaaattaggatatgttacatagtttcatcttcgctaactgcatatcagttaagttaataactctgttggtttcaagcatttgcaataagtacagtttaccatctgaatatgatgcttaatgttatcattgcccagtgttatccatctcactactattggctggctgtatgctttggttgagcactgtgtatttcctgttctgttcttatgatatctctgtattatttcagggttctaacctggctggtacaggtactctaggataagatgttgtgtcgtctcagtgtgctttgtgaataccattattacatcaatatcaacgaagagtttgttntcttcatccgtgctttccaggtcgatttgatctaatgtaacgtgaagtttcagaaatgctttacgatagcatcagctggactgtgtactgtatgttgtatcgaacccttctttcttcactaacatacagtaccagatattcatcccttcaagctaccatttaaaaagcaagcttcatctgttttgaccattagtgttggtgggctagaagcctgcatcttttgtcgaacattccaattattttgcgttcattcgtctgcttatatttgtgatgctggtattgtccacttcgtatgtcataagctgacggtagtgtgttggacagtggatggttttgtgaaaaagggtcgaagagtgccttttttttttgaaatgctatgaacactctgcacctgcaacttgctgccttgccggcaatcgaaatgttgacttgagaattgggaactttaaaaaagtgtttcagaaacgctttgcagttaagatatggtgatcatgatatgttttcttcagttctggccatcgctcagaaaatgtctctgaaaaactatgcataccataaagcgagcggcttgttttctaagagtacacatctgggacagcaatcatggagacaaataatcagcgcgtactcatatcagacagactggatgttttctgatccagatacaggaaccatgattgcaacccgaatgctacaacgacaaaggaaatcacttgggggcgatcatgcctggaagggcccctgacggaccaatgcaatgagaactaaagacgccgtcttttccgtttggaaactaaaaagaaaaattgtatttattttgcataaggaaattcagagaatgcattggctggtcccaggtgtggaatcaagttctgagtgctactttggagatgcccagcgtggccagtagcagtacaacatgtcaggtgtgaatcaatgtcctaccccgcctgatcacctagtattttgtttcgctcacgagtacgtattatacatctgcagctatacaatactctctttttgatttatcacgttttagttcaaaaatgaactagcgggcgacaaatattcgagaacggatgtagtactactgtagcttgttttattcgactctgtcatcgcacgtcaacaacacgtcttgataagggtgtaacaaccgggaacaactatggtaggagccacacttttcagatctcaagttagagaaatgaatatttgtcagctaaaatatctgtagatctcaatagcagtctagaggattagagaaagggaccatacaagagagagcatgaaaactaaaccactagatagaagccagagagatagctagttagggacaacccttctcttatttatactctattacacattttcatcatactgctaaatagtttagagctaaaccacttactcagagacataatggacaaactcccaaattgtagataagatgaccacactcccttttattattttgctttgcctcgatgcaaccttcattatggctttatgtggcacctttgattctcgctgaaaccatgcctaggattttgaggtcagacccacgaaaactattaccgggtgattttgtggctcaaccaccaaaccatcgtaggtagcatactccatacgcgtttttcatatcctattcacatgtcttgc

SEQ ID NO: 12123 - DNA, 700 bp, Zea mays
gcacgagaccattacctagaacatcctaatcgaaaagtcacaacacgtccgcatactcccaagttcccaaccaaatctccctccagcaccgcagctagcccgagaagccgacgaggaggaaaccgaccgccgacgccgagcaccctcggttccttgttttcccggcgcccaatctagacagctctttctcgttcgtctgtatccatggccgccgcctcgagcaagaccgtcgctgtcctcctcgccgcgctgctcctcgcgctggtcacgtccgcggtggccagcaggaagctggaggaggacgctttcctgggaagcctttcgccggcgcctgcccccgccgtgggcggagccgccaggctcgctagcgccaagccgggggcgtgggccgtcgccgctctggtctctctcatcgccttcctcgcgaactgagcgggtcctgcgatctggattgctgcgggcggaggggaacatttatgctcgtcctgtttgttctaggctatcggattccagtgctgctgacctctcttttggctgtataagagaggattacgcaccgtttcattttatactactacttatctgttattcttttaccatatgtgttctttgccatgatccccgtctatggtttgcctaagcaactttagtcaggggcagcatttgacaaaaaaaaaaaaaaaaaaaaaaaaaaaaaaaa

SEQ ID NO: 12124 - DNA, 682 bp, Zea mays
aaccacacgtccacatactccccaaatctccctccagcgccgcagctagcccgagaagccgacgaggaggaaaccgaccgccgacgccgagcaccctcggttcctggctttcccggcgcccaatctagacagctctttctcgttcgtctgtatccatggccgccgcctcgagcaagaccatcgctgtcctcctcgccgcgctgctcctcgcgctggtcgcgtccgcggtggccagcaggaagctggaggaggaggacgctttcctgggaagcctttcgccggcgcctgcccccgccgagggcggagccgcggggctcgctagcggcacgccgggggcgtgggccgtcgccgctctgaccgtctttgttaagctgacttgtaccctgttcagcatcatgtgattaggcggataagaaccattagatcattctattagtttgaagtagaagtatgattactctttcttttttctcataaaacatgtaccttgggagaatgggttacaatttttttttctcccacaaaagatgtatcagagttgaagtatggtaactctttttatttttctcgttacaaaatatgtaccaaatttacttcactgtatactggctggaaatatgcaacactgtgatgtggctgttaaatagatgtgatcagattctatgcaaaaaaaaaaaaaaaa

SEQ ID NO: 12125 - DNA, 669 bp, Zea mays
cattgggtaccccggccccggccggaccacacgtccacatactcccaaatctccctccagcgccgcagctagcccgagaagccgacgaggaggaaaccgaccgccgacgccgagcaccctcggttcctggctttcccggcgcccaatctagacagctctttctcgttcgtctgtatccatggccgccgcctcgagcaagaccatcgctgtcctcctcgccgcgctgctcctcgcgctggtcgcgtccgcggtggccagcaggaagctggaggaggaggacgctttcctgggaagcctttcgccggcgcctgcccccgccgagggcggagccgcggggctcgctagcggcacgccgggggcgtgggccgtcgccgctctggtctctctcatcgccttcctcgcgaactgagcgggtcctgcgatctggattgctgcgggcggaggggaacatttatgctcgccctgtttgttctaggctatcggttccagtgctgctgtcctcacttttggctgtataagagaggattacgcaccgtttcattttatactactacttatctgttactagtgtattgcgcgcgcctatgcgcgcgtgctgaatagcaacttgaaatgttttatgaggaaaaaaaaaaaaaaaaagcagtgtgaccaaaaaaaaaaaaaaaa

SEQ ID NO: 12126 - DNA, 695 bp, Zea mays
gtgcctcgcgccggccggccgggccggacaacacgtccgcatactcccaaatctccctccaacgcccgcatctagcccgagaagccgacgaggaggaaaccgacagccgagcaccctcggttccttgcttgcccagcgcccaatctagacagctctttctcgttcgtctgtatccatggccgcctcgagcaagaccgtcgctgtcctcctcgccgcgctgctcctcgcgctggtcgcgtccgcggtggccagcaggaagctggaggaggacgctttcctgggaagcctttcgccggcgcctgcccccgccgagggcggagccgcggggctcgctagcggcaagccgggggcgtgggccgtcgccgctctggtctctctcatcgccttcctcgcgaactgaggggggtcctgcgatctggattgctgcgggcggaggggaacatttatgctcgccctgtttgttctaggctatcggttccagtgctgctgtcctcacttttggctgtataagagaggattacgcaccgtttcattttatactactacttatctgttactagtgtattgcgcgcgcctatgcgcgcgtgctgaatagcaacttgaaatgttttatgaggatatcgaattggatgttgcagtgtgatcacaaaaaaaaaaaaaaaaccaaaaaaaaaaaaaaaaaggcccctagggcc

SEQ ID NO: 12127 - DNA, 1319 bp, Zea mays
ccaagcccgcaattaaccctcactaaagggaacaaaagctggagctccaccgcggtggcggccgctctagaactagtggatcccccgggctgcaggaattcgcacgagaccattacctagaacatcctaatcgaacccggctttgttataacggatttttttcccgacacggctggtcggctgccatcgccatgtgcctcgccgccgcgtgcgcgtccgccaccctcgcccgccgcctctcgccctccaccgcgctcccgcgccgcttcctcctcggcgcccccacgaggccttccccgccaccgcctctgctgcggcgctgcctcccgttccacttctaccatatggcgcaatattggactcaaccatcactggacaggaacaaagctatggttgagtacctaaagcagtatggttctgttagaactgataaagtgaaggaagtaatggaaacgattgatagagcactatttgtaccagagggtaccccttacattgacagtcctatgcctattggtttcaacgcgacgatatctgctcctcacatgcatgcgacctgcttagagctattgaaggatcatttgcaaccaggaatgcatgctctggatgtcggatcaggtagtggctacctgacagcttgttttgccatgatggttggaccagaaggccgtgcagtgggaattgaacacgttcccgagatcgttgcttcttctgttgaaaatgtgcaaagaagcgctgctgctccactactgagggatggatcgctctcttttcatgttacagatggcaggcttggctttccagacgcggcaccctacgacgctatccatgtcggtgcagcggcacccgagatccctcagcctctgcttgatcagctaaagcctggcggccggatggtgataccggttggcacctactcccaggacctgcaggtggtggacaagaacacggatggatcattcagcgtccggagcgacgcggctgtgcgctacgtcccactgaccagccgcgccgcgcagttgcagggcccctaaataaggttctctatgctctataccacgaaatgcctgtacatatatatatggtggtagctacgttcttacctgttcgtgtttcttcttctgagtagctaggtggtctcagtccgttcgtgtttcacgaacaacgacggtgaaaaaagagtggttttactgtaataagaaggatcgctagcatgtttctggtcaaaaaaaaaaaaaaaaggtggatgatgttttgaacgaacttccatctgtccgccgctgaggtgtgcatgtacaagtacaaactagccttgcacc

SEQ ID NO: 12128 - DNA, 501 bp, Zea mays
  misc_feature (473)..(473): n is a, c, g, or t
  misc_feature (492)..(492): n is a, c, g, or t
  misc_feature (497)..(497): n is a, c, g, or t
ggtgtataaaatcggtggtggccatcaagctccccgtttagcattacctatcggtgcagagcctgtggcagatcctactcgacttgttgctgtcaacatcagcccggatatgatccatacagtgcttgcaatttcctatggtaaggaccctgaaaaaataatatctagcaatgttgccggattcattcatgttactgatgttgacatccaaaggaaaaagcttacgtacattgccccttgcccgggggacttgccaaacaggttgttgttcccgagttcccttacatggtatgaagcgtgatcagtctaagttagatgggccatatgcccatacgcatgttgtaaagccaggacatgtgacgttgggactgagcgttcgatgtctactgctaaccaagagaaacgatgcaaggacaaatatcctgttccctcgtgataaaaaaaaaaaaaaaaaaaaaaaaaaaaaaaaaaancaaaaaaaaaaaaaaaaancggcncgag

SEQ ID NO: 12129 - DNA, 1707 bp, Zea mays
aattagcatgaagttgtttttgctgaaggcacgagaccattaccgagaacctcgtgagcaaaatatagcatttcgatcccgacaccccaaaatccctcagccctctggcctcggcggcgctcaaaccttcgccgtcccgccgtctccaaaaccctcttaccatggccgccgcgacaaccgcgggggccggagccgcgacgccgcagccgccacggcagtacaagctagctccgcagagcgagctgcgtgtggaggtgctccccgacgcgcccctccgagtgcgcctcgtcactggcaccgcagagatcttcggcaccgagctgcctccggagggctgggtccccgtccctccccgatccaagatcgccattttcacctggcacggcgcgacggtggaactggacggggtgagcgagagcgagtacacgtctgacgagactccaatggtaatttatgtcaacacgcacgccattctggatgcccgcagggcaagggcgagaacagccgcagctcaggggggcgataaggaggcatcacagggacctagagtgattgttgtggggccaacagattctggaaaaagtactctctgcaaaatgcttcttagctgggctgccaaactgggctggaagcctacgtatgtcgatttagatattggccagggatctataacgatccctggatgtatttctgctacaccaattgagaaacctatagatataattgatgggattcccttggagatgccactggtatacttctatggtcacccaaatccaagtattaatgcggatgtttacaaagttcttatgaaggagctagctaaaacattggagaaacagttctctggcaatgctgaatctagggcagcaggaatggttatcaatacaatggggtgggttgaaggccttgggtatgagttacttctcaacgcaattgaaaccttcaaggccaatgtagtactggtactgggacaggagaaactctggaagatgttgaaagatgcagttcaaagcaagtccaacattgatgttgtaaaacttcataaatcagagggtgttgtcctcagaaattcaaaatatcggcaaagaacgagaagcttccgaatcaaggaatacttttatgggattgcaaatgatcttgcaccgcactcaaacattgtcaatttcagtgatgtctcggtgtataaaatcggtggtggccatcaagctccccgttcagcattacctatcggtgcagagcctgtggcagatcctactcgacttgttgctgtcaacatcagcacggatatgatccatacagtgcttgcaatttcctatgctaaggaacctgaagaaataatatctagcaatgttgccggattcattcatgttactgatgttgacatccaaaggaagaagctgacgtacattgcaccttgcccgggggacttgccaagcaggttgttgatcgcgagttcacttacatggtatgaagcgtgatcagtctaagttagatgggccatatgcccatacgcatgttgtaaagccaggacatgtgacgttgggactgagcgttcgatgtctactgctaaccaagagaaacgatgcaaggacaaatatcctgttccctcgtgatttgctgtgttctcgttaataaaaaaatcatacgccaacatctacggtgcggttgagataacaaatggcgtggtggtttgagaaatgaggt

SEQ ID NO: 12130 - DNA, 2596 bp, Zea mays
tgcagagaggccacgttgcaatgcatgcaaacctgacctgacgtgctgacgccccctaataattcacttcctcatgcgggctgtgggccatcggccatgccgccacttgtcccgatacgtgtcatcagtacgtcattaatctgcctgccctaaacccgcgcccggtcgccggaaaccacgtctcgcccaatctaaaaccctttcccgggcggcaatgatacgcattatattatcctaaacgcaagaatcttgtaaattatctttttgattgaggggaattttatacattatgttagttatttcgacagggggatatcgaatcattgggcaagtacgtagtgtgtgattcatcggagtcggggcatcttgaatcctggattgtcagtcaaaatcaacctccctgcctgtgcctgcctccatctccatgccaaaacagcagcagagacagcgtggaatattcggatcccttggggaggctgggacccagtcccaccacctgaacaacacgaagctgcattaaaaggcgtccggcgggtggagaccgccgcacggcgagcgcaccaacggcaacgccaacgccaacccaaccctaacccgatctcaccgaggacacacagacaccagaccaccggagcggaccaagtacgagcatgggcggcgccgcggaggaggcgttgcggcgggagtacgtggtcggcgaggagatcgggcgcggccggttcgggacggtccgccgctgctacgccgccgccacgggggagccgttcgcgctcaagacgacgcccaaggcggcgctgcgggcggacccgctggacctggcgctggcggagcaggagcccaaggtgcaccacctggcgtctgccgccagccgccacgtggtcgcgctgcacgccgccttcgtggacgccgacgccgtgcacctggtgctggacctgtgcgcgggcggggacctgttcgcgctcgtctccgcgcggggcgcgctcccggagcccgaggcggcggagctcatggcgcagctcgccgacgcgctcgccggctgccaccgccgcggggtcgcgcaccgcgacgtcaagcccgacaacctcctcttcgacgccgccgccggcggcgcgctcaggctcggggacttcggctccgccgcctggttcggggacggcaggcccatgacggggctggtcgggacgccctactacgtcgcgcccgaggtggtggccggcagggagtacaccgagaaggtggacgtctggagcgccggggtcgtgctctacatgatgctctccgggaccgtgcccttctccggcgccaccgcgggggagatcttccaggccgtgctccgcgggaacctgcgcttccctccgcgcgccttcgccgccgtctcgcccgaggccaaggacctcctgcgccgcatgctctgcagggacgtctggcgcaggctctccgccgagcaagtcctgagtcacccatggattgtgactcgcggcggaagtgtgcctggcggtagactggtttagatgctccgcgccgcatccgatgaatctccatccgaagtgtacatagtggcgtcctccatccaatccaagaggagtagagaaggaccttttgctgttgatctcttcgctatggttctggcaaatgatcgtgaatttggacactagtgctgtagttggttaccagtagcacgcagaaagaagtaatcgttaggctaagcagggatttaggagggctgcctcttcctgggtttgctctgttctgcagtaatcctgtgctcgtcttagcttgtttgcattgcaacccaaacccatgtatgtgtatagcacagccttcttatggctgaggaagagacgactagctctgttcaggagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcc

SEQ ID NO: 12131 - DNA, 886 bp, Zea mays
  misc_feature (744)..(745): n is a, c, g, or t
  misc_feature (747)..(747): n is a, c, g, or t
  misc_feature (755)..(756): n is a, c, g, or t
  misc_feature (775)..(778): n is a, c, g, or t
  misc_feature (793)..(794): n is a, c, g, or t
gtgcggcgctcgagccggccgggctgcgcacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggccggcgcggggccccggccgggccggaaggaagcagcacagcagctagatagcgcgcgctcatcaccaaagccgagagccaagcagccagctaattaagcagccaaattcagtgcgatggcgtcgtccgtcaccagaaccgcatgtctcctcgtgctcacactgttcgtcgtctccgcggcggtgatcttgcccagctccctgtgccatggagcccgcggcgtcgctgggttacgtatcggtttggaccctaaccatcctgcgtgcatcggggcatgcccagctcctgggggctcctacactcaccttcccccctatcgcggtggcggccctgtgaaaccgcttcccccaccgaacggagggaacccctgacgccgcctgcctcccatcacgcgcgctctacgatggaacgatgcaccacgcacaactgtatcttagctgtgcttatatagtatatgatgatcaataaaactggagtagtactggaaaaaaaaaaaaaaaaaaggcccctaccccaaagaaaaaaaaaaaaaaattaaaaaaaaaaaaaaaaaaggcccctaaaaaaaaaaaaaaaaaannanaaaaaaannaaaaaaaaaaaaaaaaaannnnaaaaaaaaaaaaaannggggccccccaaccccccctttttttcccctttagggggggttatttggcccttgggggaaaaccgggaaaaagtggtttccgggggaaaat

SEQ ID NO: 12132 - DNA, 729 bp, Zea mays
gggccattgggaccctcgaggccggccgggaagcaagcagcacagcagctatagatagcgcgcgctcatcaccatagccgagagccgatcagccagccaagcagccaaagtgcaatggcgtcgtccgtcaccagaaccgcatgtctcctcgtgctcacactgttcgtcgtctccgcggcggtcatcttgcccacctccctgtgccatggagcccgcggcgtcgcagggttacgtatcggtttggaccctaaccatcctgcgtgcatcggggcatgcccagctcctgggggctcctacactcaccttcccccctatcgcggtggcggccctgtggaaccgcttcccccaccgaacggagggaacccctgacgccgcctgcctacgatggaacgatgcaccacgcacaactgtatcttagctgtgcttatatagtatatgatgatcaataaaactggagtagtactcgaaaaaaaaaaaaaaaaaagcggccaaaaaaacaaaaaaaaagcggccaaaaaaaaaaaaaaaaaaaaaaaaaaaaaaaaaaaaaaaaaaaaaaaaaaaaaaaaattgggggaaaaagggaagggaaaaagggggtaaggcccaaaaaaaaatttccaattccaattcccccctttataaaaccttatagtttggttccaaaaaaaaagggaaattgatgggccaccggtaagggaaaaagggaaggtttgggaaatttgtttc

SEQ ID NO: 12133 - DNA, 697 bp, Zea mays
cactcctaagggcgagttggggttccccgcgccggcccggaagcagcagctgctagagcaaacctaagagccaagcggcagcagccagctaataattaagcagccaaattaagtgcgacgatggcgtcgtccatcgccagaaccgcatgtctcctcgtgctcacactgttcgtcgtctccgcggcgatcatcttgcccagctccctgtgccatggagcccgcggcgtcgggttaggtatcggcggcggcgctttggaccctgaccgtccagcgtgcgtcggggtcggggcatgcccagttcgtgggcgcccctttcctatcgtcaaaccgtcccccccatccaacggaggggacccacatcactgatgcctgcctcggatcacgcgccctccgtcgtatcggtctgtctacgatggaacgatgcaccgtgcacgagcacgactgcatgctactagctactagctatctcgtgtacctgtacagtcgtcgtgcttatgtacgtacgtatggtcaattaataaaactggagtgggatgatgatggtgagaatttcttgtactggatgatgacatgcatatgtcgttggttcatatagacgaccacttgcaaaataaatgaatatatggtgatatgggaaaaaaaaaaaggcacccctcccgccccgtcgttggaaaaaaaaaaaaaaaaacccgcggcc

SEQ ID NO: 12134 - DNA, 640 bp, Zea mays
ttgggtacctcgaggccggccggggtcaagcagcagctgctagagcaaacccaagagccaagcggcagcagccagctaataattaagcagccaaattaagtgcgacgatggcgtcgtccatcaccagaaccgcatgtctcctcgtgctcacactgttcgtcgtctccgcggcggtcatcttgcccacctccttgtgccatggagcccgcagcgtcgggttaggtatcggcggcggcgctttggaccctgaccgtccagcgtgcgtcggggtcggggcatgcccagttcgtgggcgcccctaccttcccagtccctatcacggtggcgggcctggtagtaactcctaccctgtcgccaaaccgttccccccatccaacggaggggacccacatcactgatgcctgcctcggatcacgcgccctccgtcgtatctgtcggtctacgatggaacgatgcaccgtgcacgagcacgactgcatgctactagctactagctatctcgtgtacctgtgcattcgtcgtgcttatgtacgtacgtatggtcaattaataaaactggagtcggatgatgatggtgagaaaaaaaaaaaaaaaaaagcggccgccggcatgtcgttggttcatatagacaaccacttgc

SEQ ID NO: 12135 - DNA, 5251 bp, Zea mays
tgttaaagatttatattaaaaacgtattttactgtagattttgtatatatgtatttatcaggccttcaaatgtcttatatatactagttttatttaattcattataaaataataaaaatggatagagaggagaaaatttttatatacagaaaatatttttagaggtcacaaaaacgttctatacatttaaagtggaaattttaaatttttattattattgtgggttaagtggtatataaaatataacgtgagtggctcagctgttagtgatatataattaattaatcttcgcaaagatggcaaaaaaaaactaagaggcccatttgaagttgagaatcatataaactattcgattaaagacagccttgtattttagagaagacctttttaacacgaaaagtagcttcactctggagtaacttgtccttgtactgctacctcaccagtcaccacttcaccagcgctgttcaacacttcaactgcaaactagaaaagcggccggtagagtggagtcgtggacgagcagttgtggacagagcgagctactggaacggaccacagtatcgcataggattcttgttgggcagttgtgagttttgggagttgatgagttgcaagtaccacacagacacaagaaagataataaacaccttgaaaagtgaatggaagttcagaaaaaaaaacaaaagctgtcccaccgtgctttaaaaaatcgcccaaacttttccggactcttttatcctttgcccaacgtgaacccgcagtcccacacacaagtgcatagaattcacaagagctgaggggggccgggagatagaggagcggcaccgccgtccgccgcaccggcactggaggcgaaatttcattatttggcgcactggagcggggggagagagagagagagctggaaggtggaagcaaaaatccagagtctatagagggaggatggagatctggagctcctggggagcaacgagaagcagctggaaaatctcatggtaacggttggcagagggggtccttgatctcttcctgagctggaggactccatctttcgagccgcggacccggagaaacttggatctctaggccatccaagggaaggtttactcattccttgctggtagcctactgcattgctgcctgccctcagatccgagctgccgcaagaagaaaggtggaatctttgctcgccttctggacaaatccgtccaaatttgggggtttcttgagctgttcttgggagcgccgtgcttcaagtttttttggggggaaaatgtcgttttctttgccggggtagatgcgggagtgatgtcgaccactttatgagctttccccctgctattttggggtttagattcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgtgccttccacggccgctcggggtcgcggcattcttggcccagcctgtgggcggagcagcaacagtcgcatcggcagggccagggcctgggtccgggcccggaggggccgcatcatcagcatcaggggcggtgggcgaacttgcctccggaactgctgctggatgtgatacagagggtggagtccagcgaggcgacgtggccggcgcggcgccaggtcgtggcatgcgcagccatttgccgatcatggcgcgaggtcaccaaggaggtggtgaagacgctcgaggagtgtggcaggatcaccttccccatatcccttaagcaggtatctgccttgttctctgatatcacgattcatgtgaagtttgccggttaaggtgtattgagaatctgcatatcttgatgctaactttactttgcgcagccggggcctcgtgaaatgccggtccaatgttttgtgaggagggagagggcaacatccacatatctactctacctagggctcagcccatgtaagttatggagtatcatttttggccgtcgaaagatagtgcagttcttacctcttttgtagtcatttgtctgcctcgagatgaactgttttagtgttttagttatggctacattgatcaactgccaatttgcaagaataaaatcctgaatgaaattccttgcaatgatcatctaatatggtaacttaacttagttgattaggtatttaggtgtataggttttgtattaaaaatgttaagtttaggtctggtgaacaacaaaatggttatgttattttatactcccttcgtcccaaaatataattcgttttagactaaacatacattacttaattaatttatgaatgtggtttatatgtatgtctatgttcattatcatacattcgaatgtggatagaaaaaaagagggctagaaagaactatattttgggagggagggagtatatgtaaaaagatttcctacttcattgaagggaaaacgctaggttcaagtcagatgaacaacaaaatgtttctgttctttgatactccctccgtcctaaaatagtagtcgttttagctctagatttttatgtccatattcatatggataattatgaacctagacacgcacacccacacacgtacattaattattgtatgaatctagtaaaaaggtaaaacgaattttaatttggaacggagggagtatgtgtcaaaatattttctacttcgtgaaagagcattggtctcagctatttccatgcctggattttttttaccttgtctgtttgagcatactacacaaaaattcatcctacaagtttacaatccaaaacaaccgaataatttctcttttctctgcaagagatgggttggctgctagcatggtttgagaaccaacggtaactagtgaactgtgtgagcatccggtacagactgaacatacctatctgaccacattgaagttgctttccttgtattcatagcaaaattagcagggcccaaagattagctcagctgttggaagaacagtgcattatgtttcactagaataggcaacaagttgttattgttgactatccacgatatgcatacttctctgcacattcgtatttgcgctagatgtgccccacctcctgcttagggtacaagtctcggtcgcgtcggttttacaataactctgtagcttatatgtgctcgcttaatgtgattccacatcatttactgatgacatattgacattgtatattatgcagctatgaatgtggagaaagacaagttattgcttgctgcccgtaaggtcaggcgtgccacaaggacttattttgtgatatcactggtctctgatgatttctctcactctagtagcacctacgttggcaaactgaagtaagatgcttattatgccaacttatgtggcatgattgtttttctttgtcttagtgacctaacctcgccattgcttctcataaaaccaggccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtcgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtgaccgtcgcgtcagtgaagaacttccagctcgtcgcctctgttgatccttccctaaacatccccgcagcggagcaggagaaggtgatcctccagtttgggaagataggtaaggatatattcaccatggactaccggtacccactctcggcgttccaggcctttgcgatctgcctgaccagcttcgacactaaaccggcctgcgaatgattgacggtagtttaaaatcccgggtggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtgaaatatcactgccgtatcgataatggacgttgtgaccattttgctcgctcgctctcaaaaagagccgtgatgttcaacgatgtggttcctgcgttaaaaaaaaaaaactggtgcctgcgtatctgctttcatatcttccgtatcctggcgatctcatgaacttgtccgcatccgtctgagaggaagtggtgccgctcggcgtatttcgcaaagattcttattttttgagagaaaatgaactaatattttctagcaaaatggaaatccctcgaaaaaaacggtgttcccaaactagtcctaaaggttgggttggtcggtgcttttctattgggtgtgttgggtggtatttttcgggttggattattttttttttttgctttaggtatgtattttttggttaggtcaagtttagggtctaaatcgtggcacgtgctaagtccgtagattgtttgcaggttaaaactatggttcgtacctgtgcctgctgtattggtcgggtcaagttggtttttcggatgggtagagtcgagttggccgggttagacaacccatgctcaggtctagtgtcgttccatggatgatgttagtgtccgcacgtctgggcggatggagcttatgacggttggttgactgtagtcgttatacatgagcatgctagtccctagcccttagcctgatgaacatgctagttcgacttcgtgtgtgtacaaccttgactcgagacaccatagcacgatagacggtatgacaccccacagtctagacctgctaagctaggggatgcgaagaggacaaggttcataagggatatacacccacaacaatcgctccgacaggcctcggtgtccttg

SEQ ID NO: 12136 - DNA, 3138 bp, Zea mays
gtcctcactcgacgaggtccactgcccgaatactctgaattctgaaatcattctgatcagcatccctagctagattaggtgagccatcccgcgcgtctggcatctgcgctgctgactgggccaccgcatcacgagcaaggataaggtgaggtggcgcgtctactcagcgggcgcatgcccattggcggccgggttgcaaacttgcaatgcaggtgcaaagcttcatggaagaagactgaagaggcagtgcttacaaggagtcaaggagagcctaccttttattccaagcgagatgggcccgccactgtgtacggattctaaagcgcaaaatacttgagttcgagcagcgccagctccttccttggcaacgctgctgggtcaaaaagggcaggaagaaaagatggtccaacgtaccgtgtggagtgccacacccatgattaggaggattttaggggtctcgtctcacgacgtgcaacaatagcccaataatatttccagatcatggaccagcccatcatgtgcttccgccgaaaattggccataaacctggaccctcccttttttttggggcaaaaaaatcgcactgtcatttcatcatttgtcgctgtccggcggccggtgatcaggatcgccgagtcactgacgccgtatatgtacagagtagtaatgctctgtatgcatggcagacactacacgtctacacctccgtatcattgttttggcaaaacctatagcttcttcttgcttgagcctacgtgccgtgccgggcgaggggatcaacgacagcatgcatgcatatatattcggggattccctttaatttgttggaacccgagcttgtatttacggggcaagcaaaagtaacaaagctttagtatacgaacgtgctgagagttttgcgattcaaaaggaacctagctttacataaaatagcttgtgtgtttatggttggatcaactaatcgacacgatttctctcgggataactctattagttatagacatagtagctctgctgcttttagggcacaggtgctgaggcagggcagccatcaaacgagcactcgtgtggtgtggccgtgtgggtggggctcatcgtggagatggagtgaaactgcagggaagtttctcgtaagattaggacgtaatttactagagcgccgtgcacgggatgatgcactttaggtttaggaccacacatggcctttttttccctaccccccacaagttcatcacgaacggcgcctttctgtcaggcgtaggcacacgcaaacgtatgtatggcgtcaaaacttgacacgcatagtaatatgttagatgcatgtgtggtcaccacgcaacgcaattctggtatttttcatcactttggcagtcacaagaaccttttttttccctagctagtggacgggtatgcaccgatacacgtatattcaacatgaatttggcggacggaggtgaaattttctccaagccgtcggtcgtactcgtacccgtacccttctcacagtctcgcatttgtacattttggcgtcccgttctccgagaagaagacttccaacaccaaaaggagaaaagtagtagctttaccatggagtaaacttgtcatagtactaagtactgcctcaccggcgctgttcatctgcaaaccagaacagcagcagccggtaccggtagagtggagccgtggacgaggacgagtagctgtggacagagcgagctactggagttaacagtgccgcataggattctttgttgggcaggtgcgagttttgggagtcgatgagttgcaagtaccacacacagggaagataaacacctcgaagagtgaaagctcagggaaagagaacaaaagtgccccaccccacaccgtgcttaaaaaatttatataaatcgcccaaactttcctcgccccccgggatccttccccctaacacagaccaggaggacacaggcccacagaattcacaagaggggaagtatagagagagggaggagcggcaccggagcctggaggggagatttcgtttggcgcactagggagtggagagcgatagagttggaaggtggaatcagaaatccacggcgaatacagggagtaggggggatctggagctcctgaggagtagtagtaggtaggagctgtaattgtaacggttggcatagggggatcctctcgatctgttcttgagctggaagactcccatcttttgagccgcggagctggagaaacttggatctcgaggccctccaagagaaaccgtttctcgctgctaccctcctgcattgctgcctctcccccctcacacccgacctgccacaaggagaagggtggaatctctgctcgccttctccactaatcggctcagaatctgggttccttgacctgttcttgggagcgccgtgcctcaaatctttaggggggaaaaaggtcgatttttttttttgtgtgtgtgttgggtagatgcgggagtgatgtcgactactttatgagctgccccctcccctgctactttgggggtttagattcgctatagttatggcggatctcgccatggaccattaggagttccatttcgtcgaaggcgaaaggagcttgcccgtaagctgcaatgtctctcaagagcatcgttcgggagctgaaggagatgagggacggcatcgggagcatgtcgagacgcggcggcagcggctccgacggccgcgccgccggccacgcccgctcggggtcgcggcattcctggcctagcctgtgggcggagcagcaacagccgcagcggcagggccagggccagggcctgggtcaggaggggccgcggcatcagcaccaggggcggtgggcggacctgcctccggaactgctgctggatgtgatacagagggtggagtccagcgaggcgacgtggccggcgcggcgccaggtcgtggcgtgcgccgctgtttgccggtcgtggcgcgaggtcaccaaggatgtggcgaagacgctcgaggagcgcggcagaatcaccttccccatatcccttaagcaggtatctgccttgctctctgatatcatgattcgtatgaagttttgctggttaaggtgtagcgagaatctgaatgtcttgatgctaacttgtttttgcgcagcccgggcctcgcg

SEQ ID NO: 12137 - DNA, 2029 bp, Zea mays
gagctgtaattgtaacggttggcatagggggatcctctcgatctgttcttgagctggaagactcccatcttttgagccgcggagctggagaaacttggatctcgaggccctccaagagaaaccgtttctcgctgctaccctcctgcattgctgcctctcccccctcacacccgacctgccacaaggagaagggtggaatctctgctcgccttctccactaatcggctcagaatctgggttccttgacctgttcttgggagcgccgtgcctcaaatctttaggggggaaaaaggtcgattttttttttgtgtgtgtgttgggtagatgcgggagtgatgtcgactactttatgagctgccccctcccctgctactttgggggtttagattcgctatagttatggcggatctcgccatggaccattaggagttccatttcctcgaccgcgaacatcctaatcaaaaaagctgcaatgtctctcaagagcatcgttcgggagctgaaggagatgagggacggcatcgggagcatgtcgagacgcggcggcagcggctccgacggccgcgccgccggccacgcccgctcggggtcgcggcattcctggcctagcctgtgggcggagcagcaacagccgcagcggcagggccagggccagggcctgggtcaggaggggccgcggcatcagcaccaggggcggtgggcggacctgcctccggaactgctgctggatgtgatacagagggtggagtccagcgaggcgacgtggccggcgcggcgccaggtcgtggcgtgcgccgctgtttgccggtcgtggcgcgaggtcaccaaggatgtggtgaagacgctcgaggagtgcggcagaatcaccttccccatatcccttaagcagcccgggcctcgcgaactgccggtacagtgttttgtgaggagggagagggcgacatccacatatctactctacctagggctcagcccatctatgaatgtggaaaacgacaagctattgcttgcagctcgtaaggtcaggcgtgccactcggacttctttcgtgatctcactggtctctgatgatttctctcgctccagtagcacctacgtcggcaagctgaagccgaacttcctcggcacaaagttcacgatattcgacagccagccgcctcccgacgctgttgcgctaccaaacaacagaccgagcaaaaggcagtcgaagcaagtgtcaccgagactgccactaggcaactacaacgtcgccacggtcacgtatgagctcaccgtcctgcgcaacagggggccaaggagaatgcagtgcaccatgcactcgataccagccgagtgcatccaggagggcgggaaggccccaacccctaccggcaccgtccagtcgcttgacgagccagtgcccaccttacctagtaccaccaaggggaaggaagtggctgtacaattttcttcgacgagcctcagcgccgatctgtctggaccggtttctgggaacgaagcgcctctagttctgaagaacaaagccccgcgctggcacgagcagctgcagtgctggtgcctcaacttccgggggcgtgtcaccgtcgcgtcggtgaagaacttccagctcgtcgcgtcagttgacccttccctaaacgtccccgcagcggagcaggagaaggtgatcctccagttcgggaagatcgggaaggatatattcaccatggactaccggtacccactctcggcgttccaggccttcgcgatctgcctgaccagcttcgacaccaagccagcgtgcgaataactgaaggtagcataaaagctggggtgggtatgttcgtcctgggcgacgtgaatttcttgatcttgccatgggggcctgtgcccaggcgaaatggtcgcttgtgatgggggtgtgaagatgagctatggcatttgtaccataggaacagatttgaacgacctggactgttatatgtatcgttgttgggatgcctggctgtgaaatatcactgccgcatcgtatcgataatggtcgttgtgacta

SEQ ID NO: 12138 - DNA, 2340 bp, Zea mays
  misc_feature (9)..(9): n is a, c, g, or t
  misc_feature (2274)..(2278): n is a, c, g, or t
  misc_feature (2282)..(2282): n is a, c, g, or t
  misc_feature (2290)..(2290): n is a, c, g, or t
  misc_feature (2292)..(2292): n is a, c, g, or t
ggtaccctncgagaacgtgaacccgcagtcccacacacaagtgcatagaattcacaagagctgaggcctgaggggggagatagaggagtggcaccgccgtccgccgcaccggcactggaggcgaaatttcattatttggcgcactggagcggggagagagagagagagagctggaaggtggaagcaaaaatctagagtctatagagggaggatggagatctggagctcctggggagcaacgagaagcagctggaaaatctcatggtaacggttggcagagggatccttgatctcttcctgagctggaggactccatctttcgagccgcggacccggagaaacttggatctctaggccatccaagaaaaggtttactcattccttgctggtagcctactgcattgctgcctgcccccagatccgagctgccgcaagaagaaaggtggaatctttgctcgcctgctgcacaaatccgtccaaatttggggtttcttgagctgttcttgggagcgccgtgcttcatgtttttttttgggggaaaggtcgttttctttgctggggtagatgcgggagtgatgtcgaccactttatgagctttccccctgctattttggggtttagattcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgtgccttccacggccgctcggggtcgcggcattcttggcccagcctgtgggcggagcagcaacagtcgcatcggcagggccagggcctgggtccgggcccggaggggccgcatcatcagcatcaggggcggtgggcgaacttgcctccggaactgctgctggatgtgatacagagggtggagtccagcgaggcgacgtggccggcgcggcgccaggtcgtggcatgcgcagccatttgccgatcatggcgcgaggtcaccaaggaggtggtgaagacgctcgaggagtgtggcaggatcaccttccccatatcccttaagcagccggggcctcgtgaaatgccggtccagtgttttgtgaggagggagagggcaacatccacatatctactctacctagggctcagcccatctatgaatgtggagaaagacaagttattgcttgctgcccgtaaggtcaggcgtgccacgaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtcgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtcaccgtcgcgtcagtgaagaacttccagctcgtcgcctctgttgatccttccctaaacatccccgcagcggagcaggagaaggtgatcctccagtttgggaagataggcaaggatatattcaccatggactaccggtacccactctcggcgttccaggcctttgcgatctgcctgaccagcttcgacaccaaaccggcctgcgaatgattgacggtagtttaaaatcgcgggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtgaaatatcactgccgtatcgataatggacgttgtgtcctnnnnnaaantattaaananagggggcgccctctcagaggactccacgctgcgagcgcgtgcatccac

SEQ ID NO: 12139 - DNA, 7025 bp, Zea mays
  misc_feature (261)..(261): n is a, c, g, or t
  misc_feature (302)..(302): n is a, c, g, or t
atggtagtagatcatacctaaaatatcccatgaggccatgactacgatgcccagtagtactggcattatcaggatcaggctgcgaaagtgcctgctaggctttggcaaccgaatccgactaaacgccatcgcgaggcaaggaatcgtggctccacgcggtgctccgcccaagaaagtggaagaatgggcgacgcaatatcgcaaggccaaaaagggcttgcaatgctcgtgcacgtacgtaaatgcacgagctcaggccgngcggctaagcgaggcgcctgcgatgcgcgcgcatgctcganggcgccccatatgcgccatggacgcgttctcggtgcgctgtggtgtggagcgcggtggtaccggcgcttctttacctaggctccttgccttcccactacgagctgcacgatgaatccaatccctccacctcgcccccaagcacggcagaccaccggccgaccggtgctagtacagcgagaggcaagtacgtgcgcggccgggggctgcgccgcttgtaaaggaggacgtctctgaatcatggcgtgtgtggtgtgtggacgccgccggcggacatgcatgatggcctgatgggcggtccggtgcgtggtgcgctttccgcctcgttgtccggctcaaatcgtgcaggatgtagcaccgggggaaagtcgacgttgacaccgagagtgccacgtcgttcgtcagataggaacattttccctgatgatatacaaggacacatcggatatatgctttgcttgcactagttgtgcgatataattaggttcagagctgtccgtttaaattaatacaaagaggagcaagcgtcaacagtgcttattatgctgatgctaactggctccttatttgaaccgatcgaacgcctctgcccgccccgattcggtcggtgaagctcactccctcacccaacgctccatagtccacactcgccgtgctccccatgcagcaaccgcttgtgctcctccttctcttcttcatcggctcggccaagtatgccgtcgcctcccgcgccgacgccggtgcggctacctacattgtctacctgaaccccgcgctcaagccgtccccctacgccacgcacctccactggcaccacgcgcacctcgacgccctctccctggaccccgcgcgccacctcctctactcgtacacgaccgccgcgccgtccgcgttcgccgcccgcctcctcccatcccacgtggcggcgctcaccactcaccctgccgtcgcgtcagtgcacgaggacgtgctcctgcctctccacaccacgcgctccccatcgttcctccacctcccgccgtacagcgcgcctgacgcggacgccgggggcccggacgtcatcatcggggtgctcgacaccggcgtctggcccgagagccccagcttcggggacgccggtcagggccctgtgcctgcgcggtggcgcgggagctgcgagaccaatgccaccgacttcccgtcctcgatgtgcaaccgcaagctcatcggcgcccgtgccttcttccgcggctactcgtcgggggccggcgacggctctcgagtcggcgccgacctaatgtcgccgagggaccacgacgggcacggcacgcacaccgcgagtacggcagccggggccgtcgtggcgggcgcaagcctcctcgggtacgcgccgggcacggcgcggggcatggcccccggggcgcgcgtcgcggcgtacaaggtgtgctggaggcaagggtgcttcagctccgacattctggcgggcatggagaaggccatcgacgacggcgtcgacgtgctctcgctgtcgctggtggggcggcccgttcccgctctcgcgcgaccccatcgcggtcggcgcgctcgcggccacccgccgcggcatcgtcgtctcgtgctccgctgggaacagcgggccgtcgccgtcgtctctggtgaacacggccccgtgggtaatcacggtcggcgccgggacgctcgaccggagctttccggcttacgcccagctcgccaacggcgagacccacgccggcatgtccctctactccggcgatgggctcggtgacggcaagatccctctggtgtacaataagggcatccgtgccggcagcaactcgagcaagctctgcatggagggcacactgaacgccgcggaggtgaagggcaaggtggtcctctgcgacaggggcggcaactcgagggtggagaaggggcagatagtgaagctagccggtggcgtgggaatggtgcttgcgaacaccgcccagagcggcgaggaagtcgtggcggacagccacctgctcccggcggttgccgtcggcgctaagagcggggacgccataaggaggtacgtggagtcggacgccaacccggaggtggcgttaacctttgccggcaccgcgctcgacgtgcggccggcgccggtagtagccgcgttcagctcccgtggacccaacagggttgtgccgcagctactcaagccggacgtgatcggcccgggcgtgaacatccttgccgggtggacggggtccatcgggccgaccgggctagccgccgacgagcggcggtcagagtttaacatcttgtcaggtgagagcgcacgcgttgcttctttctgtcggacagactctgttgctcgtgctctaaatcgattctttagctgtctacatgaacattattattgttatgattgtttttttggtagcagctttccttcttttctttttttttaccatgatgccgtaagctttttgcctttttgggtgccgttggcgtgcataaaaaaatatgatattgcgtactactcgacatcgacagtggacagtggacactcgacatgcatgcttcctgacacgcattcggccgtgcagggacatccatgtcgtgcccgcacatcagcggcctggcggcgttcgtgaaggcggcgcacccggactggagccccagcgccatcaagtccgcgctcatgacaactgcctacaccacggacaacaccgggtcgcccctcctcgacgccgcgaccaacaccacggccacgccgtgggccttcggcgcgggccacgtggaccccgtcagcgcgctctccccgggactcgtctacgacgcctccgtcgacgactacgtcgccttcctctgcaccgtcggcgtcgcgccgcggcagatccaggccatcacggcggaggggcccaacgtgacctgcacgcggaagctgtccagcccaggggacctcaactacccgtccttttcggtcgtgttcgaccggaggtcgtcgcgcagcaccgtgaagtaccggcgcgagctgaccaacgtcggcagcgccggggacacgtacactgtcaaggtcaccggacccagcgacatcagcgttagagtcaagccggcaaggctcgagttcaggcgggccggagacaagctcaggtacaccgtcacgttcaggtccgcgaacgccagaggacccatggaccccgcggcgttcggttggctgacgtggagcagcggtgagcacgatgtgcggagcccgatatcgtacacttgggggatgtagcactgatctccacagctgatccgagcatttatcttaccgccggagtgaattgggtctcagggatgccggaaatatatatcttcaataatgatacgaattcgcttgttatttactcggcccgtttcaaaatatatatggtttaaaaaataacctgtttgcaccgcgagagaaacagtctgctatttccattgccatgcacaaaataaccatctactgactactattcccatgccaatatgccatgcacaaaacgcacgtaatcagtgggcgggcggggccaagcgctcggtttcttctaaaactttggtaaggagtacagtattcaatactggaaacaaatattgtggttttttagagatactatggtattcaaaactgtggtttctaaggagcaaccaaacacaaatagacctaaaaaccatcgtatttttcaataccacagttttacagtaaaactataaaatcacgccactatcaaactgggtttaagggttatatcatgcaatctatacttggaaaaccgatccttgatgggtctccaggagttaaataaaaaaaataaacctaaaacttctttttttgttgacagagcaagtagtacaccattatacgggctgccattgttgatttgtatacgagagacagcattattttctctgctccacacacatgccaacagcccaacacacgtacgggcatcaagcggccatgcacaggcaggctggcaatctgggctggaccacggccctgatcgggaacttacacatgacaatagcgagcacgaagtatggacggcaacggatcggattcacatcaccgggtggagcaaaacccagcacccatcgcatccgcagtgcaatttgaggcccgtatccaagcccgttggatttcgggttacctatgagtttttaaacaataattcaaatataaacaattaagtaccaacaatatttgagctatatctacagattttaagtcttctagattttaagtcttctcgtgtagagcacaaacaaaacattttataaattattagctaagttacttattcaaaataattaccattgtatcttaatcatttttcacaaaataaagactaaactaaatttcgtatcggatacgggtcacccgtaggttggaatagaagcccgcacttacacccgcgaaaatttggatcaggtcgggtacccgtcgagatttcgggtttacagattaaattgtcaatcactagcagtaaggtctcctctcttccgtgctcagctcctccgccgtcacgccgtccggaagcctcactcaagtaggtgagttattctatgattctgattctatcggttctcttctacccgcgaacatatatcgacgaacttaaatatttcagctcaggaccgtgggtaccgcgtgaccacttcgcagtgagtagtcacatactagttagacaacttcaagaatattttcacaaatggaataatatcgtcattgcagctacttcgccatccagattagttgagagatagacggtgacagaaaaaaatagttttcataggaagtaggaatacatgtggccagacatcgtccctgaagggcggcaacacgtattgctaatgagcacagtgtttatcttaacctctgaagaaccttgagatccactgtgccacggcccacgtgtgcgtgaggaccgcagtagccttggaagcgatgatccagtgtctgtcccagtgacccgtttgacacttttgactcaactgctccggggctctcttcctgattcttttggccaacttgcctcttgacagctgttcatccaatagttgctaatctttagaccatgtataaggcaacaatctcatatcatatagtattatagtaaactagtacgtatataattaaaatagcaactcggcttgggctacctctgacagattcatcccaccaaataagtgccaactcactctgagtagtgctcgggtgttttatacgtttctagcatttgaatgactttatagttgtatctattcatattttgtaggattttataaatatttaataaaatagtttatttggcttagaatttaacattacaccactttctaaagctcactcaaatttgaagggtagagtatgacaaatgattttatatatcgacgaaatatatttctactcttcaactttcggtccacttctctaataaaaatgcatcatataaatatcctcacatattactaataatatttgcataaaactatattatcttaattgaccatactagcaagttgcaaacaaatcgttgccgcgaaagcatactcccacatcagcgaaagtcccttttcagctcttgggtcggtcatggtcagtcagccgtttcaaacggggaaaggttggtccgtccacaagtcctatcaccggtagtagtagcaagtagtaggtgtttctctgtgatgttctagcaacacccctcgcaattatacgtaaagttcgcgaagcccacgcggacccgataaataaattcaaatccctgatcacgcgaccgtcatctgacaacagataccgcagcttgccgcttgaattgcatcagactcttccacgaatagctcagtgagatcaccggactacaattttagtctgtcgattggattacatgcgaaaatacaaatagttaaaaaaaaaactaatacattctattcatcaattgtctctacagtttttgttagaccataattagcccgtgtttagatgttctactatttggcatgcaagacgtggactgaagtttatgttagccaagttcttccgtagatatttttggaccagagcaagtaacctgctccgggtccctttcaacaactgacttgctacagagtcgtcgtcagtgcataatgactgtacttaggacgcaatttctgtgtggaatggcaaatctcaagggtgatggcacttcttccacacttcagcgaaggtgtgctgtcgtttgatgtaaatttcggttgccagacatatgttccattccaaaactaaactcctcgatcgacaaaaatcacacaataaatttgtgggactttacctaagagtcttgttatagtactccggtcaccttataacacgcgagagctttagcaaatcacagcctatgacttgtgttaaaatacacaaagcagttaataagcaattaacatatttttttattaaaataaaaccatgaccaatgactaatcagtaaacaaagatccagcatcacggaccatttgtcacgtactcacggtcgtgatgcaagcgcccacttgcccccttacttattcgtgtgccttcacagccaataggactccaaacgtgaattcacaacaatatatactgtactagctcaagtcctgctggtccggtagttgttagtcaaactgaaaaccaacatatatagggtctattgggactatttgtttcagcttatagattatataatttgaattataatctaaattatataattgga

SEQ ID NO: 12140 - DNA, 4384 bp, Zea mays
ctgcagcaattcaaaacttcctacccacaatttcagctcgaggacgagctgttcgtcgagggagggagagatgttatgactggaaaagtatatgggcgccggcctaagcagccaggggaagataagctagactaagcagataagtactcagataagatagctagagttgtttagattttccttaaataaaggtagtttgtttagatccccttaaaaggaggaagtcttgttaggccagggcaatatataagccctctatgcctttagtttgtaatcaagaaagattaatcaaagaaagagattgagtcttgcctccctactgttctcaactccattgctgcgcctgaaccctaggtcaggcgtcaccacggcaatctctcacacctcttcctccaaccctccaaccattagccactcatacaacctccgcagccggggtaattctaacacccttagtaacctcttgtacagttctactgctgttttcttcaaattatattatttatactgaatatctaactatattgcgcagtgccgtgggcatatttctgccttatgtcactagctcataactgttacatattttatatttttatataaatgtgcagatcttattgactgaaaactgtgaggtataaatgtgcagattgacagggacatgctcatgagtggattcatcgaacccattcctgatctttcacctgttataccatccgtggaagaaataccttccattgatccagaagtatctccatatgaaacaaatattatttccttttacaagacttgggatatttttggggctttctcaaacttttctcctcattcaattcaaatgcctgatgaaaatggagattatttcacatggccaacagtggaacactattaccaggtttgtcttctattcgtactacatgtgaaattccttgttgctatggaaagtgattctataataacgtgccaacatgtgttccatttttttataaccatgtaacatcatcatttggactgtatataggctcataactattttccttcaggctcataagtttgttggtgttgacaatcctcaagcaagagacattgttcaagaaataaagctagcaaagagtcctgaagaggctgctagaataggaaggacccgacaaaaagggttccctgaactggtatgtccgattattgtatttaggcctgttcagtggtggtttagaacaggtttggatatttggccagcttcctaaaccaaacgttatgcttacggcttagatggtttgatttgctggtgtatgcgggttcaaaccggaggacggcaacatggcctgtcacaccgatgctgcagtccagggctcggacagggttggtgccctcagtctcttcagtgctcgctgcatctgctccacctgcaccatgcacgatgacgaggtcagctgcctccatgctgtcgtggccgcaggggcactggtgaacctgattccgctgttgtggaggtggtcagtggcaggcccagggagacaaccggcactgccatggcggtttggctggttcaaaccacggttttactcaacccgtaccgaagccacagattcggtttcaacaggctggttttacgagttgcactggtttgcaataaacggtgaacagccgtaattacattctatttttaactgattgtagtgggaagggatgaagggaccttgctttctggtacctaacaaagtatgatatcatccttctgatgaaagatattctagaagaggaatctatatatctagtataggctttgccacttccacttatcatttagtataaatacatgcttgaaagctacaatggtgcccacaagtccattatagtcccaccaaaatttattttataatatcaacgactgttgtagaatccgtactattttcctcaacctctcctctggttaactcagacacagcaacaacgggactgcaaccactaggtagcatgggtgcaaaatcattagcctgggacttccctttcagatactttctactgttcaaagttcatggtattatggattgcctgatgccaaacatctacgtgctttctatttacagggattagttgtagggtcttaactcaatgtattgctacaaatacctatttaaaatgatatgaaccatcaagtaatggtaattaatacactatcaacatcaactatatctactccgtagtatgcatacctaatgtattctcgttcttacttggttttcgaattgcttttgtttttcaggtaagaacagattgggagagtacaaaaatagatgtgatgtatagagctatcaaatgcaagttttcccctcgcccccgcccgactaatatgttgctgtcaactgctggctctgttctcgttgaggcatcgcctcacgatttattttggggcggtgggagggagggagaaggcctgaattacttgggtaggttgttgatgcagttgagatcagagattctggggacagtcccagcaagcgctgaagtaggggaggcagattgatcctgaagcgagcaaatcttgtttagcaggagtgttgattgcaagaccagacgttaaggtgtggctgggtcccgattgctacagtggatggtgctagtgaaacgaagcgcaaatgagattggttaaattatctgtatgcctgtgaagaacaaacataccatgggtcttgctcttttgtcgaacaatttcatctggccctcggggtataggaattatgaaatacaaaggaggaacaccaacagtcatgcatagaatgtggtagtcctggtagatgaatgtgtttgataaggtgataaggactaatacattggaccagaagtagaagacgtgcttgttcagtaatggttgtttagtaaaaaggagggcgaattatttaataaaattaaatgcatcattgcaccatgaagtcttttgcctttgtttcacttaggcccatcaacagggagagtaggtttttgggtacatgtttgatgcatctctaatctgtacctctgttttgtttctattcggtgtctgtctttctttgaaggtgtgtccgcctgctccgcatgggtggggttcgtgaccacgaacgtgaagctagtccagatcagcacgggcgcggcgccgtgtccggctgctccgcgtgggccgggtatacgacggatgtgtgtacctggacacctggtccccatgccggcgtggacgttcttgctcatgtgcgccccctgcaggtggttgtcctcgaacgggatctccgtcagcagctcaaagcaaaccatccattcatgaagctgtacacgtccgcgttcttggtgcacttgtccgcctatcctccagcacctctggcgcacactgttagaagataattaatttataagacaaccaataaacaataaataaatcacaagtagcaaataaaaatgtggccacgtatcagattaaatttgtgttgaacacatctaataaaaaacacgagcgataaattcattattacttgctgcgaggatcgctctagcctagtcgaaaatgagtttccggtgtcgtttgaagttagtagatgtagcagtgtaggtgaactcggcgaatagtcacataatcgctgccaaaaaaaaaaactaattcgctccaactcatgcaggttcttgagcggatcaaggttttagatacactgttctttccgccaccatcgtcacactcacacctgggttatagatggaggagcctgagtttgcatagcactgtctaaaatgtaaaaccctagcttgcagtagattgattgtttcttgtgtcttacggggagagggtcctttttattacatagaggattaggtacgtaaccgcacgcaaaaaggagtggcaaattatggtggtgtatcatgggttcattcctcagatttggtgggatgactccattcctcatattagtactaactaactaactatgagaaatgagatggtgatgaatcaattcattctattccacaaaccaaacaaaagtagtgaagagtgagaagacgatggactagctcattgctcaaaccaaacaccccatatatctccatggtttgacgggattcagttccgaacttgtcgcgcaacacagaaccgcgttattgtagtcatgacaaaggataaaattatattaccgctagttgccaagtcacaattcatacggataatcacgcgaaactctagcttcctttcaagaaatgagaagagaacttgatcctcttccactttgtatgtgacactaaaatttatcacttttacttctacagtacgtgatttattctaataaagttcaacattataccaggtactgtacaaagggttagcgacgatcacgacgctgatggtgttcactgccttcgcaatctctcc

SEQ ID NO: 12141 - DNA, 1836 bp, Zea mays
cggacgcgtgggctccgcgcccgccgcgaacgccaccacccactcccgagcgtcacccctccttaaccctagctgccacaacatcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtcccaaatcggtcgatggaaaatggaatctcgatggcttttgttaaatctggattgctatgcatgtctagcgatgcacttggatttttggtacagtgagattggtagccgcacatggggaatctcgatggcttttgttaaatctggattgctatgcatgtctagcgatacacttggatttctggtaccgtgagattggtagttgcagatggatacagggggccttagtgaagtggcagcagaagacctgaatatgggggtggacacatcttctcatctggacgttgaagcaatgtcttcagttccttggtggtggtcggttaatgcttctttgtaacagctcgccagcaccagacgtggaaaactccgtcatgcaactattgtcaattgcaaattgttggtggatggcctcaaatcggcatgtccttgtattgtctgtgaggctttgagtgttgctgctcttgaaaatgggggtgtcaccttctaagcttgaagatgacaaggtccttgtgttatgtcaggagagggagtgttttgttagagaagcgctagacagaaatcgtgtgaattttttttcatactattggtttcattccattgtgattactttttttactttagcttcttaatcttcactggacattcttcatgtggatgtagaattgaagaaatcccaattattcttgaggaagataaaatccagttccgtcatctactgtgtggagattggagaaatagtgtcctcaaaactttcaccatctagaaatcttcttgggactaatgctggcagccatatctcaacacttgatagattgtatttctgggagagcaagctttatgatgaagccaaggccagcagtgccatctgcaggaagtacggtgggaaatgtaagaagctaagacttcatgaatcaagaggggtgaatcaaattgataacgattttacccgtgcggcaagggaaagatgtcagtatcactgcatcctccaagatgatcggatatgctcttcaggacccatcaataagagagatggctgagcaaattgcaagtgaccctgtgttcaaccagatggttgaacagcttcagaaaagtgctcagagcatcttgggaatgcccttatgatcctgctatgtccagaatgcttgagaacttgaccattctggctcataaggagtagcttgaggagaggatggcccgtatcaaggatgatccatccttgaagccaattcttgatgagatagataatgggcgtccatctgcaatggtgaagtgttgttactgttgtctactattactatccatgagatctgtttggaatatgcaaaaaaaaaaaaaaaaacatgaatgactttggtcattctgagataatattagctacttacacagggaatatgccgagtttatgcatcttccaagaaattacagattttggtaattcgtcttttttttccttttggggctgcatgattcatggctgatgagataagattatatcaaactatattgtcactt

SEQ ID NO: 12142 - DNA, 1337 bp, Zea mays
cattgggtacctcgaggcgccggctccccccaccccagtccccacgcacatatccatccacacatattttccatggccatggcaaccagttatggctccatggctaaccctccaattacctccagaactccctttctcagtaaacaagcctctaattggatacctgctacaatcagcaatggcaacggcactggtggcatgttcactgtcgcaagcagaaagtcgaggaatgggttccaattttgtgctgtcactggagacccaggctctcgcaatgtgtctgatgtaaacttcccaagtgattacacagaacttctgacgcaggctaaagaagctgctgaatcagctttcaaggatggaaaacagctactggaaatcgagttccctacagctggactacaaaccgtaccaggtgatggcgaagggggaaatgagatgactgggagcatgcttctcattagagaattttgtgatcgcttcgtacctgcagagaaagcaactcgaaccagagtattcttccctgaggcgaatgaggtttcttttgcaagacagtcagcctttgaaggatgttcgctgaagctagattatcttacgaaaccatccttgttcgaagattttggtttcacaacgaaagtgaaaatggcagatcgtgtgaaaccacaagacgagacattcctcgtggcttatccttacttcaatgtcaatgaaatgctcgtggtcgaagaactttacaaggaagcagtagttggcaccagccggaaattgataatattcaatggagaactagaccgaatcagaagtggatattatccggcgttcttctacccaaaacttgcagagctttccagaacattcctcccgaagctggatacggtttactatatccacgatttcaagggagctaaagggggaacgcttttcaggatagttaccctgagccttggaaggtcctgaggaaggcgtcgtctgggaactacgtctgcctgcatcaacaagaggagatgccttcgttgaaggaagtggccctcgacatccttccttctgtatagctaggatcttcacttctttggttcatagctgtgctgactggtgctaagttccattacaaggcaatctatcatttcgttgcaatttctcgccctgaaatattcttttgggtagactagaccgtctgagtctcagaagtcagaccaccccgtggggaaagcctcggcaaagtctgacacgtgctcatgctccggctgtccctgccacaaaggcgttcttgtaccagtggaagaccttgtctgaatgtgcaagtggataaacgttgatctgacaggggtggacggtaatgg

SEQ ID NO: 12143 - DNA, 2494 bp, Zea mays
ctcccaacaatgtctatattcaaatagatgatgataaatctaaacacatatacaaaacacatatcaaatgtttaaaacaaattttaatttggggcgggggagtattactctatatagggacaatcaaaataaagttggctacacttcaaattctattgtccattctggtagtccaatctttgtataccacacaatttgtatccaggaatccagcaacattaaaatcaaacactcacaatcctccctcatgcttgaactcaattcaagggcccaaaggtcgtggttctttctgtgacctggcttcaacaccgatggacctgtcagaatctgcacacattgatcctcacagaaggaaaaaaaacttgccaacactggtaagattgtaacatttggagcagacatatatgttttttttttttttttaattttatgtcgttgatttttatttatgatcaattatcaaaacacctgctaagagtcgattgatttgtgttttgagaagacaccatagacgctaatgacacatacgtagctaagcctaatagaagtactagcaagatcattctaaacaccagcttaacagaattactggaaagatcattctaaacactattcgcacatttgcctacgaccccatcatcataggtctcctgtagctcttccacaagcttgagcaaagccatggcaggttccaccgtggctcaccgctgacttggctgcttgctgcgcccacgcagccctctcccgcatccgcttcgccgccttgctttcagcgtccatcagctcccgaaccttctcctccacctccgtgctcccgacgacgtcagcgccaaccttcagggctatcctgacgccggcgcctaagatgttggccacgtgccttgcgttcaggtgctgctccgcgatcatcggccacgccagcatgggcttcccggcggcgaggctctccatcacagagttccacccgcaatggctcacgaacccaccaactgccttgtgggccagaatacttctctgcggaacccaaccacggacgatccggttgttgggccccacgtccaacggcggcgaccacgtgtcagatcggacggcccagaggaagggatggccggactgcaccagcccgtgcaccagctcgtccagctgcgcgtccgtgatgtgggcctgcgtcccgaacgagatgtacaccaccgaccccagatgcgccgccctctcgtcgagccacgagagacagccctcggggtcttgctccttcttctcgccatccggcatgtcgccggcggccatgaacagcgggcccacgagccaggcacgggcgcccgtctcgtagaatgactccaaggccgacacgtaggccgcgtcgagcgcgtcgaggctgttgctgaggactccccagctgcgcacgtccgaatcaccgatctcgtccatgaagaagcgcgtgaacgggttgtcggggtcggccctcttggtgaccccatcgggaacctcctccgccctgaccgccacgtgctccggcatgccgggcacctggatcatggtcccgggctcgaagctggtcggcgggctcgcagcgagcgccttgcagatcgccgaggcgaagcaggacatgccgttgaacacgatgcggcggacgccggcgtcggccgccacgcggcgcgtgaacccgaggaagaagtcggagacgagcgcgagcggcggggacgggagcgacgccaggaactcggcgaacggcccgcgcaggagccccgtcgcctgcatgaacgtcaggtgcagcgacgggcacgggagggcgtcggtggactcgacgccctccggcagcggcgggaacgacgggaacgggagcgcgacgaggcccaccgacgcgggcagacggctccgggcgaaggccacgttgcccggggtggtgaccagggtcacgcggagcctcccgtgttgcgccgagagtgccgtggcgaagtggagcagcgggagcatgtggcccttcgccatgaaagggaagatgacgacgtggtcgcggcctgaccttgacacaggaacgttcaaatccccgatacgaacgaactgcacgtaggggagaatgcgacaaacagttggaaagggttttctcaccagcgacagcggcgccgtgctctgcccgcggggcgcagcggaatccgcggcggagctccgactccggcatgaaatcgccacgcgctccgatcaccacttcgcccgttgatacaacggccggttctctcgagcgttgccgaaccccactgacccaatcgattgagcccaaggttcgcacggcagcgacggatctcgactctctctctcgcggtggttcacgaaggcagagaagtggtagttcggcggctggtgaaggcggtcttatagcacagagatgcgagggggaagaagtccgcggcgccggatcctcggcgagatccagcatcggcgggtggttacgcccgagccgggcgccattgcaacggccctggcggagaaggcgggc

SEQ ID NO: 12144 - DNA, 1669 bp, Zea mays
  misc_feature (1651)..(1651): n is a, c, g, or t
  misc_feature (1653)..(1654): n is a, c, g, or t
  misc_feature (1661)..(1663): n is a, c, g, or t
  misc_feature (1665)..(1665): n is a, c, g, or t
aaccctctttcccgtgggccgtggccacgaccgcgcgaccgccgccgccctacgccaggtgccctggtcggtcccttcgagccaggtcgtcgtcgtcccttcgcagccgacgagcgcccgtcagcctggaggaccactcgatgtaatcgaagacaccgggggttcacagctgtttttttgtgtgtgaatttacgttcctgaaaggttcgctttcgttacacgcttgggaatggattactacaacatcctcaaggtgaatcgcaatgcgaccttggaggacctcaagaagtcgtaccggcggctcgcgaggacgtggcaccctgacaagaatctgactggaggggcggaggctgaggccaagttcaagcagataaccgaggcctacgaggtactaagtgatccagagaagcgtgcaatttatgatcagtatggtgaggagggcttaaaagggatgcctccacctggttcccagagccggtcctccacaactgctggcccaagtggtccgagtaatttccattacaatcctagtgacccagatgatttctttgctgagttcatggcaagcaacaagacttactcctttgaccatgaccggaggcgattccagccaaggtcacattggacttcagccaggaacagtagaagtgaagctccttctggttcacagaaagagaatggtgccagtacaagcaatatagaaaagccaccacctgtggagaaaacattactttgtactcttgaagagttgtataatggaacaaaaaggaaaatgaagatcactaggaatgttgcaaagccagatggaagaatagaagttgaaacagaggtcttggcagttgaagtgttacctggctggaaaaagggaaccaagattacattccccaacaaaggcgataagctacatggccagttagcacaagacctgacctttgtcctcgattcgaagccccatgatgtgtacaatcttgaagggaacaaccttcttgtaaagcaggtgatccctctggtagatgccctcgctggggcagagataaacctcacaacccttgatggtcggaatctgcctgtgagggtggaggaagtggtgcgccctggatacgaagttgtgctggagaacgaagggtggccgatcaggaaggaacctgggaagaagggaaagctggtaatcaagtttgatgtgaccttcccgatgaggttatcgccgtcacagcgggcagccatcaggcgaatcatgggcagctaactgggggaagagaaagagaaggggcactgcattcttttacatggagaaggaacagtctctacattggcactagaattcagatggatagttggaacttggaagtaacttgagtcaatcagataggcatttccatggttaaatagcccgttactaatcctacctatttgctttggttaattgaatgtgacctagttttttttcgttttctttgttatatcgtgtgaatccgtagaaaaggtgggtgatttcgaggataatgtaagctgatttttccatccgaattttttctggggcatgtgatggttttttcattggaaaactgtagcatacccgggaaatggaaggaaaggacaaaaagatagaaaagacaagaaaggagcctttaaccaaaaaaaaaaaaaaaanannaaaaaannnanggtc

SEQ ID NO: 12145 - DNA, 1976 bp, Zea mays
  misc_feature (1362)..(1362): n is a, c, g, or t
  misc_feature (1365)..(1365): n is a, c, g, or t
atgtcgttgatttttatttatgatcaattatcaaaacacctgctaagagtcgattgatttgtgttttgagaagacaccatagacgctaatgacacatacgtagctaagcctaatagaagtactagcaagatcattctaaacaccagcttaacagaattactggaaagatcattctaaacactattcgcacatttgcctacgaccccatcatcataggtctcctgtagctcttccacaagcttgagcaaagccatggcaggttccaccgtggctcaccgctgacttggctgcttgctgcgcccacgcagccctctcccgcatccgcttcgccgccttgctttcagcgtccatcagctcccgaaccttctcctccacctccgtgctcccgacgacgtcagcgccaaccttcagggctatcctgacgccggcgcctaagatgttggccacgtgccttgcgttcaggtgctgctccgcgatcatcggccacgccagcatgggcttcccggcggcgaggctctccatcacagagttccacccgcaatggctcacgaacccaccaactgccttgtgggccagaatacttctctgcggaacccaaccacggacgatccggttgttgggccccacgtccaacggcggcgaccacgtgtcagatcggacggcccagaggaagggatggccggactgcaccagcccgtgcaccagctcgtccagctgcgcgtccgtgatgtgggcctgcgtcccgaacgagatgtacaccaccgaccccagatgcgccgccctctcgtcgagccacgagagacagccctcggggtcttgctccttcttctcgccatccggcatgtcgccggcggccatgaacagcgggcccacgagccaggcacgggcgcccgtctcgtagaatgactccaaggccgacacgtaggccgcgtcgagcgcgtcgaggctgttgctgaggactccccagctgcgcacgtccgaatcaccgatctcgtccatgaagaagcgcgtgaacgggttgtcggggtcggccctcttggtgaccccatcgggaacctcctccgccctgaccgccacgtgctccggcatgccgggcacctggatcatggtcccgggctcgaagctggtcggcgggctcgcagcgagcgccttgcagatcgccgaggcgaagcaggacatgccattgaacacgatgcggcggacgccggcgtcggccgccacgcggcgcgtgaacccgaggaagaagtcggagacgagcgcgagcggcggggacgggagcgacgccaggaactcggcgaacggcccgcgcaggagccccgtcgcctgcatgaacgtcaggtgcagcgatgggcacgggagggngtnggtggactcgacgccctccggcagcggcgggaacgacgggaacgggagcgcgacgaggcccaccgacgcgggcagacggctccgggcgaaggccacgttgcccggggtggtgacccagggtcacgcggagcctcccgtgttgcgcacgagagtgccgtggcgaagtggagcagcgggagcatgtggcccttcgccatgaaagggaagatgacgacgtggtcgcggccagcgacagctgcgaagtagtctgcccgcggggcgcagcggaatccgcggcggagctccgactccggcatgaaatcgccacttgctccgatcaccacttcgcccgttctctcgagcgttgccgaaccccactgacccaatcgattgagcccaacggtggaggttcgcccggcacggtgcttctctctcaagccgcacggcagcgacggatctcgactctctctcgcgcggtggttcacgaaggcagagaagttttcgattaggatgttctaggtaatggtctcgtgcacagagatgcgagggggaagaagtccgcggcgccggatcctcggcgagatccagcatcggcgggtggttacgcccgagccggacgccatcccggccgg

SEQ ID NO: 12146 - DNA, 1438 bp, Zea mays
actcctacgttgggtacctcgttttttgtaatcagtcatcttgttttgtcgacaagcccacaagcgttttcctctccgagtcctccctcgcctctcaaccactcatcatcgccttcgcaggcatcgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaatgaccctgaggttcttcaaaagattggccaggcaatgggtgttaaccttcccggagattctagtgtgtccactgtgctctctggacccgaagagactgaggaggaaggaggggatgacgatgagtccattgttcatcacactgcaagtgttggtgatgaagagggtttgaagaaagctttagaaggtggagcagacaaggatgaagaagatgccgagggaagacgggctttacattttgcatgtggctatggtgagttgaagtgtgcagaaattctccttgaggcgggggccgcagttgatgccctagataagaacaagaacactccgttgcactatgctgctgggtatggtcggaaggaatgtgtggatcttctgttgaagtatggtgctgctgtcacgctccagaatctggacgggaaaacccccatcgaggttgccaaactcaacagtcaagatgaggttctcaagttgctagagaaggacgctttcctatagagaagagaaccgccgaataaagtgtatcaagccgtcaaactattggttttgcattggtttatttatctcggtctggtatggttgtctgtagcttgtgaatttgatgttcttttcatagcgaatgccgtttttgaaccagtacttgtgtaagaagtacctaggcttgttcttgtcctccatatatgaatctttcacacttgtcaagaattgattacagttattttcaaggctatttcctccgttcccactataaagtaagagatctaaccaaatagactcgtgtagtacagatcgaaccattaacgttcttga

SEQ ID NO: 12147 - DNA, 3178 bp, Zea mays
ccggccgggttctccttccctctctgctatgctatgctatgcttaccccgttctctctctcctccctttcttcctcatctactactactagactactagtaactccgcttcacttcttccgaagcggcgcgggcggaagcgagggcagctcacaccaccgtgccgcgcgcgcgcgctctccacccaccacctaattccgccgccgagctcgccgacgcggccacccgcgatcgggcatttggacccgtccccgcccgccgcccgcacggcggctcgttgcgggaaagtttctcgaggccgtctgtgaccccgctccctcggccgcgagatcccgcccagccgcggtcgcagaatggcgcagagcaactgggaagcggataagatgctcgacgtgtatatctatgactacctgctgaagaggaacctgcagacgacggccaaggctttcatgaccgagggaaaggttgctgctgatccagttgcaattgatgctcctggagggtttctgtttgagtggtggtctgtcttttgggatatattcatcgcaaggacaaatgaaaagcattctgaagttgcagcggcatatctagaggcacagcaaataaaagcaagagagcaccagcagcagatgcagatgcagcaattgcaacttatgcatcaaagacatgctcaacttcagcgaactaacgcgaatcatccttcacttaatggtccaataaatgctttaaattctgagggcattttggggccatcaacagctagtgtcttagctgccaagatgtatgaagagcgattgaagcacccacattcaatggagtctgagggatcacaacttattgaagctagtagaatggctcttctcaagtcagcaacaaaccatgcagggcaattagttccagggactcctggaaatgtgtctacaactctgcagcaaatccaggcacggaatcagcaaacgattgatattaagagtgaaggtaacatgggagtaccccagagatctttacccatggatccatcatctttatacggtcaaggattaattcaacctaaacctggattgagcggtgcagggctgaaccaaggtgtaagcggtttaccactgaagggctggccattaactggaattgaccagttaaggccgaatttgggtgctcaaatgcagaagccatttctttcaacacagtcacagttccaacttatgtccccacagcagcaacaacaatacttagcacaggcccaagcacaagggaaccttggaaactcaactaattatggggatattgatccccgcagacttacagcattgaccaggggtagtttgaatggtaaagatagtcagcctgcaggaacggatggttgtattagttcccctatgcaatccagttcacccaaagtcagaccagaccaagagtatctcatgaagatgcagcagacatcttcccagcaaccccaggaacagcttcagcagcagcagcagaaccaacagcagcaacagagccaacaacaaatgcaacagaacaatagaaaaagaaagcagcctacttcttcaggaccagcaaatagtaccggtacaggaaacactgtgggtcctgcaaactccccaccatctacaccatccacacatactcctggggatggacttggaatgggtggtaatatgcgccacgttccaaagaacttaatgatttatggtgcggatggaactggacttgcctcctcttcaaatcaaatggatgacctggagcagtttggtgatgtgggctctttggacgataatgttgaatccttcttatccaatgatgatggagatcccagggatatttttgctgcactcaaaagaagtcctgcagagcctagcccagccgtttcaaaaggttttactttcagtgaagtcaactgttggcgcacaagcaacagcaaaattgtttgctgccacttctcttcagatggcaagattttggctagtgcaggacatgaaaagaaggctgtactttggaacatggaaaattttcagacacagtatacaccagaagagcatgcccttattatcactgatgtccgtttcaggcctaactctagtcagctggcaacatcttcttttgatagaactattaaattatggaatgctgccgatcctggattctctttgcatacattcactgggcacaacggccaggtcacatcattagattttcatccaaagaaaacagaccttctatgctcttgtgatggcagtggtgaaatccggtactggaatgtgacccagtttgcatgcttgcgtgccataaagggtggtagtgcccaagtccggtttcagcctcatgttggacagtttttagccgcagctgctgaaaacgtggtttccatatttgacattgagacacatgggaaaaaatacactctacagggccataacactgatgtgcagtcagtgtgctgggacaacaatggggaatatattgcatctgtcagtcaggacctagttaaggtttggtcaatgtcaactggggattgcatttatgagcttagttccaatggaaacaagttccattcttgcgtgttccacccgagctattccaatctcttggttattggaggctaccagtctctcgaggtttggaacatggtgaaaaaccagagcctaaccgtacaagctcatgaaggtctaattgcggcgctggcgcagtcaccagtcacagggatgatagcttctgctagccatgacaactctgtcaaggtgtggaaataacagtaacaacgattatgatgcatctaggtagttttttttccagggcaagtgaaatttctcctgctgaggcataaaataaggaagagtagtaaattagatggttgccggtcgcggttcagctgtccaagagcagtgagtttgttgatgggttgtattgtatttatgctgataggctgtttgtgtagctcagaaacaaaaaagaatacattggctgaaaaggtgtccgcctgttttattttttgtttctgccgtatcatatgtaaccatttaacgttccctgttttttaattggaactcgctgcgattggcatctggcaagttggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12148 - DNA, 3808 bp, Zea mays
  misc_feature (2219)..(2219): n is a, c, g, or t
  misc_feature (2238)..(2238): n is a, c, g, or t
  misc_feature (2269)..(2269): n is a, c, g, or t
  misc_feature (2271)..(2271): n is a, c, g, or t
  misc_feature (2306)..(2306): n is a, c, g, or t
  misc_feature (2330)..(2330): n is a, c, g, or t
  misc_feature (2435)..(2435): n is a, c, g, or t
  misc_feature (2471)..(2471): n is a, c, g, or t
  misc_feature (2514)..(2514): n is a, c, g, or t
  misc_feature (2542)..(2542): n is a, c, g, or t
  misc_feature (2637)..(2637): n is a, c, g, or t
  misc_feature (2763)..(2763): n is a, c, g, or t
  misc_feature (2907)..(2907): n is a, c, g, or t
  misc_feature (3152)..(3152): n is a, c, g, or t
gtgaatcgtgatcccctgtggttccttccgagcaagggagaaagaatgcagtcgtctcctccgcgtcgccctcctccagtgtagaaaactgcagcccgtatagtgtcatcggcgcaaagggacgaggtcgcagctgccgatgcaggagacggcagcaggcgcctatccctcctacatggagccggagccggagcagacgggtgcatcggcgactgtgggtgtgatgggctgccgctcgcccacgtgcccgccttggctccaagcggccattgcagacatcgatcagcgggtgcgcgcgctggcggtggacgatgccgcgccgcccacggagcactccttcgcggagcgcgccgaggagtactaccagaagcggccgcagctgctggccctcctcgccgacctccaccgccgctacctctgcctggccgaccgctactgccaccaccagcacaagcgagagcagccctcgctgccggcgtctgcctccgactgcggctcgtccgacgtcgacgaccgctgctccgacgccggcagctcgctctccttccaggcccagcacccgccgccggtggccggggtccccgccgaggaaggggaggagctgctggtggcggagctggtggccgcgtgggtggagcgcgacgtgctggcggacgaggcggcgcggcgcgcggcggagtcggcgcgcaggatccagctgcaggggagcctggtggaggtgctggagtcggagcgcctggtgctgctgggcgagaacgcgcgcctggggttccgcgcgacggcggccgaggacgaggccgcggcggcggcggccgacctgggctacgcgcgccgccgcgccgccgagatggcccgcctcgtgctcaggctccgcgaggaccaccgcgcctgcgtgctggggcgcagggccgaggcgctgcaggcgcgggtgtacgcgctggagctccgcaaccgcgagtgctgcgaggccacggcggcgtgggaggccgaggtccagcggctcagcgcagagaaccgacgcctcgcggaccaagccatgatggcgaggaggaagcgcaagggcggtggtggtgggtggtgggcgagggtcaggatggcagcggccgggtggacgccgtgtgcgcccgcggtcacggtcgccgagcagaccaaggggaaggaggacggcaagtaccaccactacggcggcggatgcttctgtgtctagactaggagatgagacggcggcggcgatctagccctcctttttgttagtagtaattactattataattcaggacttggcaggtgaatgtgaatgctgctgggtcggatgcataattctggagaagacgatgattgtgctccgcaggcactagtaaaacaacatgcaattcgtatgatctgttcaatacattataccatggtgttcccgcaaaaaaaaaaaaaaaatgtagtacaaggaattccaggatctcaatatattgctcttgggaatttagcacacggttcaaaacttgtgaatttggccgcgtgaggatgtgatgaatggcacttgcttcaggttgtgatcaattttccccattcactcaatctttgctctggaggttttacaagtaagttttgtttagtatgaaaagtattcagatttgctacttattattgacaaaattagaagttaaatactatacacatggtgtgtttgtgtaatgctttaggcaacaggggggaaatatataaaagtatcaggtatagtataggaataatcagaggattgatctcttggagtttgagaatagaaggattattgggaaatgcaaatgtctgttatctcttctactgatgatgcgaaaggttctgttgtctgttctcgtaatgaaggtcatgctgctttatttgcatcttataatgttcatctactggcagcactggtgttgcagcgtggttctctttctctctctgctgtaatagttgagatgcagcctggtagcaaaaatattttggtgatctcggattcttctggtagtaaaatggtgagttcattatctagctaggatgttactatttcattatctaaaaaactcgctacagagctcacttcaacttgtgttttcccctttggtttaatttgtttctaatttcctcctagctctatctgatatgataatcactattgtgtcattgtcttgatgccttttagctctatttaatatgataatcactattgtattcaatcatcncttgttttcagggcaaagnaagagcattttgtgctggaggcgatcttgcncnaaggcattggtatgtgctggatttaaattgagccntcttcttgcattaggaacaagcancatgtcagttctttaagttctgttttcaataagagaatctgtatcatgtgtctttttatactacaaatttagtatgagacttccatatttaaatgctttctaggncgtgtaacaccaaatcctgatttagaacacaacaanaatgttcttcatttttagagaactgttttctattctgcttatntggtttctataattctgttagtgggttnctatgatccgtgtacatggttttttaatttcatcatgggtttaatttcatcatgatatgacataataacaaggcatgttaaacctttgatagcanggataaaaactaaaatttgtagaggatgactaacctcactgatgggaagatcaaatgttgttctagaaaaagcacctttacctgcttcagtaggtccaagaagaggaaatcctaaagcataaaaantcagaaattgaagattagtgcagacgattacaatgttagtgcactcatgctcatgtcaactaaaaaatatttatgttgttaggcatgctagatgaaggcatattacttgcaagccaccaagaactttcatatagaaaattgaanagatgaaaatacatagagcaagttacaactaaggaggtgaaattgtgtttgagaactaccagtggtgacactgataaaagagaggttggtgacggcaacacagacaacatcaagctcatcatgggaggagacaccgcgacaacccctagaagctccaagagtggcaaatctgagcagctgaaataaatgcggccacattgtactaaagaacgggtatattctatcttatatttatagcctctatnctataacagatgtcattttttaaccaaacattatttgaaccttctagtgcaaaacgatcctaataaacactttctcggacaagcagtcagctcctcaaaaggaaaagggaaaaaagaaccacctcaatggatgaatatgctagtgaactaaacaagcaaaatgcactggtcagctatatagtgtgcagctagaaactgatagcttcactttcctgatagttattacctgacttatatggtccctaacattttgcagctcaattctaagcctactgtttgcatccctatttctaggattgggtcagttttttagacaaattattagtaatttacatgctatgtcggtatcactccattctaaacatattgacattttttctttagattagttgcttaaagtccagaaaagctactaatcaatgttaggcatgcattttcacattattaacatgccacagttatgatttttgtctaaagcagaacgatccttacatgtttccagtctaatttattcagttttgcaaggaacttgttcattcttataagcatgttatagataaagcatctgtgtgttctagatattattccaaaagtccaggattcatgatttgagattatctaccaaaaaggaacaagacaagcatcgtctgacaaat

SEQ ID NO: 12149 - DNA, 1740 bp, Zea mays
  misc_feature (841)..(842): n is a, c, g, or t
  misc_feature (848)..(848): n is a, c, g, or t
  misc_feature (1042)..(1042): n is a, c, g, or t
  misc_feature (1159)..(1159): n is a, c, g, or t
ctgccgatgcaggagacggcagcaggcgcctatccctcctacatggagccggagccggagcagacgggtgcatcggcgactgtgggtgtgatgggctgccgctcgcccacgtgcccgccttggctccaagcggccattgcaggtcggtcacgggcagtccttggaaattttcatgatgatgatgcgcattcattcatgcacacgacacgcctgcccgtaaaaaaatttacggcgtcacatgtttgtgcactgtgcagccatttcctttgccttgagattttgatgatccgcgttctgcattcatgtcttcgttgcagacatcgatcagcgggtgcgcgcgctggcggtggacgatgccgcgccgcccacggagcactccttcgcggagcgccgaggagtactaccagaagcggccgcagctgctggccctcctcgccgacctccaccgccgctacctctgcctaggccgaccgctactgccaccaccagcacaagcgagagcagccctcgctgccggcgtctgcctcctccgactgcggctcgtccgacgtcgacgaccgctgctccgacgccggcagctcgctctccttccaggcccagcacgcgccgccgcgggccggactccccgccgacgaagaggaggagctgctggtggcggagctggtggccgcgtgggtggagcgcgacgtgctggcggacgaggcggcgcggcgcgcggcggagtcggcgcgcaggatccagctgcaggggagcctggtggaggtgctggagtcggagcgcctggtgctgctgggcgagaacgcgcgcctggggttccgcgcgacggcggccgaggacgagnncgtcgncggcggcggccgacctgggctacgcgcgccgccgcgccgccgagatggcccgcctcgtgctcaggctccgcgaggaccaccgcgcctgcgtgctggggcgcagggccgaggcgctgcaggcgcgggtgtacgcgctggagctccgcaaccgcgagtgctgcgaggccacggcggcgtgggaggccgaggtccancggctcagcgcagagaaccgacgcctcgcggaccaagccatgatggcgaggaggaagcgcaaggccggtggtggtgggtggtgggcgagggtcaggatggcagcggccgggtggacnccgtgtgcgcccgcggtcacggtcgccgagcagaccaaggggaaggaggacggcaagtaccaccactacggcggcggatgcttctgtgtctagactaggagatgagacggcggcggcgatctagccctcctttttgttagtagtaattactattataattcaggacttggcaggtgaatgtgaatgctgctgggtcggatgcataattctggagaagacgatgattgtgctccgcaggcactagtaaaacaacatgcaattcgtatgatctgttcaatacattataccatggtgttcccgtattctgtagtacaagaaattccaagatctcaatatattgctcttgggaatttagcacacggttcaaaacttgtgaatttggccgcgtgaggatgtgatgaatggcacttgcttcaggttgtaatcaattttccctattcagtcaatctttgctctggaggttttacaagtaaaaaaaaagaaaaaaaaaaaaaaaaaaaaaaagaaaaaaaaaaaaaaaaaaaaaaaaaacgcgcgcctgctaaaaaaaaaaaaaattctataggctaaacctaaaataa

SEQ ID NO: 12150 - DNA, 1507 bp, Zea mays
tgttggggacttgttctcaaatgctatgagttaacaaacaaggcaacacaaagaatgttaaacgttaatgcccttcgtccatcgaagcattatttcccttgggatataatgatcttcggacaaaggtcatgaaggacataccttcatcattacgcatacgataatgaaaagagaatcacataaaatgtgaaagataatatgaacatttatgtatcattaccagctcgtttctattttattatcatggaaaaatagaaatgatatcaagttacaaatgtaccttcggcttgaaagaaggcaaaagtacaagcgtgatgcagaagcaaatgccaagtcatcgtgaacagtacggaagcactgttcatctatttataggcacgggacgcagcccatgtaaaattacactcatgccctttacatttgctaatgactatagtaatccatcgaggtctaaatagccttttcccttttaagtcagttcccctttctgctatcatgccgaagctcccctacacacagcttcgactctgcgccaaccttcgcattctttgtacttcttcacattgtggttctgacccgagtccgaaggtacctgttcatgtattatactccagaaaacattgttaaattatgtttttgagtaccttcggaagacgaaggcccccaacagtagctcctcgcaatattaatttgttagaataacgaattcaaattgcgacatggacgaaggccctaagcagaaggtctgaaaaaacaccttccctttgctagaatagcaacagtcaatgacagacggggccctccaacatggagtgcgctgggcgtataaataggatctcacaccgactgcatttgatacactgcttgtgccatttgccttattttctcaatttgttaacttgctgcttactaacgcttgatagctctcaagctttttagcttcggtttgaaggacacgttttcgtcatttccgaagataagatgtctcaagacaagaagacagttgctgagacgaagctaaccgaagaggagaagcttcttgagaagaagactgctggatttgttgagtcaatagcgaaaacgaatacagagaagattactaaagaaattctggagggcttgtctgaagatactgatgatagtgacagccatgatgtggagagtgggggcgaagactctgaagatcggccctggcgaccaagtcatgcagtcttcgggaaatcaactatcagacagagtcatcttgataatatgagaggaaggtattttcgagatatgtctattgtgagggctgacgtagacagggctattcctgctcctaaagaaaacgaagttgtgatcttccgaagcttcttcaaagctgggcttcggttcccgttgagcaggtttgtggttgaagttttgaagacataccggattttccttcaccagatcactcctgaagcagttattagagtggggagttttgtttgggctgtgagaagtcaaggtctgagtcgacctgcag

SEQ ID NO: 12151 - DNA, 715 bp, Zea mays
ccggccgcccgggcaggtaccgctctgtgcaatggtttgaacaaggtttggagtcagatctgtttctgcttcaatgctgtgctgccctatcttctccagagttatttgtgcggacaattcaagagcgatttggtttgtccagttatacagatttgggacttgcagagcaaaatgagtttgagtcagttttaatgcaagaaatgctgatttttcttatacaactggttaaagaacgccgtttttgtgggctttccacagcagacaacttgaggagagaattgatttacaagttagctattggagacgccactcatagccaaattgttaagtctcttcctcgcgatctttcgtcaagtgaccaacttcaaaatgttctagattcgttggcagcttattctaatccatctggcatgaagcagggtaagtatgtacctcggccgcgaccacgctaggaattggacttgtatcacccccgctggaattccagggaattgcaaattgctgaggaaagatattaccgtttctgcgaaatttctgcccttaatgctcagctacctcggtggactcatgtttttaaccccctcagaagtatttctaacattgcaacctcgaaggctgtccttcagattgttcgtgccgttcttttttatgctgtttacagtgatgcatcatcggcatcacgtgcccctgataatgttcttgtgacgggtttgca

SEQ ID NO: 12152 - DNA, 592 bp, Zea mays
ggccgtctctataccttgatgcttttggagaggaggataatgaaatgcccagaggaaaacctttatatctaagtcaagaaagatacacatccctgacgtatctggtggcatctcatagccttgaccgaacttctgaagttcttcggcaaacaacgattggcttttatggatctgattgagcccatttttcaaggaacaatgtgttcaaagtctgctttgtcaggatcttgcggatgtgcatatttttgggaactgtactgcaacttggtgtttgatcttctccggtggtaacgagagcgttacctcaaccaaggtggtgtagattctgcaggctcgccacccgtcgttgctctatggcacactggccctctgctgcctcttgtgcctaatgtacagtctacattcttttctttctttattatggacggtgctcacaaaatgaatgaccttggaagttgtaacgctgtacgatcgactgcatgatctgtatgcacagacatagcgtcggactggtgtagtttgtcagtatgaatcgcatgcatcaggtgccatttcgtcgccaaaaaaaaaaaaaaaaaaggcccctagggcc

SEQ ID NO: 12153 - DNA, 3975 bp, Zea mays
gttttcccagtgtctgacaaagtaaagaaagaaagcatgttaactctcctcgtctctttaatgcacaaatacaaagaagagactgatggcaccttttctggatccaagtactgtaatatgccatctctaatcgaaatcttattaaagaagttcgccaaactaagtcccgcgcgcccgcttacattgagacaaatggcaccacatatagtgccttctacacctgatcataccagtattaaagaaggcccaggatcttcttcagattctatggaaaagaaagcaaaagcacgccaacgccaagctgcaattatggcaaaaatgagggcagagcagtccaagtttgctcaaagtatgaagtcatcagaaaacgaggggcatgacattactatgttggaggccgatgtgtccagttcaactggggttgtgtctgaggagtcactaccagtttgctctctgtgccgggactcagattccaaaagccctctgtgctacttaattcttcttcagaaatctcggcttgcaacctttgttgagatgggtaatccatcctgggaaaatccagctcaagttaacaagactggatcagtcaaaagggaaggctcagtcgattgttgtgtctctggttcttcaacttctgaggagcttgtcaatgatacaacagtggagccatcatttgatatagacaacatggaagttgatgcctttcttgatttttctaatgagcaacatccactgattagatatatatcatctttcccaactgggcatagcaacatcaatgcagatgaaaatgtatcgcttgaggcaattgaggctgacatttacaattctattttaaatgatctatttggatccagaaatgcacatattcaggatagtgaccaaatgttgccatcaaacacttcaaacatcacaattgataccaagagaactagaagccccaagcgttcagtgctgggaacatatgttagttgtctttcatcaaaacaccgccattcttctctatatgatgtagcctcaaaatcttctgcctctgtaactacaagaaacagatttggtcccgtcgattgtgatggcatccatatatcttcttgcggacatgctgtgcatcaggaatgtcatgaccgatatttgttctccttgaaacaaagatatgtccggagacttggttttgaaggtggtcatatagttgatcctgatttgggagaattgctttgtccagtatgtcgcagatttgcaaattccattctcccagcatcacctgatttctcgggtaaaacatcaatgatgctgagaccatttgttcaaaccttgacacctcaagttgttacaaccacatcagatgtgaatagaaattgcttacagttcgctcgcgcactatctctttttgaaagtgctggaaaaatcgttggagaaaccaagtttttaaaagctatatctgggaagcttaatgaaactacaaatccagccctcgatccttgtcttcgaagattggctatgctttactatcctcgcagtcacagcagtttttcaccatctaagaggctcaacccatccttatttctctgggatacactaagatactctctggtatctacagaaattgcttctcgtggtaggatgtcaagccactctgctgaatcgaagtcctgcttggagtctttgcgtggcgaacttaattcatcaagtgggttcatattgtctctcctgttccatgctgcccactctgcacggaatttgaatcgtctcgaggttcttctgaggtttgaaggtatccaactattagcaggctctatttgctcttgtatttcgggttataaagacattctgaatgccactaagcgaaaaggctctttgccatcgatggttgatccagccagtgagggggccctctttcctgatgtacaattttggaaacaatgtgctgatccagttcttgctcaagatccattttcttctttgatgtcagcacttttctgtctgcccgttcagtttctgtcatctgctgaattcttcatcccttttgtccatctgttctatgttgtttgtgccattcaggccctggtaacatgctacggagaggaaacttttgatcgatcaaacttcaatgactgccttcttaatgatgtttgcaagacaatgtcaggatatgatatcgccagagactattttgtatccaaatatatcgatccctcttgtcatccaaaagacatggtccgcagattaacatatccatatcttcggagatgtgcattgctttgggagctgctaagatcttctgccacatcacccttgtatgacggttccaatatttgggaaggatcacatctttacttgagtaatagcacacaagacggcagttcttcactggcaatggaactggccgggttacgagaattggaagacctgtttcagattcagtcgctggatctgattctccaagatgaatctgtacatatgcttgccttaaaatggtctcaacatttctgtgaagagtacaatccccgtaaatatagaggcactctcttttctacccctgcagttccatttaggctgatgcaactaccagatgtgtaccaggttctcctagaaagatatatcaagatgcaatgccctgattgtggctcagtgcctgatgaaccggcactatgtttgctatgtggcaaactatgttcgcctagttggaaaccatgctgcaggactgggaaatgccagaatcatgcattgcaatgtggtgctggtattggcatatttcttctagtgaggaaaacaacaatcctgttgcagcgatctgctcgtctaacattttggccgtctctataccttgatgcttttggagaggaggataatgaaatgcacagaggaaaacctttatatctaagtcaagaaagatacacatccctgacgtatctggtggcatctcatagccttgaccgaacttctgaagttcttcggcaaacaacgattggcttttatggatctgattgagcccatttttcaaggaacaatgtgttcaaaggatcttgcggatgtgcatatttttgggaactgtactgcaacttggtgtttgatcttctccggtggtaacgagagcgttacctcaaccaaggtggtgtagattctgcaggctcgccacccgtcgttgctctatggcgcactggccctctgctgccctcttgtgcctaatgtacagtctacattcttttctttctttattatggacggtgctcacaaaatggatgaccttggaagttgtaacgctgtacgatcgactgcatgatctgtatgcacagacatagcgtcggactggtgtagtttgtcagtatgaaatgcaggcatcaggtgccatttcgtcgtcatttaatttcatttatttatttaccatgttgccctgtgaaaaaaaaaaaagacaaagattcagagaaatgagataagcaactcggaaagatatttccttgccctgtgataggataggcttgagggacgaactttggctccaccgccagctgcctccctccccacactatctatgctcgacgggcccgagccgcacggcgatctccactgcccacctgcctccctccccacccgccggcgcgccgacagaccaaacccgtccaggtccccactagctggcgtggcccgcttcactgccgccggcgcaccgcggtgcacacatctcctgcggcttaagttgctgtcagtttgtgaaaggaccatggtcagcgtactgtctgcttgtgctgtccttggtgcacttgagacagggaagtgggtgcattcctacgtaagaaggaagcgcctatctctgacaactattctcggctctgcactggtgggcttctacgcgaagtgtggatgcatcccctatgcggttgcagcgtttgagtcaatgcctgtgaagaactcgtgggggtgggcagcctttattaagggcaaaccaacccctggcaggggcagggaagcgttggcgct

SEQ ID NO: 12154 - DNA, 878 bp, Zea mays
ccggccgggccgggtcttcctacttcttcgagtcaccctgcgcggccggccgggccgggatcctctattcctcttcccctcccactccccagctcctgccgccccgctccacgttccagaacatctgggggggtatcccactcgcatggtcaccccatagccccccgagaaaccaccccaccgacgcaccggcagcaatggcggtgggcagcggcctggccctgtaccacgtcctcggagtggccacctgcgtggcgctgctgtacttcaccttcggcgaggtggacctccgccacatctcgctcccgtccttgcccgtctcccgcccgtcccccttccgcgcggctgccgtggcggcgcccttcgtggagcggcgcggcgcgcagctgttcctggccggccggcccttctacgtgaacgggtggaactcctactggctcatggaccaggccgtggagccgaggtcccgggaccgcgtctcccgcatgttccgcaccggcgccgagatgggcctcaccgtgtgccgctcctgggcgttcaatgacggcgcctacaacgccctacaggtctcccccggccacttcgacgagcgcgtcttcaaggcgctggaccgggtggtcgtggaggccgggcggcacggggtgcggctgatcctgagcctggcgaacaacctggaggcgtacggtggcaagacgcagtacgtgcggtgggcgtgggaagagggcgtcggcatgtccgcctccaacgattccttcttctacgatccagccatccgcgactacttcaaagtctacctcaagacgctgctgacgaggaagaacccttgacaggggtggagtacagggacgaccccaacatcctcgcgtgggagctgatga

SEQ ID NO: 12155 - DNA, 1692 bp, Zea mays
ggacgggtatgctgacaatggtaacgccacggaggctatggctttgttctggaggatggtccaggagggcatggatgtgacggatgcgtctgtgttggcagcactacaagcgtgcggggagcttggatatctcgatgaggtgaggcgtgtccatgagctacttgtgagagttggcttgagctccaatgtgtcggtgacgaacgcgcttatcaccacatacgccaagtgcaagagggcagacctcgctgcccaggtgttcaacgagctgggcaataaaaagacacggatctcatggaatgccatgatccttggcttcacgcagaacgaatgccctgaggatgcagagaggctcttcgctaggatgcagttggaaaatgtgagaccagattcgttcaccctggtcagcgtgattcctgcagtcgcggacatttctgatccgctgcaagcaagatggatccatggatattctatcaggcaccagctagaccaggatgtctatgtcctgacagcccttattgacatgtactccaaatgtgggcgtgtcagcatagctagaaggctcttcgattccgcaagggacagacatgttatcacctggaatgcgatgatccatggttatggttcacatggttttggcctgcctgcagttgagctatttgaagagatgaagggcactggcagtttgcccaacgagacaacattcctctcggttcttgcagcttgcagtcatgctggtttggttgatgaagggcagaaatattttgctagcatgaagaaggactatgggcttgaacctggaatggagcactacggtaccatggtggatctacttggacgagctgggaagctagacgaagcttggtctttcatcaaaaacatgcctatagaacctggcattagtgtttatggtgcaatgttaggtgcttgcaagttgcacaagaatgttgaattggctgaagaatcagcacagataatctttgagctgggcccagaggagggggtgtatcatgtccttttggcaaacatttatgcaaacgcttcaatgtggaaagacgtcgcgagggtgaggactgctatggagaagaaaggactccagaagactcctggatggagtattatccagctcaaaaatgaggtccataccttctactctggaagcacaaatcaccagcacgcgaaggacatatacgcaagactggctaagctcatcgaagagatcaaagatatgggctatgtgccagacactgattcaatacatgatgtggaggatgatgtcaaggcacagctgcttaacacccacagtgagaagcttgctattgcatatgggctcattcgaacagcccctggcacgacaattcagataaagaagaaccttcgagtttgtaacgactgtcataatgcaaccaagttaatatctctactgacaggacgggaaataatcatgagagacattcaacgctttcaccattttaaggatggtaaatgttcatgtggagactactggtagtgaaatgttgaaggcagtctgaatatccatttccgagatgatatacagctgctatacaagtatacaattagactaacaggtaaagctaactattctatctttttcaccgaccatgttttgaatttgatcgggggcattcgatatgttgatttaatgaggaatgtataccatgttcttttatagtc

SEQ ID NO: 12156 - DNA, 1897 bp, Zea mays
ccacgcgtccgactgaggaagagcttctattgtcaagtaaagtcatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcaagctcagctccggtcgcgtcgttggcgtcatgctcatgtccgacggccagcagaaccggggcgagccagccgccaacgtcaagatcggcaacgtgccggtgtacaccttcgggttcggcgcggactacgaccccacggtgctgaacgcggtggccaggaacagcatgggagggaccttctccgtcgtcaacgacgtgaacttgctgagcatggccttctcccagtgcctcgccggcctgctcaccgtggttgtgcaggacctcaccgtcacggtggcgcgcatcgaggatgagtccaccatacagaaggtggccgccgggaactacccgcagacgccggacgcagacgccggctcggtcaccgtggccttcggcgacctctacagcaaggaggtgcgaaaggtgatcgttgatctcctcctccccgccatcgacagcgaccgtggcgcggacatcctggaggtgacctactcgtacaagacggcaggaaagctgttcgacgcgccgcccgccacggtgacggtgcggcgcagcggcacggctttcccggcggatgatccgccagtggacgtgcagacggaggaggcccggctgaagacggcgacgatgatccagcaggcgaggacgatggcggacggcaagaagctgggcgacgcgcgggacaagctggcggaggcccagaacgcgctggaggacgtggtggcgcagtccgacccgctgctggacgccctcaggacggagctgcaggagctactgaagctgatgaagtcgcaggacgtgtacgagaagcagggccggccctacgccatgtcgtcggagacgtcgcacgacaggcagcggttcgcggcgaggggcgacatcgagagcaatcgcctcttctcgacgccgcgcatggacaagtacctggagcaggccaagaagttcgacgaggacccggctgcgccgctgccttcggcggacaaggacgaggaagaggaggtcgccgccaacccgctcgcgccattggtcggccccatcaccttctacatccgggccgccgtcgaggcgctgcaggccatcgagaagctcatcaacaagggagccaattaatgcgatgtaatgaacgggcacgcagtcagatccagtcctgttttgtttacatggccatggccatcctcgtcatcccttcttctctctgctatatctcgatgaataaaatctgcgtgtattgtgtttttcgggggatttccacgtcaccttgctgccatgtatgcagccggataataatatatttaattttgctgaaaaaaaaaaaaaaaaaaggcccctagggccggccccgtgcgagggg

SEQ ID NO: 12157 - DNA, 705 bp, Zea mays
ttcccggcggatgatccgcccagtggacgtgcagacggaggaggcccggctgaagacggcgacgcagtccgacccgctgctggacgccctcaggacggagctgcaggagctactgaagctgatgaagtcgcaggacgtgtacgagaagcagggccggccctacgccatgttgttggagacgtcgcacgacaggcaacggtttgcggcgaggggcgacatcgagagcaatcgcctttttttgaccccgcgcatggacaagtacctggagcaggccaagaagtttgacgaggacccggctgcgcccctgccttcggcggacaaggacgaggaaaaggaggttgccgccaacccgctcgcgccattggtcggccccatccccttttacatccgggcccccgttgaggcgctgcaggccatcgagaagctcatcaacaagggagcccattaatgcgatgtaatgaacgggcccccagtcagatccagtcctgttttgtttacatggccatggccatcctcgtcatccctttttttttttgctatatctcgatgaataaaatctgcgtgtattgtgtttttcgggggatttccccgtccccctgctgccatgtatgcagccgggataataatatatttaattttgctgaaaaaaaaaaaaaaaaaaaaaaaaaaaaaaaaaaaaaaactcgagggaggggcccgtgtacc

SEQ ID NO: 12158 - DNA, 890 bp, Zea mays
aggccggccggcccgggggtccctcgaggccggccgggcgggaagtcatagaacgggttgcgaggtagcccaattctacagcaaaaatctacagcactagtctttttcgtctcggtcgccatgtccttcaacgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggcggtgctggacgtgagcggcagcatgcagggcgagaagatcgagaagatgaagaccgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcaagctcagctccggtcgcgtcgttggcgtcatgctcatgtccgacggccagcagaaccggggcgagccagccgccaacgtcaagatcggcaacgtgccggtgtacaccttcgggttcggcgcggactacgaccccacggtgctgaacgcggtggccaggaacagcatgggagggaccttctccgtcgtcaacgacgtgaacttgctgagcatggccttctcccagtgcctcgccggcctgctcacacgtggttgtgcaggacctcaccgtcacggtggcgcgcatcgaggatgagtccaccatacaaa

SEQ ID NO: 12159 - DNA, 1728 bp, Zea mays
gattttagtctatttaattttcttgctttcaaacatgctctaggtgttttatgcttaccctgttgattgaaattttcgtcgtcctcgtaccatctttttacgtagcttcccatcaatccacaatggtaggctaactggccagccgcgtggattttcatttttttctaaaatagataaagcacacggaaggtttgatgtaatttcccccgaattttctgcatatatctaaaaaaaatatcgaattacatcaaatccgaggagcagccacagccatccatggaggcgctctacttgctggcctccctggccgcgaccctcgtcacctccgccttccactcgctcctgctgctcctccgcctcctcctccgctacccgcgccgcgctgcccctaccgatgatggacccgccgcggcggcgcggctctacgagggccgggtccggcacgcgcgacggcgcccggcggcgcacaccttcgagtaccccgcgcgctacgccctcgtcgacctcgaccgactgccgctccccggccacctctccgccgacgatgcccgccgcgtcgcctccacctccggccccgtgcacctcttgacggtacccgagagcgtggggtacgagcagaacccgctgagcatttactactgctacgattctgcaggacaggggcaagatggagagctcagaacgtgcattgccgaggtcacaaacaccccctgggcagagagagtgatgtttaccttccaaccgggctctgatctcatcgcgaagcccttgcatgtcagcccctttatggatatgctcagcaactggagtattcgcgctgatgctcctggtgatagactctatgttgttatatcagttcagcatccgacacttggggactacttcactgcagttttggatgccaaattggttggacagacaagtaattctctgaggctgacaaccttcttctggctgatgccgcacaaagttgctgcatggatatactgggaggccctcaaactttggctgaagaacgtcaagttcctggaccatcccaggtatgtgaacccgaggtacagggacgaagcgctggagcgcgaccttgagctccgcacctcttgctgccaccttcagcggcaggagcggaacgaccgaagaagcagaaccgcagaaaagacagctgaaatcacggaccacgtagatggcaagggcgacgcggacatcgcgaagaggtggtgcgtttggagggacgctcggtggccgtggtcatgaaaaaaaaaactcagacatgccgttttgtgttcagattcagcctggtgctcccgtttcgaccaaatatcgtagttttatttggttggtgccttcgcagccgccactacgagttgacagtatcgatactgggtaacgttgttcgctgttaaagaagaagagattactagggacatgttttttatccctcaaaagatgcattttcttcttggtagtatccagttgttgaccaattattcggcttcaatgtataacctttggaatgtgcaagaggtgcgcgtcagcgcgtgtatgctgccatcttcaatgcacatgcgtgcctgattgctgcaagatatattacattaatataacattacatcatatgtcattatattatattatataacatagaatgggatactcagccggccaggcaagaaagacacatgtctgcttttcagtagtcaggtcagatatccagactgggcaaaaaaa

SEQ ID NO: 12160 - DNA, 4510 bp, Zea mays
  misc_feature (3934)..(3934): n is a, c, g, or t
gccggccgtgtcgggagacgggacgccgcctcgtgtccggcacgccgttccctcccgtccccgctccttcccctcgctaaaacccatcgaatcgaccgacgcacgtcctgacactcctgctcccctgtcgccagtcgccaccgcgtcgcgcgcgggcagagccctctctcgccatctcgcggccgcggcacctccacagctagcctaccacccgacctcccaccgccgccgccgccgccgtcctgctcccaaccacaagtccaggaggacgccacttcgatccgccgcagggaggcccccgccccccgccaggctccatctccggatccgatcgcccgccggctcggttcaatccggaatagctgcagggaacaaaaatttcaactgatcccttgaccattttccttagagattatagaaaaggtctcccttgctttatttccatccaaaccaaagcgaaccaaaatcatcttctagatcagtttctgacgatggcagttgaaaagctaagcatgatgacctaatagcgtcagtgctgaacttaagagttccgatggagccggctcctggattatactgaccttctcatatggcgctggatccgtgatgcctcctccattcctgaagctatttggaattcattggcctggatcagtgttctgaagtgctatctaacagtcagaaatggatggatccgagcttgaaaatcctacttctagaagctcatcccagaaatctagccgacgttcgagtagtaggcgttctcaaaagtcagctggacagcattctttgaccggtggctcaagagaaaagaagcaaatcgaaatcttccaggcagaaacacttggttattgacgacaaagaggctaaaaaggggaaaacacgtccccacaaaattgacgtggcagatgagaggtccaattttctaggttatgaagtgtatgctggacagctgattcttcaaaagaaaaatagaagtgcgagtgataataatcagttaccgtcaaacggaaaagctgatgcaattgatgctagactcacaagtaaagctctgatctggggcagctctgtactcctcctggaggatgttgtctctgtatcatataattctggagtcaaacattttacattgcatgcatactcaactaaaaagtctttatttagaaagacatgcagagttcagaaagatttctgctttatagcctctacccttgacgaggccattttgtgggtgacatgctttgctgaacaaagtatatatgttaacttactacctcgccttggagcatctagtatcaatcaagactcagaaaatcccctcagtgagtctttcggcccccggccaccgattaaatgcaaatctccgcaaagagtacttgttatattgaaccctcgatctggacatggtagatcaagtaaagttttccatgagaaagctgaacctatatttaagcttgcaggttttcagatggaagttgttaaaactactcatgctgggcatgcaaaatctcttgtatctacatttgatttcagtgcatgccctgatggaatcgtgtgtgtgggtggtgatggaattgtgaatgaggtgctcaatggtcttctcattaggagtgatagagcagaagctgtatcaattccagttggaataattcctgcagggtctgacaactcacttgtctggactgttttgggagttagagatcctatttctgcatcattattaattgttaagggtggtttcacagctctagatatcttggctgtcgagtgggttcaatctgggcaaatacattttggctcaactgtttcatactatggttttgttagtgatgtcctggaactttctgagaaataccagaagaaatttggtccacttcgatattttgtggctggaatactgaaatttttatgtttgcctagctacttctatgaactggaatatcttccttcgccaaaggagatggccgtgaatggaaaaggtacagatcaagacaaggcccacctgtccaatgtctataccgatgtgatgcacagcagatcaaagaaagaaggaattccaagagcctccagtttgtccagtattgattctattatgactccaagtcggatgtcgcttggggatgttgatacatcaggtagtacagtggcaagcactgaaccatcagactatgtacgtggtcttgatccgaaagcaaaacgtttgtctctgggaagaagtaacattgtttcagaacctgaagaagtgctacaccctcaaccacatcatggatcattctggccaagaaccaggtccaaagcaagggctgatagaaattcagttggtataacgtctactaatgacacacggtcgtcttgggcagccccatcaatgcatgataaggaagacatttcctcaacaatatcagacccaggacctatttgggactgtgaaccaaagtgggacacagggccaaaatgggatagtgagctaacttgggagcctgaccaccccattgaacttcctgtaccacaagaggacatgggaattggagcaccgatggaacttgtgccaaatttggatgagaaatgggtagttaggaaagggcactttcttggtgtcttagtatgcaaccattcatgcatgacagtgcaaagtctgagttcacaggttgttgcaccaaaggccatccatgatgacaacagcttggacttacttttagttggtggaaaaggaagatggaaattgctgagatttttcatacttctgcaattcggtcgccatctctctttgccttacgtcgaatatgtaaaggtgaagtcagttaagcttaaacctggtgcaaacactcacaatggctgtggcatagatggcgagctttgccgtgtcaagggacaggtactctgctccctgcttccggagcaatgcagactgattggccggcgatgtagacaatctatttaagcgctgtgttgaatttcatggatcctggggttctttccacttctaacaaatgtttatataactatactttctgatgggattaagcttgggttggtgttgcaaatgttgagagtttgaaccagaagcaatgttgtgaggtttctgtatatttgagcggttataggatgatatgctgattctgtttaattatgttgattttgcttatatatattcaatagagtaatttagtcccaaaaaaaaaaaaagggaactcgggggggggcccccctccagttcttgcgtggtttcgccagtacccgtgcaacgtgtacccttcaatatcttgtgcgttctgcatatcttttgaggtattcaacctatacactttactagatcagctgatcattagaagttgtgaaccacgcgagacaacaagttggtccgcaaacccacaaaatcgctgacatatacaattcctcctcacctcacgcgatgcgcaccatcggcggtccacgcgaccatacaaatggggcaactaggaaggcatgggccctccgcctcgccttcactctccgccgccttatacttgctggcagagccgcccgggctactcgcaccgtcaccggatccctcgttcccctcctcatcgctcccttcctcactcgagccggacgagctcacttgtacagccgtcggagcagccacctctagggccggccgcggccgcctgccccgggagcccgaccgtgacggcattggggtggccgtctggccgagcttcgccgcgattggattggactattggagagcggcagaatgaactggattgggaaaagaaatttcagcgagtgatggcgccggtcggtgagcgagcaacgaaaaggttggcgcgcacgactcggaagatttcatgggctttcgtttatgggctctgcaaaataatgagcgctcgccgacttccagcgctcgcgcgacagggtgaggcgcgtttcggttagtcccacctcgccaccngacgctgggtgcgacgcgtgaggaggctacataagcagcacccctgcccactttgcaacatacttacctggacggggtcgacgggctatcaagaaggcccgtggcctaggtcaatggcccacattgcacttggtgggtgcgttggtttaccatctccccaagtgggagagtggacgtcataatttgtggtagagggggtacgcgttcgcgcggcccctgccaatgatacaaaattttgaagttttttcccagttcatttcttgctctttgctccatatcgtgtaataatgaagttaatttgaggcggttcatcctttttatagagtgtttggtttgaggaatcataccattcaaattaaggtggtgtatcatgggttcattcatcaaatttggtggaatgaccccattctcatattagtactaactatgaggaatgagattgtgatggattaactaattttattccacaaaccaaataaaaatagtgaggagtgagaagacaatggactagttcattactcaaaccaaacacccattaagtttaaccacatcctttacaaagttagtcactgcagc

SEQ ID NO: 12161 - DNA, 1645 bp, Zea mays
  misc_feature (1596)..(1597): n is a, c, g, or t
  misc_feature (1602)..(1602): n is a, c, g, or t
  misc_feature (1604)..(1604): n is a, c, g, or t
attgggtacctcgaggccggccgggatccactcccactcggccactccccatgctttccttgcgcaacccagccccggcgccccgctgacctggtcgggtgcgcctccgcagctgccgctccggtgcccccaggccgcaggccgctgtcctcctgtgatgccatggtgatttggagttgctcttcttgtctccatggattcattcccagagcggcatggaggaggcactacccactcttgtctcccaggcctcctgcatcgccgccgcctatccaccacttctcctccgctagacggtccaccaagaaatctgccccaaaggcgccaatgggctcttccattcctgccgcaaaggcgctaatagactcttccagagagcccttctatgtcatccgcaagggggatgtcattggcgtctataagaacctcagtgattgccaagcccaagccagcaaatcggtactccatccttcagtcactgtctacaaaggctattctctgcgtaaagaaactgaggaatatcttgctgcacgtgggttaaggaacgctgtctattccattggtgcagcggatgcaagtgacgaattgtttggcgatctggttccctgcccttttcagcaacctgatgagaacacacaatctattttgaaaatgtcacagggacaggagatggaaacaagatcatcagagcatcccaaagttgctgatctggaaccattaccagatagcgaactctcttgtattcttgaatttgatggagcttgtaaaggaaatcctgggaaatcaggtgctggagtcattattcggcggttagatggatctgtgattgctgtactacgtgagggtttgggtattatgaccaacaacgctgctgaatatcgtgcattgatcctggggctaaattatgcttccaagaagggattcaagtatattcgttgtcaaggtgattctaagcttgtctgtaaccaggttcaaggtgcctggcgtgctaggagcgataatatgtctatcttgtgcgatatagccaaggaacttaaggaaacattccttacatttcaaatcaatcatgttttgagggaattcaactccgatgctgacgttcaagctaactttggatgccaacttgctgttgatgaagttcaagagctgtccgtttgaattgccattggcagagaaaacaagacacggtgcttgagagtagactgttaatcaatactaattgacccacgtgatcatatcacagggtgcaaagagctgtttcggctttttccaagagctgtttcgtttttaccggtaaaaagatggattggaaagaggagaaactggtagagagccacaagttctagcttcatgggctctgtgcgctgctaaagtaacaaacaacacgtagccgaagcaggtgagatatgccccaagacctgcaatattttgctgttggtttggttttgtgttgccatgaggattgaggagcttgattctttgtacatgcaattgtgaactgaattgaagtatacttaactcacaaatacatgatttcagaaattattgagggtttattggtttctttcccaaaaaaaaataaaaaaaaccttcccnnaaaangnaagggcggccgccggatagaagcctcgtcgaccagggaatt

SEQ ID NO: 12162 - DNA, 875 bp, Zea mays
  misc_feature (849)..(849): n is a, c, g, or t
tcgaggccggccggggtcgccgttctcacctcccaggattcattttgtcccacgcacgtctccctcccctgcttccatggctgccgtaccctttgctcctcccagccagccgaggtctcttcccaagcaccgccggccatctcgagggagatctggcgcccggccaccctcacctcatccccttcctggcgttcgtccttggctccctcacgtcgtttgctcctccctggtactcgagatcgcccatggagcccagccccatgcggcgctccgctcgctcttgtctggtggctggtgcgcgcaggcgccgggctcagggagccccggcaagagctggcgttgtggcgggccaccaacagtgatggaggtgcttgctgccactccttgtaggcgtcgccttccttgtcgagatcacctccctttgccgcctcgacatggcgaagaacgccgaggtggtcgagagctagaccagctccttttaccactgctcctcccattggggtgaagccgtgggtcggggcgtggtcccgaggtcaggcagcgatggcgaggatgaagagatccgatggtgcgagcagcggttcgagagggaggatgtcgtgccctacgaccgcgacgttgacagggatcccgtgcttgtcggtggcgcagccaaggactggagtaaatgctacgtaggttgtgaatttgttttttttctgccagtaagacacttgatgctacttttgaaattgcaccagattcttctgtagagggtatcctcggatcaatggaatcatctcaatattattcaaaaaaaaaaaatgatgtgccgccagggagagggacaagattgtgatgacaatcagnctttcctcacacgtcccagttggcta

SEQ ID NO: 12163 - DNA, 5173 bp, Zea mays
  misc_feature (927)..(927): n is a, c, g, or t
  misc_feature (4590)..(4590): n is a, c, g, or t
agggtttgttgtatttattatgttcttaatgcaatgatgctcagctctcctgtgcatttatttaagggaaaaaacttccagttctgatgtagtttatatgccatattcactgagccattggcataagtcacttgcactctttatttgatattaactttcttcatttacaaactaggttccactcctgtttggatctgttgcaatggaaaaggttgcttgccacatcgttcattggatatttaggagaaccggtagacatctctttctaactgacgatgatgaagggctgcctccacgcctgcagcggatggttgaagatcatgacgatctctactttatgtaagttttatctcgctcttggcttattttgcattcatgatctgtttcagtttgccttgtatttttttccttttctgtttttgttggtggccaatgttgggtttcaactcgagcctactccaacttccttgactaaaagacacttctgtttttgttttggttctgccatactatactaacgatctgcacctgttgtagatctgctttgcgagcattcagaaggagagtggtgtacgcaaacgcagactgtgatcgtatccttattattagcgctgttggcaattttctttatggtgttcatgttgtttgttttattgttgttgtatacttttggctatgcacttctttaatggacaaaccagacattgttggctggagaacatcatctattagaagaaacaatgagcttcctgaggtattttttattgacttcctaattatgttaagtatctaggaaggactatgtgttttctttgtatcaccattctcatatatgaggccttcttttgcttcttttgatctgcagttgccagtatcgtcatctgacaagtacccccacattgtacatgaggagcattcagaagaaancgatgatgataagtggcaagattgcatggcagaatgtgatatggacgttctggaaggtaagtttatagagttgcatacaaaatgaggtaggattaggatctgatgggttgataggattagggtaatgatgctacgaagattatacggatgagacaccggagggcggggctgcgtgcggcgccaatgtgccgtcgctgcttgcgaggggcgagagacagaaaaggtgtggtgcgcccagctcctaggcgaagcgggcaactaagattgatgctgcttgatttcaaatagagacgtacagagttgttttatagtccctcctctcctcttatctaactaacccttatatggacttatctaatgctagtaaccgactcctatgatcctatctaatagcatctaatagctatctccttatctaatgataacttggtccttaagcctgttgatcctaatcacggcgtctctggtagtggatgctggtcataacagaatgcttttttactatatttcaagaagcttcattggttttctccttttgttgtgcctgttacaattaattgatgcttcagtgctgtgtggaaagaggtggtccttttccttattctttttagattgtgtcccttattattatacatttcctttttatttttcttttccttttttaaaaaaatgttgtctttattatgaaactgagtaaataagcttactccttccgggttcaaattataagtcgatttggacaaggtttgaatcaaacttataaaactttggctacaaatagccgttttgttatttagttttgaaacctaatagtcatattcaccgatttatcttaaaaagtactttttatataaaagtatagatgtattaagagtttatttgtgttttaacacaaaaacattggtcaaagctatgttttgaaggcggccgtgttgttgtcctaaatgacttatagtttggacctagtgggagtaccagtttagtcttcaaaacaatgaggcagcaagcgaccgtgttactaaatttgtactggctttgtcattttggtcttgccgctgaagcataccatctatcagtgcctccattgagacaatgatgcggcacgtaaaggccaaaaattcagcgtaccatctatcagtgcctccattgagacaatgatgcggcacgtaaaggccaaaaagtgctgttctgaatctaaggctaggaccctgaatgttggtcgtaactaattagcaaagcagttgcgtggtttcaaaatttaaaaaaaatgagtaggtttgtgacccaagttcagtagctgtatgcatgactcttactatctcctcattgtatgtaccatcctgtagagaagatggtgacggggcttggaaaggtgtcgtgggagaaggtggacgtgagcttccacagcagcatgacgagcttcgcggcgcatagcatcattcaggtttgtagagccccgctgggcgcctgccattgttatattgtgacgcaaacgcaacgctagttattattgttttcttttgttctggcacggacaggtgaagtacgcgttcatgaacgagggagcggatgtgatacagcacatcatagaccacttccagctctagagaattttattcctcttccccggtgcggtggccaaaaaaaatgcatggaaccgcacgaggagagcatgcatacacggatggagagccatggaggtgcagtgcagcagagtgtgtgcagaggctgctagctaaagcttgttgggcgggcgggctggctggctgacttgactggctggctgcgctgtgtaacagtgcgttgtctatgtttttgtttgtgctacgtacacaattaaagatgatgagaaaaaaaaaatcgttgatgcccccattgtctcttgccaaacatacacccgcaccctcactctgccgcggatcgaattgtacgtacgaacgcggagcattggtcgtcgtcgccggcagcagcagctttcgtggaacaggacaaggataatctctccgtttacctgtctaccaaaccaatattcaatggacaaacacaccgctgctggtacagtggtacttctcttgtctacctgtaggaagtactaagactatcccagcaaacgtatatctcactatttcaagttctactatgtagacagtgcataatagtactttgaactaaggaaactacagcagtcgatatttagctatacgaacgaacgcatgggtagtgtggagttaaatttaaggtaaatttaagataaatctatcaatatttgtgtttcaaaactgacacgggcttaacggaatagtgtcacatttgtgtttgctagtgcataagattttagttcatttgatgcaaggatggcttacacaaaaggcaacatgaagatcgagcgatcaaacagctcaagaaaagactaagctcatttttcttggtcaacgggttgtgttcctcagtgttgttcatttcaatggaaaggggtcaagtcaagagctgcatttacaagaaagcatagcaagacaccagaattatcctctactcttaggaacataccagtccctcttcgtctgatcataagcaagcgaggaacagctgccattgcggtaatcccacgagagcaccttcttcatcaggcctcgcagcctttcggcaccaggtccaggctcgaaaacagagtcttcacccctagacaggcatggatcagctcctccttcagagctcccgtcacaccatgctccaggggtgaaccagccctccgagcggtgcaagagctcgcggtctatcttgtccaggaccttgtcgtccttgggaaacttacgcgcaaatggcgcgccgctcttgaccatcctgttgaagtccttcatggagaggatcaacggatgctgctttggagggtagtcccaggcgatgtaatgaaggtcgtggccaactgccgtgccccgaaaatcatcagaattgcatatgacagtttggaagtagccttctggtgaggagatgaagttgacatagtacatcagaaggttccgtgggagattatcccagccccatatacagtactcaaggaaggacttcgtaagcattatccaagcagaacctgccgatcaaaaataggaaggacatgattatagcacagatttagagtcaccaaacatagtgacattctatagtactaccaagatgcataaatcattccaccttacagaaatagctttttatttcttttctataccgctattaattcatttcaacatgtgctgaaacaaagaaacacacgagccctaggcacggtcaatcagaagatttaatcatttaaaaaaaaccagcaaaatatccaaacactacggctcggtccaaatatcttgaccacaaacctcctgacagacaattcaatgcagcagcgactattgtttttggctctcttttttagctagaaaatgccaagcctctgagcatatcgcaacaagagtttataactactgtagacataggaggacatgaggacactgtggggcataaaactgccataagaacagcaagagttcacagtgaaggaaaaaaactgactaggaactaaaaaactaaaaatttgcattcacaattattagttcaagacgaattaagaaattccagctctatcatggccaggcagcaatactctgctagcttaanaggtgactgggatctgttcccctaattttgtggtgcctggttgtaaagcagcaaggttgaaggttaagctattagataaagtattacgcaaaattgttagtaagtaattactacatgccaatattcgtgcaaactgccgcatcaatgtattgccattttgtggctataatagtttcaagagcctatgtgctgaatattgaattcagaatcaggcctaccagtatataatttgaaagatgttggcaattctctccgctcagtagtcatagtaagatcaaatttcttggacagatagagccctgggtccagaacaattggttttgcccttatattactgtgattgggggaaaagtgtcagaaagtaagggcacaaaagtagagatcattttgtacaaagttaacaaattgacagattagtaagggtacttacactttccatccagataaccgaaagtgctctataaaattaagatttcttggcaaagaagagaagacatgaagtatgtctgcacaaaaaacaagcatttgaccatacaactacagtaacttcaatagctatgtaataacatgttgctgctctgcg

SEQ ID NO: 12164 - DNA, 1480 bp, Zea mays
cggtcggtcccatcaaaatccatcctccgcggccgcggaagctcgctcgactcgacgccgcgacgcttcccacgttccagttttccacgacacgcccggggctcctcggtgccctttcccctcgccccctaccgacaccgaccccgacccatgggcggtggcgccgaccgctcggcgccggtgcgcgccgaggagtccgtctccggcggcgtcgacgtctggagcgacgccgtctcctcccacgcaccggaccacctcctcgtcatggtccacggcatcctcggcagtactgctgattggcaatatggagctaatgaatttgtaaagcaactccctgaccatgtaatcgtgcactgcagtgaaaaaaatgcatcaatgttgactctagatggagttgacgtcatgggggaacgcttagcaaatgaggtgcttgatgtaattagtcgaaggccagaaatcaccaaaatttctttccttgcacactccgttggaggattagcagcaagatatgcaattgcaagactttatagacatccagacagcgtgtctgatggaaatactaaaggaaccatctgtggcttggaaggaataaactttattactgtagcaacgcctcaccttggttcacgagggaacaagcaggttccactcctgtttggatctgttgcaatggaaaaggttgcttgccacatcgttcattggatatttaggagaaccggtagacatctctttctaactgacgatgatgaagggctgcctccactgctgcagcggatggttgaagatcatgacgatctctactttatatctgctttgcgagcattcagaaggagagtggtgtacgcaaacgcagactgtgatcacattgttggctggagaacatcatctattagaagaaacaatgagcttcctgagttgccagtatcgtcatctgacaagtacccccacattgtacatgaggagcattcagaagaaaccgatgatgataagtggcaagattgcatggcagaatgtgatatggacgttctggaagagaagatggtgacggggcttggaaaggtgtcgtgggagaaggtggacgtgagcttccacagcagcatgacgagcttcgcggcgcatagcatcattcaggtgaagtacgcgttcatgaacgagggagcggatgtgatacagcacatcatagaccacttccagctctagagaattttattcctcttccccggtgcggtggccaaaaaaaatgcatggaaccgcacgaggagagcatgcatacacggatgtagagccatggaggtgcagtgcagcagagtgtgtgcagaggctgctagctaaagcttgttgggcgggcgggctggctggctgacttgactggctggctgcgctgtgtaacagtgcgttgtctatgtttttgtttgtgctacgtacacaattaaagatgatgagaaaaaaaaaatcgttgatgccaaaaaaaaaaaaaaaa

SEQ ID NO: 12165 - DNA, 2221 bp, Zea mays
tccccctccccgccggccgggtttcgctcccctcccctgcgtccccgtccccgtccccgtcccgtctcctcccccgccgcggtgcggaatacgggctagattaatcagtcagcgctcatgatccggaggagcgaaggccgcaaccagcgccgcggggacaaagcctcacgtgctcgggacctcttctccacccagtagaggtctccttgcctttgccgcggttcttgctcgtggagtcgtggcccaggtttccaggttggtagcatgtgagagtgatggcggccgccgaagcgagggctgcctggcaacgtgctgccaaccgctgcctggtccaggaggatgccaagcgagctcccaagctggcatgctgcccaccgtccctgcgaccgcatgacacgagcgatggaaatcctccgagtccgcaagatctccatgcccctatgtttatgcccatcaactggaacctgatgaactccagtatgcccatggaaacccagtggtggctccagttgcagcccagctttgggtgccagacagcccttgctagggagcacctcaactatgtaggtggggacgccgctgagaagggaatggagggtctagcgccggtgtctaaacttgaggatgtccaagcaaagactgtggatccttttgagcctccgtggatcgtttcgacgactctcatgaagcaaacgcctgatacgggttcggaagagttgaagaatcttgcctcctataccccggcgagcctcaagtgcaagggaaatgccaacaagtgtatttacgaggataaagagtttacagagttcaaagcttttgatcctctgtttcctaacaagccacaaaaggaacactgcgaaatgcatgccccttgggaagaaaccaaaaaatctcagccatggtggcaagtagctgatgtcgatggtttggcttcccttgtcgctgaaagagcaatggaaaacattgtcaacaatgatctgccaagacccactcagacagtccgggttcatggacctcaagtgaagggccctgaaaacaaggatgattatgggatgtctgttgtttctgggggccaagagccagatcctgtacatgacactatggagtgcagctacagtgtttcaagcaccaccaatgacatgaattcttctgacgggggacgttggcagcaccacgaaagaaataatgtgtccggggatgcacggggttcttatagttccaccaacagtacaccgggcagcaagccaacatatcaggatgcttctgagagagccaagctgctagatgctctccggcactcgcaaacacgtgctagggaagccgagatagctgccaagaaagcgtatgacgagaaggaccatgtcatcaagctactgttccgtcaagcctcacacctcttcgcatgcaagcagtggttgaaaatgctgcagctggaaaacatatgccttcagctcaggttcaaagaacaccagatagcaaccatgttcccggaccttccatggatgttggtgaaggaaaaggtagcaccgtctcaagagcacaatgaaggggctaggaagaaaggcaaaaggccaaacaggaaaggtggcctctgcgatgccgttgcatttgctgttggtgttggtatcgttggtgctggattgcttcttggatggactcttgggtggctactgccctagctggaagttccatcgacttccatgaccgtaaaggtgacaggataaatgcctcctgtgcacactagattgaatggcaatacattgcatggcaataggtaagttccaagtgtgtgcttcatggagagagagatggggcagctttttggtattcttccatgatactctgttgatttggtgatgatagcttgatgccttatgttggttcatgcatatataggaaggatctggtgtacgtactgccagaaactggatacctaggttggtagtgtgggtgtggatgcgatggttgtctgtgtgctgtacataggggtcagtggtggtctggtggaaagatgaaatcagccgacttcaacaacacatgtgctagtactgtaaatctgtagcttttatttgcttaatgtagcccgaattgtcctaatccgcttgctgtaatgtgtggaacgtatttgcatgtcttgtttacttctggtggatatggacccagtatctatttatcattctgtggattcagtttctaaattcacatattctggcctcgcgat

SEQ ID NO: 12166 - DNA, 1561 bp, Zea mays
tgcgaccgcgtcacgtttcttcgtgtccaagcctcagcacatccaagcccctgagtgacgtgaacgcctcttcagtcttcaatcacagagggagacccgagcccagtcatcacaagcaagcaagcaagcgcgctcggctcggtttgcacgcgaccacgtccgtgcgcatccggctggaaatttttagttcgctggagctgcagaaccagcaaaacgtcggtttgatctctcgatggtcatgacgcttacgagagacgaagcggaggggagcaaggatatgcagggcgtccgggcgcacgccgaggagctgtccacgctgtcgtcggcggtggcggcaggcaccgacggcacgccgcggccgccgtcctcgggcgccgcagcccgcagggccatggcggccgagggcgtgttcgagtgcaagacgtgcagcaagcgcttcccgtcgttccaggcgctcggcgggcaccgcaccagccacacgcggctgcaggcgcggacgatgctcagcgaccaggcggcggccgcggcccgagagggacagggcgcgggcgcacgagtgcgccgtctgcggcctcgagttcgccatgggccaggcgctcggcggacacatgcgccgccacaggggcgaggcgccgccgccagccgcgcagccggcggaccgggacatgccggacctcaacctgccgccgttggacgacggtaacggcagcgccgatggccaaggtccacggcggtcggaagacgatcgcggctcttccgagcctcagctgctcaacctgctcgtatagcgtagcgtgcacaaacggatgcgtgcgtggtgattcggagttgtaaatgattggtgactgaagttttagaaccagaacatgcatgaaatggaattcttcgatggttagcttagtttagcttcatagtttgatcctggattcagtcagttttttttttcctttctagagctattgcctattggtcggttcaatccatttgttgtatgtaaaattgtcttgatggttcggtggaataaagttagaacacccagttcaactagtttctcatgagaactatactatagcatcatagtttcctactgttctccgtaagtctcttcagacaaagcgactaatgggcatgcataacctagccccatgatataatcatgagccccttaaatcattaatacggttaaaagacaatatgtatagaaaattcgtaaagacagagactctttactaagaacacgtctcttgagtttgtttcccacttaatctactagatccctctgaaaagacactggagttgtacataccataatgcattgaaatcccaggtggggtaccacgccccaacatattataaaataattgggtatttatctctaatttgggcgtcgtagctttgttaccaaaagaaaagaaaccggtataatataaacatataaaacgatcccacccaattaatattgtgaatgagcttaaagggtgtgtagctcgtaatttataaagctacgcaaactgctttcgtagttgtgattagattgcataactttgatgtaagaatatcg

SEQ ID NO: 12167 - DNA, 2433 bp, Zea mays
cctccgtcgttatccggaagagcaacggggaggaacgtcgttatccggaagagcaacggttctcctctttcccgtcccctccacgtctcgtctcctccctcgctgcggtgcgggatacgggctagattcagtcagcgctcatgatccggaggatcgagggcaacaaccagcgcggagcggcacaagcctcacgtgtccgggagctcttctccgcccagtaggcttccttgccttcgggcggtttccaggttggtagcatgtgagagtgatggcggccgccgaagcgagggctgcgtggcagcgcgccgccaaccgctgcatggtccaggaggacgccaagcgagctccccatctggtctgctgctcgccgcccctacaaccgcacgacacgagcgatggaaatcctctgagcccgcaagatctccatgtccctacatttgtgcccatcaactggaacctgatgaactccagcctgcccatggagacccagtggtggctccagttgcagcccaactttgggtgccaggcagccttagcgagggagcgcctcaactatgtaggtgcggaagccgctgagaagaaaacggagggtctagcgccagtacctaaacttgaggatatccaagcaaacaaggccgcagatccttttgagcctccatggaccatttccgcggctgtcatgaagcaaacatctggaacgggtttggaagagttgaagaatctcgcttgctataccccagtgagcctcgactgcaaaggtagtgccaacagatgtgtttccgaggataacaagtttacagatttcaaagctttcgatcctctcttccctaagccacaaaaggaatactgcgaaatgcatgtcccttggaaagaaaccagaaaatctcagccatggtggcaagtagctgatgccgatggtttggcttcccttgtcgctgaaagagcaatggaaaacattgtcgacaatgatctgccaaggcccactcagacagtccgggttcatggggctgaagtgaaggtccctgaaaacaaggatgattatgggctgtctgctctttctgcggacaaagagctggatcctgcacatgacactatggagtgcagctacagtgtttcaagcaccaccaacaacgacacgaattcttctgatggggggcattggcaacaacatcaaagaaataaagagcccggggaggcacatgattcttatagttccaccgccaatacaccgggcggcaagccagcatatcagaatgcttccgagagggccaagctgttagatgctctccgccactcacaaacacgtgctagggaagctgagatagctgccaagaaagcctacgacgagaaagatcatgtcatcaagctattgttccgtcaggcctcgcacctctttgcatgcaagcagtggttgaaaatgttgcagctggaaaacatatgccttcagctcaggttcagcgagcaccagatagcgaccatgttcccggagcttccatggatggtgacgaaagaaaaggtatcaccttctcaagagcacagtgacggggctagtaagaaaggcagaaggccgaacaggaaaggtggcctccgcaatgccattgcatttgctgttggtgttggtattgttggtgctggattgcttcttggctggactcttgggtggctactgccctaagtggaagtttcattgtcgtagatgacaggacaaatgccacctgtgcacgctgaattgaatggcactaggtaagctccaagtacgtgctttcgtggagagtgaaaaaggggcagatttttagagttcttccatggtagtctgttgatttggtgatgatagcttgatctcttatgttggttccgtatacataggaaggatctggtgtacatactgccagaaactggatctaccttatgttggatgcgatccttagctgtgtgctgtacatatgggccagtgagggtctggtggaagatgaaatcagccgacttcaacaacgtatgcgctagtactgtaaatctatagattttatttgctttaatgtagcaggaattgtgataatccgtttgctgtaatgtgtgctagacttactagtttaaaataagttagattatataatctagacagattataattccaaacaaacagacccttatatgcatatgcatagcttgttttagacagattataatcccaaacaaacagatccttatgtatctctttttcgatgttcatccacatgaggccttactttgttattcatgtctcactggattgaacaagattagaaagaattaggagagattttgacttgctgtagatttaaatccgctcaatcctctccaatcatatggattaaaattataacaaacagacttgagtgttggcatttcgaaatttcaatatactaaaaagagggaatgcaacaggggtaccga

SEQ ID NO: 12168 - DNA, 3608 bp, Zea mays
  misc_feature (89)..(89): n is a, c, g, or t
aaggctctctcctcgtagaatgcactggagctaggctcctcacgaagcacccactttcttctctcttgtgttctcatcctgtcacctangattttgatgacatataactgtttggagcccacctagtcagccttactatacttgctcttagttgtgtgaaccaaacacccgtggacctaagactacttgcatctctacccgttggcccctccctcccctgtcactttagtgtcgatggcggctacagtggcacgttagtgcccacaatagtgcatgcaacaactactatagtgcaagcgggttgagcagtggttcaccagatctggagtgctgcaaccgcccccaaacactatgctgctctcgggttttgtggccacaataattgttagtagagaaaaattataataaatgataaattggtataggaaatgatattttatggttgtagtgggtatagtagggctggaaatgagtcgagctcggctcggcttggtgcgactcgctagttgaccgagctcggctagcccactcaacgagctgcaaagggaggctcggcttggctcgcaagccgcaccctgataaataatattgcattatttaaggaattaatggtatgtaaatgtgaaatatagatcataatgcaatattgcaagtaatctaaattataaattatcatatattcatcgttaaaggctaagaaacgagttatatatctatacaattatccaatagtcatcattattgtgtaggttgattaatctggtgtggctcgcgagccagaacgagtcgattcagttcgttgaaccagcgagctcgaaaacctggctcggctcggctcgaggctcgcgagccgctccgagctaagccgtttcgagctcgagccggctcacgagccttgagcttttttccagcactgggtatatgggataatttagtggaaatcaagagatgaaaaataatgttggaattttaacgatgtggcataaagtaggatatagggggagaaatttaaggtaacagttgcagactgccccttggttgggaaaaaattgcctaccgccggctgtatgaaaacatctccgtaactgcctttagatcgacgacatgcgtccgcccacaaatctcaaagacatgtgtccacccacaaatctcaaatgactacaatatcgatactgtaaatagtaaaatatcatttatagttcctccagtggtgcaaggtgcaaaaagtaaacgagcaaagaatgcagttgaaaagaatatagggaagaaaaggaaaatttattttgataaaggttcttatcctccccatatcatttctttcaatcatagagcaagtattgttggtaatatttgtactccatacatggcacatgaaaaagttcaagaaacatagaccaaaatatagaacgtgatcaagatccaaaacaattgactgtaaggcatactaaactataccattgtccttttttatcaatactgttatctaaatattctctaaaaaggtttattgtttacacagacatcttttgatgaaagcactggtgctaatatgacattacatgatgttgtaaccaatgatatgtgtgcagattttccagccatggttactccattaatgctaggaggatatacaagccttttacttggagttgatcacgaagcatcagctgctcgaaaatttcattttgatgaagcacataatcacaccacataagcagaaggcactcttttataaacttcgatgtgattgggggcgtaatagtccatttgcattgttcagatgaaaagagaaattagaactggtcactacaatcactagtatagaagaacacacatgaacataccaacaaactctgatctgtgctagtatacatataacacatggttatctttcattctcttccagcttgaaaatctcatgagatgttttcttcattgtgtagaaatcttgaacacaatcatttgctgccaggactgatagtttcaataatttgttgccctagtcttgacaatagtgtgcatcaatgcatggcgctgttgtacatcataccgaaggtgtggtgcaacggcagccaaaacctccacagatttccaaaccctagcagcaaaaatgcaaaatgattaaatgaactaggcttgcaagtctataacccatcccaaatccaacaagtagagaaaatctataaaactcgaacgcaatgcttaaacaaagcaggttaagtctaactagaattcactccaccaaagaggagcaactagttccttcaagcaggtgtatgagttgtgcgcctcgctcctgggcaacgacgaattggaggcacaatgtatcatccgtccttccctgacatcaccatcgaccatcaagcccccagcaaactaaatccctctcgagcattgatcaaaaacctcacgcgcatggtccacaccggcaccgcttgagccgagcgcgcagaggagagaaaaaaaggagccgacgagccatccgtaagcaagccagggcaaaaggagcgattaaagatgagaaaagaaaggagccggaggagtccataagccgagccagttccgtttctttgagatatgtggggggacctgtgtcgtcgatacaaaggtagctgtagagatgttttcctacagccgatggtaggcaaattttttcccttggttggtagcagatagggctggaaacgagttgagctcggttcggcgcagctcggtggctgatcgagctcggcttgcccatttcacaagctggagagatagactcaactcagctcacgagccacactctgatatatataattgcattatatagtaaattattaatatataaatataaaatatatagatatcattaattaggagtaatctaaattatgaattgtcatgaaacgctaaagaacgattgtctataaaattattacacagctcgcgagacttctctagctcgctacagaaacaaggctcgcgagccggtcagcgcgagcatattttccagcccagcagaggacacgagtggaggtgcggtccaggagcgtgagccggcaccaatcatgccgcttgcattgctggtaccgacccgtccccaccagtccagtctataagagcgacgggatcacggaaacctgttcaccgctgcgccgcctcactattgactgtcggattccccactcgccggcgacaaccgccgcgcccgatccgtctgctaggtcttgcacctccgggctctggccatggctgccgaagctggcccaatctccaaggtcctcatcgtcgtagcgatgcagacggaggcgatgccgctcgtccacaagttcaagctcgtcgaggcgcccgcccacgaatccacatttcctaaaggtgccccatgggttaggtaccatggcaactacaaaggcctccacattgaccttgtattgcctggaaaggatgctgttttaggagtcgacagtgttggtacggtatcggcagctcttttgactagtttttccattcaaacattgaagccagaccttatcattaatgctggcactgctggtggcttcaaggccaaaggggcaagcattggagatgtattcctggcatcagatgtttcattccatgacaggagg

SEQ ID NO: 12169 - DNA, 2502 bp, Zea mays
  misc_feature (28)..(28): n is a, c, g, or t
catccaggctacagcgagcccggcgtcntagagcctagctaccaatcacgtctttagtctcggttgtatgaaccgtaattaaagatgagcatttagtatcagttcacaatacaacctgctacaaatagccgagggaacggatgaaagcgctcttccgagttgacgaccagaaaaacatcaaaacgcaaaaaacgctcttcctgaaatgagtcccgccggcatcagtgaaagtacaagtcctctttctagcttgttccgttgcttttgtcatagttgtcaacttttatgtgatatcaaaaactatattgatttgctaggatggttcaattgacggatgtaatcctattgatctctcggcacgttcgtcaaatatttctacccattgcatattcaagagtgttagagaaaatgctaattttagatcccctgagattctcaaagattgagtgagaaattagcttatttttctctaaatctctagaaatccgagaaaaattaagttttcaaacaagcctttaacaaaaatttttccgcgaacaccaactggtcacgttctccccactaattcggccggcaggatccccaaatttcttgccacgtacgtctgcatccccaccaaagttgcctataaatacccctctgggtgctcactcctgcaactcaccaaacaaacactcgagctaagctcagcctcacacagcctctcctctcgagctagctagagtgctactagcttagaagaagcagcagcttacagctgaagctgcagcaatggcgaaatcttacaccttactgttcgtcgcactggtcgttctggcccttctagtgagccccattgcttgctcccgcaagctcgccaagccgaacaagcccaagccgacccacaagccggcggccagggtcacgcccggcagcaaccacaccgatatccctgcagtgtccgccgcctacggctccggcggctggttgtctgccggcgcgacgtactacggcgccccaaacggcgacggcagtgacggttagtgcggtcgcttttactacttcactctggcggctggccgttagtgtgcaccttgcacttcacggcatatgttgttgtgccgctgcattgaccgagctccaaattgacatggttttggatgaaaacgcatgtgcaggcggtgcgtgcgggtaccagaccgccgtcgggcagcgccccttctcgtcgatgatcgcggccgggagcccgtccctgttcaagggaggcaagggctgcggcgcctgctacgaggtcagtcgcatttgcggcagagttcgcgcggtggtcacacaccgcacccctttagctagcaagtgtgcctccattaatggcgtagagagagtggtcggcggcactgggtaactgaatgtgtgcatgtgccgcgcgtaacgcaggttaaatgcgacagcaacccggcatgctccggccagccggccaccgtggtcatcaccgacgagtgccccggcggtgtctgcctcgcagaggcggctcacttcgacatgagcggcacctccatgggcgccatggcgaagcccggcatggccgacaggcttcgctccgccggcatcctcaagatccagtacaagagggtataatatgcgctatatacttactggaacgtcgttgagagctttgtccagtcaaacggcgcgtgaatctcggcggtaaactctgccgtctcgtctgtcgcagggtgccgtgcaagtacagcggcgtgaacatcgccttccgggtggaccagggatccaacccgttctacttggaggtgctcatcgagttcgaggacggcgacggcgacctcagcgccgtccagctcatggaggccgggtgcggcacgtggaccccgatggtgcacaactggggcgcgctctggcgctacaactccaacaccggcaaggcgctgaaggcgcccttctcgctccggctgacctccgactccggcagggtgctcgtcgccaacaacgtcatccccgccggctggaaccccggagccacgtaccgctccttggtgaactactcctgattgatgaactgcggcggcggcggttcggttctccgccccccattgcatgcgcttggctggattattatgcgtggccaagaagtgctttccagggtgcgtggtgttcaaagaacgagtctcgagtttgttttctgagaagaagaagaaaatgtctgttcgggtgtccgcgagaggcggtgtaagaagaggaggaggaggacaagaaggttaaggagccgtgcgttcttcactccctccacggtctctgcagtcacctagtgatgtgtgtagtggtcggtgtcggtttcttttttcgttgtgatggctcaggacaggagttgggcgttgtatcagtctctgtgtgtgtgcgcgtagttttctgtaccacgcaatcctttcagagaattgaattcctgctttcttgtttcaccactccaaataatctccaatgagtactgaaccagcaccagctattagcttc

SEQ ID NO: 12170 - DNA, 955 bp, Zea mays
  misc_feature (785)..(785): n is a, c, g, or t
  misc_feature (794)..(794): n is a, c, g, or t
  misc_feature (912)..(912): n is a, c, g, or t
  misc_feature (945)..(945): n is a, c, g, or t
gggtacctcgaggccgcccgcgccggggcccaacaacccctcggtctaagctcgcctctgcctcacagccgccttccgatcgagctaccagtgcgtagctcaaaactcaaaacgagaagcaagaactcagtagcaatatatggcgaagtcttgcaccttactgttcggcacagtactggtcgtgctcttgcttctagtgagccccattgcttgctcccgcaagctcgccaagccaacaaacaagcacaggccgagacacaagccggcggcagtcagagcccgcagcaaccacactgccaccccctcggtgtccgacgcctacggctccggcggctggttgtccgccggcgcgacgtactacggcgcacccgatggagacggcagtgacggcggcgcgtgcggctaccagaccgccgtcggacagcgtcccttctcgtcgatgatcgccgccggtagcccgtcgctgttcaaggagggcaagggatgcggcgcttgctacgaggttaaatgcgacagcaacgctgcatgctccggcaagccggcgaccgtggtcatcaccgacgagtgccccggtggcgtctgcctcgccgaggcggcccacttcgacatgagcggcacctccatgggcgccatggcgaagcccggcatggccgacaggcttcgcgcctctggtatcctaaaggttcagtacaagagggtcccgtgcaagtacagcggcgtgaacatcgccttccgggtggaccagggctccaacccgttctacttcgaggtgctgggcgagtccnagaagggcnacgggaacttagcgccggcaacttatggaggccgggtgcggacaaggaccccgaggtgcaaaattgggcccgctggggggtttaaattcaattcggaaagggttgaacgccccttttnttccggttaaatccaattcggaagggccttctncacagaagta

SEQ ID NO: 12171 - DNA, 4139 bp, Zea mays
  misc_feature (1643)..(1643): n is a, c, g, or t
cattgggtacctcgaggccggccgggcccaccaaacaaacactcgagcaaagctcagcctcacacagcctctcctctcgagctagagtgctactagcttagaagaagcagcagcttacagctgaagctgcagcaatggcgaaatcttacaccttactgttcgtcgcactggtcgttctggcccttctagtgagccccattgcttgctcccgcaagctcgccaagccgaacaagcccaagccgacccacaagccggcggccagggtcacgcccggcagcaaccacaccggtatccccgcagtgtccgccgcctacggctccggcggctggttgtctgccggcgcgacgtactacggcgccccaaacggcgacggcagtgacggcggtgcgtgcgggtaccagaccgccgtcgggcagcgccccttctcgtcgatgatcgccgccgggagcccgtccctgttcaagggaggcaagggctgcggcgcctgctacgaggttaaatgcgacagcaacccggcatgctccggccagccggccaccgtggtcatcaccgacgagtgccccggcggtgtctgcctcgcagaggcggctcacttcgacatgagcggcacctccatgggcgccatggcgaagcccggcatggccgacaggcttcgcgccgccggcatcctcaagatccagtacaagagggtgccgtgcaagtacagcggcgtgaacatcgccttccgggtggaccagggatccaacccgttctacttggaggtgctcatcgagttcgaggacggcgacggcgacctcagcgccgtccacctcatggaggccgggtgcggcacgtggaccccgatggtgcagaactggggcgcgctctggcgctacaactccaacaccggcaaggcgctgaaggcgcccttctcgctccggctgacctccgactccggcagggtgctcgttgccaacaacgtcatccccgccggctggaaccccggagccacgtaccgctccttggtgaactactcctgattgatgaactgcggcggcggttcggttctccgccccccattgcatgcgcttggctggattattatgcgtggccaagaagtgctttccagggtgcgtggtgtttaaagaacgagtctcgagtttgttttctgagaagaagaagaaaatgtatgttcgggtgtccgcgagaggcggtgtaagaagaggaggaggacaagaaggttaaggagccgtgcgttcttcactccctccacggtctctgcagtcacctagtgatgtgtgtagtggtcggtgtcggtttcttttttcgttgtgatggctcaggacaggagttgggcgttgtatcagtctgtgtgtgtgtgcgcgtagttttctgtaccacgcaatcctttcagagaattgagttcctgctttcttgtttcaaaaaaaaaaaaaaaaaaaaaaaaaaaaaaaaaaactgaaccagcaccagctattagctgcatactagctctactcttgggaaaactgaatcgttggagacaataaaacgtatagtctgccactgccatgtatgtactccgatcatttggtaatctggcccaccaagtttgcagacgcaatagactgactgcaccagttttcccctgaacttgctaactgaancaccatgtttcgttcacaaaaaacggcactgcaatctactactctgttctcgaatatctgatactcactagttaatttttaaactaaaacacaacaaataaaaaagaacggggagagagcataacctataaattaattaaccatgctcaagatccattctcagttgcaatactcacttgtcaccgcactgaccattttcggacgatggcacatgcgtttatcatagaccaataagcatacaaaaaacgcaggcgcctggtactacaaaggcgtattctactcaattattgcaggactggttttttctagagatgttatgctagtagagcttccgcccgtgttcgcctttagtcccttatgaactggaatactgatggatgaagctgaccaatcagtgtgccacaacaaggcgtggagctgataaacagaggcctatccacgtgccggtgcgggccggggacaacacacactcacacaccacacgagtagttgggttgtccagtttatgctcgtcagataattcaggtgggtgttctgtcctttatggctagtttgataactctatttttgcgatagattttcattttaccaaaggaaaaaagaagttgccaaactagcccttatattcctctgcattactggtttccgatggtaatctgctggtgctgacggattaaaagcacccgtttccttgtcttgctaacgagaactggcaatgtgcgtctcttgcggtcttgcctgttgcagaacagattggctacgcaaaattaagcactgtgagtcagtgtggcgaatcacgaatacgacccgtgtgggcgtgtcgatgtccacgcgggcgctgcctagtcactgtcgcgatctcccatccgccatgtgctgcgcaaatgcggattgacgagcacgaccaggagcctaatccctccaaaaaatggtacagagctgtagtgctgcaaaacccggatcccccggccggcctcctgacttcctgagtcactgagtaagtgagtagtagtgagtacgacgttcctcgcccatcctctcacctgctttccagaacgaacgaaagccctgttagtccacacaacttcacatcgctcattcgctccgcgcccctgcagtaattatattctctcggacgccggcccccgccgtgtcttccagaacccggcagttcaaactccaaagctacagctacagatctaccggtgccggtgccactgccactgcaccgccggtggcaggagagcggcccccgccggtcgcagccaaacgccggcgcggcgtgacatggaccgggacgaaaccccgccacttgtccgctagtttttactcgactcacatggggatggtgggggcaggggcaccggcgcaccgcaatggcaggggacgatgggggccagaggacataagccggaaaaggatcaaagtcgactgttgttacagttatgggtggtcccgcgtcgctcggtcgcgcaacacgtactagtgcctacgcctaccacacaggcagctcctccaaccgccggcgttggcccacgggcaccgctgccgggcggcagagcgatacaggataccggcgtgcgtgatcggccgggatcggcgcggtatacccgccggtaaattgattggcgcgcgccatcgacgtgcgcgtgcggacacgccgacgccgacactccaagagcacaagggggtagagaccgtagaaaatcgcccccggcatgtgagcctgctcggaagaacctctgccgctgtctgggatctgctgctgccaatctttgtcggcgtctggcgttacgcacattaggcgacgcaaatcgctccgacacgctgccgcagtttacaaattacaacacgttcgagaatttatttatttatccaacagccctcgcgcccgcggtggcgccagcaatattcagcgtgcagccgtcggtgtgaaacgtaacggtcgatgtggtggtactactctactgggctgggcaggtacatggatagactggactggatggcgccaagtgacatgttaagcaagttttgcccgccggaatagctaacgtacggcggggccggggactgggagtgtggcgcgtgcatgtgctggtcgctttcggcctcgcatccgccgggatctgccctcacatgcgcggcgagggaacggccggcttggcacggcggtcgcgccgagccgccatatgcatgctccccactccggccccagctacatcctcgggccacggctcgaccggttggtggtggccgcgcagctgctcgcctcggtcagtgacgtttacacaccaaccgaacggcttggctttttacaggtccgtcggtctccgtccgagacagagggcggggcgcagaacacgtgcatgcgctcatccgtggctgcgtccatcggctactggagttggagtaacgccgttgcgggaaattattagctcgtggcccgtgtctgtagcacatggcgatcccgacggcgaccaggtagcgtccccttcg

SEQ ID NO: 12172 - DNA, 1470 bp, Zea mays
tgggtccctcgtggccggccccgcggccccccgggcggcccaccaaacaaacactcgagctaagctcagcctcacacagcctctcgtctcgagctagagtgctacactgctactagcttagaagaagaagcagcttacagctgaagctgcagcaatggcgaaatcttacaccttactgttcgtcgcactggtcgttatggcccttctagtgagccccattgcttgctcccgcaagctcgccaagccgaacaagcccaagccgacccacaagccggcggccagggtcacgcccggcggcaaccacaccagtatccccgcagtgtccgccgcctacggctccggcggctggttgtctgccggcgcgacgtactacggcgccccaaacggcgacggcagtgacggcggtgcgtgcgggtaccagaccgccgtcgggcagcgccccttctcgtcgatgatcgccgccggcagcccgtctctgttcaagggaggcaagggctgcggcgcctgctacgaggttaaatgcgacagcaacccggcatgctccggccagccggccaccgtggtcatcaccgacgagtgccccggcggtgtctgcctcgcagaggcggctcacttcgacatgagcggcacctccatgggcgccatggcgaagcccggcatggccgacaggcttcgcgccgccggcatcctcaagatccagtacaagagggtgccgtgcaagtacagcggcgtgaacatcgccttccgggtggaccagggatccaacccgttctacttggaggtgctcatcgagttcgaggacggcgacggcgacctcagcgccgtccagctcatggaggccgggtgcggcacgtggaccccgatggtgcaccactggggcgcgctctggcgctacaactccaacaccggcaaggcgctgaaggcgcccttctcgctccggctgacctccgactccggcagggtgctcgtcgccaacaacgtcatccccgccggctggaaccccggagccacgtgccgctccttggtgaactactcctgattgatgaactgcggcggcggcggttcggttctccgccccccattgcatgcgcttggctggattattatgcgtggccaagaagtgctttccagggtgcgtggtgttcaaagaacgagtctcgagtttgttttctgagaagaagaagaaaatgtatgttcgggtgtccgcgagaggcggtgtaagaagaggaggaggacgagaaggttaaggagccgtgcgttcttcactccctccacggtctctgcagtcacctagtgatgtgtgtagtggtcggtgtcggtttcttttttcgttgtgatggctcaggacaggagttgggcgttgtatcagtctgtgtgtgtgcgcgcgcgcgcgtagttttctgtaccacgcaatcctttcagagaattgaaatcctgctttcttgtttcaggaaaaaaaaaaaaaaaaaa

SEQ ID NO: 12173 - DNA, 4858 bp, Zea mays
  misc_feature (3107)..(3107): n is a, c, g, or t
cggaattttagagaaacccaaacatccattccgtctacagacccatccgaattcagtgaggtactgggtggtactgcacgtggctatccccggaggccaggacactcatctgcccttccgctcccccgcccccgccgccgtcggcattcagccctcccttccttggcttgggccacgtcgccccttctcctccccacacatccatactgaagcctcaaaatcctccgcttcactcccatcccatgccctcctctcaaccctagtccctccccatcccttactcatggcgctctcttcccacgccaccacagctgctgcggcggcggccgtcggcacctttccccaatccactcgctcctcttcccggcgattccccgcgtcgtctgtctccccccgtcctccgccgcccccgcgctccctacgcctcgaccatgccgtggcgccgtccctctcccccgccaccatgcccgcgcccgacggtctcctcgctgcagccatcgaacacctggagcgcgagccagcatccgtcgcagccgacgaggctccgctcgcggcgctgtccccgcgggagctgcagctggtgctcgtctacttcgcgcaggaggggcgcgacacctactgcgcgctcgaggtctttgactggctccggcgcgccaaccgcgtcgacggggagaccatggagctcatggccgccatcgcctgcggctggatcgagcgcctcgtgggggccggcggggacgtcgccgacgttgctgcgctgctcggggagatggactgcgtcgggctacggcccgggttcagcctcgtggagaaggccgtcgcgctctactgggaccgcggggagaaggagctagctgtcgagtttgtcagagacgtgctcaggagagggggactcggagccggcgcgggaggggagcacagctctgccaatggcgatggtgagcggggagggcccgttggctacctcgcctggaagatgatggtaaagaggccccatttcacatttcctgcagttcttacccgttttaatttgatttttccattgttttgtctcaaccattaactttgtgcgattactggtcctgatttacttcttgctactgcaaaatgactactattgggtcgttttattaaaaagtgttcttgtgattctgatgtgctaatgttcaacttgatttctgcttgttgccctgtagttctgatttctaaacttgtcgtgtatgtgatggtaccttcgagtaagttgttgccagaccaccagctgtattgaggtgttagtatatgacaagctttgtctctcacggtctcaccctttataaattaaggcatgtgtatgtggcacttcaaagtttaaagtgatctttgtttgcagcagactactcatattggtggttgaaccctattaaatctttttaagatatcatgtgttcctaattgactctttcatggtagttgccagcacatgggtgctgctataatgtagtcagcacgtttcacatatgtaattgtttatttatatgtaacttagttttatatatctctattagctgtattaaaattaaaaaatcaacatgtgtatcatcctatcaagtataaacaatgaattaattatctagcaattatgcgcccatgcctcattcatttatcaattgtttactttgcccctatgtcatttggcaaaattctaaggattccttccattttattgctaaatgcttctagttggtctatatttgctataggccaagccctccctgtgtttatctatgacatcaagtgcactagttggtctatatttggtgtaccaaggactagggtatttgttccatttaacttgttcatgaccagataattctggggcaatgtttttgttagcagcctctcaacgctgtgcggtcccatggagaagaagcaaggatagagtgggatagagtcagagatatattagttcttagttcagaattacagaaatgttcatgtccatctccctctctctggttacacatatatctgataaggcctcttgggccaccacctactgccactcagggcccgaatagcgcatgttcggtttcatctggcgccggcctgacaacgatggtattcccgcgcttgccacccgttcctccatcgactgtgccgtaggagagctgacagttttgctaattgccaaatccttctccctgtttatctgtggcatgcagggaacacattggttgtcatatttggcatacccaatactagggtaattattaggttaaatttgtgcatgaatcatgatcaggtatttctagggtcaatcttgtcatagggtctgtactataagcacccttgaatggatataaaatttgggtagttattgtgggcttgcttttaatatcagagatcatttggcaaaagaattgcccaacttcagtttttcattgttctttgggtgtgaatatgcgccatatttcatggtagaggagaaagagttgtgccaaactatagccaaatactcagagcatatccttctgtacgaagcaccaataaatctgaaagaaatccatggtagttatccatgagtagaaaataagaaatgcagcagtcactcgtcccttcgtcttccgaaaggaagtctgtctgttctgcactttccaacagacttttctttgtgtttaacagtccttggttttactcaacttatagaaagaagacatggtattccaatgcttcattttgatattagagtatgaactgcaattagagtctgtacattggataacataaacagatgtcattagttatatgagaatcaaaatgttctatctaggcaattcatagtataacaatcataatatggattcatgatatccagattataccaatcaaacttcaggacatagatgatgcttaaggttataaaggatgatgtgtaatgccataatctaccatctgttctatctaaacacctattagatcaagtattcaatataatttatctgcttataaaagccatccaatattatcatatgacactttttttaaagaaaaatcaagttataattttttttttgtgttgctttttttcctgacagatggatggagactatcggaatgctgtcaanttggtcattgaatcccacgcgtccggtctcaaacctgaggtgtatagctatctcattggcttgactgccttggttaaagagcaaaaagaattctcaaaggctctgcgaagattaaatgcatcggtgaaggatggctcaatttctaaactggatgctgagagcatgcatagtatcaacaagtatcaatcggatttgttaagtgatggtgttcttttatcgaactgggtagtacaagagggcagcagcgaagttctaggacttgtgcgtgagaggctcctatcattgtatacttgtgctggttgtggcttggaagctgagcaccaactttgggaaatgaagcttcttggccgagaacctgatacacagctctatgatgttgtattggcaatttgtgcttctcaaggggaagctgctgctgttcgccgcttgcttgcaggagtcgagtcaaccagcgccggaagaaggaagaagtctatgtcatggctactgcgaggctatgtcaaaggtggcttcattctagacgcctcagaaacactcattcagatgctggacatgggcttgcttcctgattacctggatagagctgctgtactgactgcactgcggaggaacatacaggaatccggcagcctagagtcctacttgaagctttgcaagcgactatctgagacagatctgattggaccatgtattgtgtatctatatgtccgcaaattcaaattgtggatggcacacatgctttagagttctgatgaaccctttcgtcatatatccactcatggcaggtacaaaatggagatctctaaaaaatgtgtgtggctcaaacgcttgtccctgatgaacaagacatagaagcttcaatttcggtgaaccggttggtacataataatggttccttgtatatttttgaccgaagtagaggtatcaactggttgtttgttgtaaacagcgctgttgtagtactctgaacagagtccatatcgtacatgtaaattctctgtgtcactgttctcatatgcagttgctgttgaaatctgtgcgttactgcagcctgtaggggataggcaaaatggaaacttttgttgatataaatataatgtacagttctgtcgtgactgaacttctaaagttgtaccgagatgaacttctaaagttgtaccgagattacacgatacatctctgtttttctgtttgtggtgtggtttgtggcagtaactgaatgtaacttggtttgacgcatggacatatttacaaaatagctacttcgtatgtgctctctgtaccggacaatagagtgaacctattcttttgcaaaaatccgtcaaagcaagaatggacaacaaacttcagcagacgtagaaatgatctggaccttctttatggccagcctagatgaatttgttgtcacatcaagttttgtgtaaccattaaggatattctcaatgatagttttatcacacattttcaatgttgttacgtcaataagagagataaaatgaaaataaaatgtgttctctcaacgaagagtttcaagacaatttcacatgcacttttaaatgttgcatctaaataaccgatagaaataaattgctctcaatgtttgtttcatgctcttttcaatatcttggaaacgagttgacatagtttcatgtgacatattaattaatgttataaaatatctcataaaactcccattgagaatgacctaaccaactacccattgtgaaagtaattaaactcgctatttaatc

SEQ ID NO: 12174 - DNA, 1413 bp, Zea mays
aaaaagcatcctttcacctcaaagataaggaggccgtaacctgtcggggccctcccccaatctccagcgacgccgtccccccaactcgccacccatggccatgtcgttccacttccacccgctggccgcctcgcgcgtccacttctccccactcccgttcgccgccgctgccgcgggggtgccctccccctcctcctccgtcgccatcgcggcgcaccaccaccaccaccagcactgtcgccgccgcttctccgccatcgtggccacggcggccgccgcgtcggcggcgaccacggagttcgacttcaaggcgtacatgggggagcgcgcggtcgcggtgaaccgggccctggacgcggccgtccccgccggggagccccccgcggcgctgcacgacgcgatgcggtacgcgctgctggcgggcgggaagcgcgtgcgccccgcgctgtgcctggccgcgtgcgccgtggtgggcgggccggagccctgggccatgccggccgcggcggccgtcgagatggtgcacaccatgtcgctcgtccacgacgacctcccctgcatggacgacgacgacctccgccgcggcaagcccacctgccacgtcgtctacggcgagcccatcgccgtcctcgccggggacgcgctgctctcgctctccttccaccacatggccagcgtcgggtcctaccctccggacgtggacccggagaagcaccccgcccgcgtcgtccgagccattggggagctcgcgcgctgcatcggatccgagggactcgtcgccggccaggttgtcgatctcgagatgacgggcacatcagagacggtgcccctcgaacgcctcgagtacatccacctccacaagaccgccgcattgctcgaggcctcggtggtgattggggcgatcatcggaggcggcacggacgagcagatcgagaggctgcggaagtacgcgaggtcgatcgggctgctgttccaggtggtcgacgacatactcgatgtcaccaagtcgtcagaggagctcggcaagacggcggggaaggacctggcaagcgacaaaacgacgtacccgaagctgctggggctagaaaagtcgcgggagttcgcggaggagttgctctctgatgccgtagagcagcttgcttgcttcgacaaggagaaggcagcgcctctgttgcatctggccaactatatcgcccataggcagaactgagaatttgaggtgattgcgtactctattgtcggacctgttgtaactttgtcaggccgtcgcccgtcgaactggggttcgaggaatatatccaaatcgtcatgtgatgtatactagctgtagctctgtaccttgatggaatggggctgtttagttcgaattccaaaagtatgaaataccgtatccaattatgaacccaattatta

SEQ ID NO: 12175 - DNA, 870 bp, Zea mays
agagatgagaaaccggccataggcccaaccgtttagttatcaacattatcttccctgtttcattatttcgccgccgttcgcagtcgaaccgccgcgcggccgtcgtgttgaagaggcgaggcaaaggcaaggagagcggcaaggagaggaaaagacgccatggcgaccgcttcagtgactttcaagtcacgggaggatcaccggaagcagctcgagcttgaggaggcgcgcaaggcggggcttgcgcctgcggaggtcgatgaggatgggaacgagatcaatccccatatcccccagtacatgtcctcggccccatggtatcttaatgctgagaagccgagtttgaagcatcaacggaagtggaagtcagatccgaactacaccaagtcgtggtatgataggggtgcgaagcttttccaggccaacaagtacaggaaaggtgcctgcgagaactgtggagccatgactcatgacaagaagtcttgcatggagcggcctcgaaatgtgggagctaagtggacaaatgttaacatagcacctgatgagaaagttgaatcatttgaactggactatgatgggaagcgtgatcgctggaatggttatgacgcttcaacctacactcgtgttatcgctgactatgaagctagagaagaggccaggaaaaagtatctgaaagagcagcagctgaagaaacttgaggagaaggataccgagaaggatgatgagaatgcgggtagtgaagacgaagaagatgacctgaggatagatgaggccaaagttgatgagagtgcccagatggactttgctaaggtagagaagcgtgtgcgcacaacaggtggtggaagcactggtactgttaggaatttgcgt

SEQ ID NO: 12176 - DNA, 869 bp, Zea mays
aattaaaggacaggatgtagcccttcccaagagcaaatacgaagaggccggttccggcattccccgcccgagtgtgtggggttcaatggtggaaagatcatcaatggggctacaagtgctgcaagcagactatcaagaatagttactgcacaggcttggctggaatagaagctgccgaggcctcagcagatctaatgaaggccaatatggcccgcaaggaggctgcagaagatgaacctgtacagcatgaagagaagcgactagccacttggggaaccgacgtgcctcaggatcttgttcttaatgagaagaagctggaggaatctctaaagaaggagactgcaaggagaaaagaggagaaggatgaaagaaagaggaagtataacgtgaagtggaacgacgaggtgactgcagaagacatggaggcttaccgaatgaagaggattcaccatgacgatcctatgaaagattttctcaactgaaaagtgtggtagataactagatgttcatgccactgtatcacattggttgcaccgtgccttgcatcaatgttgtgttactgtggggtggctacgcctgtcctaaggatatggccagcagaccgtgcatgtggcagtgtgtgttgcacttaaattatgatatgggatgggtaaggctggagatagcttaaccagagtggtggtggtgctgtgatctagtggcagaatgtaagaaactggctacacattttacaagctgcgtgttggagatgtatggggctgtttgcgttggattaaagctagctatttggaccgctgaagttgtaagacaaaaatactgtaaaagcagtagaagccgatattaattaaagccagactgtttctgatccc

SEQ ID NO: 12177 - DNA, 2018 bp, Zea mays
ctcgaggccggccgggtttcgccgcctcgtttcgttatttgtttcgttatttcgccgcctcgttttgttatttcgccgccgttcgccgtcgtacagccgagccgccgccgagtcgagccggcaaagcgaagggaaggagagcggggtgaagaggagaggactccatggcgacagcctcagtgactttcaagtcacgggaggatcaccggaagcagctcgagctcgaggaggcgcgcaaggccgggctcgcgcctgcggaggttgacgaggatggaaacgagatcaatccccatattccccagtacatgtcctcggccccatggtatcttaatgctgagaagccgagtttgaagcatcaacggaagtggaagtcggatccgaactacaccaagtcgtggtatgatagaggcgcaaagcttttccaggccaacaagtacaggaaaggtgcttgcgaaaactgtggagccatgacacatgacaagaagtcttgcatggagcggcctcgaaatgtgggggctaaatggacaaatgtcaacatagctcctgatgagaaggttgaatcttttgagcttgactatgatggaaagcgcgatcgttggaatggttatgacccatcaacctacactcgagttatcgctgattatgaagctagagaagaagctaggaaaaagtatctgaaagaacagcagctcaagaaacttgaggagaaggatactgagaaggatgatgagaacgctggtagtgaagatgatgaagaagatggcctgaggatagatgaggccaaagttgatgagagtgcccagatggacttcgctaaggtagagaagcgtgtgcgcacaaccggtggtggaagcactggtactgttaggaacttgcgtatcagagaagacacggcaaaatatcttttgaatcttgatgttaactctgcatattatgatccaaaaactcgctccatgagggaagaccccttgccagatgcggatccaaatgataagttctatgtgggtgacaaccaaaatcgtcttagtggtcaagctctggagttcaagcaactcaacatccatgcatgggaagcttttgaaaaggggcaggatatccatatgcaagcagccccatctcaagcagaactgctgtacaagagtttcaagatcaagaaagaaatgttgaagtctgaacataaggataaaattattgagaagtatgggaatgctgcgtcagaagatacaattcctcgggagctgcttcttgggcaaagtgagagagagattgagtatgaccgtaccggtcgaataattaaaggacaggatgtagctcttcccaagagcaaatacgaagaggatgtattcattaataaccacacgagtgtgtggggttcatggtggaaagatcatcaatggggctacaagtgctgcaagcagactatcaagaatagttactgcacaggcttggctggaatagaagctgccgaggcctcagcagatctaatgaaggccaatatggcccgcaaggaggctgcagaagatgaacctgtacagcatgaagagaagcgactagccacttggggaaccgacgtgcctcaggatcttgttcttaatgagaagaagctggaggaatctctaaagaaggagactgcgaggagaaaagaggagaaggatgaaaggaagaggaagtataacgtgaagtttaacgatgaggttactgcagaagacatggaggcctaccgcatgaagaggattcaccatgacgatcctatgaaagattttctcaactaaaagtgtggtaaatgtccgcactgccgtataacgttggtggcaccctgccttgcagtgaagctgtgtaattgaaatgtaagatagactgtgcctgacacgggagccttcttcaactcttcaggtgtatgtaatcagaaacatgtggacatggataatctgtttgacatatatataatatacttaatgtatgcttctaaaaaaaaaaaaaaaaaaaggaaaaaagtactctgcgttgttaccactgct

SEQ ID NO: 12178 - DNA, 1232 bp, Zea mays
  misc_feature (1206)..(1207): n is a, c, g, or t
  misc_feature (1212)..(1213): n is a, c, g, or t
gcacgagaccattacctagaacatcctaatcgaaaaagggtgccgtgcgagtacaagcacaggaacctgtcggtgagggtgcaggagaagaggcgctccccggggggccctggcgacctcgccatcaggtttctctaccagggcggccagaccgacatcgtcgccgtcgacgtcgcgcaggtgggctcgtccaactggaagtccatgacgcgccacagcggcgggccggcgtggagcacgaggcaggcgccggcggggccgctccagctcagggtggtggtgacgggcggctacgacggcaagtgggtgtgggcggagcgcgaggtgctgccgcggcggcggcgcgccggcgaggtctacgacacgggcgtccagatcaccgacgtcgccccaacccgcagggctccttccactacggcgccatcccgacttccaggacgctggtgctggccagctccgcttccctcgacggcgccggccgtaggcgctgcgcctgtcaacgcagtgtccttcgtcgtgcccgacacgccgctcaagctcgccgacagatacgacatcgccggcgtcatcgactgggacggcctccccgcgcggctcgacggcgccgcggcggtgccgcgcgccgggacgcccgtgctcaggctcggcctgcacgagttcgtggaggtggtgttccagaacacggaggaggagctgcagtcgtggcacctcgatggatacgacttctgggttgtagggtacggcgatggccagtggaatgagacgcagcggcagacgtacaacttggtggacgcgcaggcaagacacaccgttcaggtgtaccccaacgggtggtcggcgatcctggtgtcgctggacaaccaggggatgtggaacctgcggtcggcgatgtgggaccggcagtacctcgggcagcagctctacctcagggtgtggacgccggagcagagcctctccaacgagtacgccatccccgccaacgccatcctctgcgggaaggccgccgccctcccacactgacacgacgacgttcagcagccatactactgcctgctccattcgaccaaccaagtgaaagaagaagaggagaatctatttttgttgctgcaagaattaatgtgaaaaaaaacacaattactgccactggtatacgtatctcctaactcctaattgtccagcaacagttacagcgtttttttatgcaannctgcnngacaaaaaaaaaaaaaaaa

SEQ ID NO: 12179 - DNA, 2055 bp, Zea mays
acctcctgtgctgtgcattcatcaaagctccgaacgaatgcgcgtttctctttccgcatgcatttgattaatctgcaacacatactagtccagctataaaggctgcctcgcctcgtcttccccacaacactccactgcctgctggctggctgctgcttccttccagatctaggggatcaagcaagcagccttccccgcgccgccagcaatggcggcacccccgcccgcgccgttcctcctcctgctgctcgccgtggcagcagcgtcgttcgccggcgccgacgacccctaccgctacttcacctggaccgtcacctacgggccaatcagcccgctcggcaccacgcagcagggcatcctgatcaacggccagttcccgggcccgcgcatcgactgcgtgacgaacgacaacctggtggtgaacgtcgtcaacagcctggacgagccgttcctgctcacctggaacggcgtcaagcagcgcaagaactcgtggcaggacggggtagcgggcaccaactgcggcatcccgccgggcgccaactacacgtaccgcttccaggccaaggaccagatcggaaccttcttctacttcccgtccctggccctgcaccgcgccgcgggcggctacggcgcgctcaacgtgtaccagcggcccgccatcccggtgccctacccgccgccggccggggacttcacgctgctcgtcggcgactggtacgccgccgcgtccccgcacgcggacctccggcgcgcgctggacgacggcggcggcggagcgctcccgccgcccgccgcgctgctcatcaacggcgccgccgcgtccggggccgcgccgttcgtcggcgcccaaggcgggacgtacctgttccgggtgtccaacatcgggctccgcgcctccgtcaacgtccgggtgcagggccacgcgctgcggctggtggaggtggagggcacccacccggtgcagagcgcctacgactcgctcgacgtccacgcgggccagtcgctggcgttcctcgtcacgctggaccagccgccgctggactacgccgtggtggcgtccacgcgcttcgccgccgccgagctcacggccgtcgccacgctgcattacgcgggggccacggcccgcgcgcccggcccgctgccgccggccccgccgcccggctacggctggtcgctgggccaggcgcgctcgttccggtggaacctcacggccagcgcggcgcgccccaacccgcagggctccttccactacggcgccatcccgacgtccaggacgctggtgctggccagctccgcttccctcgacggcgccgggcgtaggcgctgcgccgtcaacgccgtgtccttcgtcgtgcccgacacgccgctcaagctcgccgacagatacgacatcgccggcgtcatcgactgggacggcctccccgccccggctcgacggcgccgccggcgcggcggcggtgctgcgcgccgggacgcccgtgctcaggctcggcctgcacgagttcgtggaggtggtgttccagaacacggaggaggagctgcagtcgtggcacctcgacggatacgacttctgggttgtagggtacggcgatggccagtggaatgagacgcagcggcagacgtacaatttggtggacgcgcaggcaagacacaccgttcaggtgtaccccaacgggtggtcggcgatcctggtgtcgctggacaaccaggggatgtggaacctgcggtcggcgatgtgggaccggcagtacctcgggcagcagctctacctcagggtgtggacgccggagcagagcctctccaacgagtacgccatccccgccaacgccatcctctgcgggaaggccgccgccctcccacactgacacgacgacgttcagcagccatactactgcctgctccattcgaccaaccaagtgaaagaagaagaggagaatctatttttgttgctgcaagaattaatgtgaaaaaaaacacaattactgccactggtaaaagtatctcctaactcctaattgtccagcaaaaaaaaaaaaaaaaaaaaaaaaagcggcc

SEQ ID NO: 12180 - DNA, 1363 bp, Zea mays
  misc_feature (1304)..(1304): n is a, c, g, or t
ttgagctactccgcctcacactataaagcccatagcggaattcatgatcggcccatttacctaccactaaacccggagcccttccgttaaaactcactttctccgttgccgccacgcgctcactccgccactcccactcccccctccgccgctccacttctcctccgtcgcgaaaaccctagaaactaccgaccccctcggcccgccgtcatgtcgtccccgccgccggctgtcgcgtcgcctgcctctgagcaagccaaatcgaagaagaagaagcataaatcgaagaacgacaccgttgccgctgacccgccgtcgcttgctgaggccgaggagaaaactgatggctacctcatcaagccgcagtcccttgtaccttccctcgacacctccacctggccgctcctcctcaagaactacgaccgcctcaacgtccgcaccggccactacaccccgctaccctccggccactcgccgctcaagcgccccctcgccgagcatctccgttacggcgtcatcaacctcgacaagccgtcgaacccgtcctcccacgaggtggtcgcctggatcaagcgcatcctccgcgccgagaagaccggtcacagcggcacgctcgaccccaaggtcacaggcaatctcatcgtctgcatcgaccgcgccacgcgcctcgtcaagtcgcagcagggcgccggcaaggagtacgtctgcgtcgcccgcttccacgccgccgtgccggacaccgcgcgagtggcccgagcgctagaggcgctcactggcgccgtgttccagcgcccaccgcttatctctgcagtcaagcgccagctcagggtgcgaacaatctacgagagcaagctcctggagcacgatcccgagcgtcaccttgccgtgttctggatctcctgcgaggcaggtacctacgtccggactctctgtgtgcaccttgggctgctccttggtgttggtgcgcatatgcaggaactgcgccgtgtcaggtcggggatcctaggggagcaggacaacatggtcaccatgcacgatgtgatggacgcgatgtggtctctcgacaactacaaggatgagtcatacttgaggcgtgtcgtgatgccactagaggtactgcttactagctacaagaggcttgttgtgaaggactccgctgtaaatgctatctgctatggtgctaagcttatgattcctgggttgctccgatttgagaatgatattgagaccggggaggaagtggttctcatgacgacgaaaggggaggctatcgcgattggtatagctgaaatgactactgctgngatggcgacctgtgaccatggtgcagtttcaaagatcaagagggtagtgatggacagag

SEQ ID NO: 12181 - DNA, 2720 bp, Zea mays
  misc_feature (2644)..(2644): n is a, c, g, or t
tgcctttacgtaggggagccgcaaatgtcaaccttccttttctaacactaagatatagcttgtgctaaagctaagaaagtaaaacaaaaaaaatgaccacgacgatgggtgaggacgcgaggaagagcgagaggggagaacgcagggtggaagaagagatgagggatgatagatgattcaaataatattgttcattggatttgaacaagtgagaggagaggaattattcagcaatttgaacagtaagtttgatggtgtgtgtaagtctgatgcaatgacggatatgtcgaaggttatgggtgtggaagtaatttggttggatgagttttgcaaaaaaataatctgatgaattatatagtggtatagatacagatgtatgttcacgtaagcagggatgtcaaaaatccatgtggggtgttcctcgtggggatcccacccattttggggtggcacgaggatgcctctccccccacagggctaacggagcgccctccgaatattaacaagacggacttccgatccaaattttttcttttttttgtgagaaacttcccatttttaattgactttggtggcaaaataggaccacgttttcaacccaatctaaggtcgttgggccaaatcagtttcgttccttttccctttctaataacatctgttccggcctggtccatactacaagcccatcagccccgagccacgatcagaccattcgtcactcactaaacccttttgccctaaaccctaaacaagaagctacccgccttccccaccccaacccccaatccccccgccctgccgccatgtcgtccacgccgccggccgtcgcgtcccccgcctccgagcaaacaaaatccaagaagaagaagcacaagtccaaggatctccccgccactgacccgccatcgctcgccgaggctgaggagaagactgatggctacctaatcaagccccagtccctggtgccgtccctggacacctcgacctggccgctcctcctcaagaactacgaccgcctcaacgtccggactggacactacaccccgctcccctccggccactcgccgctgaagcgccccctcgccgagcatctccgctacggcgtcatcaacctcgacaagccgtcgaacccgtcctcccacgaggtggtcgcctggatcaagcgtatcctccgagccgagaagaccggccacagcggcacgctcgaccccaaggtcaccggcaacctcatcgtctgcgtcgaccgcgccacgcgcctggtcaagtcgcagcaaggcgccggcaaggagtacgtgtgcgtcgctcgcttccacgccgccgtgccggacaccgcgcgcgtggcccgcgcgctagaggcgctgacgggcgccgtgttccagcgcccgccgctcatctccgcggtgaagcggcagctcagggtgcggaccatctacgagagcaagctcctggagcacgaccctgagcgccacctcgcggtgttctggatctcctgcgaggcaggcacttatgtccggactctgtgtgtgcaccttgggctgctccttggcgtcggcgcgcatatgcaggagctgcgccgtgtccggtcggggatcctcggggagcaggacaatatggtgaccatgcacgacgtgatggacgccatgtggtcgctcgacaactacaaggacgagtcctacttgaggcgcgtcgtcatgccgctggaggtgctgcttacaagctacaagaggcttgtcgtgaaggattctgccgtcaatgctatctgctatggcgctaagcttatgatccctggcttgctccggtttgagaacgatatcgagaccggggaggaggttgtcctgatgacaacgaagggggaggcgattgccattggtattgctgagatgaccactgctgttatggcaacctgcgaccatggcgcggtcgcaaagatcaagagggtcgtgatggacagggacacgtacccgaggaagtgggggcttggtccagtggcactcaagaagaagaagatggtcgccgagggcctccttgataagcatgggaagccaaacgagaagaccccagctgagtggctccgcaatgtggtgcttcccactggcggcgatgtatcgatcgctagcatcgcagctgctcctgagccagagaaggtgaaggtggaacaggatgcagttgccggtgaaaaggtcaaggagaagaagaagaagaggcagaaggatgaaaacaatggcgacgatgcttccgttccggcgaagaagatcaaggtcgaggaagatgccgaggtagtggaagtggaaggggacaagagcgagaagaagaagaagaagaagaaagaaaaggtagaatcagaatcagctgatgccgccgaagcgaaggaggtggagaaggctgatgatgcagctggcgagacgggcagcgaaaagaagaagaaaaagaagagcaaggaaggaagcgccgcggcggcggatgcagagagtgctgagcatgtagacggggcgggggtggagaagagcaagaagaaaagggagaagaaaaaggagagtgtggagacagagcaggcatagtaattagaacttacaatggacggggttgtctaatctgttttgggttgcaggggtaaggggcggtatttccaattttccggctgtantttttgtttctgtgagtacgagacaatgcgatgagttttggcctcttgcaacaaaaaaaaaaaaaaaaaagcggcc

SEQ ID NO: 12182 - DNA, 845 bp, Zea mays
gcacgagaccattacctagaacatcctaaaaaaaaaaaacgcccgttaaaagatccaaactttgtgccgccgcctcctgtttgcacagaggggaagagagagagagagagacggaaagggggagatgagccggagcctggggatcccggtgaagttgctccatgaggcagcgggtcacgtggtgacggtggagctcaagaccggcgaagtgtaccgggggtccatggtcgagtgcgaggataactggaattgccagctcgagaacattaccttcaccgccaaggatgggaaggtttcgcagctggagcacgtcttcatcagaggaagcagagtgagatttatgattatacctgatatgctcaagaacgctcccatgttcaagcgcttggaagcgagaattaggggcaaaggatcagctattggagttgggcgtggacgtgcagttgcaatgcgtgctcgggctgcttctggtcgtggtggtggtcctgttgggcgaggcagcgcgcctcctgtgaggaggtagattttatggtgtcatggggcttttcttgtctggctgaggatgttgcagtctgatgttaggacgctgtcttggtagtcaaaactgccgtaatgtataattcaacggcttaaggagtatgagtgtgcaacctcttattgttgaatgtaatgtgttgacggtggttgttttccttgctctattcggatggctggaccaaaaaatatcatgtgttctcgtcggcaaattagcttttgtcttagtcctgcagtttttttttaaagaaaatggttgagatgtcccatactcatgatacatgtacctgagcctgagtatttcttctcct

SEQ ID NO: 12183 - DNA, 907 bp, Zea mays
attgaagacgcgtcgcatcggtttattcgtctcgggctctcggcgatttgcctcatcgccaagcgattcgatgaggtcgttttcgcggcgacttggaccaggctcccctcctctcaaatttgggctggtatcctcacaaacggcccgttaaggcctgcctcgctccccccccccccgttcgcccttggtccgcctcgcttcttctcgtgccgcctccccctgtttccacgagctggggttttagcggcgaaaagagggaaaagaaagccagcgagagagacggaaaggggaagatgagccggagcctggggatcccggtgaagttgctccatgaggcagcgggtcacgtggtgacggtggagctcaagaccggcgaagtgtaccgggggtcattggtcgagtgcgaggataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttggaagcgaggattaggggcaaaggatcagctattggagttggtcgtggacgtgctgttgcaatgcgtgctcgggctgctgctggtcgtggtggtggtcctgttggacgaggtagcgcgcctcctgtgaggaggtagattctaaatggcggcttttctcgtctggctgaggttgttgtctgatctcaggacgctgtctcgtagtaaaaactgtcctaatgtaaaattcaacggcttaaaggagtatgcaacctgtgattgaatgtaatgtattgactgtatttggtagcttgcatacagtcttttccttgctctaaaaaaaaaaaaaaaaacacccgcgcccccgggagctc

SEQ ID NO: 12184 - DNA, 2386 bp, Zea mays
ctagttgggtccctcggcccgccgcagcacacccaaacccagcagctgattcgcccggccgcatcgcccgagccttctaacagctgactcgtcctcgtcgctccggcgcggcgacaaggcacgcagccaccgcgcgatggccgacggcgccagcagcagcggcggggcgcagaacgggggtgagtcggtggtgattgactacggccggcgccgcactacctgcggctactgccgatcctccgggcccacgagcatctcccacggtatgtgggctaacagtctgaaagctgatgactatcaagctcttcttgatcgtggttggaggagatctggttgttttctttacaaacctgagatggaacggacatgctgcccctcatatacgatacgcttgaaggcaaatgatttcatttgttccaaagagcaagctcgggtacttaaaaagatacaaaggttccttgatggcgagctcgatccacagattggaagccctcagtgtaaggcaagtccaacaaagcgctcactgggtgaacctctgaattcaccaacctcgaaagtatcaaaggtatcagcggaagagtttcaaaaaggcacaagtccaaatatattgaaagaagatgacatcatttgttgcctggcaaacaaaatcaatgaggccacagctacatgcttccgaggtggggtatttggttctgttcaactccccaagaccattacctagaacatcctaatcgaaaacaaaaggaaagttggagaagcagtgcaagaaaagaaagtaggagaagcagtgcaagctttggtttatacgtgtaatataagtttccaaatagtggcagcagttagacgggcattgcctaaagaaaatggtgctactcaaactgaagtaccagcagatctttctccaaattctgttgcagaaaagctatccgtggcaatggaacgtcttggagaactagctggttttgaagtaaaagcttgtaatgggcatctaaatttctatttggcctccaatcaggcaatgcagaaccataccagcgttgttgtacctgtgcaagcttcagacaaatctagtggttcaaagccaagctctgtgaaccaaactaatgcaaaatatcctctgaaaaggaaaaacctggagattaggttgagcacatctcattttgatcctgaggagtttgctctgtaccgaaggtatcagacaaaggtgcataaggagaaggcagttacagaaagctcatacaagagatttctagtagatacaccaatcctgtttgtccccccaaagactggtgataatacagttccaccgtgtgggtttgggtcttttcatcagcagtacaggattgatggaaaacttgtggctgttggtgtagttgatatccttcctaaatgtttgtcaagcaagtacttgttctgggatcctgaccttcctttcttatctcttggaaagtatactgctctgaaggagatagattgggtcaagacgacacaggagcactgtcccagccttcagtactactatctcggttattatatacattcttgcaataagatgagatacaaagctgcatatcgaccatcagaacttctatgtccactccgttatgagtgggttcgctatgatttagccaagcctctactggatgccagtcaatactccgttctatctgattatgctacaatgcaaggtgaagtgccccagcctcagatttgtggtccctctgatgactcttcagcaaaagttgaccaccatgagtctcccagcgatgaggatgaggacgacgacgatgaagatttcgacaactatgaatcagatatgatggtcgatgaagagacaattcattcagaaaaacccgatacagctgaaggcagttccgagataaatgacataaacaacatcaccctggacctgaaaggctcgagggttaaatttaagggccttcagcaagtttttgggccaatcgagaggcgacacctcaatgcgctagaaaggcaactgagcagatacgtcaaggttgttgggaaggagctgtctgatcgaatggtgtattgtctttcttgatatgcagccggtcccgagatctcaattctactgtgaaaggtgcacatgagagttaaactagtttcattcagaaagaaaggtcatattgctgcgtgtttctgcatggttttcgttgtaaaggtacgagagctgaggctgacatagaacattctccggtcgattttgtatgtgtattttggcactaaagtcttcatggatggcttatactgaagagaagtggcgattcggtacgcctaattgtgcttatagggcaattgaaccggcacagtaataaagttgcagcgaatgggcttctgtcgaaaaaaaaaaaaaaaacccgcggcc

SEQ ID NO: 12185 - DNA, 1627 bp, Zea mays
cgccgtccggctctcgcccccgtctctgcaggcgccgaaggccgcccggggatcttttccctgttgtcgcccccgggggggaaggggggaggcccgtcccgcccgtctcactcgggcaaccccaggctgttccccgcttccggggctgtacaaacggcgggccgggagatctaatagggctccgtgttgggcgaattgggttccgggccccccctcgagtcaacttcgtaggccccccccccccccaaaccttgtaaaagcattaacaaacttatggaatactctggatactcatatggaagagcgtcaaccttatgggcaaattaaggtactcgcaatgacttcagtaaacggtatgctaggtcctggaagcctcacacttgagacaattcaacaggtaaaagaccagagattaaacttcaaagcagaatgaattatgtcagacaagtaactgtcttgaagctgataggttattagtttcaccatgttgaataaaataggttgaaactgaagttcagcggctgaatcagttgaaggcaagcaaaatggaagagctattcgtaaagaagagagcagaagtcgacgaaatttgcaagaaatcacacatgggcatgccttatcaaacagaaatggacaagataatgaatctgataatgtcaggagatgtggtccatgatgatttattaaagacaatggatgaatatatatacagagcaaaagaggaggccacaagccggaaagacataatggataaggttgacaaatggatggcttcatgggatgaagaacgatggctagaagaatacagcagggtgcactagctgcctgatgaccatagccatggacattgccttctctagaactttaatttttactatgttgattataattttccacaggatgaccgaaggtactcagtaagcagaggagcgcacaagcacttgaaaagggcagagcgtgctcgaattatagttaacaaaattccaggcttggtagaacagttaatggtcaagacacaattctgggaacaggagagaaacaagatcttctactatgatgagctcccgcttctggcaatgctgaaagactacatgttcacgctcaaagaaaaagaagaagagaaatacaggcaacgggagaataaaaagatacagactctacttgtaaagaggcatgagaattcaataatgttaaggcccaacacaagcttcagccgtccatcaagcagaggcttcaatacgagtcctggctccacatccatctggagcagccaagtttctgcaaaagttcagctgcctgactcagagaactccccagctgaaaaagatatgcgtgcaaaaataattaggaacagaggtatgcagggcattttgggaaataacagaagctgttcaatctctcatgaagataaagcagaagtctccacagtgaagcaagacatttcaccaatttaattttttctcactttaaatttctacagaaatttgtctgcctgacgtgaagttgcaacagcccccttaatctattagataagtgaagaaaaatatgtttgtatgcagcttacaccatattcatatatttatttatgtatgattcattaaaatgtcaaaaaaaaaaaaaaaaaaag

SEQ ID NO: 12186 - DNA, 2240 bp, Zea mays
cattgggtaccccggccgcggttgtgtggcctggcttccgttccgcccgccgaggccagtgtggcaggcagctcccgcgcgagcgcgagcgcgatccagaggctggcgcacctgcgtcactcgctccacgctgccgcgatctcctctgacgtcgaagtcgcccgggggatgacacagggggaaggggtggtgtgggaggggtgaacaggagctcggtgacttttgtgagggccgccagatggaggagcgccggctcgacacgccggcgatgaggagaatcagcgagtggattctttcactagagttcccaagcgatattaccatccaggttggggaggcgaccttcaacttgcacaagctcccgttggcatcgaggtgcggctacataagggagcaggtgtcggggatcaatggctccagggtcacccacatcgacatcacgggcttgccgggcggcgccgcggcgttcgagctcgtcaccaaattctgctacggcgagaacttcgagctcacggaggacaacgtcgccatgctgcggtgcgccgccgagcacctggagatgaccgacgacgacagcaggggcgggaacctggccggcaggaccgaggcctacctggaggccgtggcgctgatgagcctcgcgggcgcggtcaccgtgctccggaggtcggaggacctcctcccggtgtccgaggaggtggacctcgtcggcaggtgcgtcgacgccatcgcctacttcacctgcaacgacagtcagttcagcatgtccaacggtaacggcatggacgtgtcgtcgtccaaggtcatcatcgatgattggttggctgacgagctcacgtcgctgcggattgacacgttccagagagtcgtaattgccatgaaggctagggggttcaagggcattgctctgggcacgctcatcatgctctatgcgcagaagtcgctgcgaacgctggacacacacggaagggagaagcaaaagatggagccgaggcaggaacacgagaagcgtgtggtgcttgagaccatcgtgactctgctgcccaaggagaggaactccatgtccgtgagcttcctctcgatgctgcttcgagcagcgctgtgcctggacacgaccctggcgtgccggctcgacctcgagaagcggatggccgcgcagctcgggcaggccgtgctcgacgacctcctgatcccgtccttcttgcccgacgccggcaacacgttcgacgtcgacgcggtccagaggatcctggtcgggtacctggagcacgaggccgaggcggaccggctggactacaacaccgacgacgacttcacctcgacggcgtcgccgcccaacgacgtcggaatggtcggcaagctcatggagtcctacctggctgagatcgcctcggacgtggacctgcccgttgacaagttcaccggcctcgccgagatgatcccggaacgcgccaggttcaacgacgacggcatgtaccgttccatcgacatctacttgaaggcgcatccgtatctgagcgaggccgagcggaaggcggtgtgccgggtgatggactgccagaagctgtcgcgcgaggcgtgcgcgcacgcggcgcataacaatcggctgccagtgcagacagtggtgcaggttctccaccacgagcagcggcgcctgcgcgaggcccctacgtcgtcgttctacggcggcgagtccccgaccccggcgccgagcctccagggccggcacggccggagcgtgccggacgagatgtcacagctgcagcgggagaacgaggagctcaagatggagctgctgcggctgaagatgaacctgagggacccgtcggcgcccccgcagcccagcgacgctccaccatcggggcgccgcccgctgccgaagaaggcggcaggcggcagcggggggttcattaacaacgtgtccaagaagctcgggcggctgaacccgttcctgcggcctgacgccgtgggtggcgccaaagtgcgcaccaagccgtccaggaccaaggatcggaggcactccatcggctagtgattggaattggctcatgctcattgccggcttctttcatcttgaatcttcttgacggctatttcactcgatgaacgtaaaaaaacactcgttgattgattgattgaatggccgagtcgtgagtaaagatgtgtagctatcgcacttgaacataaataagaagctacgttatactttctccaaaaaaaaaaaaaaaaaaaaaaaaaag

SEQ ID NO: 12187 - DNA, 1280 bp, Zea mays
  misc_feature (1092)..(1092): n is a, c, g, or t
  misc_feature (1144)..(1144): n is a, c, g, or t
gccattgtgtggcctggcttccgttccgcccgccgaggccagtgtggcaggcagctcccgcgcgagcgcgagcgcgatccagaggctggcgcacctgcgtcactcgctccgcgctgccgcgatctcctctgacgtcgaagtcgcccgggggatgacacagggggaaggggtggtgtgggaggggtgaacaggagctcggtgacttttgtgaggggcgcctgatggaggagcgccggctcgacacgccggcgatgaggagaatcagcgagtggtatatacgttcctagcttctcctaccttccctcctgcgtctccttgctctacttttcattaattggcatgtcgctgctgctgtttcgcatttgattcgacgagttcgtgtccgtaaccggcgccgctgatagcttgttcagtccgattttgaactgaaaacaaacagctatcgtcattaagctagcaacacgtgacctgtgctttcagatcttcacgtcttttacccgctgaaccgctcgctctagccaaaccctgcaaatgaagttttgcggagtttgaggctggctcttttgcttcgcttgattgttgcaggattctttcactagagttcccaagcgatattaccatccaggttggggaggcgaccttcaacttgcacaagctcccgttggcatcgaggtgcggctacataagggagcaggtgtcggggatcaatggctccagggtcacccacatcgacatcacgggcttgccgggcggcgccgcggcgttcgagctcgtcaccaaattctgctacggcgagaacttcgagctcacggaggacaacgtcgccatgctgcggtgcgccgccgagcacctgcagatgaccgacgacgacagcaggggcgggaacctggccggcaggaccgaggcctacctggaggccgtggcgctgatgagcctcgcgggcgcggtcaccgtgctccggaggtcggaggacctcctcccggtgtccgaggaggtggacctcgtcggcaggtgcgtcgacgccatcgcctacttcacctgcaacgacagtcagttcagcatgtccaacggtaaccggcatggaacgtgtcngtcgtccaaggtcatcatcgaatgatttggttgggctgacgagctcacgtcngctgcgggattgacacgttcccagagagtcgtaattgccatgaaaggcgaggggggttcaaggggcattgcttctgggcacgctcatcatgctcctatgcgcagaagtcgctgcgaacgctggacacacatcggaa

SEQ ID NO: 12188 - DNA, 2267 bp, Zea mays
gggtaccccctcgaggctcggccggatatagctagctagctatcttgctcccgcgagccggccctatataacaataatcgtcctctcgatctctcgtccgagatcgatctgcgtgccaagggaagggagatgggggcggcgccgccatcgtcgtggcttattgcgttcatcctgttcttcagcacgttggtagcgttgccgcagtcgtcacacgccggcggcacaaccagacactacaccttcaacgtgacgatgaagaaggtgacgcggctgtgcaccacccgcgccatcccgacggtgaacggccagttccccggccccaagatagtcaccagggagggcgaccgcgtcgtcgtcaaggtgctcaacaatgtcaaggacaacgttaccatccactggcacggcgttcggcagctgcgcacggggtggtcggacgggccggcgtacgtgacgcagtgccccatccagacggggcagagcttcgtgtacaacttcaccatcacggggcagcggggcaccctgttctggcacgcgcacgtctcctggatgcgcgccacgctctacggggccatcgtcatcctccccaagcgcggcgtgccatacccgctcccggttaaaccctacaaggacgtcccagtcatcttcggagagtggttcaacgcggatcccgaggcaattgtcgcccaggcgcttcagactggagcaggcccaaacgtgtcggacgccttcaccatcaacgggctcccgggccctttgtacaactgctccagcaaagacacgttcaagctgaaggtgctgcccggcaaatggtacctgctccgtctcatcaacgccgcgctcaacgacgagctcttcttctccatcgccaaccacacgctcaccgtcgtcgacgtcgacgccgcctacgtcaagccgttccgcacggacatcgtgctcatcacgccgggccagaccaccaacgtgctcctgcgcgccgagcccgacgcggggtgccccgcggccacgcacctcatgctggcgcgcccctacggcacgggccagcccggcaccttcgacaacaccaccgtcgccgccgtgctcgagtacgcgccgccgggccacatcaggagcctcccgctcttccggccctcgctccccgcgctcaacgacacggccttcgccgcgaactacagcgccaggctccggagcctggccaccccggactacccggccaacgtgccccgcgccgtggaccgctccttcttcttcgccgtcgggctcggcaccaacccctgccccgtcaaccagacgtgccaggggcccaacgggaccatgttcacggcgtccatgaacaacgtgtccggcaacatgcccaccaccgcgctcctgcaggcgcactacggcagcgtcgccggcgtgtacacgcccgacttccccgccgcgccgctcgacccgttcaactacacgggcacgccgccgaacaacaccaacgtttcccacgggaccaaggtggtggtgctggactacaataccagcgtcgaggtcgtgctgcaggccaccagcatcctcggcgccgagagccacccgctgcacctccacggattcgacttcttcgtcgtcggccaaggcttcggcaactacgactcgtccaaggacccacccaagttcaacctagtcgacccggtgcaaaggaacaccgtcggcgtgccggcagggggctgggtcgccatcaggttcttcgcggataatcccggtgtttggttcatgcattgccatctggaggtgcacacaagctgggggttgaagatggcatgggtggtcaacgatggcccgttgcctgagcagaagctgatgccgccgccggccgatcttcccaagtgctgaagatccaccgcgcgttgacattgtccaacattatatatgattcgtttctattgcataaacatatcaatggagatacacattgtcgtcgtacatatagcgtcgtacacagcgtttaaagaggctttgtggattttctatgcattgtttcttcttcattcttctaaaggttttgaaagttgtgttttgtgataggaagtcattgttttactttcacacagattttttttcatctggagtagtttgaaatcctttgttgcaattcgaactcaataaatatggtttggaaagaaaacaagttgaccaagtgagatattctatgtttacgcggccgtaagatggcttagtaattgttcatcttgaaattcgaaatcatttgttccaaaaaaaaaaaaaaaaaagcggcc

SEQ ID NO: 12189 - DNA, 933 bp, Zea mays
  misc_feature (858)..(858): n is a, c, g, or t
  misc_feature (865)..(865): n is a, c, g, or t
  misc_feature (868)..(868): n is a, c, g, or t
  misc_feature (879)..(880): n is a, c, g, or t
tgggtacctcgaggccggccatatataatcactgtcatagctctagctagctatcttgctgcggccggccatatataacaatcgtcctcgatctctcggccgagatcgatctgcgtgtgccaagggagatgggggcggcggcgccatcgtcgtggcttattgcgttcatcctgttcttcggcacgttggtagcgttgccgcagtcgtcacacggcggcggcacaaccagacactacaccttcaacgtgacgatgaagaaggtgacgcggctgtgcaccacccgcgccatcccgacggtgaacggccagttccccggccccaagatagtcaccaggtagggcgaccgcgtcgtcgtcaaggtgctgaacaatgtcaaggacaacgttaccatccactggcacggcgttcggcagctgcgcacggggtggtcggacgggccggcgtacgtgacgcagtgccccatccagacggggcagagcttcgtgtacaacttcaccatcacggggcagcggggcaccctgttctggcacgcgcacgtctcctggatgcgcgccacgctctacggggccatcgtcatcctccccaagcgcggcgtgccctacccgctcccggttaaaccctacaaggacgtcccagtcatcttcggagagtggttcaacgcggatccagagacaattgtcgcccaggcgcttcagactggagcaggcccaaacgtgtcggacgccttcaccatcaacgggctcccgggccctttgtacaactgctccagcaaagacacgttcaagctgaaggtgctgcccggcaaatggtacctgctccgtctcatcaacgctgcgctcaacgacgagctcttcttcntcatcgncancacacgctcanncgtcgtcgacgtcgacgccgcctacgtcaagccgttccgcacggacatcgtgc

SEQ ID NO: 12190 - DNA, 3077 bp, Zea mays
gccggccgggctttcgaacgactctcggcaacggatatcttggctctcgcatcgatgaagaacgtagcaaaatgcgatacctggtgtgaattgcagaatcccgcgaaccatcgagtttttgaaacgtctccacccaccaggccacctcggcaccagggccaagcacgcggcggcgacgccaaagcatcagtgcaccaatggtggtgctccccgcggccccgcctctcctactcctacagtcctaatcctaaataatagccttccattccaatctgttcccacagttcagtcgcacactcgggcgggtcaaattcgactcgggaggaaccaaccacccggaaattcaccccctcctccagtctccactcgatcggcgaggcgctgcggccgcgggcgaatggcgtcggaggcggagtcgcccgtggtgatccacgcgtggtcggcgccgcgctccctcagcaccagcctcatgtactccttcgcccagagggacgacatggaggtgcttgacgagcctctctacgcaaatttcctgcgtgccacaggcgtcgacaggccctaccggcaggagctcctgtccaaaatggaccctgatggaaataaggttgtcaaggaggtgatttttggcccaggggacaaaaagtatcgttactgcaagcacatctcaaagcaacatctcccaaatctgtcaagcgacctcatgaagaagggaaaacatttcatattgatacggaaccctctagatatactgccatcttttgataaagtcgttccaccatccttcatggagcttggcataggcgaacttgtctcaatatacagtgaattatgtggacttgggagcccaccccctgtgatagatgcagatgatctgcaacaggatcctgaggccgtcctgagtggtctctgtgaggatctgggcattcctttccagccacaaatgttgaaatgggaagctggccccaaggaatttgatggtatatgggcaccctggtggtatgggagtgtgcacaagtcttcaggtttctctaagcctcgccaatatcctctgactttcccattcgtgttttatgacctgcttgagcaaagcttgcctttctacaacatgctgaagcgccaaataaggaagataagaggaccgcagcaaccaccattatcggaccctcctctgcctgtccctgcaaataaaaacattcttgtttgggttggagatgaacttttgccccgtaacagtgcaaaggtttcagtgtttgattcagttgtacaaggaggagatgctgtttgggaaggtttacgtatatatgatggaaaagtattcaaattagatgaacatttggacagattgtttgattctgcaaaagctatggccttcagcaatgtgcctactcgtgattggattaaggatgccatctttaagactctgattgcaaatggaatgttcaacaatgctcatataaggctcacgctcacccgtgggaaaaaggtgacatctggaatgagtccagctttcaatctttatgggtgtgccttgattgtgcttgcagagtggaaaccaccagtttatgataactctcatgggataaaattggttactgccaccacacgtcgaaattctccaaatagtatagattccaagattcatcacaacaatcttatcaacaatattctggcaaagatagaaggtaatcttgcccaggctgaggatgccattatgctagataaggatggctttgtatcagaaacaaacgcaacaaatatttttatggtcaaaaagggaattgtattgacacctcatgctgactattgccttccaggcattacgcgagcaactgtcatggatcttgtggtgaaagaaaactttgtgttacatgaacgacgcattagtctgtcagaattccatgctgcagatgaggtatggacaaccggaacaatgggtgaaatcacaccggttgtaatgattgatggacgtgaaatcggcgacgggaaaattggtccagtcactagacaaatccagaaggcatacaagatcctgacagcagggcaaggagtaccgataccgggggttgctgaggtgtaattgtctaagatgcatccctttatctagttaggatcagtcccccaaggagctcaatgatatcaggctagcgcaacaataaattaataatctgcattgatcactgatgttcaaagacaccatggtgccgtttggttcacatatttgtaacgtaatgggtaagtgataacgttaaattatgtttgttttagtccaaccgtaatcagatatcatactaaaaattgataccgaactattcaaacttgttacggccagtaatcgagtgtaaaccattaccctttacgttacatttcgcgaaccaaacaacactcagtcattgttattcgacacaggatactgctggagattataaacgcaataagccattgcgctggcatgcgctcgtatgcgtctaagttggctaatactctaatccccgtgcccgtgcatacgattccagtgcattttgtcgaatctgacttgtttttttttcctgtgaaacaaagagagaatatgtagacgcgaattgcccacctctaataaatttccttgcagcatgcattatatatctttgcagccttacaggaaagcacgtgcattttcattcttgcgtgtctttaacttggaacagagtctccaaggagctcagtgcagcgtggtaataaggtcatactagagctagacggcaagacatctcttcggcattaatccgtctagtttcatgcaagtccagaaacactcaaggctaccatctaccaagagtgggacaagtccatggctccagattctgtgttcgcgcgtcagacaatgcattcaaacgatcaaacagagatgaatacagtacaagctagtgtcacataggttacttaagacgataaaatgtgcatggaactcacatgcagccgcaataactacgagacattgtatttccttagaggcgtcgaccgttcagtagtctttggaccgtgctttgttacggttattatatattatataattaggtattaagatatttattaactat

SEQ ID NO: 12191 - DNA, 2036 bp, Zea mays
ttttttttttttttttcgtgtgtggggaaatccgaagtcaaacatgtttatatttagatagccatttaaataaactattatatcaattaagaacaatatagagagtcttagaggtgcactaatatcttccttagccaagtttcccgctttttaacgagccgacagccgagacttgccagctagacgtccagcccgtcacaaaaggcccatctcactgaagagatacgctggtcggctggtgggcgcgtggcttgtgggccgtgggcttcttcgctgttcgtcgtctcgtcaccactcaccattgccgacgcaagctgcgactgaacctccgtggcgacggaggagaaggacatggtggcagcgatggagctcgagatcctaggcatgaatttcgggtgcgtcctcgcggctctgtccgacgccaagatccccgacaagggctgcctgctcccgctcatctctaagctgctcggctacgccatcgtcgccgcatccaccaccgtgaagcttccccaggttccctcgcctttcccttggcactagttaaaggttcttccatgcgtctaattatgcgtgcctgtatgtgtctcgatctgtggcgagctcgccttgtgggttgggttccggcggtgggtgtgtgtgagggcggatctcaatctcatgttctttgcgtgaccgtggcgtgcagaattctgcgtaaagggtccgtttgtggaggcttgtccacggtcttgacgcggcgtggtagaagagcgtagaaattgaggaagccgctggaattctttgtttgtttgtgggatgctggtggattcgcgcgatccttgctgctgcttgagtgtagagcacgaactcttgcagttacttcctctctcaagagcttcccctgctaaacaaaactctagcttctcggtcctgacctcaaggctggctggctggacgttgatcagcgaatatgatctcagcactccccgtgctctgctatggggtcacagctagtgcgttgcaatcccaatcgatccaccaaataacatcctctacaagtcctgcaccagctttcttcaaactatcaagggacccctcatccttgacaatttgtagcccacaaatacaggcaataagaatccaatcactgcggggcaaccaaaatttgaaggccatagagatgagtgaagggaatagatggggctcagggatgaagctggatgtcatgggcatgacaattggatgcttcatatcgtgtccactgcatacgaacaacctgctgcctttcatctctaagatcctcgggtattccatcattgctgcttccactgttggcaagctccctcaggtgctaagcataagtttcacagttctggaggagtttgcttcttagccttttatctagatatgcttgcaattttgtatgttatgaacctgtgttattacttattaggtaggcttactgttgcctacttatgttcccagaatctttcttgtactctagaattggttaccttctccttttaactttccaccataatcacaaatatatcatgctgcagatactgaaaattttgaagcatggaagtgttagaggactaagtgtggcatcctttgaacttgaggttgtcggctacacaattgctttggcatattgtattcataaaggacttcccttttcagcttatggggagctagcttttctgttaatccaaggtttgtatttgacttcatgtcttgagtaggcagcatatgtttctaaatctgtctttgttgatcttcttaactgatgcttttatccgatatgcagcaattattttggttgcaatcatttactattactcaccaccaatgggaaccaaaacatggatgaaagctttattgtatccttcatttctggctgtttattctaactttgcttttgtgttgccaataaagatgtgccaggtcccacggagcagttcaatgaagatcatcaaactttattaatacgttgtctgattacaatgtttcacctgctttccctatacagtggttatttagatattgtggaa

SEQ ID NO: 12192 - DNA, 1355 bp, Zea mays
ccgaagtcgaagatgtttatatttagatagccatttaaataaactattatatcaattaagaacaatatagagagtcttagaggtgcactaatatcttccctagccaagtttcccgctttttaacgagccgacacccgggattcggccttatggccggcgagacgtccagcccgtcacaaaaggcccatctcactgaagagatacgctggtcggctggtgggcgcgtggcttgtgggccgtgggcttcttcgctgttcgtcgtctcgtcaccactcaccattgccgacgcaagctgcgactgaacctccgtggcgacggaggagacggccatggtggcagcgatggagctcgagatcctaggcatgaatttcgggtgcgtcctcgcggctctgtccgacgccaagatccccgacaagggctgcctgctcccgctcatctctaagctgctcggctacgccatcgtcgccgcatccaccaccgtgaagcttccccagatactgaaaattttgaagcatggaagtgttagaggactaagtgtggcatcctttgaacttgaggttgtcggctacacaattgctttggcatattgtattcataaaggacttcccttttcagcttatggggagctagcttttctgttaatccaagcaattattttggttgcaatcatttactattactcaccaccaatgggaaccaaaacatggatgaaagctttattatattgtggaatggctccaacggttttggctggaaaaatagatcctgctctttttgaagtcctttatgcttcacagcatgctatcttcttttttgctagagttccacagatatggaagaattttacgaataaagggaccggcgagctaagcttccttacctgtttcatgaactttgctggttccatcgtaagagtttttaccagcatccaggagaagactcccttaagtgtgatcatgggctccgcaatcggcatcgtcatgaatggtacgctcttgggtcagatagtactgtaccagaagcccgctccaaagaaacagaagaaagaagattaagcaacatggagaagctgcagaaagttcttcctggttgtttaggattctgttccaacactcgctccacatctgaacaaatggcaccagtataggaagttgttggcaacttgttacgagaaaagaacatagtcggactattgctatataacaacatttctgtgctgttgtttttagcacttagcagtgtaccatgacttgaatagttcatataactgcctttagatattgactgcaagctgctgctgatgcgttttcccttcaaaaaaaacattccatattttagtttgagttaaatgcatg

SEQ ID NO: 12193 - DNA, 1409 bp, Zea mays
ctcgaggccggccgcgggccgccacgtagtcacccgctcccaacgcatttccgtcttctcctccgacgagttcccccaatccgcgctgcctgagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggccatggcgtgccggggcttctttgagtgcgtcctcaagctcctcaacctcgtcgtcatggcggttgggctggccatggtgggctacggcgccttcctgctcgtgacctggcttcaggtcgcgccactcccgccgccttcgtcgtcgccggacgccgtgccacccagcggggagctcgtgcagctcgggaggccgctgctgctttttgttgatgcatccctgtcggatgggaccgcggagaggctctccagtgcctggtttatttttgcgtttattggtgtcggtgctatactctttgtcacatcgatctttggttgtgctggagctagaaatggatgctgcttgtctatttactcattcctcattattttgttcatactggtcgagcttgctgcaggaggcttcattttcttcaaccatagctggaaagaggttattccagttgacaaaactggaaactttgacatgatgtacagctttttgaaagagaattggagaattgcaaagtgggttgcacttggagctgttgtatttgaggcattgttgttcactgtagctatcatagtacagtcaggcaaccaaaccgactatgacagcgacgatgagtacatcggcgcaaggtctggaatacggcagccattggtgaaccagcaagctgctgctgctgctgctgatcctagggtgcccaatctcgactaccgcccaatccggaacgacgcatggagccaacggatgagagagaagtacggggtggatagcttcgatccgaacaggtttcagccggccaccatatctcctggagaacaaagaaaccgatgcacgattctctgaggcaagttctacatatatccaaccgcgcaattaacaccgagttgcagagagtatgcgcctggattattcggtgttgcctggctgtgtggcatccggagggcttcacattctcgtctgtattttttttttttttggtttacatagtccaaactcagcacaccagtgctgtttttgtaataagtattgaaccaagttcgtgttctagataacgttccaatgtgcataaaaactttccctgttaccagacatgtctgttacggaaagcttttacatcgtcaaaaaaaaaaatgcgggc

SEQ ID NO: 12194 - DNA, 5913 bp, Zea mays
cactcttaagctatctccaacagcttatccatctcataaccatatcaaactccactttacaaacactgtaatatataatacaaaataatgttttgagtgactagatatgtgaactgctctggacacagtcttacgactcaaccttattgattaatataaactcctcacagccactgtttttttgcgcaataaaagaggtgcaactgtgcaaaagatgaatggatgtttgtctctctgagagcgtgcgtgatgataagcgagacctagaagcttcgagtggctaagcccctgcttagaacatctagagctataggtgtgcatttgggccggatctaatgggccggcccgaaacatgaaaaaaaagcacggcccagacacggtacagtccaaaatattttagtgtcggaccggcacgatatatcgggccgggtttgggctgaggtcgcggcttatgggcgggcacgatggcccgtttaaggcaggcacgaaatgacccatatagagacatgaaaaagctcatatatttgttaaaatcatacttcatttcatactttcatgtacttgataaagaacataaagctagagataatgttagttagatttttttgtacctttaaattagagtatgtaatgtaattttatttttgctatgaacattagactaatgaattgaacttacgaactttgtatagagctgattatactctttttccttctaacaaaatgatttgtaaacgaggtagtcattgcatagctgtggtaactttaatacaaatattaagtttgcttttggtcaaatttatttgtcttatcttttatttgttttattaaatttgtttgaatttagggctttgatgtgaatttagggggccaaaaactgaatttcgggccaaaatttgaatttcgggccctaatgtgaatttcgggccaaaaaatgaatttcgggcttttataatttcgggccgcccgaaatgggcccggcacgtttaagcaaattacgggccgggccgtgggccgggccggctaggcacatgggccggcccggcacggcccgaaattcaaacgggccaggccgacccaaaattcaaacaatacggaccttttgaggcttgggccgggccgggccgggcggtccgaatgtacacctataccttgaggtttcaccgaagtgatatgttactggaactcctagttattaattaatattccggcttaggaggagaataaaaaacgcacgccacgtaagtcacccgctctcaacgcatttccgtcttctcctccgacgagttgccccaatccgcccagacctccaacatcgcaacggagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggccatggcgtgccggggcttctttgagtgcgtcctcaagctcctcaacctcgtcgtcatggcggttgggctggccatggtgggctacggcgccttcctgctcgtgacctggcttcaggtcgcgccgctcccgccgccttcgtcgtcgccggacgccgtgccacccagcggggagctcgtgcggctcgggaggccgctgctgctttttgttgatgcatccctgtcggatgggaccgcggagaggctctccagtgcctggtgcgtgcgtgacgactggtctcttatcttctccctgtctctgtaaaactaggatctttcatgtgtggatagggcatctgcatatgtagtagacgcagaggacactaccactagtgtgtctttaaaccatcagtatatgcttaagaacactccgcatgttatgtatagacaaatgtgggatcttgcaactaaataatgactcatttgcatgtagtcgcgtgccaagaatcttacaaaatcgtacagtataaggtggcgtactgtatatcccaagtacagatcttcctttccttgtcggcattttctggtggtatccttagctagtttactatattgggaacttctgcaatcatggatttccccccaattcatactcttttataactatctgaaattgatgtctacaaaagaactatctgaaattgatgtctacaaaagaactatctgaaattgatatactgtattctttcaacttctggaattgatattttttttctactttatagaatatatatatacatctcaatctttaattttgattctcataggaacaccccaaccttaataagattactacaaaaaggatcatgtattttcatactatatggttcctagcattacaattggagcgctgtataattgcagtgatcatttatgaagttgtgccgttgttaggatgttttgctttgtatatcatctttttacatctctttttcatactttgttttaaatcttctgcaggtttatttttgcgtttattggtgtcggtgctatactctttgtcacatcgatctttggttgtgctggagctagaaatggatgctgcttatctattgtatcctttttaattctggattcttatttatgaacccaatatcatgtgatgtggtcatatccaattttgttcctgtttactgtcaaatatcaagtaagttgtgctgagtggagcaaggaatcaaccataataatcatcgatatgaattcatatcctcaaggaacatcgaaatatgggaaatgacacacaagatgcagctaatgttcaaaggcttgattaataattaactacacaaaggtttcatatgtactttgtaatgctttgctgttccctactttctgattttgatataagtctcccattagaccattagcaacaacttattttctgtggttcataccatggttttcttgacatctggaatagtactcattcctcattattttgttcatactggtcgagcttgctgcaggaggcttcattttcttcaaccatagctggaaagaggtgagtactctgtagatcctgtctctagtccattgtgcatgatttcttttttttattgagtttagtttcgcattgcaggttattccagttgacaaaactggaaactttgacatgatgtacagctttttgaaagagaattggagaattgcaaagtgggttgcacttggagctgttgtatttgaggtaaaaaataaatagcaaagccctagtattgctggatgtaattcaatacatgcattcaggagatcaagcaaatttctttatgtattaagtttggtttacgtacgaacatagatgccatgtaaatttgttaccacattatagtggcagcaatccaaatatgggaaacaataatgttagcagtaggataattatgaagtgaaacagtctgtgagaagaatggttggggatttacagctcagtaccttattattttagagatttttcgggtaatcaattttaagaagtttatccaagtatagtctggtggtatgtttattatggcagttgacaggatggtccctgtaaatatttcatatcctctttacactgcttctcttagtctgttcctgcttgcttcacctcagtgttttttttttgttgcaggttactaggttagattgttggtgaaaataaagtatcgcacactttctaaactttgcatgtatttttgagaatgtccctttcgggttgttttgtgttttttcatcctaggcttgtacaataggaatgtttttaccacagtatagacaagggtaactgtcatgcctcaactatatattaggtactagtaatgctagacaactggaatgacttgatttgaaggagttgtgtgtttctggtgaaactgaaagaaattttcatacatttgagcttctgtggaaaaaacaatacaaaaatctgaccttagcttgcacacagcgttgtttaaattgtttcttgtgctcctgtgaagctatgtctcattatttttgcttcatagaactgaaaatatcatcacagcacgcaatgttttaccagctagaagtaacagcaccaaaccgttgctatttatgcaggcattgttgttcactgtagctatcatagtacagtcaggcaaccaaaccgactatgacagcgacgatgagtacatcggcgcaaggtccggaatacggcagccattggtgaaccagcaagctgctgctgctgctgctgatcctagggtgcccaatctcgactaccgcccaatccggaacgacgcatggagccaacggatgagagagaaggtacggcgcccctctcgagcacttgtaatttcatagcggtggctcgtttctttctcttgctcacacgaacatcttctgctgtggcagtacggggtggatagcttcgatccgaacaggtttcagccggccaccatatctcctggagaacaaagaaaccgatgcacgattctctgaggcaagttctacatatatccaaccgcgcaattaacaccgagttgcagagagtatgcgcctggattattcggtgttgcctggctgtgtggcatccggagggcttcacattctcgtctgtatttttttttttttttggtttacatagtccaaactcagcacaccagtgctgtttttgtaataagtattgaaccaagttcgtgttctagataacgttccaatgtgcataaaaactttccctgttaccagacatgtctgttacggaaagcttttacatcgtcagagatgtctatgcgggcatatgaagctgttgagctttcctgtcgtgcattattgtgacagagcgagcatattcgtatggaaaaaaggcatctgttcctcagctctgctccaaaggagtgatgtgttcccctgccaaagatccacacaagctatcagtcgtcttacagatcaagatctggctatgacatgttaggtcctgatcagcactgcatattgtgtctgctgtctaaaagctggaaaagtgatgtcgatactgtaagactatgaaagtgcctcgatgtattgcataggaggcttaaaatatatcgagacacatgtaactctaaccctaatgggccagtggtgctagtctacctacacataggaacatcatagctctaacgcacactctagcacgcgcgcagtcgcaacgggagcttaaaatatatcgagacacatgatactctaaccctaatgggccagtggtgctagcctacctacacataggaacacacactctaacactcgcgcagccgcaacgggagcactgcaaacgatgagactggagcaggagccgacggttcaaattccctcacaatcgcagtgtcgtgatggtgcgagtgttgcgtctaggacaaagattggtgtgcactccgtgtagatgatagcccctgtatgctgaggtagccaaagtcgaggtggagtgttgcaacggcatatagatgcgtagtagatgcctcgtttttcgggggtgttgacgttcgagcgacagcggtcggtgaaacaacactacaaaagagcaccaacaggccgatgaccttctttcttcttcgttcgtccaatcgttgaggagccccgccatggaggcaggtggcagcgcacgcgtctgcgccggtcagggtggtcgcgctcgtgacagagtagaagaggtaacagcggtgtcggggaccataattaggggtaccctcaaggctcctaattctcagctggtaacccccatcagcataaagctgcaaaggcctgatgggtgcgattaagtcagggatcggtccatacgagggactcgatcacgcttcgcccgagcctagcctcggacaagggcagccgaccccggaggatctccgtctagcccgaggcccccctccagcggcgaacgtgttct

SEQ ID NO: 12195 - DNA, 2806 bp, Zea mays
gcttttttagcacgtgttctctgaaaccctctttataaagttaaatatatttgttcgacgttgcaacacaagcccgctaggtctataattgactcatagtctgcagctccggccgctccgccccaccccggcccgctggccggccgaggccacctgttagccggtccagacacgactaaaggtggtttaaacgcttgatcacctaaaccgaggacaggagacactggatacagcaacctaaccaacaaaactaggatctaatcataacatatagtgaatataaattgcatatttacacacactatttttgtaaaaataaaaataaaatcatgtcgggcatgattttatatacgagaattaggtactgaggtctgcattagtgcatttagtgtggtagctgcaacgcgtggtcagagtcgctcccctctgattataaattagttaggtacctcgtaccggccgggcagcagtctcgatggccgccgccgactcctccccgctccacatcgtcattttcccttggctcgcgttcggccacttgatccccggcctcgagttcgccgagcgcctcgcagagcacggccagcgcgtgtctttcgtctccacccagggcatcctccgcaggctccgcccggtcgcgcccgcgttggcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgtaaggtggactgggtgctcctcgacaacttccacgcgtccatggcggacgtcgccagcgagcacaaggttctggagatggatatagtacagcgcaatgaaattaaaatgatacccctgcactgcagtaacccccttcccatgtcctgcaggttccctgcatactgaacatgccctactccgcggcgacgacagaggatttcggcattccagacgcgtcggttctaccaatgttccggccatttgtcgagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgttgtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatgctgagtgcactcaggcagcatacttggcaatggcattggcgttacacaagtgatccgctggactccagctaatagtacgatgtatcttattttgctgcaatatgtaactttatcattgtttggttgtaaaaatatttgaatttgtttctcgtgaattgcatgaaagttattcatatctatcattacaaaagctgactcgaaataaccactgagagcaactctagatatttctttaattaacttgctaaattcataaatttagcgagttaataaaataagtagcaactttagtttatttctctctaatagtttttttggcagtagcttgctaaacaaatttggcattgggaatcctaaactatttctaacaaaccaaagttttttaatagtctctttatttcttgccgcttgaactttttgtaaatgtaattatgcatccaatttactataatcttaaaaaaacaccgaaaatggcgcgtttgaccatagaaacttacgagttggagagatttaccaagttcttacttttaagtactagaagtattttctctctcttctttaccaaaaatctaaattgggagttcatttagaaaactcctagaatagatctaaccttatttaaattgctcagatttgacattgtttgtgaaagatgatttaaaataaactcctaatatttttaaaaacattgacccaatatttaatattttctataattaacttgttaaatctatacaattaacttaccatccatcttaccaaacaatgttcgacagcagactcagaaattggcaccaccaactacagagaataatcaagcgtccaatgtccaacgatccgatcagtcgctcatctgtcatctccattttattcagcagtttggcttgaatcggtacatgtttctgctgcttctatgatgtttttctctctatgaattatagctgcaggcatgca

SEQ ID NO: 12196 - DNA, 1537 bp, Zea mays
cattgggtacctcgaggccggccgggccagcagtctcgatggccgccgccgactcctccccgctccacatcgtcattttcccttggctcgcgttcggccacttgatccccggcctcgagttcgccgagcgcctcgcagagcacggccagcgcgtgtctttcgtctccacccagggcatcctccgcaggctccgcccggtcgcgcccgcgttggcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgtaaggtggactgggtgctcctcgacaacttccacgcgtccatggcggacgtcgccagcgagcacaaggttccctgcatactgaacatgccctactccgcggcgacgacagaggatttcggcattccagacccgtcggttctaccaatgttccggccatttgtcgagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgttgtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatgctgagtgcactcaggcagcatacttggcaatggcattggcgttacacaagtgatccgctggactccagctaatagtacgatgtatcttattttgctgcaatatgtaactttatcattgtttggttgtaaaaatatttgaatttgtttctcgtgaattgcatgaaagttattcatatctaaaaaaaaaaaaaaaaaaggggggggg

SEQ ID NO: 12197 - DNA, 1431 bp, Zea mays
ttgggtacctcgaggccggccgggagcagtctcgatggccgccgccgactcctccccgctccacatcgtcattttcccttggctcgcgttcggccacttgatccccggcctcgagttcgccgagcgcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgtaaggtggactgggtgctcctcgacaacttccacgcgtccatggcggacgtcgccagcgagcacaaggttccctgcatactgaacatgccctactccgcggcgacgacagaggatttcggcattccagacccgtcggttctaccaatgttccggccatttgtcgagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgttgtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatggtattggtcagtgcactcagcatacttggcattggcgttacacaagtgattcgctggactccagcttatacgatgtatcttattttgctgcaatatgcaactttatcattgtttggttgtaaaaagatttgaatttgtttctcgtgaattgcatggaagttattcatatctatcattacaaaaaaa

SEQ ID NO: 12198 - DNA, 2526 bp, Zea mays
ctgcaggtaccggtccggaattcccgggacgatttacgtttccgagacaaagctactagattgtattaggcgcactagtgtccaagaaggcgaagctgggggtattacccaacagatcggagcaacatacttccctactgaaaacattagagagagaactagggagttgaaagctgatgctacactcaaggttccaggcctgcttgttattgatacccctggggcatgagtcgttcagtaatctgcgttcgagaggttcaagtttgtgtgatattgccattttagttgttgacatcatgcatgggcttgaacctcagacaattgaatccctgaatcttttgaagagtcgagatgcagtgttcattgttgctttgaataaggttgatcgtctctatggttggaagaaatgtccaaatgctcctattgtgaaggctttaaaacaacaaaatgaagatgttaagagggagttcaatatgagactcacagatattgttacacaattcaagatgcaaggagtgaatactgctttgtactacaagaacaaggagatggaagatacctttaacatagtgcctacgagtgctgtaagtggtgaaggtattcctgatttgcttctgttactggttcaatggactcagaagacaatggaagaaaaactcacttttgttgatgaagtccagtgtactgtactggaagtcaaggttgttgaaggccatggtactacaattgatgttgttttggtcaatggtatactccatgaaggagatcaaatagttgtttgtggcatgcagggacccattgtgacaactgtcagggctttgttaacaccacacccaatgagagagcttcgagttaagggcacctacatacatcataaggagatcagagctgcacaaggagtcaaaatatctgctcagggtctcgaacatgcaattgcagggacagccctttacgtgttaggacctgatgatgatttagacaaactgaatgaagctgttatggaagagatgacacgggttaggagccggattgacaggagtggtgaaggtgtctatgtacaggcatctacccttgggtctttggaagctctcactgagttcttgaagagccctgctgtgaatattcccttctgtgatttcagtatagggccagtgcataagaaggatgttatgaaggctagtgtcatgcttgagagaaagaaagaatatgcaactatcttggcctttgatgtcaaagtgatgcctgatgcccgcgatctcgcagaagagtccggtgtgaggatctttgtggcagatataatataccatctgtttgatcaatttacagcatacattaagaacctcaaggaagagaagaagaaagaaagcgctgaagaagctgtgttcccttgtgttcttaagattatgccaaactgtgtcttcaacaagaaggacccaatcgttttgggtgttgatgtccttgaaggaatagccaaggtgggaactcctctctgcatacccagtaaagaatttattgatattgggaagattgcctcagttgaaatcaaccacaagcaagttgatatggctacaaaaggccaaaaggttgctattaagattattgcgaacaattctgatgagcagcagaggagcttcggcagacactttgatatggaagatgagcttgtcagccggatatcaagaagatctattgatattttgaaacagaactacagggaggatttgacaactgaagactggaaacttgttgtaaagttgaaatcaatattgaagatacaatgaaaagccccctcccctaacacacctgcccatgaatttgggagttgtggttctgtggcgccacacctatctctagttctctacaccggagttccccagggagggttaccaattttgatacggtttgatttttgtaatttgctcggaaggcgcttcattttacaaccacattccgtaataacataatattttgtgtttgtttctgtacttttcatgaactctgaagcctctcaccaacgaattgtgtaatatactacatgctatggaaaatctgtgctgtttacgacaaaactcgagcccggatggggaggccttgccttggctagtttgggaactcagatcctctctaggattgaagggaacgagggggaagggaaattagtttgtttccctgtattttccttagtctcgagagtatgcatttgagttctcaaactagccctaaaagttgtggctttacatcttgacaagaagagattaatagcttgacaagaagagattatagatccacctatgcttacttgtttgtttttattgtgttgtactattatctaataaagtaaaaggaaacatttatacctcacgttaggcgttaggctgccctccttatctcactctattttaaactacaatgcaatatccagtataaaataatattttatatgttagtatacacggtctgctcgagaaagctttacaagctaaactgttctatgcatcgtttttttttctcggatcattacaacaa

SEQ ID NO: 12199 - DNA, 2367 bp, Zea mays
gtcagtcgtcctcttccactctagtattaccggtactccgcgccggccggcagcctccgttttcgacgccatcagagcaggctccacagatgaagatgctgcggcggctcatgctgagcctgagcttcatcctcctcctcccttcctatctcgcctacccactatgcaccgatgcaagggcgccggtgctgctcaacaccacgctcaagttttgcgcctcccccagcaggaacagcagaggctgctgcgacgccaccgctgatgccgcgctcagcaagcagttcgacgccatggccatctccgacgctgcctgcgctgccgtcgtcaagtcaatcctctgcgctaaatgcagtccatattccgcggacctgttcggcgcggggccaaagatccggacggttccttccctctgcaactccacgtcgtcggcaaactctgctgagtccaaggaaaccaccaccaccaccactcaggactactgcaaactcgtctgggatacttgcaaggacgtgagcatcgccagctctcccttccaacccccgctgcaaggcaccgcgccgcctcctacttcaccgtcgaagctcaccgacgcgtggcagtcccagagcgacttctgcggctccttcggcggccggtcgtctgtatgcctcagcggcgacacggtctcgttcaacgccgccggaccttcaccctccccaagaccagaaccaagaggggtatgcctggagaggatcgacaacgggtcctaccttagcctggctcctcaccccgacggctccagcaggatcttcctcggcagccaagccgggaagatatggctggccaccgtccccgagcaagggtccgggggcgcgctgcagttcgagggcgcaggcccatttgtcgacctgaccgaccaggtgcacttcgactcggcgttggggctcatgggcatggcgttccacccgggtttcgcgaccaacggccgcttcttcgcctcgtacaactgtgaccggaccaagtcgcccagctgcaccgggaggtgctcctgcaactccgacgtgggctgcgacccttccaagcttggcaccgacagcggcgcccagccgtgccagtaccaggtcgtggtgtcagagtactcagccagaggctccgccgcggcgaatgtttctcaggcaacttctgccgccgatccatctgaggtgaggagaatcttcgcgatggggctgccttacacgtccgggcatggaggccaggtactgttcggccctgccgatgggtacctctacctcatgctgggcgacggagggaagggggaccctttcaacttcgcccagaacaagaagtcgctcctgggcaagatcgtgaggcttgatgtcgacagcacgccttcttcatcaggaggagatctcggcaacacgagtctgtggggcaattactccatcccgaaggacaacccttacgccgatgacagcgagctagagccagagatctgggcgctgggccttagaaacccgtggaggtgcagctttgactccgagaggccctcctacttctactgtggagatgttgggcaggacgcgtacgaggaggtggatctcatctccaaaggcgggaactatggatggcgtgcgctggagggtccgctcgtctatcacccgcagtgggcgcctggaggaaacacctcgctcagctccattgacgccattcctcccatcatgggatacagccattcagatgtcaacaagaatatcgggtcggcgtcgatcatgggaggttacgtgtacagagggtccgctgatccctgcctgtatggaaggtatttgtatgctgacctgtacgcctcggccatgtggaccggcgcggaggctccagagagcagtggcaactacacctccgctctgatccccttcagctgctccaaggagtctccgataccatgcgacgccgctgctgggagccctctcccgtcgcttggctacgtatactcgttcggcgaggacaacagcaaggacatgtatgtgttggccagcaaaggcgtctaccgagttgtgaggcccagcctctgcagctatacttgcccggcagagagacaggagacatcgccgcctgctgctccttcatccaacaaggcgtccatggcggagatgggaatgggaatgcttttggtgtctgtcattgtggtttgggttttggtaacataggatcatgctgtgatgagacatgtcatatgcaacgaccagtcctgaggaagaataagagtgccagtcagtcagtgagattagaatagaagtgataggcagtcagttaggctgtctccaataaattgtgtatatgatcatgtaaaatattattttatattatagactgtattgttcacggaacgaa

SEQ ID NO: 12200 - DNA, 2056 bp, Zea mays
gatcccccaccgcccaccggccgccccctctgctgctgccagcaagacgagccttcgaaccttccagttccatccatcgccgccctcctcctgaggagcatccgaaacaagagcagcggcagccgccaacgcccgcgcccgccatcccgacgatgcgccgacccacactctcgctcgcgctcgggctcgggctcgggctctccctcgtcgccctcttcgcggcccggggcgcccacgcctcaatccacgagtacggcggcggcggcttcgcgccgcgggccaactccttcttcttccacggtgggagcgaggggctctacgcgtctgaccactcgtccaactcctccgcatccttcatcagatttgacaccgttgtatttcgtcgcaccctggagtcagcatctaggcatgaggagatgcaacaaaagacaggattggtggaggctataattgttgagatacaggatagaggcaaaattggaggttcatatctgcactctgatgcaatatgttgcacacctgagcttgataaggagaaatcttgtagagtaggtgaggtgatcatacgtccaaatcctgagaaccccgactggcctaagaggatccagacattctttgatggtaaaaatgaagaaaccactatggtaactcaaattgtgtcgataaacaaaactgggatgtattacctctattttatgttctgtgatcctcaacttaagggattgaagattacaggaagaactgtttggagaaatccacagggttaccttcctggtaaaatggctccaatgatgacattttatggtttcatgtcacttgcatatcttgtacttggacttctatggttcattcagtttgtgcgatgctggaaggacattttgcagctgcattaccatataacagctgttattgctcttggcatgtgtgaaatggctttttggtattttgagtatgctaactttaattcaactggaacaagacctatgggcattaccttgtgggcagttacatttacagctgtgaagaagactgtttctcggcttcttctattagtagtttcaatgggctatggtgttgttctacccacattgggtggcataacatcaagagttgctgctcttggtttcatctattttgttgcttcagaagctcttgaacttgttgaaaatctgggaaatatcaatgacttctctggaaagacaaggctattcctagtgttgcctgtcgctgtacttgatgctacctttatcatctggatattttcatccctctctagaactttggagaagctgcagctgcggagaagcatggcaaaacttgaattatatagaaagtttacaaattctctggctgtgtcagtgcttatctcaatcgcttggattggctacgagctatatttcaatgcaactgacccgttgagtgaactttggcaacgggcttggatcatcccctccttttggaatgtcctttcctatgccctcctcggcatcatatgcatcctttggtctccatctcgcaatccaacagggtttgcatattcagaggatgcaggtgagggagctgatgaggaagggctctctctagtaggcagtgcggtgaaaggaaccggagatatggtaaacatgcatatctttccggaggacaagcgtgcatgataagttttggcctgaatgcagctgtactcctggcagaatgctatgtgaagtacctttttcctctggattcacgacttagctgacatcttctaaagattgcgtaagattccagatgtacaggtggtgacttgtgttgaacgatttgaccaagagatgtttacttcagttgtggctacccaatacaaaaaggtcggcaaaataaactatcactgagagcataagagggtttgtctttgtaatccttgtgatggtgacgtagctcgtaggtgattgaaatgtatcattcccagagctgagatgtactcactccgttccaaattaaaattcgtttttctttttattagatttatacaataatgtatgtgttatatatatatatattcattcttatctatccgtat

SEQ ID NO: 12201 - DNA, 1420 bp, Zea mays
ctcgaggccggccggggtagcacatctcgctctcgctcgatgtctgacgccttctgattctcgcgctctgctcttctcgatttttgtcatcgattcagagctcacgagtcacgatccaaatcccttttccactccgccggacgtcgagagaggcggtgggtgcgggacgcgaaggcgaagccctagccccctccctgccgcggacgccgatggacccacctcgcgccgtcgcctttcttctcatactcctgcccgtgctcgccccggtggcctccggtgtacctttcgtcgtcctacacgggattggcgacgagtgcgggaacgatgggctgtcatccttcaccaagatgcttggggagtggtcaggctccaagggttactgcattgaaattggaagaggagcatgggactcttggttaatgccacttcaagagcaggcaaatacggtttgtaagaaggtcaagaaaatgaaagagctcagtgaaggttacaatatagttggcctgtctcaggggaacttaattggcagggctgtaatcgagtactgtgattgtggacctccggtcaagaatttcatatcaattgggggtcctcatgctggtacagcttcagtgccactttgtggttctgggtttctttgtattcttattgatgatctgattaaatcagagatatattcagactatgtgcaggatatggaagattatttgaagggttgcaaatttcttccaaaacttaacaatgagatcccaagtgcaagaaatactacctataaagaaagattcagcagcttggaaaacttggtactgatcatgtttgagggcgatgcagtattaatacctcgggaaacagcgtggtttggttattaccctgatggagcctttagcccagtgctgccccctcaagagacgaagctgtatacagaagattggattggcttgaagaccctggacgaggctgggcgtgttaaattcgtgtctgtgccaggaggtcacctgcgtatcaccagaagcgacatgaagaagtacattgtgccttacttgacgccggaggcgtcatccaagaagaacatacacatacaccggatgctgtcgctttgagcgagtatctaacaaggtttgtatcggtggccattgtgccctgacacgtgggccatgtgttgacgccttgtaaatacgctgaacacgaagggaggaaatgatagctccttggaagagtggatccgaacttgtgaagtgaagcgtgtttggtcctttccgtttcctatctgacaaacaaatatgtccatgccgtggccacaacacgcataaatcattatgcacatttcctattgagtaaaatacaattccggacaaaaaaaaaaaagaaccatgtcatgccggttcataaacctttaaaatatgtttcttaaatgcttaag

SEQ ID NO: 12202 - DNA, 2202 bp, Zea mays
tcggtccgtccctcccggccgggccgggctcttctcgtcatcttcttcgtttcgtccttcttccgccgcagccgccgtcgccgtcgccgcagctaggggttttgcctttttggctatggacgcgacgggacagcaggagcagcatacaggaagtgtaggcggagatctctacggagtgcttctttactacaagtacgccgaggtgcctgacgccgccgcgctcgccgcgttctacgaggcgcactgccgcagccttgcgctcgtcggccgcgtccgcgtcggccccgacggagtaaacgcgacgctcggagggcagatgaacgcgctggagaagcatatcgcggagatgagctccaacgacttgttcgtgggcacagatttcaagctggcgtcctgcgacgaccctgtcgacgagagggtcgcccgggagtgcggcttcacctcactctccgttcgggtcgtcaaggagctagttaccctgtgctgcaaccccgcattggcacccccagagatttcgagtgctgggagacacttgtctgcggccgagttccattcggtgctccagaatgttgctgggactaattatgctgtggcatctgcggagaagaaggaagtggttgtcttggatgcaaggaatgtatatgagactcggatcggcaagttcaatgtgccaaatgcgaagaccttagatcctgaaattaggcaatacagtgacctgccttcttggatagacaagcatgctgagcagctgcatgggaaatcaattcttatgtactgcacaggaggtatacgctgtgaaatggcatcagcttatattcgctcaaaaggtgaaggatttgagaacgtttttcagctatatggaggcattcagcggtatctggagcaattcccagatggtggctattttgaaggaaagaattttgtatttgaccacagaatatcagtgggaagccttaaggaaaacatactcggtgcatgtttgatatgtggttcttcttttgatgactattcgtcacgctgtcggtgtagccattgcagaatgttggtcttagtgtgcccaacatgtcaggattctactgaggaatatgcatgcgagctgtgccaaaagaatggaaaagaaccgtgccaactatcaacaggacaagactgcaaaatacagagaggactatctgaaagctttgaaaagccatccataagctatcacaatgtgacctccaaagtttcctggggtgatggtaaggtagcgagcaaccgaaaaggttgaggatcctctgcttgcatggtttccgccagaacgcatccagttttaagggaagaacgtcagcactttccaagaagctgaagcatatcactgagcttgtctttgtcgacgcgcctcatgagctttcctttgtatatcaaccaatccggggacactgctccgacaaaccctcacctctgtctgttacaccgaaacggaaattcgcatggctcattgctccaaactcccactgcaaccctgaacaaaactggagggctgcagatgtgccgtttgaccctcttcagtaccagcaacaaaccgaaggcttcgaggaatcatacacctatcttgaaaatgcaatctctcacatggggaaatttgatggaatcctgggcttctctcagggcgctgccatggctgccttattctgcaggcagcagcagaagatgtgcggctttccaaagttcaggtttgggatgttctgctctggatatccagcacctgtgggcgattttggcaacgaaccaatcaagctcccctcgctccattgtttcggcaatggggatggtcatgataggcagatagcgaacagggcaagcgctgaacttgctggtttgttcgagcaggattgctgctccgttgttgagcatgatatgggccacataatccccacccggtcgccctacatcgatcggataaaggattttctttccagtttcctgtgaaatgttttgaactgactattgcgttgtaagttggtatacacaagttgggttctgaatggcattgactgtgtttgttggtcattaaaaaaaaaaaaatgattgtgctaaacaaattgggattctcctctctcgccgactctgagaggactacttgtgccacgacatcagaatgttttgaaataatatatttttggtattggtattattaaaaaaaaaaaaaaaaaaaaaaaaaaaaaa

SEQ ID NO: 12203 - DNA, 1615 bp, Zea mays
ccggccgggccgcacttctccgcgcggccatggcgtaggcccagggagatctagctagagtttcccgcatcggcctccgccacccaccgccgccgccgccccgccccgccccgccaaaggaacggaggatggaagccccgggctcgccctacgcctcctcgccggaatccgcccccaagcgtgcccctcgctccccaccgcagcagcagcctccctccgaggaaggagatgacaaggagaaaccaatacatttgaggtttctggtgtctaatgcgtcagcaggatgtatcattggcaagggtggatcaactattaatgactttcagtcccaatctggggctcgtattcagttatcacgtagccatgagtttttccctggtactaatgacagaatcatcatggtttctggactgtttggtgaagtaatgaaggccatggagttgattcttgagaaacttttggctgagggtgaagaattcaatgaagctgaagctagacctaaagttagacttgtagttcctaacaactcttgtggcgggataattggtaaaggtggagcaacaataaagtcatttattgaagaatcacatgctggaatcaaaatttcgccacaggataacaattatgttggtttgcatgataggcttgttacagttacaggaacctttgataatcagatgaatgcgatagatttgatactgaaaaagttatctgaggatgttcactacccagctaatttgagctccccatttccatatgcaggtcttactttcccaagctaccctggtgttcctgttggttatatgattccgcaggtgccatataataatgctgtgaactatggacctaataacgggtatggaggaaggtaccaaaacaacaagcccagtacacctatgagatctcctgctagtaatgaagcccaagaatctctgaccattggtattgccgatgaacacattggtgctgttgtaggacgtgctggaaggaacataacagagattattcaggctagtggtgctcggatcaagatatcggataggggtgacttcatatctgggacatctgacaggaaggtgacgattactggaacatcagaagctatccggaccgcggagtccatgatcatgcagagggtgtcagccagttcggagaggctatgataccagatatgtttgacggactgtgggggccgttgttgagtccgagcagcatgtttgatgcaagttattattgtttgttgcgttgcgccaatggtttagtcgaagatatataggtgcagcgtttgaatggatttgggaatagggctgagttatatcccgtggatgccacaacaaggcaggcaggcgccgctctgtgctagtggctgagtaggttgacaattcggtatgttgatttcctggttcccccccttccttcttgtgtgcctctccgtgtatggagatcctctgcagtgccatgtcggccagactgcgagcaaaagctgacttttctggcggacgaagataggagtagcatgcatctagctgtcttgtgaaagtactattatttatcaaaatacagaatcggtcctcaaactttggtacgttgttggctccctgaattcaagaaatcg

SEQ ID NO: 12204 - DNA, 1639 bp, Zea mays
gcacgaggaagtccaaaaaggcccaaccagcccccctccctctcctttcttcacttggaaatccatggtgtaggcccagagagatctagctagagtttcctgcatccgcctccgccccccaccgcctccacctccgccccccaccgccccgccccacagcaggaaggatggaagccccgggctccccctacgcctcctcgccggaatccgcccccaagcgtgccccacgctcccctccgcagcagcagcagtctccctccgaggaaggagatgacaaggagaaaccaacacatttgagatttctagtgtctaatacggcagcagggtgcatcattggcaagggtggatcaaccattaatgattttcagtcccagtctggggctcgtattcagttatcacgtagcaatgagtttttccctggtacaaatgacagaatcatcatggtttctggactgtttgatgaagtaatgaaggccatggagctgattcttgagaaactgttggctgagggtgaagaattcaacgaagcagaagctagacctaaagttagacttgtagttcctaatagctcttgtggtggtataattggtaaaggtggagcaacaataaagtcgtttattgaagaatcacatgctggaatcaaaatctcgccacaggataacaactatgttggtttgcatgataggcttgttacaatcacagggacctttgataaccaaatgaatgcaatagatttgatactgaaaaagttatctgaggatgttcactatccacctaatttgagctccccatttccttatgcaggccttactttcccaagctaccctggtgttcctgttggttatatgattccacaggtgccatatagtaatgctgtgaactatggacctaataatggttacggaggaaggtatcaaaataacaagccaactacacctatgagatcacctgctagtaatgaagcccaagaatctttgaccattggtatagccgatgaacacattggtgctgttgtaggtcgagcaggaaggaacataacagagatcattcaggctagtggtgctcggatcaagatatcagataggggtgactatatatctgggacatctgacaggaaagtgacgattactggaacacccgaagctatccggaccgcggagtccatgatcatgcagagggtgtcagccagttcagagaggtgatgagccccttctgaaggaagggcgtaggccattgctgtgtccgagcacagcagcgtgtttgatgcaagttaggaggatgtgggaactgctttccttttattttccccccttttttcttttttcctagcaagctcgagcagaaaaaagaaacaagctgttattgtttgttgcattgcgtccaaccgatggttttatgttagtataaactgctagtcgaagataattaggtgcagcgtttgaattgatttgggtttacggttgagttatatcccgtgtatgccataacaaaggcagtcgccgctctgttgctagtggcaagcgctgcctgtcctgtgtctgtttgtacgttgacaatttgattccgttgctcaaggatagaagaatattgatacaggagacccgaggactggtttggtttttgcaaaaaaaaaaaaaaa

SEQ ID NO: 12205 - DNA, 1592 bp, Zea mays
tcgagccgccgggagccctctcatcgctctcctccgcactcactggaagccccgcctaggcccgggccgatcgagctagagtttcccgcatcggcctccgccacccaccgccgccgccgccccgccccgccccgccaaaggaacggaggatggaagccccgggctcgccctacgcctcctcgccggaatccgcccccaagcgtgcccctcgctccccaccgcagcagcagcctccctccgaggaaggagatgacaaggagaaaccaatacatttgaggtttctggtgtctaatgcgtcagcaggatgtatcattggcaagggtggatcaactattaatgactttcagtcccaatctggggctcgtattcagttatcacgtagccatgagtttttccctggtactaatgacagaatcatcatggtttctggactgtttggtgaagtaatgaaggccatggagttgattcttgagaaacttttggctgagggtgaagaattcaatgaagctgaagctagacctaaagttagacttgtagttcctaacaactcttgtggcgggataattggtaaaggtggagcaacaataaagtcatttattgaagaatcacatgctggaatcaaaatttcgccacaggataacaattatgttggtttgcatgataggcttgttacagttacaggaacctttgataatcagatgaatgcgatagatttgatactgaaaaagttatctgaggatgttcactacccagctaatttgagctccccatttccatatgcaggtcttactttcccaagctaccctggtgttcctgttggttatatgattccgcaggtgccatataataatgctgtgaactatggacctaataacgggtatggaggaaggtaccaaaacaacaagcccagtacacctatgagatctcctgctagtaatgaagcccaagaatctctgaccattggtattgccgatgaacacattggtgctgttgtaggacgtgctggaaggaacataacagagattattcaggctagtggtgctcggatcaagatatcggataggggtgacttcatatctgggacatctgacaggaaggtgacgattactggaacatcagaagctatccggaccgcggagtccatgatcatgcagagggtgtcagccagttcggagaggctatgataccagatatgtttgacggactgtgggggccgttgttgagtccgagcagcatgtttgatgcaagttattattgtttgttgcgttgcgccaatggtttagtcgaagatatataggtgcagcgtttgaatggatttgggaatagggctgagttatatcccgtggatgccacaacaaggcaggcaggcgccgctctgtgctagtggctgagtaggttgacaattcggtatgttgatttcctggtacccccccttcctttttttttgagtcttgtgtatgtagatctgagtatgggttctttctttcacgtggccagaaagagcatggttggaagctaaagaaaaaaaaaaaaaaaaaagaggagggaaccgaaaaaaaaagaaaaaaagcggccctccagctactacggaa

SEQ ID NO: 12206 - DNA, 2454 bp, Zea mays
ggcgggataattggtaaaggtggagcaacaataaagtatgtatatcttcatagacctgttctactttgttgtgttatcagtggttttgttcccattatggtagttaattttattcacaagccggtgctatatgatgattcaacaaattaaccatgctacttaattaagaagcatactgttcctacttctgcaaatagtcttctagctgtttgctggtaaatttgtttttccagttctaaatatcttgtgactcatttatattcccattttatatatctgttcgttttttacattgctctgcatgttgaaagttggtatgttctcttttctcttcaggtcatttattgaagaatcacatgctggaatcaaaatttcgccacaggataacaattatgttggtttgcatgataggcttgttacagtcacaggaacctttgataatcagatgaatgcgatagatttgatactgaaaaagttatctgaggatgttcactacccagctaatttgagctccccatttccatatgcaggtgaatcctgttatctatgactacttatgttaccacatgtatatctgaaaatgcctccttatgacctcttccttacatctgtcttctatgtatcacatctgcatttcacacttcatgacagcatgcatttcttggaaacataggtgagctttcttgcatcatattgacatgtgggttttgcagtaccttttgccagtcatggtgaagcctgccatttctattatttatagaatcacaactttctggaattgattcctttcttcaaatttaatcaggtcttactttcccaagctaccctggtgttcctgttggttatatgattccgcaggtgccatataataatgctgtgaactatggacctaataacgggtatggaggaaggtaccaaaacaacaaggtggggggttctctgtgggttgctctgcttgttatctcacacttgtggacttgttctgcaggtgcaacatgcatgcattcagttcatctttgttgaaactgagctattctatgttttatttttgttatgcattagagtggtagtctggagcctggagggctgatatgcatgacatgttatctaatagaaacactgtcctgtaatgtaatcatgttatattttctgttctgaacaaattcaaagaaatctcatggagacaaactttgatagtacaagttggaggtctcgaattttaaggtaatatcgtgctagtattttcatttgcagtattgatctttgttggtgcaacctaacattagagtgatgttaatgagctgctgtagatgtttgatttaatctgcatgtgctattttttgtggagtttgatatttatgtgcttaaatttcgtgacttagcaatactggttgtatgctgagatgtctgaaaagctattacgttttctgtgaactgttgtgtagtttttaggtcgtgcatgccgtggaaagtgtgggtgtggcttttggtggaaaacatgaaagaacttcacccactgctacaatctaattgttttatatttttatcatgcatatctatactgttggtctgttggattaatttgagttgtgactatttctgttgatactttgcagcccagtacacctatgagatctcctgctagtaatgaagcccaagaatctctgaccattggtattgccgatgaacacattggtgctgttgtaggacgtgctggaaggaacataacagagattattcaggctagtggtgctcggatcaagatatcggataggggtgacttcatatctgggacatctgacaggaaggtgacgattactggaacatcagaagctatccggaccgcggagtccatgatcatgcagagggtgtcagccagttcggagaggctatgataccagatatgtttgacggactgtgggggccgttgttgagtccgagcagcatgtttgatgcaagttattattgtttgttgcgttgcgccaatggtttagtcgaagatatatatgtgcagcgtttgaatggatttgggaatagggctgagttatatcccgtggatgccacaacaaggcaggcaggcgccgctctgtgctagtggctgagtaggttgacaattcggtatgttgatttcctggtaccccccccttcctttttttttttgagtcttgtgtatgtagatctgagtatgggttctttctttcacgtggccagaaagggcatggttggaagctttcagcgtttcccattcaaaaaaaaaaaactctccggatggactcccgccgcagtgccatgtcggccagactgcgagcaaaagctgacttttctggcggacgaagataggagtagcatgcatctagctgtcttgtgaaagtactattatttatcaaaatacagaatcggtcctcaaactttggtaaaaaaaaaaaaaaaaaaccgagaccctcgtgccgaatt

SEQ ID NO: 12207 - DNA, 2529 bp, Zea mays
  misc_feature (2381)..(2381): n is a, c, g, or t
atcccacatctgtgagacacgagccgccgccagaagaccaccgcgcgccccggcccttcttccacgcctccgtcttccgcgcctggccacggcccaccgccgtccgcccttcgacgcctgacgcgccccggcaccgcccaggcaaggcggccgccggtagctacggacagcccaccgcgtccgcggcaccgcccaccggcagcagctaccggcaaccgcgcccgcggctctgtacccagggagtagcctatcatggggaagaggccgaggacaactctgcggcgcacgccagcacggggccttccaaagtccaagcgggccgacgagctgccatcgatgcctgattctgacaacgacgaaattgatgcatttcacaagcagcgggacatgatccctttcgacgccaatgatgtaagggagtcggaggatgatgatgtggagcagcccgtgtttgacctcaagggtgtttctgatagcgaaagtgatgacagcaaaggagaattgtccggtgacatggctgaagctgattatgaaggatgggacaaagggtatatttcgaaattaaaaagagcacagagggctgtcaaacaaattgctggaggtgatgatagcatggatgagcaggaggatgaaacacaagaaaatgtttggggcagaggtaaaaatgcatactatgctcctggtgaacaatctggtgatgatgaggtggattacgaggaggcacaaaggatacaaaaaaataaggaaaaaaggctgtctatgaaggattttggattagaagatggtgaaagtgatgaagagggtaatgcaacaaaggtatccaaccatgaatccaaaatgaaagaagactttgctgtcttatcaggcgatgagaaaatggatgtgctatacagttctgcccctgaactcgttagcttgttgtctgagttgaaggatgcccatgaagaacttagggccataggacagctaacaagtgaggtcacgtcttgtctaggcaaagataaaatgcaaccttttgaagtgaagaaagcttgtttgcttgctcattgtcaagctattaccttctatctccttatgaaatctgaggggttgtccgtacaggatcatcctgtaatttctcgcttgatagagaccaagaatatggtagagaagataaagcaaatcactttgaatccagtgagccaaaaagggtgcgctgatgaccatagtatgcattgtggcaccatccaaacagataagatagtctcattggacaaacaggagggcaaatttagcaatgtactagcactggataaagtgaaacaaggtgctgaagtctctgaatcaagaaagagtgagccttctaataacgattatcatgaagttaatgaacagaagaacaaggatgaacgaatgggcttgcatagccttgaaatgttgaaggtaagagcaaaccttgaggaaaggttaaagaaaaaagggctctataatttgacacgcttgaagccagagaagtcaaaaaccaggacaactagtgataaaagtggcctgcagacattggatgattttgatgatgaagtgctgaagaataaccaaatgatgaagcctagcaagcttgttgcagcagctgctaaatcaaataaaagcatgtttgtttctggtgatgatgaccttccgaagagagataatatcggagaaagacggagaaaacatgagcttcgcgtcctatcaagagtaggggctaactcagcagaggatcatgagctgccagatggtgacgcttctgaagaggaggaccaccatgagttgccagaaggtggtgatgaatctgaagacgacatccatcgggatgtcaaaagaaagaggactgaaaagctatcaaccaagaatgctctgtactcgccaactccgggcgttgaacatctggaggaagaaacagaaggcgatggcaagaggacgatttcgtatcagatcttgaagaacagggggttgactcgttccaggaataagaagaagaagaacccgcggaagaactacagggataagcacaagaacaagcttgtcaagcggaaaggccaagtgcgtgatatcaagaagcagtctggtccgtatggaggtgaaacgtctggcatcaacccgaatgtcacccgcggtgttcggttcaagagttgagttggtgcaagtagtatatttaggttggacatggaaggagttatttgtggtcttaacttggcattttctttattttttgtttgcatgtcattcgaacgcataaactccagaatttgtcttacggtattagatgagtacaattttgcttgcgaaaaatatcattatcaccgttgcctgtgtgtgaaaactaggtggtatacaaggaaatttgtatattatttcgaaccaanctatatattagtaggggctgtttatttagataaaggtccttaccgtgagacattgctagtagcatgacagcatgcataacatggcagcctttcattcttgacaataaccagctgtggaactgatatgggtccctaggtaattctacac

SEQ ID NO: 12208 - DNA, 1404 bp, Zea mays
ccacgcgtccgtgaaatctgaggggttgtccgtacaggatcatcctgtaatttctcgcttgatagagaccaagaatatggtagagaagataaagcaaatcactttgaatccagtgagcccacgcggccgcgctcgcgtccgcggtcgcctgggtggcaccatccaaacagataagatagtctcattggacaaacaggagggcaaatttagcaatgtactagcactggataaagtgaaacaaggtgctgaagtctctgaatcaagaaagagtgagccttctaataacgattatcatgaagttaatgaacagaagaacaaggatgaacgaatgggcttgcatagccttgaaatgttgaaggtaagagcaaaccttgaggaaaggttaaagaaaaaagggctctataatttgacacgctcgaagccagagaagtcgtcaaaaaccaggacaactagtgataaaagtggcctgcagacattggatgattttgatgatgaagtgctgaagaataaccaaatgatgaagcctagcaagcttgttgcagcagctgctaaatcaaataaaagcatgtttgtttctggtgatgatgaccttccgaagagagataatatcggagaaagacggagaaaacatgagcttcgcgtcctatcaagagtaggggctaactcagcagaggatcatgagctgccagatggtgacgcttctgaagaggaggaccaccatgtgttggcagaaggaggtgatgcatctgaagacgacttctatcgggatgttaaaagaaagaggactgaaaagctatcaaccaagaatgctctggactcgcaaactccgggcgttgaacatctggaggaagaaactgaaggcgatggcaagaggacgatttcgtatcagatcttgaagaacagggggttgactcgttccaggaataagaagaagaagaacccgcggaagaactacagggataagcacaagaacaagcttgtcaagcggaaaggccaagtgcgtgatatcaagaagcagtctggtccgtatggaggtgaaacgtctggcatcaacccgaatgtcagccgcagtgttcggttcaagagttgagttggtgcaagtagtatatttaggttggacatggaaggagttatttgtggtcttaacttggcattttctttattttttgtttgcatgtcattcgaacgcataaactccagaatttgtcttacggtattagatgagtacaattttgcttgcgaaaaatatcattatcaccgttgcctgtgtgtgtgaaaactaggtggtataattatcaaggaaattgtgtatattatttcgaccccatatatattagtaggggctgtttatttagataaaaaaaaaaaaaaaaaaaaaaaaactcgaggaagggcgccggtacc

SEQ ID NO: 12209 - DNA, 1538 bp, Zea mays
ctcgaggccggccgggaggactatagattattattattatcataggggtcggatcctcctctgctcttatccactcgcctactacctcctctttctccgcccacctccacccccttccctgctctctcccactactgccccctttcgccgtctcccttctcccatcccttccgccgtttctgcctgctgcgaacccggcggcaaccgacctcgatcgtcgccgttcgtccgccgaccaccgccaagaggcagagttgatatggccctcaagaccccgcacctcccatccaatttcgcgaggcggccaagcagccaccacagcttcagccagtggcactcgcctccgcaccacccaaagcttcctccaaggcccgacccgcagacaagagttgccattgccacgaagccgccgccgccgccgcatgtcgtccgcaagaggagcacgacgtcgacgttgatgaggtgcagggacggcctaggcctacacggcttcacggacgacgaggctgttcatcagaccccggaaccggaagaccaccagaccaccgagctccccgtcgtgacgcacccgtcggtcgtcttccccggcgccacgctgcagctgcacgcgttcgagttccggagccgcatcatggcgcacaccctgctgcagcagggcctcagcttcggggtcgtctgccgcgggggggtagcggacgtggggtgcgtcgtgcacgtcgtggagtgcgagaggctcaccgacggccgcttcttcctcacctgcgtgggcagggaccggttccgggtcgtcgagaccgtcaggacgaagccctacgcggtcgcacgggtccaggtctttcgggaccgtgaccacagccaccaccaccaccaccacgacctgatgcagcaggtggagcggcacctcgggaacgtggccgcgctcgcggacaagctgggccagaagccgccgccgccgccgctgccgtaccgccagggcgaccggcggctgcacaccgccgcctcgctctcgttcctcgtcgcgcgcctgttcgtcgacgaccgccgggagcagcaggcgctgctgcggatggacgacgccgcgcagcggctggcgcgggagggggagtacctggagcgcaggagcaagtacctggcggccttggcggcgatcaaggacgcgttccagcacttgtcctgcaacgagaagtagattgcggacctgtacattttcaagggtagaagaactgtacaagttccctggtgaggtctgaccgtctgttaatacctaagggtttgattagtgagttggtctgtttttgtatgttggtttattcctggataagattgggacgatgatctaaagctctaaaaaaataataagaagggcaataagcaaccagactatatgcttgctgttggtattgcttcagctacgaccagccctgctgctgcctgtacattcttgcatggcctttctgtgctgccacttctgctgctatttctaataaagaagtgctgctatttctaataaactgatgtactcattcgtgtgtaaaaag

SEQ ID NO: 12210 - DNA, 1827 bp, Zea mays
aagccccaaacgcacgaccaccgtctccaccacggcaccaccatcactccaacaccaccgcctccctctccgttctcttcctcccaacgactcaaaccgccaccgtcgcggctccctgaaccatcagaccagcccagagcccagcccaccacaaacgctgctgctgctggagagaggggcgcgcgggcggacgggagcgatgggcaactgccaggcggcggaggcggcggcggtcatcatccagcaccccggcgggaaggtcgaccggctctactggtccaccaccgccgccgaggtcatgcggaacaacccgggacactacgttgccctcgtcatactccgtgttcctgcagataacaagcccgccgccgccggggacgccgcggcgtcctccggccccggcagtggtggtgccaagatcaccagggtcaagctgctgaagcccaaggacacgcttctccttggccagggctgccgcctcatcaccgcgcaaggtttgttagcactcagctgtcctggccatgggcttaaggcccatggcgcggttcaatttactcgggcaatcttgaaattctcaacccgatcgtgctccgcgcgcagaggtgacgaaggcggtgcgggcgaggaagaacgagaagatgcagcggtgcgaggccatcaggcagcagcacgagcagctccggcgcggcgacggggctcaccagagctcttccagccaggtcggtatgcgattctctgacaccatttttttctttttatttcctggtgcaacaagcagctactgattcttctgtggcttcaggacgggaagcaggacaaggaccggcaccggggaagaggccggcactggcggccggtgctgcagagcatctccgagtccgcgagccagagcagcagcagcatcgtctctgaatccgccaccagctaatgctactgaccggactgtgccatccggccggtgctctctttctttctttttcttttgggatttctgtttgcttgttagtatagagtgcttgagcctagccagaaatggaaaaaaaaactgtaaatcagagtgtcagggcaggactaataggaagtttgtttcgtctgtcaatgtgatttggcatggtgaaactgacactaaaaccgcgtattcagatcaatcgagtggtttgccaattgcaacaaaaaaaaaaaaaaaaactaagcaaaaaggaagaagaaaaaaagatgcaatccttgctcttcgatccagaggagggccctaagaattttaactcatctcgagagaaaaggttcaagaaccggactcttgtaccatactgtattattagtcttcgcatcactagcagaaactttggcaatcgtaactttgcaaagcattaggtcagtggcgaagactaaaaatcgtatcgatcttataactaaaaaatgtgtcaatatttggtcatttgcggagactatgcaaatctgagtatatgacagataaacagaacaaaagaacttcaatttcagactggagataagcatatctcgaagctgctggagactcgagactcgagaaaaagagacatacaaaaaaaaaactgtaacagagaccatcgtacacacacatctggaatcttgagcactgcttgcgtccaaactactcataaactaggggcagcaccgttcttcgtagagatgggcaatggtgaagacccgctgggctttgctatcttagatctggccctattagactaaaaactcttagtttcaatactcgtacctgttagaatgatattagggtttgggattctctttccgcgtgtttggttccatgctgttctcatgcagctgcag

SEQ ID NO: 12211 - DNA, 983 bp, Zea mays
ctcgaggccggccgggaaactcacgaccaccgtctccaccacggcaccaccatcactccaacaccaccgcctccctctccgttctcttcctccccccggcccgaaccgccaccgtcgcggctccctgaaccaccagaccagcccagagcccagcccaccacaaacgctgctgctgctggagagaggggcgcgcgggcggacgggagcgatgggcaactgccaggcggcggaggcggcggcggtcatcatccagcaccccggcgggaaggtcgaccggctctactggtccaccaccgccgccgaggtcatgcggaacaacccgggacactacgttgccctcgtcatactccgtgttcctgcagataacaagcccgccgccgccggggacgccgcggcgtcctccggccccggcagtggtggtgccaagatcaccagggtcaagctgctgaagcccaaggacacgcttctccttggccaggtctaccgcctcatcaccgcgcaagaggtgacgaaggcggtgcgggcgaggaagaacgagaagatgcagcggtgcgaggccatcaggcagcagcacgagcagctccggcgcggcgacggggctcaccggagctcttccagccaggacgggaagcaggacaaggaccggcaccggggaagaggccggcactggcggccggcgctgcagagcatctccgagtccgcgagccagagcagcagcagcatcgtctctgaatccgccaccagctaatgctactgaccggactgtgccatccggccggtgctctctttctttctttttcttttgggatttctgtttgcttgttagtatagagtgcttgagcctagccagaaatgaaaaaaaagaactgtaaatcagagtgtcagggcaggactaataggaagtttgttccgtctctcaatgtgatttggcatggtgaaactgacactaagaccgcgtattcagatcaatcgagtggtttgcc

SEQ ID NO: 12212 - DNA, 999 bp, Zea mays
  misc_feature (899)..(899): n is a, c, g, or t
  misc_feature (919)..(919): n is a, c, g, or t
  misc_feature (926)..(926): n is a, c, g, or t
gccggccgggtcggactccaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgctttcgtcttttcccctctgctcgagtacgagcggctactcccggcggcggcggcgatgagcgcggtgaacatcaccaacgtggcggtgctggataaccccaccgccttcctcaatcccttccagtttgagatctcctacgagtgcctcgtgcccctcgacgacgatctggagtggaagcttatatatgttggatcagctgaagatgaaaactacgatcaacagcttgagagcgtgcttgttggccctgtcaatgttgggacctaccgttttgtccttcaggctgacccaccggatccctcaaagatccgtgaggaagacataattggtgtgactgtgctgctattgacatgctcttacatgggccaggagttcatgagagtaggctactacgtgaacaatgattatgacgatgaacaattgagagaagagcctccagcaaaggtgctaattgaccgggtgcaaagaaatatcttggccgacaagccccgagtcaccaagttccctatcaacttccatcctgaacccagtacaggcccggggcagcagcagcagcaggaaccccagacgacctcgccagaaaaccacacaggcaatggcgaggccaatggtagcaagcctgaggctgaccaatgaacacagttggcctcagatattttgatgcgtgccccttacaggttgtgctgtaatattaaaaacgggattagtggttgtgcattggcctgggatcctgaactctgttctgntacttgagatgcaaatgtgnggtaccntggatggtttcttaggcacgagtatttaagcctgctctgcaattcagcaaaaaaaaaaaaaaaaggcccctag

SEQ ID NO: 12213 - DNA, 1086 bp, Zea mays
  misc_feature (950)..(950): n is a, c, g, or t
gcacgagagcttctctggccctctcactccaaacatcgggctccaggccgtctcccgccaacccaaattcgcttcccgccgctccccattaaacccgcttgaaaggtcgcgccctcgagcagggcaacccctgaccacaaatccgatccgcagccgccgtgcctcgctttcgtcttttcccctctgctcgagtacgaggagtacgagcggctactcccggcggcggcggcgatgagcgcggtgaacatcaccaacgtggcggtgctggataaccccaccgccttcctcaatcccttccagtttgagatctcctacgagtgcctcgtgcccctcgacgacgatctggagtggaagcttatatatgttggatcagctgaagatgaaaactacgatcaacagcttgagagcgtgcttgttggccctgtcaatgttgggacctaccgttttgtccttcaggctgacccaccggatccctcaaagatccgtgaggaagacataattggtgtgactgtgctgctattgacatgctcttacatgggccaggagttcatgagagtaggctactacgtgaacaacgattatgatgatgaacaattgagagaagagcctccagcaaaggtgctaattgaccgggtgcaaagaaatatcttggccgacaagccccgagtcaccaagttccctatcaacttccatcctgaacccagtacaggcccggggcagcagcagcagcaggaaccccagacgacctcgccagaaaaccacacaggcaatggcgaggccaatggtagcaagcctgaggctgaccaatgaacacagttggcttcagatattttgatgcgtgccccttacaggttgtgctgtaatattacaaacgggattagtggttgtgcattgccctgggatcctgaactctgttctgtaacttgagatgcaattgcggggtacctggnatggtttcttaggcacgagtatttcagcctcctctgctgttcagctgcatcgaaagcatgtgctccaagaacgcaagcatgaggaaatacagcaaaaaacagcagattaactgaaaaaaaaaaaaaaaaaaaaaaa

SEQ ID NO: 12214 - DNA, 1047 bp, Zea mays
gtcaccattacaccgcccgagaggccgctagaaatccgatcccgagccgccgcgtcttgctcgcgtcttttcccctctgctcgagcacgcgcgggcgcgcggctgctcccggcggcggcgatgagcgcggtgaacatcaccaacgtggcggtgctggacaaccccaccgccttcatcaaccccttccagttcgagatatcctacgagtgcctcgtgcccctcgacgacgatctggagtggaagcttatatatgttggatcagctgaagatgaaaactacgaccaacagcttgagagtgtgcttgttggccctgtcaatgttgggacctaccgttttgtcctccaggctgatccaccggatccctcaaagatccgtgaggaagacataattggtgtgactgtgctgctattgacttgctcttacatgggccaggagttcatgagagtaggctactacgtgaacaatgattacggcgatgagcagttgagagaggagcctccagcaaaggtgctaatcgatcgggtgcagagaaatatcctggccgacaagccccgggttaccaagttccctatcaacttccatcctgaaccaagtacaggcacggggcggcagcagcagcagcaggagcctcagacggcctcaccagagaagcacgcaggcagcggtgagggcaatggaagcaagcctgaggctgaccaatgaacacagtcgacttcaagtatttttgaagcgcgtccctacaggttgtgctgtaaggttacgaacgggattagcggttatacattgccctgggatcctgtttctagcacatggtggctgtttagaactctttgttctgtacacattgagatgcaaatgctgggtagtgggtagctgggtgtttccttggcaaagagtattttaagcctgttctcctgcaattgctttatgcttctttagagtttagagtagcggtttacctcaaaactaactggctagtcttggtcaccagctttggcctttgcggtatagcttgtaacgggaatccttctggttcacttaggcaag

SEQ ID NO: 12215 - DNA, 1044 bp, Zea mays
tcgaaaggccggccgggttccggaaaaaaaaaaaaaaaaaaaaaaaaaaccgcagaccccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgcggtgcctcgctttcgagtacgagcggctactcccagcggctgcggcggcggcggcgatgagcgcggtgaacatcaccaacgtggcggtgctggataaccccaccgccttcctcaatcccttccagtttgagatctcctacgagtgcctcgtgcccctcgacgacgatctggagtggaagcttatatatgttggatcagctgaagatgaaaactacgatcaacagcttgagagcgtgcttgttggccctgtcaatgttgggacctaccgttttgtccttcaggctgacccaccggatccctcaaagatccgtgaggaagacataattggtgtgactgtgctgctattgacatgctcttacatgggccaggagttcatgagagtaggctactacgtgaacaatgattatgacgatgaacaattgagagaagagcctccagcaaaggtgctaattgaccgggtgcaaagaaatatcttggccgacaagccccgagtcaccaagttccctatcaacttccatcctgaacccagtacaggcccggggcagcagcagcagcagcaggaaccccagacgacctcgccagaaaaccacacaggcaatggcgaggccaatggtagcaagcctgaggctgaccaatgaacacagttggcttcagatattttgatgcgtgccccttacaggttgtgctgtaatattacaaacgggattagtggttgtgcattgccctgggatcctgaactctgttctgtaacttgagatgcaaatgctgggtacctggatgttttcttaggcaaaaaaaaaaaaaaaagctctgcaatttcagcgagatgtgatc

SEQ ID NO: 12216 - DNA, 981 bp, Zea mays
ccggccgggaccattcgatgtacccaaacgccaataaatcccattgggtgcctcgaggccggccgggaccctcacgcatacgcttcatagcgctgatctcgcgcagcaggagaaaactgcagcagcgcttgactactgcatccatggcggccacttccagttccatgtcgtcggtcatcttcctcctactcgctaccttggccgccgatgccagcgcggccaccttcaccgtcaaaaacaactgtaactacacggtgtggccagcagtcatcccggccggcggaggcgagcggctggacccaggacagacgtggaccgtctccgtgccccccggcacaaccggccggttctggggccgcacaggctgctccttcagcggtggtggaagcggcggccactgcgataccggtgactgcgctggcgccctcaattgcaccgtctccgggcagcctcccacgacgctggccgagttcagcatcggcggcgccgaggatttctacgacatctcggtggtcgacggttacaacctgcccatggccttctcctgcagcaccggcgttggtctggtgtgcacgagtcccgcctgccctgccgcgtacctgtttccgaacgacgattccaagacccgtgggtgcagcagcaacagcaactaccagctcaccttctgtccatgaggtgtcggctactctcggatgcaccgtgcacgcacagcatagatggcattagagtatgtatgcatggaacacctcctaaataatttttaaaacgtattaagcaaataaaggtgtgggttttaaaataaaagcttgtgatgagttgtatagagaatttggaacagcgccgtagacatcgtctgccatagatatatgcgcttgtgattcaagattgtgatgagtgagatcgtgtggttagaattgtatacaagaaatcataatcttaatggatcgatatgtatccaaaaaaaaaaaaaaaaaagcggcc

SEQ ID NO: 12217 - DNA, 934 bp, Zea mays
  misc_feature (900)..(900): n is a, c, g, or t
cattgggtacctcgaggccggccgttaagcgactcggcctgccgcgatttttatcatccgccggcgcgcccgggccggccgggacatatcagcaccgcccctgcctcgaggttgcgtgttttgttctctgtgagcgccgtgggtgttgatggcgtcaacggcgtactcgcggccatccaagccgccagggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcgacagctcgtcgtccatggtgttgaagaacatgccgccagcaacgacgacggtgccgggtacagctacaggggcgctgccggtggagcaaaaggcccaagtggaggagcagaaagaggttcgtgaccctgaggcggacccgcacatgccaaacttaccggaggtcacagaaaaggatcagcaggaggaggccacggcgacgaagccagccggtggtgccattattacagaggccaagatcacctgcgacgagaacggcgtcgacgagggcttcccgtacgcacggccgccggtttgtgagctagccggcgacatccgtgtcagtcctaaggagaaaaccatgtacttcgttaacccgtccggcgccggcccgttcgactccaacggggagaagaagatccgaccgttcgcccgcaaggacgacttcctcctccccggcgtcgtggaggtcacgatcaagtccgtgtcctcggccgcagccgcgccgcggtgcgcccgccggcacgacgtcccgggtgggtggtcgtctccgtggccgggtacacggacaacttnctcccacgacacacggacgtgctgatcccgctgc

SEQ ID NO: 12218 - DNA, 1034 bp, Zea mays
  misc_feature (915)..(915): n is a, c, g, or t
  misc_feature (958)..(958): n is a, c, g, or t
ggggtggacaagtcaacagagggagggaagggcgacgaagccgcctcctcgtttgtcttggtcgtagtactcgcgccatcagcaccaacccacgccacggcaccctcccccgccccaaccccaacgaacaacgaggtatacaattcatttcccaacagatcaatcatcctctacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacggcgtactcgcggccatccaagccgccagggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcgacagctcgtcgtccatggtgttgaagaacatgccgccagcaacgacgacggtgccgggtacagctacaggggcgctgccggtggagcaaaaggcccaagtggaggagcagaaagaggttcgtgaccctgaggcggacccgcacatgccaaacttaccggaggtcacagaaaaggatcagcaggaggaggccacggcgacgaagccagaggccaagatcacctgcgacgagaacggcgtcgacgagggcttcccgtacgcacggcccgccggtttgtgagctagccggcgacatccgtgtcagtcctaaggagaaaaccatgtacttcgttaacccgtccgccgccggcccgttcgactccaccggggagaagaagatccgaccgttcgcccgcaaggacgacttcctcctcccncggcgtcgtggaggtcacgatcaagtccgtgtcctcggcgcancccgcgccgcggtgcgccgccggcacgacgtccccggtggtggtcttctcccgtggcgggtacacggacacttctt

SEQ ID NO: 12219 - DNA, 3479 bp, Zea mays
ccttcacctctccctactccacatttaaatggtaaaaaactaaaattatatataaataagaatttgaacaatggttgttggctctaaacctacattcacatctatcagaccaacataatacatatatttttatgtttttatatcctacactcaagaataaataaaaactatagcaatgtacgtgcacttaagtagtaaggatatggagctatcctaaacgcatagacaaattatagttgtactagtggacctgctctaggaccaatatgggtgaatgataggtacaaattttttttaaggttacaaagctgtcataataagggctagtttgaaaactcgaattctcttaggtttagaggagattgaggagaaaatttgttcattccccactcacgttctatttggttgtggaatttgaacgataatgtaaaggtcatctgataacgttgtaaatagaaaagaagttagccattctcatattgtttggtctagcttaactgatattctatcgtggggaggtgtattagataacgtttcattttttatacatctgtattccattagaaggtagcagattacattgggctcaaacaaacacaacgcagcataagtagttgtcgttgtaatcaaatcaggtcacattccactaaaccaaacaccacctcaatccccttcaatcttgaagaggatttgagtttttcaaactagcctagattgacagggctccggggacaatgttatggcctaaccgacggaatcctccgtcgtaacaaggcctaaccgatggaatcctccagctcagtcacggtggagtgtcaaacgaagcaagcaataggtaggtctgttcccggcgacctgttccatgctcgcatgcgtctccatcctggggacgccatctccatcgccaagccaaccaagccctgttgcgagattgaaataaggtgccgtacgtgatgccaaaagtcgagtaaaagatggacgagtcctactgtcaatctaacatggaattaggtaagcaatccgaattattgggcatcggttgtggacaagtcaaacagagggagggaagggcgacgaagccgcctcctcgtttgtcttggtcgtagtactcgcgccatcagcaccaacccacgccacggcacaccccaaccccaacgaacaacgaggtatacaattcatttcccaacagatcaatcatcctctacatgttacagcgactcggcctgccgcgatttttataatgcgccgcggtggccgtcgctagtggtacatatcagcaccgcccctgcctcgaggttgcgtgttttgttctctgtgagcgtcgtgggtgttgatggcgtcaacggcgtactcgcggccatccaagccgcctgggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcgacagctcagtcgtccatggtgttgaatccgattccctaccaagaattagaattcgtctcttgcgtgtgcggtgagagttccttcaatgaaccgggccgcagacagctcgtcgtccatggtgttgaagaacatgccgccagcaacgacgacggtgccgggtacagctacaggggcgctgccggtggaggagcagaaagaggttcgtgaccctgaggcggacccgcacatgccgaacttaccggaggtcacagaaaaggatcagcaggaggaggccacggcgacgaagccaggtattttgcatttcttgtttgaaagggtatctcattctcaaactactacctattaaccgattaaccaatactacgatgtaagtaatcaagacatacatgcgcaatcctcagccggtggtgccattattacagaggccaagatcacctccgccgccaacggcgtcgacgagggcttcccgtacgcacggccgccggtttgtgagctagccggcgacatccgtgtcagtcctaaggagaaaaccatgtacttcgttaacccgtccggcgccggcccgttcgactccaacggggagaagaagatccgaccgttcgcccgcaaggacgacttcctcctccccggcgtcgtggaggtcacgatcaagtccgtgtcctcggccgcagccgcgccgcggtgcacccgccggcacgacgtcccggtggtggtcttctccgtggccgggtacacggacaacttcttccacgacaacacggacgtgctgatcccgctgttcctcaccacggcgcacctgcaaggagaggtgcagctcctcgtcaccaactacaagccgtggtgggtgcgcaagttcacgcccctgctcaggaagctctccaactacgacgtcatcgacttcggcaaggacgacgaggtgcactgcttccgggcaggccacctcgggatgtaccgcgaccgcgatctcatcatctcccctcaccccacgcgcaacccgcgcaactactccatggttgactacaaccgcttcctccgccgcgccttcaacctgccgcgcgacgcgccggcggtgctcggggaggagaccagcgccaagcctcagatgctcatcatcgagcggaagggcacgcggaagctgctcaacctacccgaggtgtccgcgctgtgcgaggcgctcggcttcgcggtgaccgtggcagaggccgacgctgacgtgcgtgtgttcgcggagaaggtgaacgcggccgacgtgctcctcgcggtgcacggcgccgggctcacgaaccagatcttcctgcccacgggcgccgtgctcgtgcagatcgtgccgtggggcaagatggactggatggccaccaacttctacggccagccggcgcgcgacatgcgcctccggtacgtcgagtactacgtctcggaggaggagacgacgctcaaggacaagtacccaagggaccactacgtgttcaaggacccaatgcacatccacgcgcaggggtggccagcgatcgccgagatcatcatgaagcaggatgtcatggtcaacatgacaaggttcaaacccttcttgctccaggcgctcaacgagttgcaggactagctgcagctggagaagggtgattccctttgtatggctcgatacggacagttcggatagggcgataggccagcacagatgcggtacaggagggcctttcgtttgtttcccttttttatttgtcattttaaatcaactaaaattgatatttttatttgggactatttaaaaaaaaaaaaaaaacgccatttgcggccgatacaagttaggatctaattgagaaattttcaccagctacaaactcaccaaaaataattttattttaccaaaagttactcaaatggaatagattaacgaagtccagattattcactaatatatgaatctgaggactaaattcaacagatttg

SEQ ID NO: 12220 - DNA, 2048 bp, Zea mays
gtcttggtcgtagtactcgcgccatcagcaccaacccacgccacggcaccctcccccgccccaaccccaacgccccgagagggccgcacgtcttttcccaacagatcaatcatcctctacatgttacagcgactcggcctgccgcgatttttataatgcgccgcggtggccgtcgctagtggtacatatcagcaccgcccctgcctcgaggttgcgtgttttgttctctgtgagcgtcgtgggtgttgatggcgtcaacggcgtactcgcggccatccaagccgcctgggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcgacagctcgtcgtccatggtgttgaagaacatgccgccagcaacgacgacggtgccgggtacagctacaggggcgctgccggtggaggagcagaaagaggttcgtgaccctgaggcggacccgcacatgccgaacttaccggaggtcacagaaaaggatcagcaggaggaggccacggcgacgaagccagaggccaagatcacctgcgacgagaacggcgtcgacgagggcttcccgtacgcacggccgccggtttgtgagctagccggcgacatccgtgtcagtcctaaggagaaaaccatgtacttcgttaacccgtccggcgccggcccgttcgactccaacggggagaagaagatccgaccgttcgcccgcaaggacgacttcctcctccccggcgtcgtggaggtcacgatcaagtccgtgtcctcggccgcagccgcgccgcggtgcacccgccggcacgacgtcccggtggtggtcttctccgtggccgggtacacggacaacttcttccacgacaacacggacgtgctgatcccgctgttcctcaccacggcgcacctgcaaggagaggtgcagctcctcgtcaccaactacaagccgtggtgggtgcgcaagttcacgcccctgctcaggaagctctccaactacgacgtcatcgacttcggcaaggacgacgaggtgcactgcttccgggcaggccacctcgggatgtaccgcgaccgcgatctcatcatctcccctcaccccacgcgcaacccgcgcaactactccatggttgactacaaccgcttcctccgccgcgccttcaacctgccgcgcgacgcgccggcggtgctcggggaggagaccagcgccaagcctcagatgctcatcatcgagcggaagggcacgcggaagctgctcaacctacccgaggtgtccgcgctgtgcgaggcgctcggcttcgcggtgaccgtggcagaggccgacgctgacgtgcgtgtgttcgcggagaaggtgaacgcggccgacgtgctcctcgcggtgcacggcgccgggctcacgaaccagatcttcctgcccacgggcgccgtgctcgtgcagatcgtgccgtggggcaagatggactggatggccaccaacttctacggccagccggcgcgcgacatgcgcctccggtacgtcgagtactacgtctcggaggaggagacgacgctcaaggacaagtacccaagggaccactacgtgttcaaggacccaatgcacatccacgcgcaggggtggccagcgatcgccgagatcatcatgaagcaggatgtcatggtcaacatgacaaggttcaaacccttcttgctccaggcgctcaacgagttgcaggactagctgcagctggagaagggtgattccctttgtatggctcgatacggacagttcggatagggcgataggccagcacagatgcggtacaggagggcctttcgtttgtttcccttttttatttgtcattttaaatcaactaaaattgatatttttatttgggactgtttattaacacgccgttgtgcaatttaaaacagatacaagttaggatctaatgaagaaaaaaaatacaaagac

SEQ ID NO: 12221 - DNA, 1103 bp, Zea mays
ggtaccctcgcggccggccgggagaggcacccacccactcatccgtccgtccatccaatgcgatggtgtcgttggcgcgccggccgctctccgccgccgtacctgcgggcaacctcctcggcatccatctcttccggtgccccgacgccgttggcatcgtcgccaagctctcggaatgcatcgcctcccgcggtggcaacatccacagcgtcgacgtcttcgtccccgacgacaaacccgtcttctactcccgcagtgagtttacctacaatccaaggctctggccgcgtcatgagctccacaaggatttcctcaatctctcccgctgcttcaatgcgcaaacctccaccgtacgagttcccgatcttgaccccaaatacaacatctccatcctcgcatcaaagcaggaccactgcttgttcgatttgctctatagatggcaagaaggcaggcttccagtacacattaattgtgtcattagcaaccatgatagaccacaagataatcatgtacggcgttttctccagaggcatggaatcccataccactacttacccaccgcacctgccaacaaaagagagaaagagatcttggaattgatccagggtacagattttgttgtgctggcaagatacatgcagatactctcagaaaacctgttaaaagcatatggtaaagacattatcaatattcatcatggccttcttccctcatttaagggagggaatccttcaagacaggccttcagtgctggggtgaagttaatcggggcaactagccatttcgttactccagaacttgatgctgggccaatcattgaacagatggttgaacgagtctctcaccgagacacgttacagagttttgttgtcaagtctgagaaccttgagaagcagtgcttagcagaggctatcaagtcatattgcgagcttcgtgtcctaccatatgaactcaggaagactgtcgtgttctgatctgagctccctttattttctgtcttattgtacttttatatggattgataaaatgaattttttagcttaaatatatccatcccctcgacattatttaaaaaaaaaaaaaaaaaaaaaaaaaaagcggcc

SEQ ID NO: 12222 - DNA, 999 bp, Zea mays
  misc_feature (994)..(994): n is a, c, g, or t
actcctacgcgcggctggccgggagaagaccggccgggatcaaaaagatagacacactcaaacaccgcaagctaagaagatcccttgctgaattcagagagcacaaacacaaaagcgagtgcaaaaccaaatggctgcctcgacctacttccttcttgttgcctttctagcgttggtcacatctcaggccattgcctctgaccctagcccgctccaagacttctgtgttgccgacaaatactctccggtgaaggtaaatggatttgtttgcaaggaccccatggctgtgaacgcagatgacttcttcaaggcagcaaaacttgaccaaccaagggacaccaagaacaaggtgggatccaacgttactttgatcaatgccatgcagttaccaggactcaacacattgggcatctcgttggctcgcattgactacgcacccttaggtcaaaatcctccacacacccacccacgtgccacagagatcctcaccgtgcttgaggggaaactctatgttggatttgtcacctccaaccaagctaacagcaacaacaagctatttaccaaggtcctcaacaagggcgatgtgtttgtattcccccaaggactcatccacttccagttcaacccggtccatgacaagccagcagtcgcgatcgctgcactaagcagccagaaccctggagttattactattgcgaatgcagtctttggatcaaagccacctatctcggatgatgtcttggccaaggccttccaggtgcaaaaggggacaatcgattggcttcaagctcagttttgggagaacaaccactactaaaacaattaagtctgggttcatcatttgatattatagaaatttatttgcattttacatactactccatgtatttactttttcctaggctacgacccataataaaaataaatgttctgtgtttctgaacaaaaaaaaaaaaaaaaaaacctagtgggctcaaaaaaaaaaaaaaaaaanaaaaa

SEQ ID NO: 12223 - DNA, 1037 bp, Zea mays
gtggcggccgcttcgaaaggccggccgggttgcggaaaagatagacacacacacaaacaccgcaagctaagaagatctcttgctgaattcagagagcacaaacacaaaagcgagtgcaaaaccaaatggctgcatcgacctacttccttcttgttgcctttctagccttggtcacatctcagtccattgcctctgaccctagcccgctccaagacttctgtgttgccgacaaatactctccggtgaaggtaaatggatttgtttgcaaggaccccatggctgtgaacgcagatgacttcttcaaggcagcaaaacttgaccaaccaagggacgcccaccaagaacaaggtgggatccaacgttactttgatcaatgtcatgcagttaccaggactcaacacattgggcatctcgttggctcgcattgactacgcacccttaggtcaaaatcctccacacacccacccacgtgccacagagatcctcaccgtgcttgaggggaaactctatgttggatttgtcacctccaaccaagctaacagcaacaacaagctatttaccaaggtcctcaacaagggtgatgtgtttgtattcccccaaggactcatccacttccagttcaacccggtccatgacaagccagcagtcgcgatcgctgcactaagcagccagaaccctggagttattactattgcgaatgcagtctttggatcaaagccacctatctcggatgatgtcttggcaaaggccttccaggtgcaaaaggggacaatcgattggcttcaagctcaattttgggagaacaaccactactaaaacaattaagtctgggttcatcatttgatattatagaaatttatttgcattttacatactactccatgtatttactttttcctagtctacgacccataataaaaataaatgttctgtgtttctgaactataattgtaattgtgttcctagtgggctcaaaaaaaaaaaaaaaaaatcgaaagtgaatgtaatgtatatgacactctatcgtttcccatttt

SEQ ID NO: 12224 - DNA, 1831 bp, Zea mays
caatggaaaaacagtttgggcatttttttcaggtttgaagaaggattccttcgtgatgacatgcggtcacagaaatccatccaacctcacggtgcgcctgattgaggcgccctagctaggcagcgcacggggccacaggggaccatgacccgttttcgcctccacggcggtggaagtataggggtgcatcgaacatggacgctatcggcatagagcgcgcgctggctgagcaatgtagggcccgatcccaaccaccaggagcctaccccaatgcacaactccgctgagttgaaagaaagcacagttttctctgtctcgacgttgacaaatctacgtactaagaagcaatcaagtgcttggtctagtaaaacgtgtagggcacatgttggtttaggtgtggagctgacgatcccattgctgactatttctatatttcttgtgagttgactctttctatgtacgtagcaaattaaaagctcggttgtccaatgaaacatttttcttgtttattacgcaactatcacagtccaccatcagccacctgaaaacgcaaaaatggaaagaaagaaagaatacactttctttagaagcaaagagacgaccaagcagcacgttgaatctataaggcaaatgtattgtttcagcagctgcagattaattcaagcgcagccagagactgtttctgctgataggttcaacttaaggctcattcagccattggtacgtacatgcatgctctacgcaggtgctatatataacctcaccatccccatgcccaaagcaccaacaagctaagaagcgtcattgctgaattcagagagcacaaacaccaaatggctgcctcgacctacctccttctcgttgcttttctagcactgctcacttctcaggccattgcctctgatcctagcccgctccaagacttctgtgttgccgacaaacactctccgggtatgtgtgctcgagtcatgttgtgttcttatacaaattaccacatcaaataaggatcatttgttcaacaagcatttctagctaggtatggcctaatcatgtcatgttctccatctaattgccgtttgccttcgtctatgcatacagtgaatgtgaatggatttgtttgcaaggaccccatgactgtgaacgcagatgacttctttaaggcagcaaaacttgaccaaccaagggacaccaccaagagcaaggtgggatccaacgttactttgatcaatgtcatgcagttgcctggactaaacaccttgggcatctcgttggctcgcatcgactatgcacccttaggtcagaatcctccacacacccacccgcgtgccactgagatcctcaccgtgcttgagggcacactctacgttggatttgtcacctccaaccaagctgacaacaccaacaagctattttccaaggtcctcaacaagggcgatgtttttgtgttcccctaaggactcatccacttccagttcaacccgatccatgacaagccagcagtcgcgatcgctgcactaagtagccagaaccctggagttattactattgcgaatgcagtttttggatcaaagccacctatctcggatgatgtcttggcaaaggctttccaggtgcaaaaggggacaatcgattggcttcaagctcagttttgggagaacaaccactactaaaacaattaagtctgggctcatcatttgagattatagaaatttatttgcattttacatactactccatgtatttattttttcctaggctatgacccataataaaaataaatgttatgtgttaaaaaaaaaaaaaaaaaaaaaaaaaaaaaaaaaaaaaaaaa

SEQ ID NO: 12225 - DNA, 1212 bp, Zea mays
gcgccgccccgcccgaggtacagggaagaacattttgcagaaaaggaacttatccccatgaaaatcaggctcaaaggaaagtgccctttaactccagaagaggtaggttttattctacgtgccatgggatttgacaatagaacacgcatttaccttgcctctggcgagctctttggagggaaacgtttcatgaagccattcaagaccatgtttccacgcttagagaaccacagcacagttggacctggaaagctggaagagaatacccaagggctagcaggatcagcagttgactacatggtttgcctcctgtctgacattttcatgcccacatatgatggcccaagcaactttgcaaacaacctcatgggccaccgtatgtactacggtttccggaccacaatcacgccgaacagaaaggctcttgccccgatactcatcgacaggatggaaggccgccacattggctttgagagaatcaggagggtgatgtccaacacccattttggtgccccccacaagcgcgtccatccagagtctttctacacgaactcatggcctgagtgcttctgccagacggatgccaagaaccatgcagaccggtgtccccctgataacataaatgacgttctggaaagccagttccagagcgaagaagaaatggaagaagcaagagcctctaatcagactgacccatccagccaaatagaagagctgacgatttaactgatcaactagggattactgctcggaagcattttgaacacttggaatggtcatcagagaaatccagatacaactatattcaaggaatgtattaattgatggctcaaactggagcggttgacatgctgaggtgtggtatctggtggtattcagggagagcattgaaccagattttgaataggtctggtcatatatggttttgaggagaaaacaatatgtatgtcaatagttttcctcattgaagagtgaagttgtgcgggttgtgtaggtggcagtgacaaaagtgagaaacctttgcgcaatatggtaccatccggtgtataaaggccccggttaggctggtgccagtgcaccctttgtctttcgtccctggcatgtcagctattgactccactttgtccttactgtttcagtgcacagcttgcagtgggatatagcttcaccctataagtcatattaactttttaaaaaaaaaaaaaaaaaaaa

SEQ ID NO: 12226 - DNA, 2570 bp, Zea mays
  misc_feature (128)..(128): n is a, c, g, or t
gatttttttgcattatcacttgaaatgtgaatggccggtctggtgctgtctcactgactgactaagtctactaagtcaccaggtcacgaattcgaaacaatactgaggggtgtttaaatgtactaaanttagtttgttggttataaaattgctagcttactagtagctagcttattaaaaatagttaatacctaaactattagctagtgtgtttgaatgtctatagctaattttagttactaaccattagctttagtgcattaaaaaacccctaaggcttagtttgggtactttagtattgagtttaatccacatgtattgaggttaattggggtgtaatttaaactaatttacacaacaatccacatcaacataagtgaattgggttcaatacttgaataaccaaataaagcctaagtcactggtcatgaattcgaaactatctttctgtatttatggtgggcttgtcttgtgaaggtttgtctcagcttactaatttgttggtttatcctttgctagcccaaaatagagtttcttttcttttcgagatcaaaatgactgaaattgctcggacagtctgactgcttaattcactctgttaaatcttatgaaatatttaaatgtactggagctaatagttagtgactaaaattagttagagacattaaatactctatctaatagttcaaatattaactaatgtatcgtggatcgtcaaaatagacaaaaatagtatttctacgtaaaacactcataaagggtatttccatttaactacccaaacaggatattcgtttttttcttatttttgatgatattgtgatggaacgacgagcctatttcttcgctttttcgccaacaaatcttttagtaaattagttaattacactgacaattttttatctaactaactattacgttcaaacatccttagtctagctcagtcctgccgaacctgactgaacccatctcatctgagggggttatcgggccgaaatttctacatcggccggtccccagcgccctccccatgaactcatcgccctccccacagccagaaccctagcctcgtcgccatggcctcctccttgctccgctccggccaccgcctctttctccgacgccaccgcctacccgcggcattctccaccgctacggccgaggagctaatcgacgtacgcaagcttcccaccaactacgacccctccaccttcgacccgtcctccccgtcccgcccgctgccgtccgaccgcgtgtggcgcctcgtcgaggatgtctcctccctcaccctcgcggagaccgcggctctctcctctctcctcctccgccgcctcgacataccctccgcaccacccatcgccatcctcaactccgccgcggggctgggcggcgccgccacggccggcgcggcgggggagaaggcgggggcggcggcggcggcggcggccgagaagaccgtcttcgagctgcggctggagggctacgacgctgcgagcaagatcaaggtgatcaaggagatccggtcgttcaccgacctggggctgaaggaggccaaggagctggtggagaaggcgcctgcggtgatcaagggcggcctatccaaggacgaagccaaggcgatcatcgagcggatgaaggcagttggcgccaaggtcgtcatggactgatcagaacaagcctttttcaacggtgaaatcctgcaactgcgaatctatgcttcgtttcagatcaactttaagtgcaaggatggacgggtggattgtggacagttcctgtatgaacttgcggaaatttgatgtggcacagcgctaataggttttcaagcacgttaatcaaatgaacattgatcctgcaatgctatagggtattggcatcaaacgctcgtcattatgttcgaatttgtgacctttcaattgtgggaagttaaaatgacctagttagttattttgttcatcacagggtcttgtttgagactggatgtccatatggatacaataacattttgctcttgtttctgtgaatttacaaatcgattcttattgaatgcaacttaactctcgactgttgttgccttaatgctatgtgcaggtggccaggtgctgtagctccatgcgcttctctatcctcagggttgatgccgcatgctgcttggctcggcactgttactgaaatttcgaggctcaacggtcttcaatcattcatgtcatcatgtgtttcttcctgtcctgtttaggaatagccttcgctaacaggaaacagggaataaattatttctaaatttgagataaaaagcacgcacagttggagtattaaagcatgtgttctacttctaggcctctggttgacgtcttgccttacgtagactgattggtacactgtctcactcacggtttgccacacctaaagttaggctagtttgactagattagaagtgtgttttgtttgtagctatagttgtgataagatttttctttcattaatgacttgtaaaaacgttacaaaattcttttaggcataacaagatgtggcaaagaatttgagcgtctaaccttaaacaagtggtagaaaat

SEQ ID NO: 12227 - DNA, 708 bp, Zea mays
ccatttgtgttgggggcttgtcatgctccactattcgtaaacgatgatatcgagaaaaagtggaacccagacgtcatcgtcttcaacacctggcagcattacgggactcctagctactggatgcagaagcttttccgcgcctctggcgccgccgtgcttccgccgacgacgatcagttctggcagctctgctgattctctagcagcgtctgctattacctggaaggattcagagaataatgactcgttcctaagagtaaagattgtaaactttggatctgatgctattagagttgcaatctccacagctggacttcaagcgaccagctctgggccgcgatcgaccgctactgttctcacatcaaccgctgtgatggacgaaaactctttcagtaacccaaacaaggtcatgccggtcaagagccagctattcgacgcaggagcgcagatgcaagtcacgctgtctcctcactcattaacatctttcgaccttgctctggctacgtcgaaacttgtcacgttgtctgatgcctgaactgtgatgcacatttgtctgtatttgaggagatgtcagtgtagtgtaaagagttgtgtgctgatgatgaactgaacaaaaatgacactgcgatccacgtttttatctatttggaggtgtccctttcaaagaaaaatttatgtggagataatgccaccgcaattcctctttttc

SEQ ID NO: 12228 - DNA, 1107 bp, Zea mays
gtttctctgaagaccctgaaactccagtgattttcttgcttatttatgacatcaccagtaccctgtccatacagtaaaaatgttgctgaaatgattcgaacacaggcctttgtgagcgagtacgctgtctggagaagtgacgcgggtagaggcagtcttcttgcttcgttggctgaagctgctttcctcactggtctggagaagaacagtgatatcgttcagatggcaagttacgctccactcttcgtgaacgacaatgaccaaacgtggaacccggacgctatcgtcttcaactcctggcagcactatggaactcctagctactggatgcagacgattttccgcgagtcaagcggtgccatgatccatccggttaatatcagttcccggtactcgagttcgctggccgcgtctgcgatcacgtggcaggatgcagagaatagcttcctgagagtgaaggtcgtgaacttcgggtcggacaccgttaacctcacggtctccacgagcggactcggggccagcgtcaacgcgctgggatcaaccgccaccgtcctcacgtctggcaacgtcatggacgagaactccttcagtaacccgaacaaggttgcgccggtgaaaagccagctgagcaacgccgcggagcagatgcaggtcacgctggctcctcactccttcaccgccttcgatctggcgctggctgagcccaagcttgtggcggagatatgatgtgtgtgctgttagcgatcttgatcgataaaaaggctttgtactggtgtaccatgatacaggataacgtactacgtactgttgcttcatgaaataaaaaccacatcaggtttttgcttggtgttggttggtttcctttctcctgtacgtgtttgctttgctcgtgcggcgccgcctactgtacgggatgatggtacattgatggtgagaacgacagcctcctgtggattaaacaaattgtcgatggatgccttcatggtaaacaactttatcatgaatcacggtatgaggctgtcaatgtttaatagtttcttgctgctgccggtacaatgttttcatcacatattgacatattgtaatgcttaagaggtttcttcgatc

SEQ ID NO: 12229 - DNA, 2944 bp, Zea mays
ccggcccccgccagggccccacgcgtcggcgggcgcgcgccgccgaacgaaaccatcccggcaaggcaagcaagcaaccgtggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcactcgcatccggtagctcgatcacttcttcctctggattttgggaaggaggcatcggacgtcggatgcatgacacactcattgcattagcgcctacgcctaccgcaagtggaagcctatggatctcaagcaagcctcctctggtacaatcttctgccttctgcttctattctgcgtgggctgcagatgtcggccttcggaaatagaggccacccagacagcagccctcaaggttgatgcctcgccacagcttgcccggaagatccctgaaacactgtttgggatattttttgaggagatcaaccatgcaggagctggtggcatatgggcagagcttgtcagtaacagaggtttcgaagctggaggctctcatactccatcaaacatcgacccgtggtccatcattggagatgactcctccgtgtttgtggcgactgatcgtacatcatgtttcagtcgaaacattgttgctctgaggatggaggtcctctgtgatgagtgtccagctggtggtgttggtgtttataacccaggtttttggggcatgaacatagaagatgggaaggcctacaatctcgttatgtatgttcagtccccagaaacaaaggatctaacagtttcattaacaagctctgatgggttgcaaaacttggcttcagctacaataacagtttctggcacatcaaattggacaaaagtggagcagaagctggttgctaaaggaaccaatagaacatcaaggcttcaaataacaacgaacaaaaaaggagttgtttggcttgatcaagtatcactcatgcctgaagacacatacaagggacatggtttccgcacagaacttatatccatgcttttggatttgaaaccacgattcttgagatttcctggaggttgttttgtagaaggtgactggctaagaaatgcattcagatggagagagtcaattggtccatgggaagagaggcctggacacttcggggatgtttggcattactggactgatgatgggcttggatattatgagttccttcagcttgcggaggacctgggtgctgccccaatctgggtattcaacaatggaataagccacaatgatgaagttgatactgtagctattgccccttttgtaaaggatgtattggacagtctggaatttgcaagggggagtgcagattcaacatggggctctgttagggctgcaatggggcaccctgaacctttcctggtcaaacatgtcgcaattggaaatgaagattgcgggaaaaagttctaccgtggtaattacctcaaattctacaatgctataagagaggcctatccagacattcagatgatttcaaactgtgatggttcatctagaccacttgaccatcctgcggatttgtatgatttccatgtctatactgattctaagactttgtttaacatgaggagcacatttgacagaacatctcgtagtggacctaaggcttttgtgagcgagtacgctgtctggagaagtgacgcgggtagaggcagtcttcttgcttcgttggctgaagctgctttcctcactggtctggagaagaacagtgatattgttcagatggcaagttacgcaccactcttcgtgaacgacaatgaccaaacgtggaacccggacgctatcgtcttcaactcctggcagcactatggaactcctagctactggatgcagacgattttccgcgagtccagcggcgccatgatccatccggttaatatcagttcccggtactcgagttcgctggccgcgtctgcgatcacgtggcaagatgcagagaatagcttcctgagagtgaaggtcgtgaactttgggtcggacaccgttaacctcacggtctccacgagcggactcggggccagcgtcaacgcgctgggatcaaccgccaccgtcctcacgtctggcaacgtcatggacgagaactccttcagtaacccgaacaaggttgcgccggtgaaaagccagctgagcaacgccgcggagcagatgcaggtcacgctggctcctcactccttcaccgccttcgatctggcgctggctgagcccaagcttgtggcggagatatgatgtgtgtgctgttagcgatcttgatcgataaaaaggctttgtactggtgtactacgtactgttgcttcatgaaataaaaaccacatcaggtttttgcttggtgttggttggtttcctttctcttgtacgtgtttgctttgcatgttcatcaccatctactgtacgggatgatggtacattgatggtgagaacgatagcctcctgtggattaaacaaactgtcgatggatgccttcatggtaaagaactttatcgtgaatcacggtatgtggctgtcaatgcttaatgagtatactgaccgcaagtttcttcctgctgccggtacaatgtttccatcacatattgacatattgtaatgcttaagaggtttcttcgtcttaaaaattatcttgtattaatggtggctggtgataagtggccagcagccagcttataaggatgagatgatcatgtgaaaggtctctagcatactggttaagagcttctgacacttccaagtcctaggttcgatcactctcgagagcgaaattttaggtttggttaaaaaaaatcacctcgatatgctccatccactctcggattacgacgtttctatacgtcacccttcaaggg

SEQ ID NO: 12230 - DNA, 2614 bp, Zea mays
gaaaaaaaccaatgatagatgcggataaggcgacagcacagctgacagggccccacgcccccgcgggcgcgcgccgccgaacgaaaccatcccggcaaggcaagcaagcaaccgtggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcattcgcatccggtagctcgatcacttcttcctctggattttgggaaggaggcatcggacgtcggatgcatgacacactcattgcattagcgcctacgcctaccgcaagtggaagcctatggatctcaagcaagccttctctggtacaatcttctgccttctgcttctattctgcgtgggctgcagatgtcggactttggaaatagaggccacccagacagcagccctcaaggttgatgcctcgccacagcttgcccggaagatccctgaaacactgtttgggatattttttgaggagatcaaccatgcaggagctggtggcatatgggcagagcttgtcagtaacagaggtttcgaagctggaggctctcatactccatcaaacatcgacccgtggtccatcattggagatgactcctccgtgttcgtggcgactgatcgtacatcatgtttcagtcgaaacattgttgctctgaggatggaggtcctctgtgatgactgtccagctggtggtgttggtgtttataacccaggtttttggggcatgaacatagaagatgggaaggcctacaatctcgttatgtatgttcagtccccagaaacaaaggatctaacagtttcattaacaagctctgatgggttgcaaaacttggcttcagctacaataacagtttctggcacatcaaattggacaaaagtggagcagaagctggttgctaaaggaaccaatagaacatcaaggcttcaaataacaacgaacaaaaaaggagttgtttggcttgatcaagtatcactcatgcctgaagacacatacaagggacatggtttccgcacagaacttatatccatgcttttggatttgaaaccacgattcttgagatttcctggaggttgttttgtagaaggtgactggctaagaaatgcattcagatggagagagtcaattggtccatgggaagagaggcctggacacttcggggatgtttggcattactggactgatgatgggcttggatattatgagttccttcagcttgcggaggacctgggtgctgccccaatctgggtattcaacaatggaataagccacaatgatgaagttgatactgtagctattgccccttttgtaaaggatgtattggacagtctagaatttgcaagggggagtgcagattcaacatggggctctgttagggctgcaatggggcaccctgaacctttcctggtcaaacatgtcgcaattggaaatgaagattgcgggaaaaagttctaccgtggtaattacctcaaattctacaatgctataagagaggcctatccagacattcagatgatttcaaactgtgatggttcatctagaccacttgaccatcctgcggatttgtatgatttccatgtctatactgattctaagactttgtttaacatgaggagcacatttgacagaacatcacgtagtggacctaaggcctttgtgagcgagtacgctgtctggagaagtgacgcgggtagaggcagtcttcttgcttcgttggctgaagctgctttcctcactggtctggagaagaacagtgatatcgttcagatggcaagttacgctccactcttcgtgaacgacaatgaccaaacgtggaacccggacgctattgtcttcaactcctggcaacactatggaactcctagctactggatgcagacgattttccgcgagtcaagcggcgccatgattcatccggttaatatcagttcccggtactcgagttcgctggccgcgtctgcgatcacgtggcaggatgcagagaatagcttcctgagagtgaaggtcgtgaacttcgggtcggacaccgttaacctcacggtctccacgagcggactcggggccagcgtcaacgcgctgggatcaaccgccaccgtcctcacgtctggcaacgtcatggacgagaactccttcagtaacccgaacaaggttgcgccggtgaaaagccagctgagcaacgccgcggagcagatgcaggtcacgctggctcctcactccttcaccgccttcgatctggcgctggctgagcccaagcttgtggcggagatatgatgtgtgtgctgcacattacagtacacaaacagcgcgcggatggcagcaaccagagggtgtggagtgtggtgtgctgttagcgatcttgatcgataaaaaaggctttgtactggtgtaccacgatacaggataacgtactacgtactgttgcttcatgaaataaaaaccacatcaggtttttgcttggtgttggttggtttcctttcaaaaaaaaaaaaaaaaaaaaaaaactcgaaagggggcccgg

SEQ ID NO: 12231 - DNA, 1750 bp, Zea mays
caagaattaaagcagacgcagaagctcctgaagcaaaataagaggtggtgcgtgatccatgatgaatattatagatgatgattatagcaatttatctatctgaaaatacttaaacttctccattcactgatctttgtttcccttgctaataaataattgccattttctaataaacattctatttgcttgttttgtagcaaaataaatcgttcgaatccaattgctgaaatggtaaaaccattaattataggcagcaaatagtgtgtgtctgttgtgttgtgggcacactgcattatccttggagatgacactttgttccaacttctggtgtaaaactattatattcagattctctagcggctttaaaatcagagattagatggaggctctatgtatttaaagatggtgaatcattgaatggtaggtgaggcgcactctttgaaggtagacaaggcgttgttcgaggggaagtcgaactatgttatgttttcaggtaacctgcagaaaaaagttctctgaatctgtgccataaactgtttccactatgcctaaacttaagtacatgtgagtacattttctcattaacaaaaactagagttgcattaaattctatgtttttgtttgaggttaaatcgatttttctatgtatatagaaacctcccaagattatgcggaatcaatcatttgatctgtgctcccccatcgccaccagcgacggcgccacccctgttgcgtccatgggtgccaggaaagacggtcagctaggcaacctcctcaaggctccgaagctgttggacacttcccccaagtcctgacagcaatcggtaacttctgcatttgctcgattgtggtcggcatcatcgtcgagatcatcgtcacgtgttgctcttggctgtaagggcgtcaaggactgagaaccaagacaccttcgatactgccatggatggcatgcttgctgatcctaaggaggccatgactggtatcagagaaatccactttttgcccttcaaccctattgataagaggactgctctaacatatattgacgccgatggcaactacaccgtgtcagcaagggtgctcctgaacaggtgaggaaatttgcaatcacgttgcttattctggaatgaaaaaaactttgttcattcagcgtgactaattaattgctcctgggctgaaacccaaacatattcttgacatatgccactgcaaggataatttgaggcgaaaggtgcacgctattatcgtcaagtatgtcgagcgtgttctttttcgcttgatgttgccagacatatattggttgatgctccttttctttttttgtgtgttttggtgatcggtgagccaattttctcattcaaaatgtgaccttaccataggaagtacctgagaaaaacaaggagtcccctagcggaccatggcaatccattggtctgctgcccctgtttgatccacctaggcagcgctgagacagttagcaaggctcttgttcttggtgtatgtgatatagacgtgccactaataatcattactccgtatgaaataggacgagaagattcaggcccccctaatcataagcgcagacgattactcgtgctgccagtatgattatgagcagagagctgaaaagaatcacctgcagaggtccaagaagtctgccgtgactgcgcagccgtgctcctcacagagcctgctgatgaatcatctgtccccttgaattcagccgtctaaaaataaagacacacacaca

SEQ ID NO: 12232 - DNA, 2331 bp, Zea mays
  misc_feature (2237)..(2237): n is a, c, g, or t
aacagaagaaatagcgctcctttctctcaaactatattgcacgccatcaaggcatcaactatatatttcagataatgcacccaatagctgatgacattaccagttttgcagacaaatgcacccaatagctgatgacattaccagttttgcagttaactgtccaaactgacaatcaaataagctgacatacattaatctaaccttagcagttttgcagataactgtcctaactaacatgcaccctaagaatacatatatgtctagctcttcctaggtgtattttaacgaacaaccttcttcacgcgtcttttggaggagagattggttctgtagtaggcacaacctcgcttggaggagacattggttgcactatctgtgaagatgcaagcacatcctctcctggcggaggaggcattgtgagcacaatctctgaagatgcaggcacatcatcacttggaggagtaatattgggtgctgcctgtgatgatgtaggcacttctttaggaaaccaacctttagttgtattcttccttggcgctcttttcctcctcttggtcccattaacatgagttcaaatgatgtcatatgacaaggactaaaaaaacaaaatcgtaactcttactacctcttctttgtcccatttagtgggcatttggagctattttttctgtgccccaattctccacagttcggacacttgaacctccttcggatcattttcttgcctttttcacttgcttccttaccgcttacaccttcgaggctactcttaatactattttccctttgtctcccaacacatcttctatcaagaggtgcaccaacctcacttgcaatgtccacttttggccaaaaagatttgtcctcaagaggctccaccatcctacaataagcttgtctaaatttctcaactgagtaataatggtcaacaaagtcctccatcctgacatttctcatctgttgggcagtgataaagcacaatgcatgttggcaaggtttaccggtgtgttgccactcttgacatgagcattctttcaaatatgctttgaccacatgtggagcacagtagttactattgtcatagatctcagcagcatagtcatcaccctttataaactccaagtgacctattcctctagtcctcgtcgtcaagacatgtatgattgacggtaaaatgttcccatggaacctctgacttatccgcctcctcttgtgaaacaaatgcattatcatttccctgatcttatcggcaagatcacacactggaagacctttataatccttaatccaattattgaacaactcagcgatattgtttgtgatatagtcacacttaatagctgtgttgaaaccacttcggtaccataataaatcatgatattgatctagccacctggctataacaggatcacagctcactttaccaatgtgatgctcaaacacatccctcctgtatgccctagctgctggatacatgtattctgagcccgtataactcttcacatagttgttcattagatgcctgaaacacactcttttttcagcattaggaaaaactgacttcacagcatttgtcaaacctttgcaagcatcagaacagatagcaagaactggaagatctcctactgcttggtgcaatttagtcataaaccaagtccagttctcttcagtttcagaactaaaaaaaccaaatgccactgggtacatccaattcaggccatctacacttgtagcagaagccaagtgaccgtcccatataccatttaaagcagtagagtcgacactaagatacggtctacaaccttctttaaacccagaaatgcatggaccaaatgcacagaagaacttgctgaaaaaaagtttgtcatcttcaactcggaggtcaatctctattacactgtcaggtgacttctgcaagactgcttccttccaggaaaacaagagctgaaagctctcctcccaactctcgaacaactctctcaatgctttctccttccccttccaaatagtgtcatatgaaatagcacatgtgaatctgtcctgcaaaatagtctgcaactccttagcacccatttggggtttcttcataaggataggaagagcttttgcagccacccaagcactagaaggagtggtagtcttcttcctaccactagaagtacaagtgtggacatcgttcaccactaccacgattatggttggcgatcctttcatctccgttcgtgcatatatactcncaacgacaatccaaaccacgacaatagcctctatatcttgtcgtgctagtagcctcaatacctaactcaaatttattgtttatggccgtcgtgc

SEQ ID NO: 12233 - DNA, 812 bp, Zea mays
cgtaggtccttccagaaaaccaagaaagctcactcctcttccctctctctttcctctcttgcctccgtcgccatgacccaccgcctccttctcctgctcctgctgctccctttgctagcgccgcctgctgcgtctgcacgccagggcgcggggcaggatttgggacagtgccccgggctggagtacggcctgccgccgttcgccgccgctctccgggcaagctgccccgtctcgacggaggggtactcgccccccgaggaggttgttaatggggaagaacttctcaggttgttggatggcaaggaagagcacacagctgtccttttctatgcatcatggtgccctttctcagaaagaatcagaccagtctttgatgatctgagctcaatgtttccacgggttaagcacttggctatcgaagagtccaatgtcacgaaagccattttgtcgagatatcatgtccgtgcactaccttccataataatagctcgcagctcatacatattctgggcgctcagttcgaaagatctcgactctctagtcaacctttacactgctgctacgggtcaagaaccagtcgcatatattggtactcgcaagtggagggccacgcaaagcacagactatgctaagatttggaacagctcgattagtgaaacagtgaagcaagaaccctgcctagcattcagaatcctgtttgcttgcctgaagatattcctctttcttcttcccaaagttcttttgctctcgtccaagacttctggacccaatactattgagaaattaaccttgggaatcctcgccaaattgac

SEQ ID NO: 12234 - DNA, 3751 bp, Zea mays
  misc_feature (1532)..(1532): n is a, c, g, or t
  misc_feature (3039)..(3039): n is a, c, g, or t
  misc_feature (3261)..(3261): n is a, c, g, or t
tatgatatgggtaaactttaatcccaagaaaaaagttaggccatactttttgcaggttttgacccgtcatcaccacctatctatccgaaagctacgagtgactcctctaccgtaatgtccggccgctgcccagcagggttaccctgttgccggacccacacgtcagctggcagcggctacgttcgtggagaatcctgccggccgaagcacgggtagtctaatcaaaccctgattccacgaagggcacaccaaacctcgaaagattcccaaagctgaccctctagaaagccaagaaaactcactcctctctcctctctctctctctctctcgcctctcgcctccgtcggccgtcgccatgacccgcgtcctcctccccctgcttctgctgctggcgctgcctggtgcgtatgcacgcccggcgcggcagtatctgggacagtgtccggggctggagtacgggctgccgccgttcgccgccgcgctccgggcaacctgccccgtctcgacggaggggtactggcccccctacgaggtgcgtgtctctgagccctacctccggccgtgtggttgcctagttggcggcaagccggcaatatttagttctctcgggcagggcgaagccaaacaaaccgggcggtttattagcgtacggttctggcggatctcacactttgctccgatgctcatgccgagaaattcctgtgctgttcatacttcttgatcgatgatgtattgctgtttccatcccagaagtttagctccttttgtttacttcactgattagcgtggattctccctggcgaaccatgggcagaaaattttgtttcctaagtttttttacgggccggggtgaatagaggcgcctggatcaagctgtactttagtagattggtttccattaatctttctttgtacacaggatcactttcttgacccccttcccttgtttgttgttgacggaatctgcatgttcttgtgtgttcaagtataaatataattcaactagtcaacgcaaacagcgtcaagaacagtagggtgcgtggcctatgtccgtggtccttcgttttactttctatagtgtattgttggggtttgtgaactgtttcccttacgttatttgtatatttcccagttatttaagcgtttgatgcacatgggtcctagttggaatgactcaaaaattcattcagtagtgagtatctatcagtgtagcaccagaacaactaatgggaactctcaggactaatttacagtcaactcggtaggatcagggactgggacggctaaaagttaaatgttgttgtgctctttaattctggcgagtggcttaaatgtgataagggaagagcatcaagtatgtatgatcatttgcaaaggttgacttttactggattggcctggagttttatcgtgtgtgtagtatggaggtttggtgtctaataatacggtatgaagctcacttccaaaagttttggcaggttgttagtggggaggagcttctgaggatgttggatggcaaggaaaagcacanggctgtccttttctatgcatcatggtgccctttctctcaaagaaccagatcagtctttgatgatctgagctcaatgtttccacgggttaagcacttggccgtggaagagtccagcatcatgaagcgtaagacccgaatatgctggaacgcagtaattacctttcataataatagctaataatgcatgtaagtgagacatctctttccttgtattgcttgcctgcagcattttgtcaaggtaccatgtccgtgcactgccttccataataatagctcgcaactcacacgtgttctggcctcttggttccaaagatctcgactccctggtcagcctttacactgctgctacaggtacgtattggaatttagaatgttattggtggagaagaagttaaataaaaaaacaatttagttacttattaaatgagagcttggttttgatgcaggtgaagagccagtggcatacatcggtagccggaagtggagcgcagcgcaaagcacagacggctatgcaaaggcttggaacagctcaattattagtgaaacagtgaagcgagaaccctaccttgcattgagcatcctgtttatttgcctgagggtgttctttttcttcttcccaaagtcctttgccctcatccaagacttgtggaccggataccgcgagcagatcaacctcggaatcctcggcagattggcccagctgcttgaatgcgtgcctcacgccgtggatgtgaggaaggtgtggagcaagttgaggctcgtggttggagctaatgagaacggtagggtctgggcagccctaacttcgttgccccttggtgggcgaccttctccgatccacgggttgctgttggactgattggctcgaccatctaactgacagcaacaactaatatgcaatgattttatctgtaagcatttaagtaaggctctgggtttgttagattacgatccaactgtagatataatcttgatttgttatgggttttctataaatctacatgagccggtgatagaaaggtttaaatattaaatgtgatatatcgttggatcataatctaacagaccaggagtcttgtttgcatgattgtacataaagtctgattgcatattagttgttgccctgactgacagcatgagaacacgctggctgattcattgaattgcatcattgcatgcacttgacgaagtacatattgagacagataagtgaggtctctggctctctctgctcagaaacatgcatcctgtttgtagcatgtagtaaatcttagggacacaccgtggtggagcctttgtaaatcatactgtaacagtagtcgttttcatcatgtaatcggtaatggatgaatggtccatggacatccttcagtgtcgttttctgtacaagtctttgtttgcttcgcctatatatattgtgacctttcattcttgattgatggatgttgaaacttgaaacaaatcagattcgaaaatcttagccaggattctgctcagactttgacanaaacgtcctccattgacaacctcctcatggacgtcaacaatagatagagacgatgcgctgtaatttagggcaagatcatcaactacctctcttgatgatgtcacatcaggaaacaaagtcagactcaggcggcctccaatggctccctccaatgataggtgttgaaccatggacttcaccaatgtgtgtaacgacaatgtaacacattaccatggttttttncaatctatttaaggtttgttcggttattcatatcccatatggattagaaaaaaaatatgaaagactttgacttgtttgggattaaaacacactcaatctcacccaatccatatatattgagagtaaaacgaacagtctcttagcattcgcagatccaatctcactcaattcatatatattgagagtaaaacgaacagtcccttagcattcgcagatcaggctattcccaacaggatgcccatgcgcgtgtggaagctgccacacgcggacgcctgcctgcgcaatccaaaaagtgaccatgtccagcaaaccacgcatgcgcatgaacacccgcagagagagaatcgcgtgaaaattgacatcccagcgctcattttgcacgtcctcatccgcattctgcttgaatacggacacgcaaaaatatgcatccacgaccagatttgcaccacaagggttcagtggaccaccgagagagacagtgctagcggta

SEQ ID NO: 12235 - DNA, 1344 bp, Zea mays
gccggccgttccgggacccaaacctcgaaagattcccttagctgaccctctagaaagccaagaaaactcactcctctctcctctgggtacctcgaggctctctcctctcgcctccgtcggccgtcgccatgacccgcgtcctcctccccctgcttctgctgttggcgctgcctggtgcgtatgcacgcccggcgcggcagtatttgggacagtgtccggggctggagtacaggctgccgccgttcgccgccgcgctccgggcaacctgccccgtctcgacggaggggtactcgtccccctacgaggttgttagtggggaggagcttctgaggatgttggatggcaaggaagagcacacggctgtccttttctatgcatcatggtgccctttctcgcaaagaaccagatcagtctttgatgatctgagctcaatgtttccacgggttaagcacttggccgtggaagagtccagcatcatgaaagccattttgtcaaggtaccatgtccgtgcactgccttccataataatagctcgcaactcacacgtgttctggcctcttggttccaaagatctcgactccctggtcagcctttacactgctgctacaggtgaagagccagtggcatacatcggtagccggaagtggagcgcagcgcaaagcacagacggctatgcaaaggcttggaacagctcaattattagtgaaacagtgaagcgagaaccctacctagcattgagcatcctgtttatttgcctgagggtgttctttttcttcttcccaaagtcctttgccctcatccaagacttgtggaccggataccgcgagcagatcaacctcggaatcctcggcagattggcccagctgcttgaatgcgtgcctcacgccgtggatgtgaggaaggtgtggagcaagttgaggctcgtggttggagctaatgagaacggtagggtctgggcagccctaacttcgttgccccttggtgggcgaccttctccgatccacgggttgctgttggactgattggctcgaccatctaactgacagcaacaactaatatgcaatgattttatctgtaagcatttaagtaaggctctgggtttgttagattacgatccaactgtagatataatcttgatttgttatgggttttctataaatctacatgagccggtgatagaaaggtttaaatattaaatgtgatatatcgttggatcataatctaacagaccaggagtcttgtttgcatgattgtacataaagtctgattgcatattagttgttgctctgactgacagcccgagaaaaaaaaaaaaaaaaaaaaaaaaaaaaactcgaggaaggg

SEQ ID NO: 12236 - DNA, 1661 bp, Zea mays
  misc_feature (1645)..(1646): n is a, c, g, or t
ctcgtccgtccctcgctctcgcaaaagctccgctctgcttgtcgcagtgtcccttgtctgtttcccctcgccggctcgccgccaccgccgcatccacttctgcgccgcggccgcccatattcctccgagcgcatcttctcctcgcattacagcaccgtaaagccgcatcatttccggatccctacctaggccgaagccgcagctcccaatggcggccgcctcgtcgttgcgtgtcacgtctttcgccgccacatgccctagagcgcgggtgggatctgccggcctcggatctgcctgatgcacggctggagctttgaagctttgctgacattggcggtggttttccctttcttcagcgcccgggggccttgctcgttgctgcggcggggcggacagtgcagatttcagtatgtctttcaagattcagctcttgtcctccattgccatttttgcttttgccttgcatcttcacccttgtgtgtccactgagtttcgccgtgagctctccagctggaccactggcatagctacgtggtatggcgatgctaatggtgccggaagtgaaggtggtgcatgtgggtaccaatatgctgttgaccaaccaccgttctcgtccttgattgctgccggcagccccttcatctatgactctggcaatggatgtggctcttgctatcaggtggtatgctctagcaatcaagcttgctctggttacccggtgacagttgtcatcaccgaccagggccctggtggtggcccatgcctgagccaagcaagcgatggcatgtgcatgaatgagggagcccactttgacatgagtgggactgcatttggcgccatggcaaagcctggaatggccgatcaactccgtgctgctggcctgctacaaatccaatacactcgtgtgcagtgcgaatggcctggagttgatgtaaccttctctgttgactccggctcgaacccgaactatctggctgtgctcatcgagtacgaggactgcgagagcgatctttcagccgtcgacatcattcagagctcagcagggcaatgggtgccgatgcagcattcatggggtgcaatctggaggctcgactctggctctgctcttcagggcccgttccacctccgcttgacgttcagctcaggccgggtactcatagccagcaatgccatacctgcagggtggaatgcgggtgcggcgtaccgggcaggcggagtggcggtgactagggccaggcccaggagtggtggcagccaggccggtgaggctgctgctggaacatttagaggtttggtgtatcaccttctgatgtttgtggtattggcgctgtgaattataatgcaaatgcatctttggtagttttgagatgcaaatttaacaaatttaggactacccagggatttagattgtgcattttgatgttttcttgtagctgaggtctgagatggggggagtgttgtgcacgtttttgttgtggttgagttaccatcatgcaactgatcaggttttatggtagtccttgcatgtaaatacacatttggtgaaactgcttaggttaagtgtttagttcctttatcgaaaaaaaaaaaaaaaaaaaaaaaaaaaaaaaaaaaaaaaaaaaaaaaaaaaaaaaaaaaaaaaaannaaaaaaaaaaaaaaa

SEQ ID NO: 12237 - DNA, 1678 bp, Zea mays
  misc_feature (9)..(9): n is a, c, g, or t
gagagaganctcactagtaccccccccccccatttactcttgtttctaggtctttgtgtggaaaatcatcgagctgcatgacaaatatgtagcttatgtgacagaatgtttccagggacatacactcttccataaggcacttaaagaagcctttgaggtcttctgtaacaaaggtgtctctggcagttcgagtgccgagttgttggctaccttctgcgacaatattctgaagaaaggttgcagtgaaaagctcagtgatgaagccatcgaagatgcccttgagaaggtggtgagaatgcttgcatacatcagtgataaagacctgtttgccgagttctataggaagaagcttgcaagaagattactttttgacaaaagtgctaatgatgagcatgagagaagtattctgacaaagctcaaacaacagtgtgggggacagtttacttcaaaaatggagggcatggttactgaccttactgtcgctagagatcatcaaactaagtttgaggagtttgtagctggacatccagagttgaatcctgggatagacttagctgttactgttttgacaacgggattctggccaagctacaaaacttttgacataaaccttcctgccgagatggtgaaatgtgtagaggttttcaaggagttctatcaaacaagaacaaagcacaggaagctgacatggatttattccttgggaacctgcaacatcaatgctaagtttgatgctaaacctattgaacttattgttacaacatatcaggctgcattgctactactgtttaatggatctgacaggcttagttattctgagattgtaacacaattaaacctgtcagatgatgatgtagtgcgtttgctccattctctttcttgtgcgaagtacaagatccttaacaaggaaccggctagtagatccatctctcccaatgatgtttttgagttcaattcaaagtttactgacagaatgagaagaatcaaggttccactccctcctgttgatgagaagaaaaaggttgttgaagatgttgacaaagacaggaggtatgcaattgatgcatcaattgtgcgcattatgaagagccgcaaagttatgggtcatcaacagctggttgctgaatgtgttgagcagctgagccgcatgttcaagcctgacttcaaagccataaagaagaggattgaggatctcattacaagggactacttggagcgcgacaaggacaacgctaatacgtacaaataccttgcctgattggtggtcagtggcaaaagtccaaaacagctcccagactagtgcaataccacgggggtggcgatctcctgcaaggtggtggtgcgtcaacttttaccatgatttgaggtgcgttatggtgatttgcgtgcttatgggtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgcttgggggttgctttgctatatgaaatgagtggatactatgcgaatttgcagtaaaaaaaccgattaaaaaactcgagaaagggccgcgggtacc

SEQ ID NO: 12238 - DNA, 6931 bp, Zea mays
ccggccgggcccgcggggccggccggcgacacaagcccaacccttcctgacgctccacgcgctcgtctctctccttccttccatcctccctccctccttccctccctcgctcgcctctggaggaccctcgccatcctgcccaagcgcaccaccaaacccccagcagcggcgctagggttcgcgcctcggcgcgtcggcaccgtcacctgcggcgatggcggggcaggagcgtaggacaatcgatctggaggagggatgggcgttcatgcagaagggcatcaccaagctgaagaacatcctcgagggcaagcccgagccgcagttcagttccgaggactacatgatgctctacacgacgatatacaacatgtgcacgcagaagccgccgcaggactactcacagcagctctacgacaagtatcgggagtcgttcgaggagtacatcgcctccatggtactaccttcattaagggagaaacatgacgagtttatgctgagggagctagtgcaaaggtggtcaaaccataaagtcatggttcgctggctgtcacgcttcttttattaccttgaccgatacttcatatcaaggaggtcacttacaccacttaaagaagtgggccttacttgcttccgagagttgatctatcaagagattaaaggacaagttaaagatgcagtgatagctctgatagacaaagaacgtgagggtgaacagattgaccgggctctgttgaagaatgttttggatatttttgttgaaattgggttgggtcaaatggagtgttatgagaatgactttgaagatttcttgctcaaggatactacagagtactactctgtcaaagctcaaagctggattcttgaggactcatgcccagattacatgattaaggctgaggagtgtttaaagcgggagaaggagcgagttggtcactatttgcatattagcagcgaacagaagttattggagaaagtgcaaaatgaattgcttgctcagtatgcaaccccgctgttagagaaggagcattctggatgttctgctttgcttcgcgatgacaaggttgaggatctttctaggatgtacagactcttctccaaaatctcccgtggtctggagcctatttcaaacatgttcaaaacgcatgtcacaagtgagggtacagccttggtcaagcaagcagaagattctgctagtaataagaagccagagaagaaggatatggttggcatgcaggaacaggtctttgtgtggaaaatcatcgagctgcatgacaaatatgtagcttatgtgacagaatgtttccagggacatacactcttccataaggcacttaaagaagcctttgaggtcttctgtaacaaaggtgtctctggcagttcgaatgctgagttgttggctaccttctgcgacaatattctgaagaaaggctgcagtgaaaagctcagtgatgaagccattgaagatgcccttgagaaggttgtgagattgctggcatacatcagtgataaagacctgtttgccgagttctataggaagaaacttgccagaagattacttttcgacaaaagtgctaatgatgagcatgagagaagtattctgacaaagctcaagcaacagtgcggggggcagtttacttccaaaatggagggcatggttacggaccttactgtcgctagagatcaccaaactaagtttgaagagtttgtagctgggcatccagagttgaatcctggcatagatttggctgttactgttttgacaacgggattctggccaagctacaaaacttttgacataaaccttcctgcggagatggtgaaatgtgtagaggttttcaaggaattctatcaaacaagaacgaagcacaggaagctgacatggatttattccttgggaacctgcaacatcaatgctaagtttgatgctaaacctattgagctcattgttacgacatatcaggctgcattactactactgttcaatggatccgaaaggcttagttattctgaaattgcaacacaattaaacctgtcagatgatgatgtagtgcgtttgctccattcccttgcgtgccccgaggccggccgccttaacaaggcaaccagcaaatagatccatctcgcccaatgatgtttttgagttcaattcaaaatttactgacagaatgagaagaattaagattccactgcctcccgttgatgagaagaaaaaggttgttgaagatgttgacaaagacaggaggtatgcaattgatgcatcaattgtgcgcattatgaagagccgcaaagttatgggtcatcaacagctggttgctgaatgtgttgagcagcttagccgcatgtttaagccggacttcaaagccataaagaagaggattgaggatctcatcacaagggactatttggagcgcgacaaggacaacgccaatacgtacaaataccttgcctgattggtggttagtgacaaagtccaaaacagctccgggactatgcgataccactgggatggcaatcttcctgcaatgtcgtggtgcgtccacttctaccatgatttgcagcacgttttggtgatttgccctgccacagcacgggctgctcacattttgtacattggtcgttaaataggataagcgtgttggcctacattagatataatgatgattgatgatatgaggaataggagaggcattcaagtacttgtatgtgtcttctatgccaatgctttatctatatagctgtatcagtgttccagtcaattgatatgagatgatgcttggagtcgttttgctatatgaagtgacggatacaatgggaatttgcagcatccgtttgtatctgaatgcacctgcttttgttttataggtagatgcgtattctggctccgttgtcacctgttggtttgtggaggcagagtggattggtcagctagctgacggaagtcactgactcactagaagctattaagtggttttgtacttactgagtcaaatatatgtcatacgttgaaaccatgtttcgtaattatgaatagtttctttaaaattaaattttgcgtaaaaaaaaacaaaaaacggctgcctaaggacagtcacgctctgatatgcgatcatttcacatttaccgagtcaaatagacgtatgtatatagaaaccataccagtatacttaagttcattttagctcgttataaatgttctctctctcttaacgtccagccatcagtcgaaatattgattcttgtgtaaatgacatctatttttttttaaaaaatcttgcagctccttttttcttcactaattaattatagcgtcattcatattagcattttgcatagttgaaggcatctagttttgtaagaggcaggacggcaggatacataatacaatttaaattcaaggaaattgcaattgtcctttttttgttatctgaacatgcttttgtcagaagctttagaaccatcattgaaatcctcccaactcgttctgatctgtctgttgagtctaataaataaataaataaagaaagaaagaaatcctagagagagagggagggggagggatcacggcggcgggagcacgcacgggtcgcccggcgcggggtctgccttggatgcgtggaggaacctccgctgcttgtcgtctgcgaggcagagcagggatgcctcgcatgcctcctgcgcgtggggcggcgggctcaagccgtggtcctggtctatgaggaggcgcgcatactcggtgagcaggtgcagcatgtagtcgtagacggcgtgcatgcggaggtcctgcacgagcctctgcccgcgcctgccgacgcgctcggcctcgtccgggttggcgttgccccagtcgacggcgtcccggatggactcgcacatgcccagggcggcgaccggccagtagttcacccggggctccagcccgcggctgaagaagtcctggtagcgcggctcgatgagcagcgccatggagccgcaggagaggatgtacttgaggctgaccgaccacgcgaatccctcggcgtagatcttgtagcggtgcgtgcactgcgccgagagcctcgagtgctggtagccggacctggcctcgtcgtcccagttctggcgcatgatctcggcgcgccacagggccgtgtcgttgcagcccagcagcgcctcccgcagcggcgacgccacgtccgggttgcccttccagtacgccgtcggcaccctgtccgcccatctcgttgccctggcgcccgccctgatgttcttgaactcgtggttccatggctcgatgttcgtctccggccagccccagaaggaccagtcagggaaggggatgtcgaagtggtccctggtggtgcagtagcggaagagcggcggcggcggcagagcgccgtccccgtgctcggtccggttgatggcggggcggtccatgcagtcgaacatgaggtccacgtcgggcacgcgcccggggtaccgccgcatcagctgcagcaggctccacaccgtgaacagggcgcggctctgcacgcaggcgtagtagaggtccacgtgcagccgccgcccgccgcccgtgatggtgacgcgcatggacgcgcgccgccgcgcctcgtccaggagcgcgcgcgtcacgccccggccctgcccgcgccacggagccaggtcccggtggatggcagcgaagtaggcagggcactgcttctgcttcttcttcttgttaccttgcggcggcggcgacgacgacgacgacgatagcggcggcaggcaggcgatggagggcgcgcaccgcagcgccgcgcgcgccggcggccggcctcgagggtcccggtccccctgccacggcgtcggctccaggttgtggcccagcagcgtccgcgtccgcgacatggcgtcgtcgtacgcctgcgccgacgaaacaaaatcaaacaaaccgcaacaagcacgcggtcaaccgcttaaatcctgtaccgagtggacgacggcgaggacgatcacggccgagaaggccgcgatggcggagaccacgagcgccgacagaggcgggtaccgcatggctcgtccccggcctccggcgccctccgccgccatgtatgtgtgtgtagcccgcctgcggatcgccgcccagaatatggaccactgcacaggggccgcactaaaagtaaaacacgcgcacgaatgtatcaaaccaaccaaaagaataaatccgtgcactttcaaaagtagtacgtgtcctcaatattcggatctgacaaccggcaaccgtctgcgtgcatgctgacctgcatggccatggcccatggacgccgagcactcacccggcggactagcggaggacgaggatgagttaattaccgtgcaatctcacgtactattcgtttgttcctgaatattggtgtccgcagagctctgtctactttttatttgtttactagctagctattcctatgatctatctgatccgcaggattctactcccgtctgaaaaaagaagaaacaattctacttctgctctattcttatcttttaaagtttgatagaagggtgtcaatattttcaacacaagatttggtatatatacttcgagaagaatattataaacattactccctctatcccaaaatagaattcgtcttagactaataatatatttattaaataatatatgaatgtagtttacatgtacgtttatatttattatcatttaaacgattgtgaatggaaaaaataggcaagaaaaaactatattttaggatagagggaatattatttttttaagaactagacacaactatcaccaattctatctttttgtgatgaaaagaagatgtgatatatttttttatatataaagaaatgagaaggtattgattcttttgattggatactagtccttgggagggaagaatacttttttccctctctcaagagggggacaacagagatgctgaaactacgtgcatttatttgtgagcattggtatttattcgtccaccatattttcctcagcataaacttgtcagccatttgcaaagcaaagtgctcatcagattaaatgaataatatggataaaactctctttactagccgcatcctgtggacccaaatgcaggccttttttggctagctccatgagagtgagatgtgtgggcatgtgacagagtggctgcccagcgccacacggaatgagctggacatgcacaaatggaatggtggtccatgtagagttgacatgctggtccagtcatatcatcgcttagaagctactccactcaaaggtgtcttttttgggtaccttggaccgtagtttagttcagactttatatgtcaattataaggattaatgtggtgtttgagatgactctaggttccaactctattgtggagctatagtttataatatcaatttaaatagttctaaaaatattttttaatataaataataaataaaatgacttgtcttctaaagacttacagctccaactttataattttctagagcaacctaatgatctaaagctatctcaaacaagacctaaatataagctaattacgaaattaattgtataagccccaacaaatacacgagacaaatctacttagcataattaatctacaactagcacatatttactgtagcaacacatagactaattaagattaatagattcgtctaaaaattaaccatgatttatacaaactatttttataattaacttatgttttgtcttcttaattgacaaccaaaacctacactaaactttagtccgagagatccgaacaccctaaaagtaacctcacttatcctcttatcaaacgccaaaaatgataactctcttagcaagaatgcacattacgcttcatgttccttaccataacaatatacctaataagaccggtagataaaagagatccaaggaaataaatttagagaaacaactttcattaatactca

SEQ ID NO: 12239 - DNA, 1420 bp, Zea mays
agaatttttaggaaacatttagttatagggaatatagggaataggtatgaggtgctacaaattgtcaaacttgataaatttatactctcttcgtcataaaatataatttacttgtggacaaaatatacattcgctcaataagttatgaatgtagtttgtatatattctatattatttatttaaatgtggatggaaaaagagaacttaaaagaaaagagtatttaaagataaaacagtgatttaagcatatgctatccactcccgtctctcggtcccgcggtgcggaggaaccagtctaagccaccacccaggcccagctcacctctttcctctcttctcatgcccacgcgctcgcctatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgttcgaggagtatatcacctccatggtactaccttcgctaagggagaaacatgatgagtttatgctgagggagctagtgcaaaggtggtcaaaccataaagtcatggttcgttggctctcgcgtttctttcattaccttgaccggtacttcatatcaaggaggtcacttaccccacttaaagaagttggtcttacttgcttccgagagttgatatatcaagagattaaagggcaagttaaagatgcggtgatagctctgatagacaaagaacgcgagggtgaacagattgaccggggtctgttgaagaatgtattggatatttttgttgaaattgggctgggtcaaatggagtgttatgagaatgactttgaagatttcttgctcaaggatactacagagtactactctgtcaaggctcaaagctggattcttgaggtcccttgtggtgatttgcgtgcttatgggtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgcttgggggttgctttgctaaaaaaaaaaaaaaaaaaaaaaaa

SEQ ID NO: 12240 - DNA, 902 bp, Zea mays
cctcgaggccgggccgggaagcgcttcccgcgctccggagtctcctccgggcgggccgctcgctgctccgagaggcattcgtacgttacacaaatagccatcctcgttcccttgtcttgtccatcaccaccagccatcgcgccagccctcgtccagtcgccggcggcgtacgtgtatcgaccaacgacctgtagaacagattgaggacacatggacatggcggaggaggcggcggcaggagcaggaggctcatggtcatcatcggagaagccggtgatggtggtgggcatcgacgacagcgaccacagctactacgcgctgaactggacgctgcagcacttcttcgtcgccgggcagccgcagcagtaccagctggtggtgctcaccgccaagcccccggcgtcctccgtcatcggcatcgccggcgtgggctccgccgagctgctgcccaaggtggagaccgacctcaagcgctccgtcgcccgggtcatggacaaggccaagaagctctgcaccgagaccgaggtgaccgacgtcggctacgaagccatcgagggggacgccaggagcgtcatctgcgacgcggtcgagcggcaccacgccgagatcctcgtcgtcggatgccatgcctacagcaagtggaagagggctgtcctggggagcgtgagcgactactgcacgcaccacgcgcactgcaccgtcatgatcgtcaagaggccaaagcacaagcactgagatttcggatcgatttcggatctttgtatctcttaattagctgcgcgtgccaaacttttccaattttggactagcaatattgtcgagtaactcatcatcccatatcatttaggtcacgaaactcttaaaatgattttttttggaaaaaaaaaaaaaaaaaagcggcc

SEQ ID NO: 12241 - DNA, 1452 bp, Zea mays
cattggggaccccggacgccgcgatacaaaacacaaactctcggagacagggaagtagcgtagctagatccagagctcggcgccagagatacccgacatcctcgtcatgtctccggttgcaagcaagggagtagtgatggacggtgcggtggcggtggcggcagtggccgccgccgtgctgctgtgcctccatctgccggcggtggcgcgaggccagctgcaggtggggttctacaacacgagctgccccaacgccgagtccctggtccgccaggcggtggccagcgcgttcgccaacgactccggcatcgccgccggcctcatccgcctccatttccacgactgcttcgtcaggggctgcgatgcgtcggtgctgctgacctccgccaacaacacggcggagcgtgacgcgccgcccaacaacccgagcctccacgggttccaggtgatcgacgcggcgaaggcggcggtggagcagagctgcccgcagacggtgtcgtgcgcggacatcgtggccttcgcggcgcgcgacagcatcaacctcacgggcaacctgccgtaccaggtgccctcgggccgccgggacggcaacgtctccctcgacacggaggccaacagcaacctgccggcgccaacgttcaacgcgtcccagctggtggccagcttcgcggccaagaacctcaccgacgaggagatggtcatcctctccggcgcccacaccgtcggccgctccttctgcacatcgtttctcgcgcgcatctacaacggatccaccccgatcgttgactctggcctgagcgccgggtacgccacactgctgcgcgcgctgtgcccgtccaacgccaactcgtccacgcccacgaccacggtgatcgaccccagcacgccggcggtgctggacaacaactactacaagctgctgccgctcaacctgggcctcttcttctccgacaaccagctgcgcgtcaactccacgctcaacgcctccgtcaacagcttcgccgccaacgagacgctctggaaggagaagttcgtcgccgccatggtcaagatgggaaacatccaggtgctcacggggacccagggccagatcaggctcaactgcagcatcgtcaacaacggctcgtcgtcggtggggatccagcagatgacagtgcccaactcctactctggcgccaccgcgtcccttgatgatgagatcgccacgagctgatctagatcggcgcggtgtgatgtgatgatagatatttgcattgtgtgtccatctttaggctattaattagtacgtttgctcccggtacgcgcgagagtgcgtagttcgtgtgtcattcatatgcgcgtacacgagatttccagtatcaccatgcatgtatcccgtgaatcatcatcagtaaataaaactggtgctctttgagagtctattattatcgaaaaaaaaaaaaaaaaaaaaaa

SEQ ID NO: 12242 - DNA, 1887 bp, Zea mays
ccgggatccgtgatgcaagacaatttcctgaaccactgtgattagtacagcaaaaatcgccccccccgcgccgcccggggaaatacacaaatagatcaagcttatatacgcaattaagtaggtagccacaatggaggacaaggtgctcatcgccgtgggaacggtggcggtggtcgccgtcctctccaagctcaagtcggccgtgaccaagccgaagctgaaccttcctccagggccatggacgctgccgttgattggcagcatccaccacatcgtcagcaacccgctgccctaccgggcgatgcgcgagctcgcgcacaagcacgggccgctcatgatgctgtggctgggcgaggtgcccacgctggtggtgtcgtcgccggaggccgcgcaggcgatcaccaagacgcacgacgtgtcgttcgccgaccgtcacatcaacagcaccgtcgacatactcaccttcaacggcatggacatggttttcgggtcctacggcgagcagtggcggcagctccgcaagctcagcgtgctggagctgctgagcgccgcgcgggtgcagtcgttccagcgcatccgcgaggaggaggtggcgcggttcatgcggagcctcgccgcgtccgccagcgccggcgccaccgtcgacctgtccaagatgatctcaagcttcatcaacgacaccttcgtcagggagtccatcggcagccggtgcaagtatcaggacgagtacctggctgccctggacactgccattcgggtggccgcggagctaagcgtaggtaacatcttcccgtcgtctaggctgttgcagagtcttagcacggcgcgacgcaaggcgatagcgtcccgcgacgagatggcgcgcatcctcgggcagatcatccgcgagaccaaggaatccatggatcagggtgacaagacttcaaacgagagcatgatctccgtcctgctcaggcttcagaaagacgccggcttgcccatcgagctcaccgacaacgtcgtcatggcgctcatgtttgacttgtttggcgcgggcagcgacacctcgtcgacaacgctgacctggtgcatgacagagctggtccggtacccggcaacgatggccaaagcgcaggccgaggtccgggaggctttcaaggggaagaccacgatcacggaggacgacctgtccacggcaaatcttaggtacctgaagctcgtggtgaaggaagcgctcaggttgcactgcccggtgccgctcctgctcccacgcaaatgccgggaggcgtgccaggtgatgggctacgacatccctaaaggcacatgcgtgttcgtcaatgtctgggcgatctgtagggaccctaggtactgggaagacgccgaggaattcaagccggagcggttcgagaactccaacctagactacaagggaacatactacgagtacctcccgttcgggtctggccgtcgcatgtgcccgggagcaaaccttggagtggccaacttggagcttgcactggccagccttctgtaccatttcgattggaagctaccaagtggacaggagcctaaggatgtcgatgtttgggaggctgcaggactggttgcgaagaaaaacacaggcctggttctgcaccctgtcagccacattgctccggataatgcctaattgacgaaccagtttgctcctgtatttttcatgctttactgatatatgagaaaataaatccaaccagttcgctcctgtaaaaatcatgaaaaaaaaaaaacaaaaaaacgacctgccgccctatctatctatctatctatctatctatccataatgcttcatcaagagaaatgttggcgaaaatctatttttgcaagaataacaatatcagagccaacaacagttttatatgtgcatgg

SEQ ID NO: 12243 - DNA, 1985 bp, Zea mays
tatatatatatatatatatatatataaactctcgtcaacaactatagtattttttaccaagatatcgataaatgtgcaagctttctctaagctattgttggagcctcttgcaaggatggtcacttaaagagtcaagctcctagttgagtaaatctgtggaaagcatcagtcctttctcacacacaagtggatctctagaatagcctttcttggatgctttccattgtatttactattgagtttctggtccaagtgccacaaatctcgatccctccagtacatggtgtcagccaaaccacaaacatagttcgtgcgatctcacaagactacaagccccttcggtacaaactataacagtgcacatgagcaccaaggcacaagaggtattataatctcactcaaacactaggaataaacctagaacaagcgttatgtgtggtggtctaactaacctaagcactttacagaaacacacttatactaaccatagagtgatttataggaacttggatgtctacgtatttgcatcaatccaccacacattaagaggatatagggtattgcgcatttgcatcttaaacctctgtaaacatctcatgtattgatagctaggtagtactcagtattagtgtgcatgtaccatatgcccctcgctgcatccttcacttatcagctctcttgggtacctacggtaccctaatgacatcaaacaccgcataagcctacttttattttggtctaaagaaacatttgttggaattgagaacacttcttctagtcttttgttctcattcattaggtaatttaggattgtatgtgaacgtctgaagatagtgatatattggtgatttgtaaatctctttcaaaatatggtattgagctatccctgttactagtttatttgagaaattgtattagggccggcccgggaactaaccctaatcacacacactcctaactcccatcccatcccatcccatcccagccgccacagctgctgctcgccctctccctgtctcctctctctttccagccacggtttccccttcccccatccgcgcgctagggcacgaggcaaatctgtggccctctcctagtctcctgaagtccgactcagccgtctcccagctcccgctcgctcgaactcgggttggggaggcacggagtcactgaccccttcgcgttaggcggtgcccttaccggctcttcgtctaaggtgtagtcaagctgccggccacgcccggcacccccctatccagtacaaggccttctccgagatccagtacaaggtcgtcgtctccaagatctgaccccgacgctagtgaggagggaagagtgggtggacgaagtgggggaggatgagcgaggagaggccggtgccgcggcgggagagcccgtggggtctgcctgagggcgacacgcggcagcccaaggctcaccgctgcaacgaccgcgccgaggacgtcgtccaggcttgctttgaagggaacccattcaagacagttccaggcccatttaagctcttctggcaatgcatgcgctcaaaacctggggaggaaccaaccgagccctatacctacctgcagctagatcctccgagaaagggtggaagtgaatctggagcaaacaggaagtgaaccttgaacgagcatgcctagtttagcatctcgtgcctatttgtcttcacctttcgagcagactttttccccctagggatcacatcatgtgagcacaaagctgcataatggtttggatgtttatataatctacctaataaaccgtgatccccagagctgcctgtccaggctgccaactccttgaaattcccccccccccgtgtaagaattgtgcccctttcttctgaataaatggtgcacgcccaagtccacatgccgccagacatcagagctagtgcatctgaatggttgtgctcctgttctgaaacagagtgatccatatggtttttgtgtttaaaaaaaaccaac

SEQ ID NO: 12244 - DNA, 1649 bp, Zea mays
cattgggacctcgagcccgcgggccggactcccatcccagccgccacacggtggacgctgcagctgctgcagacagctgctgctcgccctctccctgtctcctctctatttcccagccacggtttccccttcccccgtccgcacgttagggcacgaggcaaatctgtggccctctcctagtctcccgaagtccgactcagccgtctcccatctcccgctcgctcgaactcgggttggggaggcacggagtcactgaccccttcgcgtttggcggtgcccctgcaccggctcttcgtctaaggtgtagtcaagctgccggccacgcccggcacccccctatccagtacaaggccttctccgagatccagtacaaggtcgtctccaagatccagtacaaggtcgtctcctccaagatctgaccccgacgctagtgagaagggaagagagggtggacgaagtgggggaggatgagcgaggagaggccggtgccgcggcgggagagcccatggggtcttcctgagggcgacacacggcagcccaaggctcaccgctgcaacgaccgcgccgaggacgtcgtccaggcttgctttgaagggaacccattcaagacagttccaggcccatttaagctcttctggcaatgcatgcgctcaaaacctggggaggaaccaaccgagccctatacctacctgcagctagatcctccgagaagggtggaagtgaatctggagcaaacaggaagtgaaccttgaacgagcatgcctagtttaccatctcgtgccgatgtgtcttcacctttcgagcagactttttcctcctagggatcacatcatgtgagcacaaagctgcatatgtttggatgtttatataatctacctaataaaccatgatccgcagagctgcctgtccaggctgccaactccttgaaatttgctgatgctggtgtaagaattgtgcccctttcttctgataaatggtgcacgtccaagtccacatgccgccagacatcagagctagcgcatctgaatggttgtgctcctgttctgaaacagagtgctctatatggtttttgtgtgtttgtccatactttcatatagcatactagtgtagccgtacagtttacaagctgtatataaggccatccatccattctccaaaaaaaaaaaaacaactgaagtattttgtcttaagagggggttttagccccttggttgccaaacagtggcagggaaatacacccgagtggaaaaaaatcctcccagggaattgaagtgtcatttaaaatccccttggtgcattacttccctagctttttttgtccatttgttgccaaactagccctaactgttctttttaccccttcatacagtggtccagcttccactatggctctaagcagcagtatttcggtccagaaaaccttgtatgaggttttatctgtgagcgaagacgctacatatgatgaaattcgtgcggcatacaggtctgctgctctgaacacacaccctgacaaggcacggacaactctcgagtcacgtgttctttgccggtgagcaacaggaattttctagtgtgcagaaagcatgggaaatcctacgccatcctacatctagagcagactacgataagcagcagcaggtcgactctag

SEQ ID NO: 12245 - DNA, 1343 bp, Zea mays
ttggggtaccctccgggctggccggggttgacggcatgcattttatttttttgcatcgaacacactgtggttagttctagcctcccagccacccacgcttctctcgtccctcccctttgtcggtgtcttccccctctctcttctcttctctacaaatctctcttccgcatccgccgcaaaaccctaacctaagcggctcaaccctacgattaccgccgccgccgccccccgctcgcccacgcaagcttgggcgggcctccctcagctcggccaagagcccgaccccctgctccggcaccagcgccgccaccgccatggatatggaagtgtacgagcgcctcaccgccgaaaccagtcactaccgtggcacgcgtttcgatgcgctgatcgggctcgacgaggtggagcctagtgacgaggaagaggatgaggaggaagaagagcgagcggcgggtgccggggctggagacgagctgctctgcccgttctgcagcgaggagctggacgcggtggggctgtggtgccatatggacgacgagcaccatgctgaggtcaatgccggggtgtgtccaatttgcacagataaggttgatatgaacttgattgtccacatcagctcacagcatcgaggtttcttgaaggataagtggagaaatcagcaaggttcatctggggtgcgttattcaacacttgccttattgaagaaagatctacatgagaggataagtggatcatctcgtgctgccccagtcagcacggtgcctgatcctctactgtcctcttttgttggtagcttttatgaagtcgatttgccaaaggatgctaaaaaagagtccttggttgagacagaagtgggaagtgataacatagagcagagagcagcggagagctttgatgagcctttgctccctgaggtgaaggaggagaaaaccaggaggagccaatttgtgcaggggcttgtcttgtccctgatgtttgatgacatcttatgaagagcacatcccaaaaggggaagggagaaggcatattttgctaccagcaaacgtttcgccggcacagctgttgtaacgattcgctgatttgccatcggaagatggtgacattgctctgggataatgggggagatgaactgtggatatggatgtttcgtagtactatgcatcatcattgcatgaataatagagtatatgtatgtatagcttgttagcatcatggtactggatattctggggctctgtatgtatattgggaggccgaaatggaccctacctatcataaatcagccatttgataatgtgcatgtggtgtttttctggaaaaaaagaaaaaaaaaaaaaaaaaaa

SEQ ID NO: 12246 - DNA, 2643 bp, Zea mays
  misc_feature (1948)..(1948): n is a, c, g, or t
ccggccgggctctccctccccgtgcgccgcctacagcctaaacgcaccgcaccagacaagaaacaaggggagggagaaccgagagcggcggcgaccggcgagagagagggagggagggacgagatagattcataggtactagcggaggaagcgagtcaagggaaagatgcggactcccgcgatgcgcgttgcctaaaagttccatttcattccttccggcggaggccgggcaatacgctatctctggcgagagagatgccggcgacaggagaaatccacggcctttattagagagaagagatcctattcctacggttctcctcgcatcctgttgcttctgcgtgcggccagacgcgggcacgatatgcaggccgccgccgccgccgccccgtggacgacgaagaccctgccggtgtttgggaaccacctcggcaaccccacgcgcttcacaggcgcctcctcgtccttccacagtacgcccgcctccttcgccaagtggaggaacaaatgggactgccacaagagcgaaaaaggagcacgaaaggcatccaggaattatgagaggtatgtggttcggcaaaaacgagcagaaggaaagaaggccctaaaggattatcttctctatggaaagtcattgcctcatttacaggatggaagcacaggtagctttgctaactcacatgcaattccgaggttcaaaacgtttaggaaaggacctcaaactcactggtcatcgaattcatggcaagggcgtacacaatcacagaaagagtaaaaaggacaaggaaaggttctgcaacttcttccatgatgaccatcatgtgcaccctgatgacatctttgaagctgtcttcggggcacattatggttttacttggtctcaaatatcgtgggaagggtttcacttcagggacaaatcgttcagatttagatggagcggccgtgaatcacgcagagagagaattccatgtgacagcgaagatgaagaaagcgcggatgagagcagagaaacagccagcgttggttcacatgctcacagggtcatccttggattacaaccatgtggtccactaactctagaagatgttaaaactgctttccgggcatctgcgctgcggtggcaccctgacaggcacccggggtcatcacaggccatggctgaggagaagtttaagctgtgcgtgaatgcgtacaattcactctgcagtgtcctcaaggctgcttaggttgtgtttgctgtcactggaggttgttagcttgttatggtatatcagtttttaagggctcagggcctgaacaatttggcggggaaaccactggcgaccatggatgcagtgcagtgggttgttttgtttcacttttcgtttcgattgaaatagcaagggccaagctccgacgtcagggttgatttggtgattgagggggaaatggactaatttccccccaatcctctcgtgatttctggtcaccaaatcagccctgggaaacttaaacccccgggatccctgcctttaaaccctctgggatctctgcattttctcagggtgagcaatccatcggggtaccatttgaattaaacatttatttccttatgtgaggttttcctccctgtatttggcctcccttgcttccaaactagtcccaaaagggataggagcgccactgtttgttgttgtactaacttgtacactagtgtgaattgtaacatttgattcataaaagtggaacaaataaaaatacaaaggggcatgtgaggcatgagaatcctgcaaatgggattgctcgctggcggcctgtggtactgttggctattttattttgcagcccctgtctgaaactttgtggctgatccatctgagattctgatgtgccgttctgggtacaggtttgtggagtgtgatgatttggccggggtaaagcgaggctggccggtgtggtcgccatctcncagctttagtccaaagtacctgtactgatatgtactacaatcgcagcaaatcaaatgaaaacaaatctgctaatgcggcgccgtgtctgtttgtttgtttgaatgaatgaaaagactgatactcatggtaggctggtagcaggggcaggcaaaagcatcattccgacacaattaggagaggagaatcttgacctctcttttcatttcatagctagtgcagctcctagaagtgctacttataataaagaaaagaaacgatggtaggtaatctggattctcctctgaaactgaaatgccatcgtctcagactctattcaactgatgcattatgctatgcagagagatggatccaggatctcctagacagatcgatccaaaaactagaagcagcagccatagaagggtactagaagcagaggattgcgacggaggcggcgacgcagaatgcgaatgtggtgatgaggaaggcaaagtggatggcccagctccgcctgaacttggcgaggtacgcctcgggcggctcctggtacggcacctcgacgtctgcggccgggacgacatcggccgcggacttgagcatcctgagcctgtcggcggcgagcgcgagcgtgagcttgtggcatcggcgctggtagcggaagccgtgggcccggcccggccggcgcgcgacggcggcgtagaaggcgaggtgcgcg

SEQ ID NO: 12247 - DNA, 1877 bp, Zea mays
catgaaaaatatagaaccgaacgaatcagtcaggcaggaaataattgagccaattagcagctcgaacccacggctcacagtacaaagacaagaaatcaccgccaccacgcgcaaagccgaatccgaagccaagagccgtatcgacatggaactctccctgacctcatctgctgctctgcagttcgtcctgctcctccccctgttctctgtgctctgcatactctacctgcgccaggatcccaagaagcagcctcgcgctcatggcctcaaggtctacccgctcgtcggtaccctcccgcacttcgtcaagaaccagcgccgcttcctccactggtccaccgacgtcctcaagcgcgacccctcgcacaccctgtcgttcaaggcgctcggcctcaccggcggcgtcatcacggctaacccggccaacgtcgagcacatcctcaagaccaacttcgccaactaccccaagggcgagctgacggtgtctatgatcgaggacttcctcgggcacggcatcttcaactccgacggggagcagtggctgtggcagcgcaaggccgccagctacgagttcagcaagcgctcgctcaggagcttcgtggtcgacgccgtccggttcgaggtcgtggagcggctgctgccgctgctcgaccgggcgcagcgcgacgggcggacgctggacgtgcaggacgtgctggagcgcttcgcgctcgacaacatctgccgcgtggcgttcggtgacgacccggcgtgcctcgccgaggaggagggcatgggcatggcgatggcggcgcagcagaggcagagcgccgagttcatgcgcgccttcaacgacgcgcagagcgccatcatggcccggttcatgtcgcccgtgaagtcgctgtggcgcctcaagaggctgctgaacgtggagcccgagcggcggatgcgcgaggcggtccgcaccgtccacggctacgccgacaggatcatccgcgagcgccgggcgaggggcgaggcggccgggcccgcgcgcgacgacgacttcctgtcgcgcttcgccgcgagcggcgagcacagcgacgagagcctccgggacgtggtcaccaacttcctcctcgccgggcgggacacgacgtcgtcggcgctgacgtggttcttctggctggtctccacgcggcccgacgtggaggagaagatcgtgcgcgaggtccgcgcggtgcggcgtctgggaagcgcgggcgcggcggcgccggcgttcagcttcgacgagctgcgggacatgcagtacctccacgcggccatcaccgagtccatgcggctgtacccgccggtggccatggacacgcacagctgcaaggaggacgacttcctccccgacggcacgttcgtcggcaaagggtggctgacgacctactccgcgttcgcgatgggccgcgtggaggacatatggggcgcggactgcgaggagttcaggccggagcggtgggtcggcgaggacggcgcgttccgcccggagagcccgttcaagtacccagtcttccacgccgggccacggatgtgcctcggcaaggagatggcgtacatccagatgaagtccattgctgcatgcgtgctcgagaggttcagcttccagttcgtcggcggcggggagcggccggggctcgtgctctcgctcacgctgcggatgcagggcggtctgcccatgaaagtggtcaccaggacgaactcggctctaggctagactttccacaccagacagtatccatctcaatacacatacgattggacggtttagggagattggggtgtaatttcacttagttttcgagctgatccatgtcaacccatatctatatatgaattaaaatgaatacgagtgaaaaaaaaaaaaaaaa

SEQ ID NO: 12248 - DNA, 1830 bp, Zea mays
gcgttcgctactatatacaagcatattcaggggggggtgtgaactaaaaagaataagaaatggagtcaaataatatatatgtaattagagtaacgggaccggtcatcccaggtcccagtccaccggtatcctcacgcagccacgctaaattcgtctccacctcctccctcgtgacatcgtctcgcacggtcgctcccacctttccgcccgccgaaaccctagcccgccccgcctcgccgacggcgatgggcgctgcatgatcggtgcgtccccttggaaccgcctgccttctggcatcgccaagcccgctgccgcggctgccgtcgtcgtagcggcgctcgcgtcctccttcctcgccctcccgcgtcctcgcgccgccccgcccccagcgggatccgggcccctcatgtcgaaggcaaaggtctacaccgacgtcaacgttctgcgtcccaaggagtactgggactacgaggcgctcaccgtccaatggggtgagcaggatgactatgaagttgtcagaaaagttggaagaggtaaatatagtgaggtctttgaaggcatcaatgttaacaattatgagaaatgcatcattaagatccttaagcctgtcaagaaaaagaagatcaaaagggagatcaaaatacttcagaatctctgtggaggtccaaacattgtgaagttgcttgatattgtcagagatcagcattcaaagactcccagtttgatatttgaattcgtcaacaacacagacttcaaagtcttgtaccccacattgacggattatgacatccgctactacatatatgagctactcaaggctctagattactgccattctcaaggcatcatgcatcgagatgtcaagccccataatgtcatgatagatcacgagcttcgcaaacttcggttgatagactggggcttagctgagttttaccatccaggcaaggaatataatgtccgcgttgcatcgaggtatttcaagggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctacttcctccaagtcagagctgtggagaacagtagaacgagaccacaataatcgttgtctacaccctcgaaatgaagttgttgctaatttctggaacatcataggctaaaaccgttcaataagcatctcgctccaggaatctgggccatgactccgtggcagtgaatcagatagtatgggtcgcatcatgtgggcaaccttggcagatgtttttattgttgtctttaatcttgggactactgtagctttaaacctacaggctgtgcttgaatgacatgatattcatatcatatcgtctcctgtggtgggatatgaaattgtatgttatctttaaacataaacatactggttgtattatggtgtgctattatgtatgtatgattcttatttattctgtgtgatattgtgatgaaatactcatggacctcagagatgaaatatgagtttcccaaaaaaaaaaaaaaaaagcggcc

SEQ ID NO: 12249 - DNA, 1689 bp, Zea mays
aattcggcgcgtcggccggtcccagtcggccggtattcacacgcagccacgctaaacaaagcccgacgagagattcgtctccatctcccctcgtcttcctccctccttcagcccgaggaaaccctagcacgtcccgtctcgcctcgccgccggcgatggccgctgcatgatcggtttccccccttggaactgcctgcctaccggcatcgccaagatcgccgccgcggctgccgtcgtcgtagcggcgctcgcgtcctccgggatcgccctcccgcgtccacgcgccgcgccgcccccatcgggattcggcctcctcatgtcgaaggcgaaggtctacaccgacgtcaacgtcctgcgtcccaaggagtactgggactacgaggcgctcaccgtccaatggggtgagcaggatgactatgaagttgtcaggaaagttggaagaggtaaatatagtgaggtctttgaaggcatcaatgttaacaacaatgagaaatgcatcattaagatccttaagcctgtcaagaaaaagaagatcaaaagggagatcaaaatacttcagaatctctgtggaggtccaaacattgtgaaattgcttgatattgtcagggatcagcattcaaagactcccagtttgatatttgaattcgtcaacaacacagacttcaaagttttgtaccccacattgacggattatgacatccgctactacatatatgagctactcaaggcccttgattactgtcattctcaaggcatcatgcatcgagatgtcaagccccataatgtaatgatagatcatgagcttcgaaaacttcggttgatagactggggcttagctgagttctaccatccaggcaaggaatacaatgtccgtgttgcatcgaggtatttcaagggacctgaactccttgttgatttacaagactatgattattctttagacatgtggagtcttggttgcatgtttgctggaatgatatttcgcaaggaaccattcttttatggccatgacaaccatgaccaacttgtgaagattgcaaaggtccttggaacagatgggctgaattcttatttgaacaagtaccacattgagctggaccctcaacttgaagctcttgttggaaggcatagtagaaaaccctggttgaagttcatgaatggtgataaccaacatctagtatcacctgaggccatagattttctcgataagctcctgcgctatgatcaccaagacaggcttactgcacgggaagctatggcacatccctacttccttcaagtcagagctgtggagaacagtaggacgagagcacaataatcatggtctgcactcttgaaatggagttgttgctagttcgtgaaaatcataggcttaaatccatgttcagtattcacatcgctccaggaatctgggccatgactccatggcaatgaatcaaaatagtacgagccgcatcatgtggacaaccttggcagatctttttattcttgtctttattgctgggagcactgtagctttaaacctacaagtagtgcttgaatgagatgagattcatatcatctcctgtggtggaatgtgaaattgtatgtgacctttagactaattaaaaagtacaatacagcgctaagcatactgcttgtattaaaaaaaaaaaaaaaaaaaaaaaaaaacaaattgggcgcggccgc

SEQ ID NO: 12250 - DNA, 1756 bp, Zea mays
  misc_feature (1745)..(1754): n is a, c, g, or t
ccgggacctcatctcatcatcgcctccacctcacccctcgaggccgccccccccctagtccctagccaattcttttttgtatcaaaccctctttccccatctcagatccctctcccgtcccagctcgatcctgcccgatggccgccgtaccgtacgccgctgctgccggacgctgaacgaccaggacaaccacctccgacgtccccccgtgtatccacgagatggtcgcggaggcggcgccgtcctcctcggcggcgatctggtcgctccgccgcgacgagatcactttcgaccgcctccacaagttttggagtgccctgtcatctcgtgcacggtacgaactgctaagacttgataaacagacccttattgagcatgctcgcaagaatttgtactgttcaaggtgcaacgggctgcttttggaaagtttcacacaaataatgatgtatgggaagtcactgcatcatgaaggttcgtgtgagccaaggattcaggaagttgaagcagaagttcaggacccttcagttcatccttggggaggcctttcgacaacaaaggatggcatcctaactcttcttgattgcttcataaatgcaaaatcacttcatgagatccagaatgtatttgacaatgcacgtgctagagaacgtgaacgtgaaatgctttaccctgatgcatgtggtggcggtggcagaggatggattagtccagtgatgcctaactatggcaggggccatggaacacgagatacttgtgctttgcatactgcacgtctttcttgtgacactctagtggatttttggtcggcactgggtgatgaaactagatcatcacttttaaggatgaaggaagaggacttcattgaaagactcatgcacaggttcgacagcaaaagattctgcagagactgcagaaggaatgttattcgtgaattcaaggaactcaaggaactaaagcgcatgcgaagggaaccccacgcgtccggttggttttgtgttgcagataccacatttaactgtgaggtgttcgaggatgctattcttgttgattggcatcaatccttattggagcaagatggaatttaccatcatttcgagtgggctattggaacagatgaaggaaaatctgatattctaaactttgaaaatgtgggcatgaatggacaagtccacaggaaaggcctcgatcttgatcactttgaagactattttgttacactgagagcatgtaggctggatggccgccgtacagaattctgtgtgaaggcccatgccttgaagggccaatcttgtgttcaccggaggctaatcgtgggggatggatttgtgacaattacaaaaggtgaaagtattagaagtttctttgagcatgctgaagaagctgaggaagaggatgaagatgatgtagtggacagagacagcaatgaccctgatggtgatatcgctcatccacaaaagcatgctaagagccctgaacttgcaagagaatttctcctggatgctgctgctgttatcttcaaagaacagattgagaaggctttcagagaaggcacagcgcggcaaaatgcacatagcgttttcgtgtcccttgctctaaaactgttagaagaacgagttcatgttgcctgcaaggaaataattacattggaaaaacagaccaagcttcttgaggaagaagagaaagaaaagcgtgaagaagaggagcgcagggagaggaggagaacaaaagaaaaattaatataatannnnnnnnnnag

SEQ ID NO: 12251 - DNA, 2154 bp, Zea mays
gggtacccccggccggccggccgagtacctgagctgatcacgagtctctcagcgagtgctggagagcccactatgtccgccgccggcggcgacctgccggagactgtggaggtgacgctgcgcgccgtcggcccgtcccgtccaaccaccctccgcctccctccgcttctctcggtcgccgagctgcgcggctgcatcgcgcgcgaacgccgtctagcaggcacggaagaagttcgactccgcttgatcctgcgggggaagacgctcccgcaccaagacgacagccatgtcactctccgcgatggggatactcttatagtcgccgtggcacctaagcctcctgttaatcatcttcttgatgatgacgttgaggacgaagaagaggatgaactgaagttcagaataccacaaacgacaaccttgtggaagaggaaattttttatgtttcttcgagacaaattgagattgcctgatatcattttgatggcgctgttttctctcagtatgaaagcatggattatcattgcaatgtggttcctattggcaccgattgctcagaagtacgacattggacctttatatataattggtactggtttcttgatcatacttattaatctcggaagacgacagcaaggtgatgttagtgcatactccatattcaacgaagattttagggagctgccaggaacacttaatgcagatcgcattgatgcagacatccgggcaggtcaattttaagcccttactgggcattgcagagatagggaccatggtatgctgagatttgtacagaagcgtactgggcattgcatttgtttgtgcatggaaagcagtgtggagataaaggctgtgcccctctaaggttaaggtcaaataaatttctgacctgtaagtgaaaatgttgcctggttacaattggaaattaccgtgatactttgcagatctgtacttgtgaaaccaaaagagcagagtagcttaagactggcaacaaagtgattttattcctctcttgcaagttcttgtgtccgctatgagccacaaagtcctatatagcaacttgcatttatgagtttcatccaagttaatgttggtactagcggccttgcccaggttaagggcatgtttggccagaaccaggctttggttgcctgcaaaaagtttggacctgactcactagatgcaaaatgcaggcactagcctggctcaccagagattatagttgttaaggtgagtggctcccttttcaccttttaagtgataaggcgtaaggtgaggtgacaccttactaatatataaaaaataggcaataaaaacagtatatataagaatatagtctcaaataaatagggataatagtattaaagtagtaaataggtgtgcaagtccaatataaaccaacattatagacataaacacaagtaatagataatagtagtagtagtctagtagagtagataacactcgtctctcaaagatttttgagaattaagagtatttccatgtgcaatgtaacgaggcgtacttcagtgacatgatacccgtggccccaacataatagaaatccttacccgaattatcggtgtattccccaaaaaaactgtggcaattcacacaatggcaggactaaatcctacagaagaatcactgcaaaatttatataccccgcacaatgccactggctcaaaaaaaaaagttttaaggatctgccatcatgtaataatccccatttgaaacaaatccaggattgaagttcaagaccctctcgagtttttgttgattgaacacttcaacttcaaccaagaagacagcgctgactggccggtgatctgagaggttcagaccggagctccaatatgatagttgtttggtacccttcccaaaccatagcacacgatcgcacctgattcattggcaatacactgaacagttgagcgtcttcgaaaggacaaccagttactagaatagatatagtagctagaattctgacaggaaattttcaagttcaaaaacgtagcaaaatagactctcaagaatgctagaagaaatctcaagtttagaaacatggtcatgatctgcatgcttcaacttggtatatgtggatatatgcatgcctgatatatttctaatcttaaccagaaatacagtataatc

SEQ ID NO: 12252 - DNA, 2412 bp, Zea mays
ggctttgcctgcgctcacggacggtcactggctcacgctcccctcgcctgcgtcgcctcgcctagacaagagacaagacgcctagtcgcctccgatcgaaatcgaatcgagtcgggtgggctcgggcccggtcttgttgtcttgtctcccagctaggaatagcgcaacgagatccctcgcgcgcgcggaccccggagaggccgagggagggtgacagggcgtgtcctcgaccgcgaggggaatgggatcggagggacgggcctggaacggcgcgggcatggccgccggcagcggctatggcggcggggtagaggcgaaagcgaccaccacggctgtgtcggccgcggcccccgcggaggttcccacgtcggcggcctccgtcgacatctcgctgccgctcctgaagatgtcgcctcgcatcatagctctctgcaaggaattggtcgaagggtggtcgtcgattgacagctcgctcttctccatcgagaccgtgtccgggggcatcacgaatctattgctgaaggtttctgtcaaagaagacaacggcaatgagtcttctgttactgttcggttgtatggaccaaatacggacttggtgattgataggaaaagggaattgcaggtgagaatctgagtggtacgagattgtgtgttatagtcatattatactaacctagtaacctgcatcctatagtattctacattgggtctagtatgaccccttgtatttggtgtcatatttttatagtggcatattttcaattcttctagacatagcatagtcatggtcttgtagtagcatctgtcctaccaagtgcattaccttttgtttcatatctgtaccttttccctgacaaatggatttcatttcattctctgaaaattgctaacctagaatgatagtttttaagggttcctagactgtacacatagtataatttatctcggttctaaaatatttcctaatgcatacatctattaccgtcatggttaggcgataccatatctctcagctgcagggttcggggctcggctacttggaatatttgagaatggagtagttcagtcattcatctatgctcgaacactgtcaccagcaggtaggcatagatcctgtctgaataacatatgggtgtggggtcctaatcaacctagtgcaatagtttctttgttctcctttgtagtttcagttgcaatttcaaatgcaagttgaaaggatttatgttttttcctttccctgtagtcagcattatccacgatttggtatgccaatttgaagccttggatgtttggaggttttatgaaatgcttctgtaaacaaatctactgatcctcgttattttgttttgcacgcctctaagaacctaaaatagcagctgaaattgccaaggaccttcgcaaattccatcaagtagacataccagggtctaaagaaccacaattgtggaatgatatattcaagtttttgaagaaagctgcagcattgaagtttgaggataacatgaagcagaagagatatgaaaagatctcatttagagaaatacaagatgaagttcaagaacttaaggatctcttggacattctgcacgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgcaggatttgattgtgactataatttgtacccagataaagatgcccagtatcacttcttcaggaattatctacacactgatagacctagtgaggtggatgcacaagatatggaagtactttatgtggaaacaaacactttcagactagcatcgcacatttactgggcattatgggcccttattcaggcaaaggtatccccaattgactttgactatcttggatacttcttcttgcggtatggtgagtacaagaaacaaagggagtcctgcttctccttggcacaaagctttctctccgagctaaaaaatggctagagcctgagaatctgttcacgagtttatactggtgtacgcatgctcggagcgggtacgcgttgtgatcatcgactgctacccagaaactctattatagcggttgtagcagcccctcattgttgtatctgatgttaggttcatcattgtctaaggactagtttggatactctagtatcgagctcaattcatgtgtatgagatggattcgggtgtaacttaaactaatttacacactaatccaactcaacacatgtggattggggtcaatactagattacccaaacaaagcctaacagggaagtccccagtggcaaattatgtacttatatttataataataaacacaatcctgatgggttgtgcccc

SEQ ID NO: 12253 - DNA, 736 bp, Zea mays
aattcggcaactggctcacgctcccctcgcctagacaagacgcctagtccgctagtcgcctccgatcgaaatcgaatcgagtcgggtgggctcgggcccggtcttgtttgttgtcttgtctcccagctaggaatagcgcaacgagatccctcgcgcgcgcggaccccggagaggccgagggagggtgacagggcgtggcagctcgaggggaatgggatcggagggacgggcctggaacggcgcgggcatggccgccggcagcggctatggcagcggtggagaggccaaagcgaccaccacggctgtgtcggccgcggcccccgcggaggttcccacgtcggcggcctccgtcgacatctcgctgccgctcctgaagatgtcgcctcccatcatagctctctgcaaggaattggtcgaagggtggtcgtcgattgacagctcgctcttctccatcgagaccgtgtccgggggcatcacgaatctattgctgaaggtttctgtcaaagaagacaacggcaatgagtcttctgttactgttcggttgtatggaccaaatacggacttggtgattgataggaaaagggaattgcaggcgataccatatctctcagctgcagggggtccggggcttccggcctaccttggatataattcgaaaaaaggggagcaacctcagaccatttccttctaatggctgcggaaacacctgccacaccccggaagaacaatggaaaag

SEQ ID NO: 12254 - DNA, 1965 bp, Zea mays
gcacgagaccattacctagaacatcctaatcgaaaaactgtcttgcctgttgcctctgcggctttgcctgcgctcacggacggtcactggctcacgctcccctcgcctgcgtcgcctcgcctagacaagagacaagacgcctagtcgcctccgatcgaaatcgaatcgagtcgggtgggctcgggcccggtcttgttgtcttgtctcccagctaggaatagcgcaacgagatccctcgcgcgcgcggaccccggagaggccgagggagggtgacagggcgtgtcctcgaccgcgaggggaatgggatcggagggacgggcctggaacggcgcgggcatggccgccggcagcggctatggcggcggggtagaggcgaaagcgaccaccacggctgtgtcggccgcggcccccgcggaggttcccacgtcggcggcctccgtcgacatctcgctgccgctcctgaagatgtcgcctcgcatcatagctctctgcaaggaattggtcgaagggtggtcgtcgattgacagctcgctcttctccatcgagaccgtgtccgggggcatcacgaatctattgctgaaggtttctgtcaaagaagacaacggcaatgagtcttctgttactgttcggttgtatggaccaaatacggacttggtgattgataggaaaagggaattgcaggcgataccatatctctcagctgcagggttcggggctcggctacttggaatatttgagaatggagtagttcagtcattcatctatgctcgaacactgtcaccagcagacatgaaagaacctaaaatagcagctgaaattgccaaggagctacgcaaattccatcaagtagacataccagggtctaaataaccacaattgtggaatgatatattcaagtttttgaagaaagctgcagcattgaagtttgaggataacatgaagcagaagagatatgaaaagatctcatttagagaaatacaagatgaagttcaagaacttaaggatctcttggacattctgcgcgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgcaggatttgattgtgactataatttgtacccagataaagatgcccagtatcacttcttcaggaattatctacacactgatagacctagtgaggtggatgcacaagatatggaagtactttatgtggaaacaaacactttcagactagcatcgcacatttactgggcattatgggcccttattcaggcaaaggtatccccaattgactttgactatcttggatacttcttcttgcggtatggtgagtacaagaaacaaagggagtcctgcttctccttggcacaaagctttctctccgagctaaaaaatggctagagcctgagaatctgttcacgagtttatactggtgtacgcatgctcggagcgggtacgcgttgtgatcatcgactgctacccagaaactctattatagcggttgtagcagcccctcattgttgtatctgatgttaggttcatcattgtctaaggactagtttggatactctagtatcgagctcaattcatgtgtatgagatggattcgggtgtaacttaaactaatttacacactaatccaactcaacacatgtggattggggtcaatactaaattacccaaacaaagcctaacagggaagtcaccagtggcaaattatgtacttatatttataataataaacacaatcctgatgggttgtgccctgttgaatttgttcttcgaaaaaaaaaaaaaaaagtgcggcgagacaccctatacgtctgcgagacctaccagctgcaggttgacttacgtgagcattatcctatggatgcacctcatg

SEQ ID NO: 12255 - DNA, 1672 bp, Zea mays
ggtcgcctccgatcgaatcgtgtcgggcgggctcgtgcccgatcttgtctggtcctgtcttggctccccgccaggaatagcgcaccgagatcccttgcgcgcacggaccagcagatcgcgcgcgggagtgagagggcgacagggcgtggccgcgaggtgggcatgggatcggagggacgggtctggaatggcgcgggcgtggccgccggcagcggctatggcggcagcgtcgaggcgaaagcgaccaccgcggcgcccgcggacgttcccacgtcggcggcctccgtcgacatctcgctgccgctcccggagatgtcgcctcacatcataggtctctgcaaggagttggtcaaagggtggtcgtcgattgacagctcgcgcttctccatcgagaccgtgtctgggggcatcaccaatctattgctcaaggtttctgtcaaaggaaacaatggcaatgagtcttctgttactgttcggttgtatggaccaaatacagacttggtgattgatcggaaaagggaattgcaggcgataccgtatctctcagctgcagggttcggggctcggctgcttggaatgtttgaaaatggagtagttcagtcattcatctatgctcgaacactgtcacctgcagacatgaaagaacctaaaatagcagctgaaattgccaaggagctacgcaaatttcatcaagtagatataccagggtctaaagaaccacaattgtggaatgatatattcaagtttttgaagaaagctgcagcattgaagtttgaggataatgagcagcaaaagagatatgtaaagatctcatttagagaaatacaagatgaagttaaagaacttaaggatctcttggacattctgcatgcacctgtggtttatgcacacaatgacttgctttcaggaaatctgatgctcaatgatttggaagggaagctatattttattgattttgagtatgggtcatacagctaccgtgggtatgacattgcaaatcatttcaatgagtatgcaggatttgactgtgactataatttgtacccagataaagatgcccagtatcacttctttaggaattatctgcaccctgatagacctagtgaggtgcaggcacaagatatggaagtactttatgtggaaacaaacactttcagactagcatcgcacatttactgggcattatgggctcttattcaggcaaaggtatccccaattgactttgactatcttggatacttcttcttacggtatggtgagtacaagaaacaaagggactcctgcttcgccttggcacaaagtttcctctccgggctaagaaatggctagagcctgagaatctggtcaagggtttgcactgttgtacgcatactcggggcgggtacgcgttgtgatcatcgtctgctactcagaaactctactatagtggtggtagcagcctcattttgttgtatctgatggtagtttcgtcatcgcctgataggaaagtctcatgatcgccctcgggaacgcagggtggcgagatctgtacttatatttgtaataaacacaatccggatgggttctgtcctgtgcaatttgttgtgcgcataagcattccgtgtttttatacattattgtgaggaattgcataagtttttttgtttttcgattaaaaaaaaaaaaaaaaccc

SEQ ID NO: 12256 - DNA, 821 bp, Zea mays
  misc_feature (804)..(804): n is a, c, g, or t
ccgggaaaaaaaaaaaaaaaaaaaaatccctacccaataggccaccatcatccaccgctgcggccgtgcgtggaggcgtgaggccgatcaaatcggcggcgaatccccaaccctagcagcagtgggcggccggaccgggacgggcggtagacggctccagcacgcaacgctgacaggtttggccgtgcgaggcgcgagggctagacaggtgtcgcggcgccaggcatccagttccagggctgcgtgggctcgaccagagcgagtctgcaatccgcccgtccttgtccccgtcggcggccgttcaccagtgtcaggtgcggaggtgacaacatttctgaaagaagtaagcaagcactagttatatggtgagtcatgtcaaaggcacgtaatgctgtagttgccactggattgctgctcttcgctggtgctggcttatcatttccgttccttttcgtgaaatcaaagaacaagcctattattgattcgacaaaacctctgccaccacaggctacttttcgaggaccatacgtgaatacgggttcacgtgatatcggacctgatcctaccaactatcccaagaagtgatttgaatcttccatgacatttcggagtcccatttcactcgactccactgctgtgaaattgttcgttttggggccatcttactgtgcacgtgccttgatattgcaaaaaaataaaataaataacaatacctaaataaagggtggttattgaagctaaaaaattctccttgctcccggccaaaaatcccttgcttccaaataaatcctagtgtaaagtttnccaatattgtatgggaa

SEQ ID NO: 12257 - DNA, 1415 bp, Zea mays
accttcttgggttttgtataaatgtctataataatggcaaagctacaaatgaatatgattctccttcacaagaatccatgaaatatagcttgtcattataatatttgtcctcttggaacatattgtataattatgtgtatatgtgcattggttgatcaggaaccttatgttctccatgaatgtagaataggaaattgaagataacctagaagggtacaacttttttttcattaggtgattaagattatgaaaattcaagccgtgccctatgtctataactctatcgttttgattaaaattattgcattttggatttatggttccgttagtatgggcaccttactaatactaatgtagaatagtagacgatttgaatgaaattctcgttgcgttattggcccggctatgcaactgggctcaatgcaaaattaaacgtgggctctgaaggagaaaagtagcccacctaactattccggaccccctacccaataggccaccatcatccaccgctgcggccgtgcgtggaggcgtgaggccgatcaaatcggcggcgaatccccaaccctagcagcagtgggcggccggaccgggacgggcggtagacggctccagcacgcaacgctgacaggtttggccgtgcgaggcgcgagggctagacaggtgtcgcggcgccaggcatccagttccagggctgcgtgggctcgaccagagcgagtctgcaatccgcccgtccttgtccccgtcggcggccgttcaccagtgtcaggtgcggaggtgacaacatttctgaaagaattgtatggtgagtcatgtcaaaggcacgtaatgctgtagttgccactggattgctgctcttcgctggtgctggcttatcatttccgttccttttcgtgaaatcaaagagcaagcctattattgattcgacaaaacctctgccaccacaggctacttttcgaggaccatacgtgaatacgggttcacgtgatatcggacctgatcctaccaactatcccaagaagtgatttgaatcttccatgacatttcggagtcccatttcactcgactccactgctgtgaaattgttcgttttggggccatcttactgtgcacatgccttgatattgcaaaaaaataaaataaataacaatacctaaataaagggtggttattgaagctcctccattctccttgcccccaaacaaattccccttgcttccaaataaatcctagtgtaaagtttcccaatattgtatgggaatatctattttttacagattcatatatgtttagttgaatttcatataggcgtattttgttttgtagataagactttattacaaaaaaagagttttaggcttgcgaaattggaagaacaggaacgacatcatttccaaaaaaaaaaaaaaaaagcggcc

SEQ ID NO: 12258 - DNA, 3175 bp, Zea mays
  misc_feature (2650)..(2650): n is a, c, g, or t
gcacgagaccattacctagaacatcctaatcgaaaagaaatgaggatatgactcagtatatagggtaatgtatgtaggaccgagagactgagccctataattgtttgataaaattttataaaatagagccactgttggaagagtgttttatggttttgaactctgtaattaaaataggattatgtttagagtctttatgatcttagctacctaattccactgccaatttttagccaaataactagctaaacaaacacccctcggcactgatagaagagagaagaaacagacagcctcctcggcgccggaatggcgaaaagcggcggcgagtccactgtggaggttcctattcccgcttccgcgtcggctacgaggccgaaggcgaaacaccgtatagagatcgaggggtaccctgtggatggcgtctccattggcggtcaagagacttgcgtcatcttcccgacgctgagcctcgccttcgacatcggccggtgcccgcagcgcgccgtctcccaggagttcctcttcgtctctcacgggcacctcgaccacatcgggggccttcccatgtatgtggccacgcgggggctcttcaggctgcgtccgcccaccatcttcgtccccgcgtgcctccgggacctcgtggagaggctatttgaggtgcaccgcgccatggaccagtccgagctcaaccacaacctggtccccctggaggtcggggaggagtacgagctcaggagggacctcaaggtcagggctttcaggacctatcacgccatacccagccaggggtatgtgatatactcggtgaagcagaagcttaagcaggagttcattggcctaccagggagcgagatcaagcggctcaagctatcaggtgtggagatcacaaatacggtgtccacccctgaaattgctttcacgggggatacaacagcagatttcattcttgatccggataatgcagatgtgctgcaggcaaaaattcttgttgtcgagagtacctttctagacgactcaatttcagttgagcatgcaagagaatatgggcacacacatttatttgagataacaagtcaggccgacaagcttcaaaacaaagctattctactgatccacttttctgctcgttatactacagaggaaattgatgcggcaataaacaaattgccaccgtctttccgtagcagagtttatgccttgaaggaaggcttctaataaaaacatgaaccaggaaatcagtattgaagttttgtcggagcagttttccaaattggattgcgtggctatttttcaccagaaacctttttgctatgtgtgctctgatgatactataccaatcatctgaaggttcgttcggggctttttgttgtcggtactcatgcttgtgacattggaatgtttaaatggtgaaatgcgaaacacatgtaagcaccatttacttaattacttttttaacaaaaaacaaaaaaaaaaaaaaaatttaccttgtttctgaacattggcagtttgatatcgcatgaataacatgtgactttcgaccagccaatggttcatgttctatacttaaatatatcttaatatctatgtacagccagaacaggaactctcctcacctcatctctgaagatatacaagtagtactaaatcaatttcacacaaaaaaaagagctacccattgtgtctgaaccgtaaattatggttaggtttcaattctagcctactccaacttgtttggaattagaagactgttgttgttgctgctgctttaaaccttggtggcagattgctcaaattcagatcagagtcgtcatctcaatactagttttaaggcaatggagaaacaattttttttttttttttggcaggaacacacccatcgttctttccattcctgctatgtattaatgtatacaccacacaatcaaaagaattgggacctggagtgtaatatacagttacaaactttgttttctacgtgtgcttcggagtcttcagaccatgcatccatcaccaatcaaaaagctcgtggcaaatcaatcaccttcatcttgtcggcaaacacatgcagataatcaaacaagctccggcgcctctggtatcagctcgatggtcagctatagctgccttgctccagattttccctcagttcaggctaaaccatcttactctgaacaggagcacctggcacttggtcatgggccccaccacggccccatcggacgaccccacggcgcgcggcgccatcacgccgtcatcgcacagcagcctgagcggcaccatccccgtgcgcagcgccccgacgcggacgccgacgtgagcgtccacgaccaccctgaacccctgccgccgccgccggtacctgtcgcgcacgcgcgccgcgacggcgtcgtcgagcacgacgcccctggcggtggccacgaacgcgacggcggcgacgcggcgcggcgcgtgggcgaagccccgcacgggggcccacccgagcgcgacgtcgccgtcggggtcggccagcgcgacgcggccctcgccgtcgccgtaccggaactcgacccgctcgttggggttccacgacacgacgcgggcgccgacggtggcgtccacggaggaggcgttgctgccgaggcggaggcgcacgggggccagcggctgnaggtggaacgacggcgcgcgcggccggtagtagaggtaggccaggcaggcggcggccagcgccaggcagagcgcgagcagcgcgaggcccgtggccaggcagcacgcgcggcggcacgagcacccgcggccgcggcggtgcgggtgcggctgctgctggcggtacgcccgcggcttccgggcaccgcccgggggcgccgggtgctgctgctgctgctgctggcggtactggtgcgccggcggcaggcttgagcgggagcacctgcggcggcgcgagcgtgggcttcttgaagggcgacgcggccggcctgctgccgggggccggcgtcgtcgttgtcggccttgccgccgacgccgccttaggcctcggcttggacggcaggggaggcttggccgacagaggcggcttctcggccatggcgcgcgcacggttcttgggcttggtgcgcgtgtggtgatcgtagtacctatgtgcaggtgcagggcgcagagaggtgggagtgaagtgatggtttggtgcctagtt

SEQ ID NO: 12259 - DNA, 438 bp, Zea mays
  misc_feature (94)..(101): n is a, c, g, or t
cctgcagcggttcctggccaagcgcaaggaccgcctcgtggagcgcgccccctacgcccgcccgtccccatccgaggaggcggagaaggcgaannnnnnnntcctgagcaggcggcgcgacggcaccggcgccggccgcctcaacatcgcgctgtgatttggatctcggttgctacccacccggatcgaccggtggcgatttgattggctgggttcctggcttcttttgggtcttgctggattggggttggtgtggagatcggagacggaggattgtagaaacgtattcttgttttttttctctctcccttacgagagagtttggctgttaattgattcgataatagaaagatggaggatgtccaattcgtatcaaaaaaaaaaaaaaaaaaaaaacccgccgtggtaccaacgcctaaaataaaaaaaaaaaaaaaa

SEQ ID NO: 12260 - DNA, 6461 bp, Zea mays
  misc_feature (4453)..(4453): n is a, c, g, or t
  misc_feature (4810)..(4810): n is a, c, g, or t
  misc_feature (6200)..(6200): n is a, c, g, or t
attatgaatttataaagataagtttagatttaatatattttttttgaaaataccaaatttattaaagacggtaaaattacgaataaaaacagtaattttcaaaaatagtcaaaagaaattcaaactattttcgattccgatttttcttaccgattcaatttaaacctaaattcctatttaaagctatttttcataaatttttttaaaacaatacctgatgtccaaaaaataccgtttccgttttcacccgctgaccccacccacccaacctgctctcttccgtcgccgtcgcccacaagaatcacgtgtttttcgtgcccagcaccacgccaccaccgcgtctcacgtctcccccacccgccggtgggaaaaaaaaaaaccgatgccgccctctccgctccatcaaatcaattgccttgcccaggttgcccattgcccttgccccgcccccatcccgctataaaagacaaggctccccgccccgccccaatccattcccacagcaccaagcaagagcaaagagcaacacaagccaaggcagcaaacgacccgcggcgacgcaagaagagaagccagcagtcgtctggatccatcgattgacatggccatggcggcggcagcggagggcaagagccggaggttcgcgctggcctgcggggtgctgagccagtacgtgaaggccgagcagcagatggcggccgccggggcccctgccccgcgcgccccggccacgacgctgagcctcatgcccggcgcggacgtcggcgccgagcaggagcaggccgccgcgagggggcaggagacggccgggtccgcctccacggcggcgccgctcaccatcttctacggcggcagggtggtcgtgttcgacgacttcccggcggagaaggcggccgaggtcatgcgcctcgcagctggcgccgagcgcccggcggccccggccccggcgccggcgccgcgcgacgacctgcccatcgcccggaaggcgtcgctgcagcggttcctggccaagcgcaaggaccgcctcgtggagcgcgccccctacgcccgcccgtccccatccgaggaggcggagaaggcgaagccggcctcctgggctcgggctcggcggcacggacgccgagcgcctcaacatcgcgctgtgatttggatctcgcttgctacccacctggatcgaccgggggcgatttgattggctgggttcctggcttcctttgggtcttgctggattggggttggtgtggagatcggagacggaggattgtagaaacgtattcttgtttttttgctctctcccttacgagagagtttggctgttaattgattcgataatagaaagatggaggatgtacaattcgtgtctttccttcgttctgaggacagattttccctgcaaaaatcgtggctgaattcatacaaaactcgatgccagcagcaacttctccacgcttgaccatgagagaggagagagagaaatattgacgacttccagaaaagatagaaaactgaaaatccgaaacggagctccaatcacagcctcaaaatcgcatcggtatagtcctccaacaagcaaagctaggaatagtctattgcccaagaattcaaaaaagtggtccaaacggccaccacgaaaacgtgcctacaaaaccgcgtagtactataaaccccacccccactacgcggcaacaccttttggtggagcggcaccagccaccgcagtccgcaccgcaccgccccgtctctctcgcgcgcgtgtggaatggattatgataatactcaaccgtcgcttgcgctggtgattatcgccgggcaagcgcaagtggggccggcacccacggaaagaatccacaggccgaccgagctagctagtaggcgacgggaaccttcgcgctcccaggtggccaggtcccaaccgctgccggccaggcctgccgctgcaacttgcacgccccctgctaatattcaaaccgaaccgtgctcgtcgtgtccgtccgtccgtcgcgtcgcgtcgcgtcgctttctccggccacgcgcgtgcgttcccgtgtggcagcccccgcgacgtgcccaacacgcccgcctttgaaacgggagcggtcagggtgcccccggtccggtacagttgtacgcctccgactcgaaaggctctagtacccggggcggggatcggatgcgcacgattctgtcacgttcccgacagcaactcgcacgcggcatgttgggtttagggtgccgaaatatctccgtgtttatccgggctaccattgtcttacaggttgtcgctcgccgcttgatggcgatctctcgtgatccttacgctaacagcttgtttaccatagttctactttctcaggctcagccaaacactttcagacccattatcaatggagctaatttgatagagtaaacgatccatcaaatatacaattagagaagtttttaataaaactatacgccatgacatcagttgcgcataaaaaataaactgttctccttttctctgtccatctcctcatcgattcattcgtatcggttcacccacactgccattcaccggtggccatgtccacccgcagtcgtcgcacgccaattagaacgaagcaaagaacgataaaatgcatcagcgactctcgaatttgacctctctttcagttgcatcaccaaacactggtagaaaaaaagttaccgccagtagaaatgatttgaaacgattttttgaggtttttgaatgaactcatacgaaaaaacgtcgaaataaaagtcatagatctctaaaattatttttcttcgtagttgataacgttttcatttgaaatcattttaaaattgattgatgtttttttttgtaaatgattaagaatggcaatatgctaatttgtgtgtaactgtgtagctagatccaagggccactttaaaaagcacaaccttaaaactaaaatatgacattcaagtcttacaattttcacgaaatgaatcaagatttgctggaaagaacttagtttggcaatcatttagactatatggaatattataagaagatttacacatggaccatgcttaaaagttggacccacttacatgtgtagtgcggggtggggtgttcctaggaactcattccaacccactcgcgcaaaacccgtccaatttagttctaagacccattcctacccgctaaacaataccatatcaatacccacctataaactcgttacaatccaacccattagcaggtctatctgtgacttaagtgatatatcatgccaaagacagatactacgtttacccttctttttttcccgtggtggatatgaattactagtaggtacctgcacgatcacaagtcatgattggacggacgttggcgaccaggcaaaggtatcatcgcccatcatcagggtacaaaaacacagagaagtactggcagctacgttttagaggtcaaacgggacaaatgatgatgcagatctcgtgtagcaaatccgcacaaccagacactgacgaagcggaaagcgccttcaattacgcagcgcggcggcgtgcgacacaagcagagtcaaaagcggcgccgtggttttgattttatttatcatgtgttactaggatcgtagcgtgcgtagactagccttagccacctgcgttatgttatgtctgtcggcactcaactcgtacagtgcgtagatcaccgcaaagtcaaaaggttgtctgaaactctgaacactaaccataacaaaagccatctgacctgccctgccctgccgaagcaagtcaacttgggagagtaggaatgggaggggacttgctagggcctagggcggttttggcagtttcggccaggtgagagagactcggaggaaaccaaacatgtgctcgtgctcggctcggcctcttatctcttcctggtgggttccgtagcgtagtgtttcagcatacacgggtttgtcaggagaacacgctcgccgaacagtccagactagtcgttcgttgtgttgttcttgttccaacaaagattgcgtccactccactggcatgcagtgcaggtatgcgcacacatttgtcttccctgcctctggctgcaactgccacgatcctaagctgttcgctttaaattaaaatcaattatttaaactattgtagcggtagtttatggagacaaatgtcatctctggaacacggcaattttagaagagttatatagtaattttataggaatcagttcattttcgcagaaaaaaacacagaaacccagaaaattttccgcattccaaaataaacagtagaaaccatttcgcattaagcctttgcctgcaactacgacgatcctatgttgttctctttgaattaaagctaattgtttggactactacaactgtaatttatgaggacaaagacctcctttaaaatacgagaatttcagaagaattatataggaatttatagaaatcaatttattttnacataaaacacagaaaacgagaaaatttcccgcattctaaaacaaacagtagaaacgtttgagattaaagccaacgaacaccactactaagtgcgtagaataccaaccagcactagccatattagggacgtagttactatataataaagcgggacacaaaagtgctctcccatacgtccacgcgggcagaaaaaagcccatgcacacgatgcttcttcaatgaacgcgaatgcttctcagtttgccagtgttgtacacgcgcctggagagttccagctagatgtaatatgtacactatacggcgagcgaggaagacaccgcatatttcttttctagagccaacgttcgatctttttnttaggatgaggatttcgcttggattcttttttaccgatatgcaacgtactcatcagcgctttctggaaccagcagtacaaaaatatattggacgagatgttcgcccgcgcgggtgaggtatccaccgagctcgcggtcgacctgcgcgttgtcggaacccgtcgtcaacgtcggtgtctctacaggcgcattcctcttcttcgtcgatatatattaggcagcatcgacgcattgcgtgctgctcgcaatagcacagacagggctcgacatgggcgatgcattctcttcattcacttgcacacaacaggtattgaatattgatggatatgaagatctattttcttattggagcctcgagatagcacatgtctggacgtatggtataggatttggtttctgcacagatttgatgttctcggcagttccttctctcgtgttgttgcagctggatgtgactatgtgaacgactctacaaaagttgcataccatgtgctcgatagaatgtcgatgaggtatcccgtacaggaagccagtcctaattcctatgcagcaggacaatccgatgaaattgcttttaagaaaaggtatgcgatgtaatatactgactgccatatgtacagtaagtgtaaacatgttcaactcctatcaactagcattctattcccagacctttggcaacattaaaggtgaacaaccctatataattgatttccattttaataactataatttagataaaactaattaagtttatatatttatatatataatacatttgtatattatcttaaatcacatgagagagatagttatatactacattcatgttataacgaaccaaatagaataaactatatacttgcacaattatatactacatagaataaactatatacttgcacaattatacaactgaataattttttatttcaacatgaccttgacatgtgatgatttttctaagcgttgcaactttttttttgctacgccagctaaataaaattaatttttaagttgtcttaagtcaactgaataaagaaagagccccaagatttataatactaaattagtatcattagataattataatatattaatttggtatcatatttttttcataaaaaacaattaaatctaataatagtttaattaattctaaaaatttatttattgagcaacggagaaaatgtctataacggtataaccttgatacaatatcaaaaggagaaaaatattcttctaaattttgattttgtactctcttcccggtctgtcactctcttcacttctctaagcataatggttttaggaggagtatgtatgtggtaaattatcaataagataaaaaattgttattgatctattgtcaaattcatgacttgatcttgcnaatggtgccccatacaagtttatttacttggctttaatccgtaccggcttcaactacttctataatatttttgtctctatagattccagttgcagcactccaaacattcaaactttaatccgaagcgaatagcccaaagctagcaatgatacgagtgatttcaaaatgtattaaattatgtagtataaattttacgttctcttacaacatacaaacatattttactattttaaatcaaagcttcaacatgttattaacaac

SEQ ID NO: 12261 - DNA, 934 bp, Zea mays
gactcctatagggcgattgcgttgcgcaccgccggcccggccatcaattcccacagcaccaccaaaccaatccaataggcaattagctcgagcaaagaggcagcaaacacaagccaaaaggcaacacccgcggcgacgcaagagggagaagcgagcgtgcagcggtcctcctctcgatccacatggccatggcggcagcggacggcaagagccggaggttcgcgctggcctgcggggtgctgagccagtacgtcaaggccgagcagcagcagatggcggccccgcgcgccccggccaccacgaccacgaccctgagcctgatgcccggcgcggacgtcggcgccgacgagcagcaggagccggccgccgcgagggccgaggagatgcccgggcccgcccccgcccccgccgcggcgccgccgctcaccatcttctacggcggcagggtggtggtgttcgaggacttcccggcggagaaggcggccgaggtcatgcgcctcgcggccggcgccgacctgcccatcgcccggaaggcgtcgctgcagcggtttctggccaagcgcaaggaccgcctcgtcgagcgcgcgccctacgcccgcccgtcgtcccccgcggaggcggtcaagccggcctcctggctcgggctcggcagcacggaagccgaccgcctcaccatcgcgctgtgatttactggatcgacctcgaccagtggcgatttaattggctaatgatgggttcatgatcatgcctgcctttggcgaatggcggggctgtatggagatcggagacagagacaggattgtagagatgttttttttttcatttcttacgagagtttcgctgctgtcgtgagatctgattcgacaatagaaaaaaagatgaagatggaacaatttgtgccaaaaaaaaaaaaaaaaaaaaaaaaaaagtccac

SEQ ID NO: 12262 - DNA, 1825 bp, Zea mays
ccggccgggctctgaccactgacgcgtggcccattcttcccttcatcaaccacgcggcgccggagcgagcctcctctagtctagcgccgcctagggtttctcctccgccgtgtcgtcaccgtccacgcgccattgcaccatctcgatcgcgcgtcctccctgccaacttgcagctttcactgattcaggaccaggtacccgtcactattatgctcccgccgagcgatgcgtagaagtcgccgctcgcaggtctcgctcttccctacttttcccgccggcccgctgttccaggcaatggccaaacttccgttccatcaggtcgaagcctaacgaaaacatgaggctcgttgtagtaacgatcgttggtgcggtctttggattccttatcggaatctcgttcccgacagttaacataacaaaacttcactttccatctagcatcgtctcctacatagaggacaagaactctggcatctcagctcaagctatacttaaccatgcttggactgcggccaggaacgcaaggggaaatggctcccaaccaatctcacttgacaacttcaaggtctatgtaccaacaaaccccaggggtgcagagagcctagcgccaggtattgttgtgccagagtctgattttcatcagcacaggttatgggggaacccagatgaggacttacccttcaagccaaagtaccttgttacttttactgttggcatttcacagaaagataacataaacagggctgtcaagaagttttcgaaggattttgcaatcctgttgtttcactatgatggccgggtgactgaatgggatgaatttgagtggtcaaagcgagctatccatgtaagcgtccggaaacaagcaaagtggtggtatgctaaaagattcttgcaccctgatatcgtggcagcctatgagtacatatttatctgggatgaggaccttggagctgatcattttaatggagaggagtacattaaacttgtgaagaaatatagactagaaatctcacaacctggtctagagccagataggggattgacatggcagatgaccaagagaagaggtgatcgtcaagttcacatggttacagaggagagagaaggctggtgctctgatcctcatgtccccccgtgcgctgggtttgttgaaataatggctccagttttctccagagatgcgtggagatgtgtctggcatatgattcagaatgacttagttcatggatggggtctcgatttcgctctccggaaatgtgtggagcctgctcacgagaaaatcggtgtcgttgattcccaatggattgtacaccaagtgattccttctctcgggaaccaggggcagtcggagaatgggagggcgccatgggaaggggtaagagagcgttgccggaaagagtgggggcttttccagacaagaatggcagaagctgagaaagcatattacgagatgatggggattacacctccgaatgtaacatttgtctcctaggataaaagtttcaacccacatttttttttcctttgtgtccagcagtggctcttcgaatagagttagctattgatgaatggcacaagtagatcatacgtgacgatatatatacatatagatcctttgatccttcgtcctgtgtatttatcgcggccgcctctcactagggttctggtgaaatgcgaatgatatgtctgttcagtttagagcttatattctctaaacatgaacattcaaaatcgacagcattgtgcgcacacgaaaattctgcagaaaacatttcagacggacaaggatggccaaagtatggcacttcattgtatatatgtaggt

SEQ ID NO: 12263 - DNA, 1716 bp, Zea mays
  misc_feature (1017)..(1017): n is a, c, g, or t
ggaccactgacgcgtggcccattcttcccttcatcaaccacgcggcgccggagcgagcctcctctagtgtagcgcggcctagggtttctcctccgccgtgtcgtcaccgtccacgcgccattgcaccatctcgatcgcgcgtcctccctgccatcttgcagctttcactgattcaggaccaggtacccgtcactattatgctcccgccgagcgatgcgtagaagtcgccgctcgcaggtctcgctcttccctacttttcccgccggcccgctgttccaggcaatggccaaacttccggtacttgcacgcagttccatcaggtcgaagcctaacgaaaacatgaggctcgttgtagtaacgatcgttggtgcggtctttggattccttatcggaatctcgttcccgacagttaacataacaaaacttcactttccatctagcatcgtctcctacatagaggacaagaactctggcatctcagctcaagctatacttaaccatgcttggactgcggccaggaacgcaaggggaaatggctcccaaccaatctcacttgacaacttcaaggtctatgtaccaacaaaccccaggggtgcagagagcctagcgccaggtattgttgtgccagagtctgattttcatcagcacaggttatgggggaacccagatgaggacctacccttcaagccaaagtaccttgttacttttactgttggcatttcacagaaagataacataaacagggctgtcaagaagttttcgaaggattttgcaatcctgttgtttcactatgatggccgggtgactgaatgggatgaatttgagtggtcaaagcgagctatccatgtaagcgtccgggaacaagcaaagtggtggtatgctaaaagattcttgcaccctgatatcgtggcagcctatgagtacatatttatctgggatgaggaccttggagctgatcattttaatggagaggagtacattaaacttgtgaagaaatatagactagaaatcttacancctggtctagagccagataggggattgacatggcagatgaccaagagaagaggtgatcgtcaagttcacatggttacagaggagagagaaggctggtgctctgatcctcatgtccccccgtgcgcttgggttggtgaaataatggctccagttttctccagagatgcgtggagatgtgtctggcatatgattcaggtataacacagcttcagtgtctgcacttggcttggtttggtgatatcttggcgttcttgcagaatgacttagtttaatgatggggtctcgatttcgctctccgggaatgtgtggagcctgctcccgagaaaatcggtgtcgtttattcccaatggattgtacaccaagtgattccttctctcgggaaccaggggcagtcggagaatgggagggcgccatgggaaggggtaagagagcgttgccggaaagagtgggggcttttccagacaagaatggcagaagctgagaaagcatattacgagatgatggggattacacctccgaatgtaacatttgtctcctaggataaaagtttcaacccacatttttttttcctttgtgtccagcagtggctcttcgaatagagttagctattgatgaatggctcaagtagatcaagcgtagccatatataccccgatggatcctttgatccttcttcctgtgtgaagaactcgtgcccaaa

SEQ ID NO: 12264 - DNA, 3871 bp, Zea mays
  misc_feature (2657)..(2657): n is a, c, g, or t
tttaatatactaaaacactatgaaactacccattgagaataaacttataaaactagcctaaaaataatgagaaatgtaacttgtcagctcctctgcatgtgtacttccgaggccaatatggaggcacactatacattgggagccccctcgtcgacgccggccggcatggaccacagtgtgtactactgccttgtagctcttcttccacttgtgtacttccttctcaagtcgtcgtggaagaaagctcccttcggatctggtagccgccatggactaaagctccctccaggcccatggcagctccctgtcatcggcagcatccaccatctccgcggctccctcgtgcaccacgctctgagggacctatcgctccgccatgggcctctcatgttcctcaagctgggcgagctcccagtggtcgtagcatccacgccggaggctgcgaaagaggtgatgaagacccacgacgccatcttctcgaccaggccactgagctcaaccattaggacggtctccaaggatggcctgggcatcgtctgggctccgtacggcgaccactggcggcagctccgcaagatctgcaccatgcagctgctcggcgcgcggcgcgtccagtccctgcggcccgcgcgcgaggaggaggcgttccggctggtccgagccgtcatgtcctcgtccaccgcggcaggaggagctgcgccgccgccgctcgtggacctcggcaagctggccgccgtgtacgtcgccgaggcgtcgttgcgcgccatcttgggcagacggttcaaggtcgaggaccgggacacgctgctgcgctacgtggatgacggcgtccggctggccggcgggttcacgcccagagacctgttcccgtcgtcgtggctcgtccgcgccctgacccaccgggccgtgcgcgaggtggatgcctaccgagactccttgttcgccttcatggatgtagtggtaggtgagcgcttggatcgacgagaaggtcaactgaagaagaggaggaggagggagaggatctgattgacgttctcctccggagccacaaggaaggaaacctcccgttccctctcaccatgaggacaatcgaagcggtcatatttgtcagtgtccttgtttatttgctaattaatgtcaactgatctgaggtcccctaactgaattgtgcgtgtgtatatgaacaggatctgatcggagggggtatcgagacagcaacaacaacgctgcagtgggcgatggcggagctgatgaggaatccaggcatcatggccaaggcacaggccgaggtcaggggattgttcatgggccaaaccaaggtaaccgaagaccggctaggcgagctaccctacctgcagctggtcatcaaggagacgctgaggctgcatgtcccggggccgctgctgatcccaagggagtgccaggagcagtgccggatactgggctacgacgtgcccaggggagccatggtgctcgtgaacgcctgggccatcgctcggagcccggatcactgggaggagccagacgcgttcgtccctgagaggttcgtcggtgacgcgagggatttcaagggcaacgacttggagttcatcccgtttggcgccgggaggaggatctgccctgggatgtcgttcgggctggccagtggccaacgtcgagctcggtctcgccagcttgctcttctacttcgactggagtctcccggcgggcgtccttcctgctgagatggacatggccgagaccatggggatcactgctaggaggaaagcagacctcttcttgtctgctactctgcgtgtcaaactgccttaattttcatctgatctgatggtactctatgcctatgagatatgcagtgactgttacgggacgggctatctgtgctgcagcgtgtggagcagagtatttccagtttttctcccttagaccgtcttccacagttcaccgcctaaaacactattttacgttgtatatcccaattttcgtgatgtggagtatgaatatgtggacgtggatggataaactattagaggtaatctaagactatctctaatagcttactaattcatcttcatctccatgcttaaacttcactctacgaacaatataatttacaatacaaaacaatatttttctatatgatttgatgtgtgagcggccggaaacaaccatatatagttgagaccacatgcataaagtcatcatggaggtgagaaaggtagtgggaagtccacacgtacgtgcttgctcgtctggcctagctgaagcaaaggatatggacatatgacatatgtgtgaatgattcgtcattactaaggatatagtctccgctacatttctacacctttccaaatgagctctcgaggtctatttattgtctacaagggtgagaggtgcttatagtgtccttaggtcggttttgcaatctactcggttggaaggaagcacatggcatggccgaacagcgtaagtggccaagtggtgggtcggccggccctcccctctgtcctttaagagtgtgtatggttagatgtacaaggaatgatggaaaggaatggctacagtttctatagtattgggatgaaagtcacgtgagggcaaggtaaacaccggagtaatttttagtatcgacgtgatcccaaaaaatcgaggacacngtatcgcccccgctttatcctactttgagttcaaaccaaacatgtcctaagtgtgtttctttctcaagcattggatttgagcacttggattatgtgtcacccatgcacgagattctttatttgagtcgtgtcaaatgtgcaggagaggaacaagtgcagcaggaagagactttgtctggctaggcggcctggcctttggacggccgggcctagctctagcccatctccctttggcatgtatcctcttatgatggttggttccacaacatgtatggtggtgtcttatataaaaagatcatacataacttgtggaactcgtcaaataacataaatctggtcttatattactctttaaacaaaaaatattggtggttacaacatattgttatgaccaccaatagcgaaagtctcatgatgtgctctcaccatcgactgtactagcacctattcaacacaacattcatcgaaaaaatttcatactaatacatacacaaaaactaaagtgaaaccctcacaatctagaattctaaagatcttcgtcattatgatttttcagacagatttctggtcctgcagtcttttatccattaatttgacttcctacctcaaatcaggcaaacatttacatttttaaatctgtggaaaatttactacaacttttgtgtttaccactaagtctaattcaacatgaataatttctagttgtcaggacaaacttcctactcgaatttgtttgcatattctagaacaacatcactgtttctgcgattacttataaaccgctaattggatcggaacgaaaccaacgacatttgacaaataacaagatgtcctactatttttttattcatgggattccaaattcttaaccgaaccatatcagaattcgatgtatacctgctatccagatcgtagcgaacaaccaaccatggcccgcgaccaaattcaccatgaattctgagcatgcttgcatgcaaggactaatttgttaattgatgacatgtgcaaattaggctattgatgttgtcggcgtttcggacccgcgaggaccgtcaaccgaccagtaaatttgttgttgtgtgtccctgcccagataggttgatgcaagatagaacacaagagggaaatgaggcttatgttatctcgcaccagggtgcttgtagtaggggttacaagcgtcgcgcgagggagcgagggcgagaacgagagagaga

SEQ ID NO: 12265 - DNA, 2044 bp, Zea mays
  misc_feature (3)..(4): n is a, c, g, or t
  misc_feature (10)..(22): n is a, c, g, or t
  misc_feature (26)..(26): n is a, c, g, or t
  misc_feature (31)..(32): n is a, c, g, or t
  misc_feature (39)..(39): n is a, c, g, or t
  misc_feature (45)..(45): n is a, c, g, or t
  misc_feature (51)..(52): n is a, c, g, or t
  misc_feature (66)..(67): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (97)..(97): n is a, c, g, or t
  misc_feature (100)..(100): n is a, c, g, or t
  misc_feature (105)..(105): n is a, c, g, or t
  misc_feature (177)..(177): n is a, c, g, or t
  misc_feature (181)..(181): n is a, c, g, or t
  misc_feature (2032)..(2036): n is a, c, g, or t
atnntttttnnnnnnnnnnnnntttntgaanntattatnttaaangtaaannatcatttaaaattnngatgtacnaantnttttaatatncntnaancanctatnaactcccattgagaatacccttataaactagcctaaaaataatgccaacgtaggggatgtttggatgccgcntaanccgccgccggccgccacacttcccacgcaccagtgtggcgctcgttttgagcgccacaggtgtggcgcggcgtgccgccggcgcgccgatccaaactagcctgtaatttgtcagctcctccgcctgtgtacttccgaggccaatatggcccggcacactatactatagtagccaaagcatcaacttcggcaatcatggaccacagtgtgtactactgccttgtagctcttcttccacttgtgtacttccttctcaagtcgtcgtggaagaaagctcccttcggatctggtagccgccatggactaaagctccctccaggcccatggcagctccctgtcatcggcagcatccaccatctccgcggctccctcgtgcaccacgctctgagggacctatcgctccgccatgggcctctcatgttcctcaagctgggcgagctcccagtggtcgtagcatccacgccggaggctgcgaaagaggtgatgaagacccacgacgccatcttctcgaccaggccactgagctcaaccattaggacggtctccaaggatggcctgggcatcgtctgggctccgtacggcgaccactggcggcagctccgcaagatctgcaccatgcagctgctcggcgcgcggcgcgtccagtccctgcggcccgcgcgcgaggaggaggcgttccggctggtccgagccgtcatgtcctcgtccaccgcggcaggaggagctgcgccgccgccgctcgtggacctcggcaagctggccgccgtgtacgtcgccgaggcgtcgttgcgcgccatcttgggcagacggttcaaggtcgaggaccgggacacgctgctgcgctacgtggaccacggcgtccggctggccggcgggttcacgcccagagacctgttcccgtcgtcgtggctcgtccgcgccctgacccaccgggccgtgcgcgaggtggatgcctaccgagactccttgttcgccttcatggatgtagtggtaggtgagcgcttggatcgacgagaaggtcaactgaagaagaggaggaggagggagaggatctgattgacgttctcctccggagccacaaggaaggaaacctcccgttccctctcaccatgaggacaatcgaagcggtcatatttgatctgatcggagggggtatcgagacagcaacaacaacgctgcagtgggcgatggctgagctgatgaggaatccaggcatcatggccaaggcacaggccgaggtcaggggattgttcatgggccaaaccaaggtaaccgaagaccggctaggtgagctaccctacctgcagctggtcatcaaggagacgctgaggctgcatgtcccggggccgctgctgatcccaagggagtgccaggagcagtgccggatactgggctacgacgtgcccaggggagccatggtgctcgtgaacgcctgggccatcgctcggagcccggatcactgggaggagccggacgcgttcgtccctgagaggttcgtcggtgccccgagggatttcaagggcaacgacctggagttcatcccgttgggcgccgggaggaggatctgccctgggatgtcgttcgggctggccaacgtcgagctcggtctcgccagcttgctcttctacttcgactggagtctcccggcgggcgtccttcctgctgagatggacatggccgagaccatggggatcactgctaggaggaaagcagacctcttcttgtctgctactctgagtgtcaaactgccttaattttcatctgatctgatggtactctatgcctatgagatatgcagtgactgttacggcgaaaaaaaaaaaaagggcggccaaaaactagtgagcgtcgnnnnncgggaatt

SEQ ID NO: 12266 - DNA, 1994 bp, Zea mays
cattgggtacctcgaggccggccgggataccaccttctctctttccttcacacacgcagctcacgtacacgatgaccacaccgcgtcgcgacgggcagcaccacggcgacaagcgcaccgtgacacgagcagcctcccgaaacagcgacggacacggcgcaggcgacttgagcttcgggtccacggcggggcctcggttcgccgtcgccccgccgcgcccttgggcgccgccgcctgagcacgcggccgtcttcgtgcagccaccagacgatccgtcgacgttgatcatgctgtggggaccgcccggcgaggtgcccgttgccggcttcgctgcggcaccggaagggctaccggatgcgttcgctggcagcgcgtcgtgcctgccgctcgcgaggcaggtcggcctgcaagcggccggcggccagcagggggcgcgcaacttcgtggtgtcgccgctgtcgttccacgcggcgctcgcgctggtggccgcgggcgcgcggggcgagacgcagcgggagctcctgcgcttcttggactccgagtcgctgggcgagctgcaccgcgccgcggcgacggcgctggtcgccaggctcagcgacctcccgcagacgtccttcgcgtgcggcgtctgggtggaccggagccgcgcgctcacgccggagttcatggacaccgccgcgtcgcgctacgcggcggtcgcggagtccgtcgacttcttgaagaactccgaggcggcaaggcagcaaatcaacgccttcgtgaaaggggcaacgaaagggctcatcgacgacgtcctgcctcccggctccgtcgactcgtccacggcgctcgtcctcgccaacgccatctacttcaagggggcgtgggctcggccgttcgatccgtcgagaaccatcttcgcgccgttccatctccccgacggcggcaccgtgcgcgtgccgttcatgactacgactacgagtggtttcgaggaccagcgggttgccgtgttccccggattcaaggcgctcaagctgccctacaagaacgacggcggcgcgcagcaggacgcgttctacatgcttctactcctccccgacggtgagaccctaaccctcaatgatctctatgataaggtcgtgtcgtcgccgggattcatcaggaagcacacgccggtggacgaggtcccggtcgggcggttcatggtgccgaagttcaagttcacgttcgagtttgaggcgtctcacgatatccagaagctgggagtcaaccgagcctttcaaagcggtgacttctccggcatggtctccggtggaaacgggctcatcatctcaggagtgtaccacaaagccaccgtagaggtggacgaggccggcaccgttgccgccgcggccacggccgagttcatgtttatgtgtgcaagaatgcatccaccgccggtggatttcgtggcggaccggccgtttttgttcgccatcgtggagagaagtggcgtcgtgctgtttcttgggcatgtggtgaaccctctagttgggtgatgatatcagtgacagtgttggagacctttctcttccgaatatccttaaaaatatgattaattatctgtttttagtataatatggattactatagagagattcggcttcagaatataagttttgtttcatagcaaaggtatacaagatgaagatatagcctgaggatgataagaatgaacgctgaagttatagtcgaagagtaacaatttcggtttaaaatgatgatgaagaccaagcatgatgctgacctgaagagaaaaggactaattagttcctaatgatttatattatagttatggataaatgttgaggatataaatgtatttttactcgggatacgtcccatgtctataaatagatgaatagtaacaccaaaaaaaaaaaaaaaaagcgggcccactctcgtatctttaccttcgaacaagccgaatgtatcaatgtaatataaattgtgttaatatttatgtgcgtattatg

SEQ ID NO: 12267 - DNA, 3923 bp, Zea mays
  misc_feature (11)..(13): n is a, c, g, or t
gcggcgagttnnnaaagattcatgccaaagtgtattaggttcttaacttgttatactgctaatttgtctatgatcttgtgctccactaaggggttacatgtgcatcaatgactagcattggatcattattgttcatatgacaccatgattattgttcatatggcatcttgatttgtttattggactactataagaatctaccacgcgttcctgaaattatattatttctccaatttgtgtgggcatgcttactaatgaattaccacatttcatggttacgagttacaacaatacaaagcatgctaattttgttcctctgctttcactgttacattcagagtcaatatgtcgctcgatgttactctagtactcttaagcgcgcaatctgctgatggcgcagtaaggaagcatgctgaagaaagcctcaagcagttccaggagcagaacctccctggattcttgctctctctctcaggtgagttggccaatgaagagaaacctgaggagagccgcaggttagctggcttgattcttaagaatgcactggatgcaaaggagcagcacaggaagaatgagcttttccagagatggctggcactggatgctggtgccaaagcacaaattaaaggattgctgctgcaaactctcacatctcctgttgcaagtgccagatccactgcttcccaagttattgccaaggttgccggtattgagattccgcagaagcaatggccagaacttataggatcattgcttgcaaacatacatcaggtccagccaaatgtcaagcaagcgacgcttgagacacttggctatttatgtgaggaagtttctccagatgctgttgaccaagaccaagtcaataaaatacttacagctgttgttcagggtatgaatgcttctgaggcaaactctgatgtcaggcttgcagctacacgggcattgtataatgctttgggctttgctcaggttaatttctcgaatgacatggagcgtgactatatcatgagagtagtttgtgaagcgacacagtctccagatgtgaagataaggcaggctgcttttgagtgtttggtggctatctcgtctacttattatgataagctggcaacatacatgcgggatatatttaatataactgcaaaagctgtgaggggagatgaggagtcagttgcgctccaggctattgaattctggagttccatatgtgatgaggaaatcgacattctggatgagtacagcagtgaatttacagctgattctgatgttccttgctactactttatcaagcaggctcttcctgccttggtgccgatgttgttggaaactctcctcaagcaagaggaagaccaagacttggatgaaggtgcttggaatcttgcaatggctgggggaacttgtctgggcctggtggcaaggaccgttggtgatgacattgttcctctcgtaatgccttttgtggaggagaacataaccaagtctgagtggagacaaagagaggctgcaacatatgcctttggctctatcttggagggcccatcagctgataaactggctcctcttgttaatgttgcattgggcttcatgctgtccgcgctgatgaaggatccaagtaaccatgtgaaggacacaactgcttggacccttgggagaatctttgagtttcttcatggttcagcgcttgaaactcctcctatcattacggccgagaattgtcagcaaatacttactgtgttgcttcacagcatgaaggatgtcccaaatgtggctgaaaaggcctgtggagccctctattttcttgcacaaggctatgttgattctgggtctgcatcgccactatcccctttctttcaagatattgttcagaaccttcttatggtcactcacagggaggatgctggggaatctcggctacgaacagcagcatatgagaccctaaatgaagttgtcaggtgctccactgaggagacggctgctattgttatgcagttagtacctgtgatcatggtggaactccatcagacacttgaagctgaaaagttgtcaactgatgagagggagaagaggagcgaactgcagggcctcctttgtggttgcttgcaggtcattattcaaaagttgggagggatggagtcaactaagtactctttcttgcagtatgctgatcagatgatggaactgtttttgagagttttcgcatgtcgaaatgccacagtgcatgaggaggctatgcttgctattggtgcattggcatatgcagctggtccaaactttgcaaaatacatggcacagttttatcagtatttggagatgggtcttcagaactttgaggagtatcaggtgtgtgccattaccgtgggcgttgttggtgacctctgtagagcactggaagacaaaattttgcccttctgtgatggcatcatgactcaactcctgaaggacctgtccagtaaccagttgcacagatcagtgaaaccaccaatattttcgtgctttggtgatattgcactggcaattggggaaaactttgagaagtatttgatctatgcgatgcctatgctccaaagtgctgctgatttgtctgcccataccactgcaactgatgatgagatgctcgactacaccaatcagctaaggagtggaatcttggaagcctactctggtatcctgcaaggatttaagagttcacctaagacacaactactgatgtcatatgctccacatattattcagttccttgatgctctgtacaatggaaaggatatggatgatgctgtgatgaagactgcaataggtgtcttgggagatctggcagacacattgggtgtccatgctggccctttgatcaatcaatccacctcaacccaggcatttttagaggaatgcttggcatcagatgatcctttggtgaaagaatctgccgattgggcgaggatagcaatcagccgtgcagtttcgggttgatgccagagtcttgagtctgcacttgcattcatctacatatcatcatgcctgggtctttgattgcatcatgtccagacatgctcttgggagaaatccaacatttttacagcagagtctgagggtcctcactaactcatgcatcactacatgtgtcaacccgcccttcttgcttctgcgagaaaagagggttcaagctggccgtctgctaactttttctaaaggcatctgcaaccttcatttcttattggaggtgagatgtgagcttctattgtcgcatgacatgctgaccagtttccttggcatgtcaagcgtatgatctgtggcctatcatttccccttgcattcatctcatgcattgaacattggtcggatggtcacttgggacaacaggtccagttgcttgctgctgctccagtaagcaagagcgggctcaaacgcattgtcacaggattatttttgtatcgatcagggtggccaagtccatgctgatagtaggatgttaatttcctagcattcttttcctttcatccacttgcattgtctttgcatttcattcttggtcggattgttttgtaagagttattttagggcaaaactttgtcctgtctggtctgctaccgcacgctatttgtaagtcaagttcatgcgtgcattggtttatttacgggtgctattggagcagcgggtgtttgtgcttttttccatcttgtttttggtaatatacatacatgctgctccatttcggattatcaggagctgggcgggtgaagagacagttttataggtctttggagttgtttttgccggggcagaggcagttgagttggctgtgatatcttttgtgatttatgaagaaacaaagtgaattgagaataatatggtgaaatgtaaatggtcttcatttcacgcttggaagttggaactaaccaccgtgcaggctgcgggcttgcaaaaaaaag

SEQ ID NO: 12268 - DNA, 2538 bp, Zea mays
aacataaccaagtctgagtggagacaaagagacccccccccccccccccctggctctatcttggagggcccatcagctgataaactggctcctcttgttaatgttgcattgggcttcatgctgtctgcactgatgaaggatccaagcaaccatgtgaaggacacaactgcttggacccttgggagaatctttgagttccttcatggttcagcgcttgaaactcctcctatcatcacaggtgagaattgtcagcaaatacttactgtgctgcttcacagcatgaaggatgtcccaaatgtggctgaaaaggcatgtggagccctatatttccttgcacaaggctatgttgatgctggatctgcatcaccattatcccctttctttcaagatatcgttcagaacctgcttatggtcactcacagggacgatgctggagaatctcggttgcgaacagcagcatatgagaccctaaatgaagttgtcaggtgctccactgaggagacggcccctattgttatgcagttagtacctgtgatcatggtggagctccatcagacacttgaagctgaaaagctgtcaactgatgagagggagaagaggagcgaactgcagggcctcctttgtggttgcttgcaggtcataatccaaaagttaggggggatggagtcaactaagtactctttcttgcagtatgctgatcagatgatggatctgtttttgaaagttttcgcatgtcgaaatgccacagtacacgaagaagctatgcttgctattggtgcattggcatatgcagctggcccaaactttgcaaagtacatgacacagttttatcagtatttggagatgggacttcagaactttgaggagtatcaggtgtgtgccattaccgtgggtgttgttggtgacctctgcagagcactggaagacaaaattttacccttctgcgatggcatcatgacccagctcctgaaggacctgtccagtaaccagttgcacagatctgtgaaaccaccgatattttcgtgctttggtgatatagcactggcaattggggaggactttgagaagtatttgatctatgcgatgcctatgctgcaaagtgctgctgatttgtcggcccataccactgcaactgatgatgagatgctcgactacaccaatcagctaagaaatggaatcttggaagcctactctggtatcctgcaaggatttaagagttcacctaagacacaactgctgatgccattcgctccgcatattattcagttccttgatgctctgtacaatgggaaggatatggatgatactgtgatgaagactgcaataggtgtcttgggagatctggctgacacattaggtgtccatgctggccctttgatcaatcaatccacctcaagccaggcatttttagaggaatgcttggcatcagacgatcctttggtgaaagaatctgccgattgggcgaggatagcagtcagccgtgcagtttcgggttgatgccacagtgagtctcgagtctgcacttgcatcccatccacatgtcatcatgcctgggtctttaattgcttcatgtccagacctgctcttcggtgaagtccaacatctttacagcagagtcggagggtccccactaactcatgcatcagtacatgtgtcaacccgcgccccgcttcggcgggaaaagaagggttcaagttggccgcccactaactttcgccaaatgcatctgcaaccttcatgtcttgttggaggtgagatgaggttctattatcgcatgacatgctcacagattcctgtgcatggcatgcctatgatatgtggcccatcatttcctcccctgtatccatcccatgcatcaaagtttggtcagatggccacgtgggacaaaaggcgcagtttcttgctgctgctccagtaagaaagagcgggctcgaatcgcgttgtcacaggattatttttgtatcgatcagggtggccaagtccatttatgtcagacatatcctccctgctgctgctggtaggttgtgaatttcctagcattcttttccctttggccgcttgcattgtctttgcatttcattcttggtcggtctattttgtaagagttgctttgggggcaaaacatgtgtcctgtccggtctgctaccgcacgctatttgtacaagtcaggtccgtgcgtgcattggtttatttcccggtgttatcggagcagcgcgtgtttgtgcctttttccaccgtgtttttggtaatctacatacatgctgctccatttcggtttatgaggagctgtgtgggtgaagaaacagagatagagttatataggtctttgaagtggttcttgctggtggcagaggcaaattgagttgggtgtggtttatgaattgtaccatggtgtggagaagacccactggtaatatttactgtatttggctggtgctccgccgcagagcatatgagcaaagttaagcgtgagtgctctttttctcagcttcatccaaaaaaaaaaaaaaaccgagcggcggcccgggggcccggtac

SEQ ID NO: 12269 - DNA, 1530 bp, Zea mays
ttgggtacctcgagccttgggtacctcgaggccggccgggacggcacaacagcagctcgtgacccattagtaggggagctgctggagcacacgcacggccacgccccgatatcgccatggctatcctcgccgttgcctctccactcaaaaccctaaaccctagccccggggaccacagccgctgccgcctctcctcttccctcctccaccttccgctaccagtgccacgatggcgccgcctccggtgctccgctcagtacagtgaggcggcggcgcagcccacgtcgacaacgacggcgcgtccagcggacataccctggagcaaggagctctgcaactcggtgcggctcattgggactgtaggcaccgacgtagagctgcggcagctgcccagcggctccgccgttgcgaggggtcgcctcgccgtatggaagtcagccaccgagactacatgggtaactctacaattctgggacgatcttgctattgtggcctctgagcatgttaagaagggtgaccggatatttgtttctggacggcttgtgtcagatactgttgatgaggggcctgagaagcggcatgtttactacaagcttgcagttcaacagttgaatttcatcgagtcccagccagttcgattatatgaaccagaggcaagccaggatgccctaggtggaaggcgtgctgattattttaactctatctctaattcaactgaggataagaatagggataatatgagctcatctcgatcaaccgaagagctgtggcaagtgttctttgccaatcctcttgactggtgggataacaggacaaataagaagaacccaaggtatccagacttcaagcataagcagactggcgaagcactatgggttgacgggaggaacaaccccaactgggttatatctcagctggcggttttggactcgagaatgagttcgctgcaagacaatgagaggaaaccagtctcctatatgtatgctgacgagttcatgacattggacggcaaccgatagtcgttatggaggagggaagcttcgctcgtgccgattggctggctgttatggcgagcgagatcatgctgtcgacctgtcttagtagctagctcatgcttgctgtctcagttttgttgagcggctctggagggttgcgtgttatgagcgtcgtccgtagtatggtttgtgacataaggtagctatgatgagcctagaacaaacataaacaaagtgcgggggaaacccttgcttttagtgactccattagtagtgctatgtggtttgtgacatggtttttaactatgatgttacgccgagtggtaatatattgaagaacgtgccgtggccctaaaaaaaaaaaaaaaaatttagactagatggagcacttaccaatgttggacttgttaaatctgggtttttctgaatgtaaatgatactagtaattgtggttaagattaatctatggtaggcctggaataccaggactagggctttgaagggggaaggttgatgatgccttctaggccgagtt

SEQ ID NO: 12270 - DNA, 1775 bp, Zea mays
ccgggacgttttattttgtccggcattgactgggtcagtactcagtagccactagccagtaccgtccagtcatccacgctgatttgccggaaggcgcctcggcggaagctgctatctagttgaagccagccatggccgccgagcccccggcgtacttgctgctccttcccctcatcgccataccgctcatcgtcttcctcgtcctgtcccgccgaagggatgaccagcggcgcttcccaccggcgccgtgggcgctgccggtcatcggccacctgcaccacctcgccggcgcgccaccgcaccgtgccctgcgggaccttgcgaggcgccacggcccgctcatgacgctccgcttctgcgagctccgggtcgtggtcgcctcgtcgccggacgccgcgcgggagatcttgaggacccacgacgtggacttcgcgtcgcggcccatcgggccgatgctgcagctcgtgttccggggcgccgagggcctcatcttcgcgccctacggcgacgggtggcggcagctccgcaagatctgcaccctcgaactcctcagcgcccgccgcgtccactccttccggcccgtccgcgaggacgaggtcggccgcctcctcggctcggtcgcgtccgccgcggcggcggggttgcccgtgaacctgagtgagaggatcacggcgttcgtcgcggacgcagcggtgcgcgccatcatcggcagccggagcgagcaccgcgacgagttcttgcgcctgctgatggacgggctcaagataattccgggattgagcctgccggacctcttcccgtcgtcacgcctcgcgatgctcgtcagcagcgttcccggtaaaatcgagcgccgccggaaaggcctccttgacatcgtcgaccccatcattctggagcatcaggagaagagagcggccggtggcatagacgaagatgaggacttgcttgacgtgctcttgagactccagaaagacatggactcccagtaccctctcaccaccgacaacatcaaatccgtcctcatcgacatgtttggagcaagcagcgagacgtcggcgacgacgctgaagtggacaatggccgagctgatgcggaacccggcggtgatgcggaaggcgcaagatgaggtcaggggagcactcgccggccacgacgaggtggcggaggacagcctggtcaatctgcggtacctgcagctagtcataaaggagacgctgcggctgcacccgccggcgccattgctgctgccgcgggagtgccgcagcccgtgccaggtgctcggctacgacgtgcctcgtggcaccatggtgctggtgaacgcgtgggcaataggcagggacccagcgctgtgggacgcgccggaggatttcgtgccggaaaggttcgaggagagtggacgagacttcaagggcatggattttgagttcatcccgttcggtgcgggaaggaggatgtgccccggcatggcgttcgggctggcgcacattgagctcgctctcgcggcgttgctgtttcacttcgactggaagctaccggaaggggtggtcgccgaggagatagacatggccgaggcggtcgcgatcacggcccctccgcgatctgatttagtggtgctccctgttactaggctaccggtgtcaatataatgtgcttcggcccaaaagcttattttctttcagtatgctagaaatagaacaacaacttttctttcgctttcggcgggtgtgaaggtcgaaaccttttcctcgttatgtttgatattggttccttttctt

SEQ ID NO: 12271 - DNA, 2969 bp, Zea mays
tttggttgggtctactatggttgggctcaacttagtcagggagctagactaggtctatatgcggttggatccgtcgtgttaggtcggagcgtgtgtgatcgaggatcggctttagttacgcgaggcctttatctccaggagtgatcttttatgtttttcttggatactttgtgtacatgtacttgtcgcttttaatgcttgagttatctactcaacaaaatctcatcaagagcttagttttttatatataatatttttatctgatgtcatacaagaaatatataaattttataagtggtaaaattggtacgcaatcaaattactgacactttataatatttttttgaatatcttaacgctcttaaatgataaaactaaaaattagaaagttatagatttaaaaaggctatagttttttttataaaataatatcttaatctgatataattttttctaagattaagatttgctcctgatacgtgaatcttatctgtcatatttagggctggtaatgagatccaaatttgcactataaaatttaatgatcgaatcgaattagtattgagctctattttattcaactttgaactaaaattagttaagggctcaaataaattgtcaagaaacatttaaatcatgatccattaccactcgtatttatatgtgttgagtcaccgtattatgccagctatagagtcgggtaaacggacttggatatccgaagtaacttgggaggttataaaattacattttgagactttagggatctggtaaatttcactcagcacagaaactaagcaagtatgcgtttgtttgttgccaattttaaagcaagatgctttgcaaattgcgatatggccgcatgctctagtcttccttgtgatctgactgaccccacgtctttttccttgttccttcgctatgctacatagttgttgctttcgtggcttgtttagtccggccgggacgttttattttgtccggcattgactgggtcagtactcagtagccactagctagccagtaccgtccagtcatccacgctgatttgccggaaggcgcctcggcggaagctgctatctagttgaagccagccatggccgccgagcccccggcgtacttgctgctccttcccctcatcgccataccgctcatcgtcttcctcgtcctgtcccgccgaagggatgaccagcggcgcttcccaccggcgccgtgggcgctgccggtcatcggccacctgcaccacctcgccggcgcgccaccgcaccgtgccctgcgggaccttgcgaggcgccacggcccgctcatgacgctccgcttctgcgagctccgggtcgtggtcgcctcgtcgccggacgccgcgcgggagatcttgaggacccacgacgtggacttcgcgtcgcggcccatcgggccgatgctgcagctcgtgttccggggcgccgagggcctcatcttcgcgccctacggcgacgggtggcggcagctccgcaagatctgcaccctcgaactcctcagcgcccgccgcgtccactccttccggcccgtccgcgaggacgaggtcggccgcctcctcggctcggtcgcgtccgccgcggcggcggggttgcccgtgaacctgagtgagaggatcacggcgttcgtcgcggacgcagcggtgcgcgccatcatcggcagccggagcgagcaccgcgacgagttcttgcgcctgctgatggacgggctcaagataattccgggattgagcctgccggacctcttcccgtcgtcacgcctcgcgatgctcgtcagcagcgttcccggtaaaatcgagcgccgccggaaaggcctccttgacatcgtcgaccccatcattctggagcatcaggagaagagagcggccggtggcatagacgaagatgaggacttgcttgacgtgctcttgagactccagaaagacatggactcccagtaccctctcaccaccgacaacatcaaatccgtcctcatcgtaagcgctcctcacaatctctcaccttagatccacaaacgaaacagctctccacgttcactctgtttcttccacacactgcgcaggacatgtttggagcaagcagcgagacgtcggcgacgacgctgaagtggacaatggccgagctgatgcggaacccggcggtgatgcggaaggcgcaagatgaggtcaggggagcactcgccggccacgacgaggtggcggaggacagcctggtcaatctgcggtacctgcagctagtcataaaggagacgctgcggcctgcggctgcacccgccggcgccattgctgctgccgcgggagtgccgcagcccgtgccaggtgctcggctacgacgtgcctcgtggcaccatggtgctggtgaacgcgtgggcaataggcagggacccagcgctgtgggacgcgccggaggatttcgtgccggaaaggttcgaggagagtggacgagacttcaagggcatggattttgagttcatcccgttcggtgcgggaaggaggatgtgccccggcatggcgttcgggctggcgcacattgagctcgctctcgcggcgttgctgtttcacttcgactggaagctaccggaaggggtggtcgccgaggagatagacatggccgaggcggtcgcgatcacggcccctccgcgatctgatttagtggtgctccctgttactaggctaccggtgtcaatataatgtgcttcggcccaaaagcttattttctttcagtatgctagaaatagaacaacaacttttctttcgctttcggcggttgtgaaggtcgaaaccttttcctcgttatgtttgatattggttccttttctttttccggcttgtttatctcttctgtgaaggtaggtaggtgagcaagcgccggtcatggtcgctgcacgcgggttccacacttccactagatgagctctgaagagcgttgggcaagcgctggcgagcgcgccgggtg

SEQ ID NO: 12272 - DNA, 5089 bp, Zea mays
gcacgagaccattacctagaacatcctaatcgaaaagcttgcttcaggcacttgagagttgagactcactcagtcactagcaagtgcctcgtcacatggcagcggcagcgctagcggcgtggtggtggtctctgtcgctcctggctaccatcgtcggcggaggcagcgcctcaccgtcaccggtgcccggctgctacacgcgcatcttcagcttcggcgactcgctgaccgacacgggcaactacgtccacctgacggcgagcagccacagcccctacggcgcgccgccgtacgggaggacgttcttcggcaaacctaccggccgcgccagcgacggacgcctcgtcatcgacttcatcgcggaagagttcgggctggcgaaggtgacggcgatccaggcgggcacggcgccaggggacttccagaacggcgccaacttcgccatcatctcggccaccgccaacaacggctccttcttcgcgggcaacggcatggacatcaggcccttctcgctggacacgcagatgctgtggttcaggacccacctccgcgagctcgtgcaggcggcggcggcggcacagcagaacggcagcgtgggcgcgctgctgagcggcgcgctggtggcgctgggcgagatcggagggaacgactacaacttcgccttctcgcggggcgtgccgcgggacgcggtgcgcaggttcgtgccggccgtggtggacaagctggcgggcgccatggaggagctcatcgccatgggggcgcgcgccttcgtggtgcccgggaacctacccttcggctgcacgccgctgtacctgcagcggttccgcgccaacggcgggtggtgggactacgacccggccacgggctgcctcgcctggttcaaccgcttcgcccagtaccacaaccgggtgctcgcggcgcgcctcgacaggctccggcgcctgcacccggacgtgaccatcgtctacgccgactggtacgaggccacgatgagcatcttccaggaccccgggaagctagggttcacaaacgctctgcggacttgctgcgggaaccagaccgtgccgtgtggcaggcccgggtgctccgtctgcaaggacccgtccacgtacgggtcctgggacgggacgcacccgacggaggcggtgtacaaggtgatcgccgacggggtgctgcacgggccgcacgcgtcccctgttcctctcgccgacacctgtcctccgacatgacccttagaagatttataattggcagctttaagagcggtggtaacatctgaatcgtacttgcgtgattttaaggatggcacgataatagctttgtttaagaatacaggtgaggttggcatatttcgatagcataagcatacacacgaagctctgaagtgataattgagtttgtataaacatcatcattgatttagggggtgtttggttagagggactaaagattagtctctagtttttagtctcttttagtctcttttttaccaaacattaggactaaaatatgaactaaaatgatttagtctgtagtccttcacatatgtgctaaaagggactaaaccatattaattccacatttaccctttatttagttcaattgtactaatagtaggagaatgttaaaggctattttagtctaaaaaaaaaaaaaaaagtatattcttactatttttagcccctaaaaccaaacatgttagagactaaactttagtcccctaactaaactttagtccctagactaaagaaaccaaatatggcctaactatgtaggagatgcaggatacgggatggtcaagataatttaagttgtgataataagactgccataaaacttgctaataacttaatttaacacttctcgtactaaacacactaaacacatttatatccatcgtaccattacttagggattatgtaactaaagaaaatattttattagaaagagtgaagatagatgatcaattattagtaactaacctaataaacaactaataggtctcgaagaatttgtttggctacgctcgcacatcgatctgaattgacgtgtgttagatttatcaacattttttttctaaaatacatagaaaaaaaatggtagatggctgttattttagaaaacaatacgaaatggctagccggggcgtgggattactgcagggccggagctgacattttagaggtaatataggccggacagacttaaatactggtgcctcttctatataaatataattttattttacttatttgatatacacacttttatatcagtagaaattaacgtggtattaaaaatatatcgaaatattcgtataatatcttaaaactttttcgtgatgcgaagtcgatatcaaccttagcaaacaattattttttcacacataaagttgtcagaccaatcggtcaatcttaagacattgtataccttgaatagttcttcaataattttaattttaaaaagttttattcatctgatgccaccgtgtcacaaacatacatggtaaataagatccgataaacaataaaaaaatattaaaaataagaatctattttttcttgaagggaaagaatccatctttttgatattactaaaaatataaatagaatacattgatgtttctcacaaacttaacttcagtatattattattttttcagattttttaacgggtcaaaatttagatacctatataaaaagacatgcggaaggtccatcggattcgtggcctagggcggccgccctcatggtcctctatgtaaattcactcctggattactgtaaattactaggccagagctatatattttaagagaagtcagagccaaggtggatgatgcaggaccctaccaaaccaaccaaagaggcctaatatatatgacaaaaaagcagatgacagcaacgggcggagcatctgccttgctcgcatcgtccgatacctattcccatcctgccagaagctgctgacgtttcgagctcgccgcctgcaagtatacatagatttacattggatcgacgccatcgccactacgaactacgactcgatcgcaagcttccccagtagcgccatggaggccacggcaccagcaaaccttttctacgctgctttcctttttctgtcggtactgtatctcgccgtcacccggcgccgcaccagccgcctgccgcctggaccgacgggcctaccgcttgtgggcagcctccctttcctcgaccggaacctacacgcctgcttcgctggcctcgccgcgaagtacggccctgtcttcgccatccgtctgggctccaaggtggaaatcgttgtcacctccccggagctggcccacgaggtcctccgtgacaaggaccctgtcttctccaaccgcgtcatccccgacgccggccgcgcggtcgcgttcgacggcgtggagaacatcgtgggcgtcccggtcggacccaagtggcgcctgctccggcgcctctgcgcgcaggagatgctgagccccgcaggcctcgacagcctgtacggccttcgccggcgcgagttcaggtctaccctgcgctacctctacgcccagtcccaggccggcgagccggtggacctcggcgccctgatgttcgtcaacatgatgaacgtggtcaccagcaccctctggggtggcaccatcgggagcgagagcgagcgagctgccatagggaaggagttcagggcactcgtcgccaagttgaccgagctcctcggcacgcccaacctatccgacttctttccggtgctagcgccgttcgacctgcagggcgtccggaagaagatggagcggatcagggtgcgcttcgaccagatattcgactagatcatccagcagagggtgaacgcccagcaggacggcagcaagatggccccggacttcctcgagtgcatgctcaagatggagagggaaggcggggacggcaaggccaccttcactatgactgacgtcaagtctctgctcctggtacaaataatctttttgcatccatgtttccccaacctcctgctactgtaagaacgtttccatatatatgatgatatatacatgaataggacatggtggtcgccgggacggagaccatgtcaaataccgtggaatgggccatcgcagagatgctgcagaaacctgaggttcttcggaaggtgcaagaagagctcgacaaggtggtgtccggggacgccatcgtggaggagtcccagcttcctgagctccgctacctccgcgatggtgatcaaggaaacgctccggctgcacccagcactgcccctcatggtgccgcactccccgagcgaagagtccacgatcggcgggttccacgtcccggccggctgccgcgtcttcgtcaacgtctgggccatccacaggaaccccctggtgtggaccgagcctctcgagttcaaccccgagaggttcagcggggacgacgacggccgcaggtgggatttcacgggcagacagttcgactacctccccttcgggtccgggaggaggatctgcgccggcatcgccatggccgacaagatgaccccgcgcgcccgggccatgctgctgcaggcgttcgactggaagctgccgcagggtaccgagctggacctatccgagaagttcggagtcgtgatgaagaaggctacgccactgatggtcatacccaagtcaaggttccctaagcccgatctgtattgttcctgagcaagacctcagatatcatcgtgtcgatctttcccacaaacgctgtcaaataatcctgatatatacccagaaccgttctatattgtactcctcccgtaatttgcttgggtgagtacagtaaacgtgtggtacagtacaacagatgaacagaacaggtgtaaatcaatatatatagtaatattttctcatgatcttaattatctaaaagatgctagtttctgggatcttaactgtgtcctacttagactaatcccgtggtggttcttggcgcggtggagcgtcttgtcgaggagctgagggaggtcgaggtcgccgaaagatagtttcgtcttgccctgataaaggcaaggtttcctccggcgccaggaaaaaaaattggtgcaggtccgc

SEQ ID NO: 12273 - DNA, 1120 bp, Zea mays
tcatgcagttcacacactctcctctgacctctcctctcctctcctctcgacctctcccttctatctagccaccgaagccaagaccaaggaacggcatggctcagctgctgcacctgccggacctcgcggcggcgcggccgccggcgcggaggaggaggggtgtggcggtggcggtggcgggggggcgcgtcaagcagggggaggcggggcgggtgatcagggtcgccgaccccgtgcgggagggccggatgccgcctcctcttcttgccgcgccggccacgccgtcggagtctccgccggtcgcggggaggcgcggggacgaggacgacgaggtgaggcagaggtactacctcaacatggggtacgcgatccggacgctcagggaggagctccccgatgtgctctacaaggagcccagctttgacatctacagagatgacattgtcttcacagaccctttgaatacattcaagggcctggaaaattacaagacgatattctgggcgcttcgttttactggccggatcttcttcaaggcattgtgggttgatatagttagtatatggcagcctgctgagaacattatcatgattcgctggatcgcccacggcattcctcgagtaccttgggatgggcatggccgcttcgatggtgcttctgtgtataaactcgacaaggatggtaagatctacgagcataaggtccacaatgttgctatgaatccaccaacgaagttcaaggtcctaccagtccatgagctaatcagatcacttggttgcccctctactgcaaaaccaacttattttgaagcttcatcacaatatctgtgcgctgggccatcttatttgagattagcttggataagatgctacatctcattgtgccgcatgctttcgctcgcaaatctgggagaaggatagcctgggtttagtgatacctccaaattttgtattttcagtatgacagcacacatgttactaagtactattgagtcatgacagttgtatatatgaacactgatagtttatagaataagacctcttagttaaggtgtacaacacttgttattgattgttataagcatcagtcagcaaactagtcaagaaaaaaaaaaaaaaaa

SEQ ID NO: 12274 - DNA, 1337 bp, Zea mays
ctattgggcttgtcgtttatttccccttccgcaaaccaaaatgttggcggctcgccggctgtccgccgccacctctccgctcttcctccgccgcctttctgcacagacccagcccacggcatcgtcggcgcagcccccgccggaggtgaccgattcgggtccgggagcgtgggccggccgcgtggtgacgctctcgctgttgggcctgacgggcgccgtcgcagccagtgctgtcagcgacctctccgtcttcctctcatgctccagccaggcaatagagaaggccacccagaaccagcagatagtcaatgctatcggtaaaccaatcatgcggggaccctggtacagtgcttccattgctgtgaatcacgcgaagcattctgtctcctgcactttcccggtgtcaggaccccaaggaaatggtctgctcaagctcaaagctgtgcgcttgggagatgaatcttggtattcgtatgtgcagcccaccgagtgggagatactgataatggatgccatccttgatgtccatacggaagatggtaagcacacgacaatgcgggtaacaattccagacaacacacctgctccgccaccagcagactgcaccgcgtgcaagtcccatgcagcggagaagtgaatccattgacagatgttctttgcacaatttcttacgaaaataatttattcacacatttctgatgcaaccggctattatcggaaaataattcttactgatttctaaggtcgactggggtcctcgatttatttattcacacattataaatcgaggaccccaggttgaccttaggaatcggtaagagttattttctgatgctagccagaaatccctaaatcggtaagaataaagtgcttgcaacgatgttggacaaaaaaaaaaaaaaaaaatatttgatccatgtggttcatgcgtcacactttgtctaagattagtcgttcgaattgaagaactaaacttagacagaaacgttagacaaagtgtgacaagttagattaggaatcaaacaggttctagtacctagatagctggggaaaaaaggcttcattgtacgcttcaggactagagtgagcatagctagctcagccatgcgtgctcccgttggcactccccggtgggctgggctccgagccaaacacgtagcgagcccactccccggcctgcgcgtccgcctgcgccatggccgcgcgcacgccttctccgtctgcccacgccgacgcgatcaccgcggcgacgatggccaccacaagcagaggcgccagcagggtgagtagctgcgccgcgtcctccaccgccattggtcgtcgcctcgtgccgaatt

SEQ ID NO: 12275 - DNA, 1207 bp, Zea mays
cctccctcccggcccccacacggtcccaccccacccggagaaaacgaaacaaaccaaatctcgctgcgagctgggcggcgagggcgcgcggcgccatggcgaggagcaggacgtcgggcggcggcgagtacgagagcggcagcgaccacgacggcgcgctgcagaagccgctgctgcccaacagcgggagctggtaccggatggggatggggtcgcgccagtccagcctcaacgccgccggcacctcctccatggccgtcctgcgcgagtcccacgtctccgccttcctctgcacgctcatcgtcgcgctcggccccatccagttcggcttcaccggcggctactcctccccgacgcaggccagcatcatccgggacctcaacctctccatctccgagttctcggtgttcggctcgctgtccaacgtgggcgccatggtcggggcgatcgccagcggccagatggccgagtacgttggccgcaaagggtcgttgatgattgcagcaattccaaacgtcattggttggcttgcgatctcctttgcaaaagactcttcatttctgtatatgggacgcttgcttgaaggattcggtgtcggtatcatttcctatgtggtaccggtatacatagcagagatatctccacaaaacatgagaggggctcttggctctgtgaaccagttatctgtaacccttggtatcatgtttgcctatttgctcggcttgtttgttccttggaggcttcttgcagtaataggaaccttgccctgcatagtgttgatacctggccttttcttcattccggaatctccaagatggctggcaaagatgaatatgatggatgattgcgagacttctctacaagttctgagaggattcgatgctgacatcactgcagaattgaatgatataaagagagcagtaatgtcagcaaacaaaagggctacaattcgtttccaagagttgaaccaaaagaaataccgaacgcccctaattataggaattggtctacttgtgctgcaacagctaagtggaataaatggtatactattttatgcaagtagcatcttcaaagctgccggtctgaaggacagtgacttggacacctttgcacttggagctattcaggttcttgccacttttgttacaaccatgttcttggacagagctgggcggcgaatcccccctattatttcttctgctgggat

SEQ ID NO: 12276 - DNA, 1290 bp, Zea mays
caaccacactcgcattgcattgcattccttcagttcagtagtgtgctctgacagtgagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaaggcgaggcgctcaccttcgaggacgagagcctcaccctctccgactccagggggatcctccgccacatctcccacaagtacgcgaagcagggcaacccgtacctgattggcacgggcgcgctggagcgggcgtccatcgagcagtggctgcagacggaggcgcagagcttcgacgcgcccagcgccgagatggtctacagcctcgccttcctgccgcccaccctgcccaggcagaacgacaacggcaacggcggcgcgttcaacgccagggaagccaccgtgggcagtaacgccgacgcgtccagcagcaagcgcggtgtggccgggtcacagccggcggcaagccagaccaaggtgagcgcgcagaaggaggaggagatgctgaagctgttcgagcagaggaagaaggacctggagaagctgctggacatctacgagcagcgcctggaggaggccacgttcctggccggcgacaacttcaccatcgccgacctgtcgcacctgccctacgcggaccacctcgtctccgacccgcgctcccgccgcatgttcgagtcccgcaagaacgtcagcaggtggtggcacgacgtctccggccgcgacacctggaagtacgtcaagaccctgcagcgcccgccgtccacgtccaccgacgccatcgccaagaacggccagctgggccagcagcagcacctgccgtcgtccaccgacggccacggcgtgaagagccaacggctggtccagaacgagcggcacttctagccgttgccgtcccttcccgccgacgaataaactacctgcgccgccgccaccgccgccgtccatcaacatgctgctgttcgtgtcgttttcatgcgtcatacgtgtcttgctgcttttgaagctccgttcccgggtgcagggacctacgagtccattccgccgtttgctgattctgtttgtcgtgtaataaaatgaaaaccccaccccgttttgaatgaaattcaattctcagtgtcgtgtgaaaaaaaaaaaaaaaaaaaacgcgggggcttgatgttgtcaaaataacgtccacatgatcggaagtcttgcat

SEQ ID NO: 12277 - DNA, 1106 bp, Zea mays
acaaaacatatctatatatctgcaacgtcaaatcaacacaggctgttgtttgcttcttttggtaaaggctttagctgcggcagatccaccggcggcgccccgagaatcgaagatgccggtgaaggtgttcggatcgccgacgtcggcggaggtcgcccgcgtcctggcctgcctgttcgagaaggacgtcgagttccagctcatccgcgtcgactccttccgcggcaccaagcgcctgccccagtacctcaagctccagccgcacggcgaggcgctcaccttcgaggacggcaacgtcaccctcgtcggtacgtacgtacacacgcaagcgacgcgagagagccaactgaccaactgaaaacgtaatggatcatggatggatggatggatgcatgcagagtcgaggaagatcctgcgccacatcgccgacaagtacaagaaccaggggtacagggacctgttcggcccgggcgcgctggagcgggcctccatcgagcagtggctgcagacggaggcgcagagcttcgacgtccccagcgccgacatggtctacagcctcgcctacctgccgcccgacatgcagctcgacggcaggggcgtcggcggcctcccggcggcgacggggacgatgaacccggcgcaccggcagaaggtggaggagatgctgcagctgttcgagaagagccgcaggcagctgggcaagctgctggacatctacgagcagcgccttggcgaggaggccttcctggccggaggcaagttcacgctcgccgacctgtcccacctgcccaacgccgaccgcctcgccggcgacccgcggtccgcacgcctcatggagtcgcgcaggaacgtcagcaagtggtgggacaccgtatcccgccgcgactcttgggtcagggtcaaggagttgcagcgcccgccgtccgcggaggcgcccttctgatgtcgatcgatcgcaaattaaggcggtggcctttgctcaagcctacgtgttcggtttctgcataattttttaataaataaacgccactggcccctctacgtcattggcgattgttcattgtgtaataaatcgttcaagagcatatgatgcttcttgccgtgag

SEQ ID NO: 12278 - DNA, 2658 bp, Zea mays
attttagcacttagagacctaaacataagtgctaaaataagtgatatgctaaactttaacttttaatagaagtttagcccctcaagatatgctaaattttagcaccccgcgcgtgggattcaatcgtgaaaacaggcccttattaatcaccgaaataaaaaaatttatgtattttttgcctgttgcgttactgtcaccgaccatcaatatctttttttttcttgggaaaaatatgtttttgttatcacgtccttcagtgcagacgagcctgtaacactttattattcccttctctgattgtcttcatcttttcttaagtgttactagtaatgagtacattatttcgatagcatgtgaacataggagaaaataactaacagcaagatgatacttggcgctctattatataacctatacaaaaaaaaagtgcaaagatgataaaggatggtctatgtacgaggctggttaataatctgcttttgctttcattttacattactgagatctgtttgcagctaaaagtgtagtgctctagtacttagcatatctgaacatgttaagatcacccccatatggttactaaaagtgaagcttttgcagtttttgcttgatgcgccgaacagaatcaaacaacccaaaccagctctaagcccagtacctgtttcccgcactcttctttttctcgcccctttcctgacttaataaatagttaaatcttcagatcttgatcatatgtcactcttactaaagcatccatttgtgctgttctttgatgaacaccctaccctggtatccagtgactgccataatggcttcatgtttatgcaacacaagacaatcgtctctttctccttgatggcatcgaacgctttgctctttatcttctttctctttccctttgattcgtgttccagctttagatttgcctcccgccaagcaaggcattttgtgctacccgctttggcaactatataagcacgcccaagcaatccaatggcagcccccccctccccccacgaccacactcgcattgcattgcattccttcagttcagtagtgtgctctgacagtgagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaaggcgaggcgctcaccttcgaggacgagagcctcaccctctccgactccagggggatcctccgccacatctcccacaagtacgcgaagcagtggtgcagtgcagcaatggcgctgacattcaccggccgttgaacgttaccttgctgcagactccagggggatcctccgccacatctcccacaagtacgcgaagcagggcaacccgtacctgattggcacgggcgcgctggagcgggcgtccatcgagcagtggctgcagacggaggcgcagagcttcgacgcgcccagcgccgagatggtctacagcctcgccttcctgccgcccaccctgcccaggcagaacgacaacggcaacggcggcgcgttcaacgccagggacgccaccgtgggcagcaacgccgacgcgtccagcggcaagcgcggtgtggccgggtcacagccggcggcgagccagaccaaggtgagcgcgcagaaggaggaggagatgctgaagctgttcgagcagaggaagaaggacctggagaagctgctggacatctacgagcagcgcctggaggaggccacgttcctggccggcgacaacttcaccatcgccgacctgtcgcacctgccctacgcggaccacctcgtctccgacccgcgctcccgccgcatgttcgagtcccgcaagaacgtcagcaggtggtggcacgacgtctccggccgcgacacctggaagtacgtcaagaccctgcagcgcccgccgtccacgtccaccgacgccagcgccaagaacggccagctgggccagcagcagcacctgccgtcgtccaccgacggccacggcgtgaagacccaacggctggtccagaacgagcggcacttctagctgttgccgtcccttcccgccgacgaataaactacctgcgccgccgccaccgccgccatccatcaacatggttccttgtgctgttcgtgtcgttttcatacgtcatacgtgtcttgctgcttttgaagctccgttcccgggtgcagggacctacgagtccattccgtcgtttgctgattctgttcgtcgtgtaataaaatgaaaaccccaccccgttttgaatgaaattcaattctcagtgtcgtgtgaaatatactcgattgtaagagttttgatcttgctcttgtcaaaataacgtccacatgatcggaagtcttgcatagcatatatccatgtacctgcttcctaaaacaacaattagggtgtgtttggtttgatttttggctttggcttttatctcctaaaagttaaaagctaaaccagactagattcaggaagcaattttttctaaaaaccgactttctcacggtctaaaaatgaaagcatcattggacctacttttagtgacttttagatgtaactgtggaaatatatatcgaaaaacttttaacgatttttag

SEQ ID NO: 12279 - DNA, 1318 bp, Zea mays
cagcagcacacaacctaccacacccccattgcattgcattgcattccttcagttcagtagtgtgctctgacagtgagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaaggcgaggcgctcaccttcgaggacgagagcctcaccctctccgactccagggggatcctccgccacatctcccacaagtacgcgaagcagggcaacccgtacctgattggcacgggcgcgctggagcgggcgtccatcgagcagtggctgcagacggaggcgcagagcttcgacgcgcccagcgccgagatggtctacagcctcgccttcctgccgcccaccctgcccaggcagaacgacaacggcaacggcggcgcgttcaacgccagggacgccaccgtgggcagtaacgccgacgcgtccagcggcaagcgcggtgtggccgggtcacagccggcggcgagccagaccaaggtgagcgcgcagaaggaggaggagatgctgaagctgttcgagcagaggaagaaggacctggagaagctgctggacatctacgagcagcgcctggaggaggccacgttcctggccggcgacaacttcaccatcgccgacctgtcgcacctgccctacgcggaccacctcgtctccgacccgcgctcccgccgcatgttcgagtcccgcaagaacgtcagcaggtggtggcacgacgtctccggccgcgacacctggaagtacgtcaagaccctgcagcgcccgccgtccacgtccaccgacgccagcgccaagaacggccagctgggccagcagcagcacctgccgtcgtccaccgacggccacggcgtgaagacccaacggctggtccagaacgagcggcacttctagctgttgccgtcccttcccgccgacgaataaactacctgcgccgccgccaccgccgccatccatcaacatggttccttgtgctgttcgtgtcgttttcatacgtcatacgtgtcttgctgcttttgaagctccgttcccgggtgcagggacctacgagtccattccgtcgtttgctgattctgttcgtcgtgtaataaaatgaaaaccccaccccgttttgaatgaaattcaattctcagtgtcgtgtgaaataaaaaaaaaaaaaaaaaaaaaaaaaaaaaaaaaaaaaaaaaaaaaaaaaaaaaaaaaaaaaaaaaaaaaaa

SEQ ID NO: 12280 - DNA, 1057 bp, Zea mays
caaaaaacaaaacatatctatatatctgcaacgtcaaatcaacacaggctgttgtttgcttcttttggtaaaggctttagctgcggcagatccaccggcggcgccccgagaatcgaagatgccggtgaaggtgttcggatcgccgacgtcggcggaggtcgcccgcgtcctggcctgcctgttcgagaaggacgtcgagttccagctcatccgcgtcgactccttccgcggcaccaagcgcctgccccagtacctcaagctccagccgcacggcgaggcgctcaccttcgaggacggcaacgtcaccctcgtcgagtcgaggaagatcctgcgccacatcgccgacaagtacaagaaccaggggtacagggacctgttcggcccgggcgcgctggagcgggcctccatcgagcagtggctgcagacggaggcgcagagcttcgacgtccccagcgccgacatggtctacagcctcgcctacctgccgcccgacatgcagctcgacggcaggggcgtcggcggcctcccggcggcgacggggacgatgaacccggcgcaccggcagaaggtggaggagatgctgcagctgttcgagaagagccgcaggcagctgggcaagctgctggacatctacgagcagcgccttggcgaggaggccttcctggccggaggcaagttcacgctcgccgacctgtcccacctgcccaacgccgaccgcctcgccggcgacccgcggtccgcacgcctcatggagtcgcgcaggaacgtcagcaagtggtgggacaccgtatcccgccgcgactcttgggtcagggtcaaggagttgcagcgcccgccgtccgcggaggcgcccttctgatgtcgatcgatcgcaaattaaggcggtggcctttgctcaagcctacgtgttcggtttctgcataattttttaataaataaacgccactggcccctctacgtcattggcgattgttcattgtgtaataaatcgttcaagagcatatgatgcttcttgccgtgagattgaactaaaaaaaaaaaagcttctctattgagc

SEQ ID NO: 12281 - DNA, 2617 bp, Zea mays
  misc_feature (164)..(164): n is a, c, g, or t
tgcatgcctgcagataccagtttgctcaccggcaccatgcgtagcgcatgatctattttcaatcctgcctttgatcgccattcctaccaactcaataatataatatatcccgtcaccagttcgatcgacataattaaccgcgacgtcgccagatctcgatcggncggtggccgccgtggtcagtaaggcaggcatggcatccgaggtagccggcctcgccgtggtctcggccgccgcgtccgtggccctggtctacgctcgtctcgccacctcgcggctggctcccggcaccccccgcctcgcggcgcttgctccggtgctcctacccttcccttgaagccgtcatcacaggctgcacagcacacaaaccccgcgtagaggtagagatcacctcacccctcccgactccggcgcatccattcggtcgctgccggatgcgcgctcgacccggccatggatgactctgtctctttcaatgacctcggtccctccaagcccccgtcggcctctttctacgacgatatgttcgagtcctacttcaatcgcgcggccgaggcccccgagccctcgcctaaggcttcttcctcgccgtcgacgccgccgcccgtgttcgacaagccagtcttcgacgacgatccttacacggccgatccattcgacgcgatccccttgtttggaggcggtggtggaggggaagaggaagacttgcacggtggcgtccggagtgcggcaaagccggagaggacggagttggaggtggtgggttttgatgaagatttgttccctgggttggctgggagcaccaattttcccatggagaagccggccagggaggtggagcgggaccgtcaaccagtggggttcgacgacgagttgatccctggattcgatggaagcatgaagccagcgccgcaaatggagcctgagacagtggcgtttgatgatgatgtgatccctgactgcagtggaggcacgagctatccctcttcggcaagggaggaacctataacgagacaagaaagtgaatcaatttcctctagcaaaattagcatgagcatgccagaaggtcctttcgttacttttaggtggtacacacaaatccgggatattcatctttagggttgttttcaaatcttctgaataacattggcatgcctagaaaggaagcggacacaacgcctgataataccagtgggatatttcagggttctgatatctttactgagtttccaaaagccatgccacccttttcgtttacatctgaaaaccagagtgatagaactgaaaggagatatactgaaaacataatcagcacgagtcactccgatcggctgcctcaggagaagacagtccaacaagcatcaacagaagcacctgccaatacattgactgagatgaacttccctgaagcatctgttgtccatgaagtacctgttaccactagttttcagacattgaacccatttgttgaggaagacgatttgttagaggtgaatcaatcttcacaaacgactaatgatgtgtggctaactgttttagatattgctttagtgacactacctacaagtgcgccacctccttcaaggcctccacctccacttgctgctaagaaaccacctactgaatctgtaactagtgaagcatatgcccatcattgtaatcaacgctaccatcactccatatgttcttcaaacacctctaaaacatcccaaattgatgaattggaagattttttcttgacaaagcctgcaaattctgccattggtcatccacaagttctaaagcatgaaggaaatgggcattatccatctgcagctactgcaagtttcatggactggactgagatgggacactgtaaaagggggaaccaaggggcatttgattctatgttcactagcagtcaatatcgacagccagaaatagatgagaaagcagaggtatgtgctcatgaaacagaaagtacagatgaagaaaagagattagagaatgaacaaatacaaaaagaacataaagaagagcaaataagagcagaaagggagatggaagaagagcttgagagggaaagagaaaatgtgagacaaagggaacaagaggagcagaggaggcgtgaaaaagaaagagtggccaggcaggctgtagataaggctatacgggaggcacgcgaaagagcagctgctgaagcacgcatgcaagctgagaaggaggctcgtcaaagagcagagcgagctgcagtatggaaagcagcaacagaagctcgtgagagagctgcagtggaggcaaaggaaagagctgcgaaggctgctgcagaagctaaggaaagagaagcagcagaggctagagaaagggctgcaacagaatcaagggaaagggatgccaaagttgccgcagatgcaagggaaagagctgctagggctgctgctgaagctagggaaaaggaaacagcagaatttcaggagaaagctactgcagaagctcgggcaaaggctgagcgagctgctgttgagaaagctgcagcagaagcacggtggggggctgaaagagcagctttcgagagggttgctactgaagttaagcaaaagggcttttaatgatgctagagaaagggctgccgctgcag

SEQ ID NO: 12282 - DNA, 941 bp, Zea mays
tcgccggtacacaagcaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcagctgggccatgaggggtacagcgagatgggcagcaagggcgggcagacccgcaaagagcagctgggccacgaagggtacagcgagatggggaggaagggcggcctgagcaccatgcaggagtccggcggcgagcgcgccgcccgggagggcatcgagatcgacgagtccaagttcaggaccaagtcctagatctgatgcgtgcccccgcttagcatgtagtacgtagctgcaggaatgtagtgtcgtcgtagtagtagggtagtcgtacgacgtgccgctcctcgtttggcacgtgtgccctgaataatgtagtgctgtcagtcgtcgtcctagcacgcgtgtaggagaccatacgtgcgcgtatgatcatgcgtgcttcgcttcagttaggttctgatgttggtcgtcgtcaccgtgtttgaagcaggcaggtctcttcaggctttgtcgtcgtagcagcctgtgttctagctctacgaccccatactcatagcgtgtggtggtgggtcgtgatgccttaaggtctccgagtttgtatccgtgcttgtttcgttaaggtagtttggttcataactcaaatcttctctcacttatgttcgactacattttgtttggagtctctccgttcatatacaagaaagggaaggatgtagctagct

SEQ ID NO: 12283 - DNA, 4195 bp, Zea mays
ctaatgttttgatttaaagtactgatatacatgtcactatattgccttgggtcaagtctatattgtatcctttaaactctaatcataaatactaacaaatatcgttagttcaactgattatattgattatcggacaccaagattcattaattaaataggtttctatctatttttcttacactagttattagtttttaaaaataagacatcaatttattccgttccacgaacaaacgagcaaataaacaaaatgagatggcgatggactatctcgttctttaacacaaatgttccctatagttaatggcgtcgaccggaacaggacatgagtgacgtttttttttggctttggcttaattgctccatagcccctctcgatagctgagtgctggactgctggctgctgaaacaaattgcgacatgccgattcgggaaccggaatttttcttaaggctagtttgagaactcaatttttcaaaatatttctattttttaagaaaaaataaactaaatccctttgaaaaaatataaaactcttagaaaaaattctaaggttcccaaactagtactaaacattcaaagtggggtactagaattcttcccgtaccttttaaaaaatcacagtcccaatctgacattcgaaaaaagggatatctgatcaacgcgaagctttcggtgcgcacttcacggggcatcgtcatcgactcatcgtcattctgaacaacacgacacagcgccacagagggtggagaagatacgacgtttcaggaattcagatgcacgctgcagataccagttggctcaccggcaccatgcgtagcgcatgatctattttcaatcctgcctttgatcgccattccctaccaactcaaataatataatatatcccgtcaccagttcgatcgacataaataacgcgacgtcgtccagatctcgatcggccggtggccgccgtggtcagtaaggcaggcatggcatccgaggtagccggcctcgccgtggtctcggccgccgcgtccgtggccctggtctacgctcgtctcgccacctcgcggctggctcccggcaccccccgcctcgcggcgctgctcccggtgctcctactcctcccagtcctccccttcgccttctcctccatccacctccgcaccgtctccgccttcttcctcgtctggctctgcggcttcaagctcctcctcctcgccgcggggcacgacgggccgctccaccccgccctcccgctcgtgcgcttcgtcgcgtgcgccgcgctgcccatcaaggtccgggacgagaacgacaagcagcagcaaacacggatatcccgctcctctctcccttcgggattcctgctgtcctacgcggccaaggcggcgctcttctccgcgctcgtctccgtccggtgctacagggcgcggatgcccgcgtacgccgtgcccgtgttcgacggcgcgcacgtgtacctcatgctggagctcttcctcgcgtccgccgcggcgctcgcgcgcgcgctgctgggcgcggagctggagccgcagttcgaccggccgtacctcgcttcctccctgcgcgacttctggggccggcggtggaacctcatggtccccggcgtgctccggccctgcgtgtaccgccccgtgcgcgcccgcttcggcgccgccgcgggcgtgctcgcggcgttcctcgtgtccggggccatgcacgaggtcatgttctactacatcacgctggaggccgggaccggggaggtgaccgcgttcttcgcgctgcacggcgcgtgcgcggtggccgagcggtggatggcgcggcagggcggcatgtggcggccgccgcggcccgtcgcgacggcgctgacgctggcgttcgtgacggggacggggtcgtggctattctttgcgcccgtgatccgaagccggctggacgaggccatcatcgcagagtgcgaggggatgcttgcgttcttggagcgcgctggccggaatctagccgcgatggcacatttgatttgaacttctgtaaggtagtactgatacatgtaacgcaacatgtacccctatttggtcgatgcacttgtaacaccctggtgtatttgccggcgagcaccgctcctagagctcggatatcctttcacgaagtctcagattacacaaggagttcagggtttttggaggaggaagaagaacgcacaccaactctccggagtccggacgcagtcggccgccgacgtattgctcaaacccttccgcaaaaccattccacgaacaaaataccaccacgagcagccactgggcctggctacttcatccagtccggcccacagaataaatggttgggcttcacttgacgtcgagtcctatccgccaccagtccttcattcaaattcacggcttgttcccaagctggagcacctgggaattgagacttgatgctggcttcatcctcccatgtcgccagatccaccggccaggatgaccattatcagaagttgggatgtaggaccctcaggagtgttgttcaacccgctctgcctgctgcctctagccactgaaacatatttgaaataggaggcaaggtggcactgaccgtgttagaagaggagatcgctttcttcagaaaagagacatggaatacgaggtagatattggaagtttcaggcaaccccagtttatatgccactttacccactttggctaacacaggaaatggcccaaagaatttaaaagctaatttgtgtttagctcttttcaccgaagacaattgaaagagataattggatttttgccactcacaatgttgttttcttgttataattatcactgtgtctatgaattgtagatctaattgggtctatgaaatgtggacctgatagcaattttacaaacctgtttcttgctgatggcaaatatcagaatctcttgttgaacacaggatgttgaggaggaactgagtggggaggggcatgaatgcctgtgaccggaggtggagtcagggtggtaaccactccaaaaccatcactccggcagagtaggtgcccaaaattcccagcgtagacaacggagatgcaccaccgtcggggatggaattggtggttccagagacccatggtcgaacaccttggggacgggatggaattgatcccggaacgccaccagttcattaattctctccgttagatggcccacctccttgcgaagatgaccaacgtccgcttcgatttgtggtttagaggagagatcgcgcaccacggccgtgttctcctcgagggccagcttgatggagtcgttctgagcttgcatggactggagaagcgtggagaggtcgctgatgtgcttctccatggtgtcgtgttgttgttgctctcgggttctgtacttcgaccgaagaaggtaatctggtgggtccgccaggatcgagacgggaacctgataccacttgtaacacgctggtgtatttgacggcgagcaccgctcccgaagctcggatatcctctcacgaagtctcagattacacaaggagttcagggtttctgggggaggaagaagaacgcacaccaactctccggacgcagtcggcgggccgccgacgtattgctcaaacccttccacgaacgttaagaacccttgctaccgagtgtagtctaaaggctgcttaactgaataatagtagaataaaagaagataagagtgtagagaggaactgattctttgttactatatggtgctgctctccaaaggttacatgatatgatgatttcctctctatttatagacaaaactagggtttcaggcatatgggtcacataggccttcctggcccaagaaagatttcttaacactcccccttggcccaatgccgcaagatgcatatgtccaaaactccataaaaacccagtgagaaaaaattggagaaagagtacatagcacgcttgttgtgtcgcatgaattgcctcatcaaaaccctagtgagaaactttcatgaaaactcacataaaggaaaaagagtacaattcacccaatataacaatttaatcttctagattatttgggtacttaaaatttacgtttaagattatttgggtgtgtgtgaagtttctccccctgagatatgcaattctctaagtctcatcattccaagtcctcggacgcatcattcaaaagatgacgcagggagtgactttgtgaacatatctgcgagattt

SEQ ID NO: 12284 - DNA, 548 bp, Zea mays
  misc_feature (349)..(349): n is a, c, g, or t
  misc_feature (357)..(357): n is a, c, g, or t
  misc_feature (359)..(363): n is a, c, g, or t
  misc_feature (365)..(367): n is a, c, g, or t
  misc_feature (378)..(383): n is a, c, g, or t
  misc_feature (389)..(391): n is a, c, g, or t
  misc_feature (393)..(393): n is a, c, g, or t
  misc_feature (404)..(404): n is a, c, g, or t
  misc_feature (407)..(411): n is a, c, g, or t
  misc_feature (413)..(413): n is a, c, g, or t
  misc_feature (416)..(417): n is a, c, g, or t
  misc_feature (423)..(424): n is a, c, g, or t
  misc_feature (426)..(429): n is a, c, g, or t
  misc_feature (431)..(433): n is a, c, g, or t
  misc_feature (435)..(435): n is a, c, g, or t
  misc_feature (440)..(441): n is a, c, g, or t
  misc_feature (447)..(447): n is a, c, g, or t
  misc_feature (452)..(455): n is a, c, g, or t
  misc_feature (457)..(459): n is a, c, g, or t
  misc_feature (461)..(462): n is a, c, g, or t
  misc_feature (467)..(475): n is a, c, g, or t
  misc_feature (477)..(486): n is a, c, g, or t
  misc_feature (492)..(492): n is a, c, g, or t
  misc_feature (494)..(497): n is a, c, g, or t
  misc_feature (500)..(500): n is a, c, g, or t
  misc_feature (503)..(508): n is a, c, g, or t
  misc_feature (511)..(512): n is a, c, g, or t
  misc_feature (515)..(517): n is a, c, g, or t
  misc_feature (519)..(519): n is a, c, g, or t
  misc_feature (526)..(528): n is a, c, g, or t
  misc_feature (531)..(531): n is a, c, g, or t
  misc_feature (533)..(537): n is a, c, g, or t
  misc_feature (539)..(543): n is a, c, g, or t
  misc_feature (545)..(547): n is a, c, g, or t
atctcacacaagcaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcagctgggcccatggaggggtacagcgagatgggcaagcaagggcgggcagacccgcaaaggagcagtggggnccacgagnannnnnannngagatgggggnnnnnnaaaggnnngncctgagcaccnggnnnnngnaanncccggnngnnnnannngngcccnncccggnagggnnnntnnnannatcgnnnnnnnnncnnnnnnnnnnggaccnannnnccnaannnnnnggnnggnnngnccccccnnnttnannnnngnnnnnannna

SEQ ID NO: 12285 - DNA, 6299 bp, Zea mays
  misc_feature (248)..(248): n is a, c, g, or t
  misc_feature (287)..(287): n is a, c, g, or t
  misc_feature (363)..(363): n is a, c, g, or t
  misc_feature (413)..(413): n is a, c, g, or t
  misc_feature (431)..(431): n is a, c, g, or t
  misc_feature (449)..(449): n is a, c, g, or t
  misc_feature (599)..(599): n is a, c, g, or t
  misc_feature (649)..(649): n is a, c, g, or t
  misc_feature (2144)..(2144): n is a, c, g, or t
  misc_feature (2761)..(2761): n is a, c, g, or t
  misc_feature (3006)..(3006): n is a, c, g, or t
  misc_feature (3018)..(3018): n is a, c, g, or t
  misc_feature (3126)..(3126): n is a, c, g, or t
gactagccttgctttgtaccttgatatttcattattttcatttctctgccggacaaatacccacttataacctacagggtgtatgtgggatggtgtgcggcttacgggcccaaacacctctcttttgtctagagaaattaattccgcagtaattgcctttttccatttatcccaatccggtcttttcttgcactctgcgatagatgccggttccgggtcatgatcaatgatcgaggcaacttttttgngaaatatatgtctatgttggctgttgctctgttcatgcnttctccagttaatacatagtttatggccatttcatcatgggatgcttcttgcatttcttcttgcgtttccctgctncttcttgttgcgggagcgagttcctttagtttttcatcgcctttgtgtgngcacatgtttgggttggnggtttcttcaacgggaangtttaagtccggaattcttttcttcatgtgttccttcccggtgccaggtctcgtctggctccccttcttgctttggggcatttctgtgatcggctgtggcaagtcctcttgccctcttttcttcggacgtctccgagtacttggggtttnagaggccagagttcctgtccttttgttatgaggcctcttaacaggatcgngtataccttcaattttctttggtatttcaaccctctctggtgcattccgtgcaggaacatgcgacttaaccacgctcttcaaatcacaaaaatgatcaggcagttcttttgctaagttttgcaaatcgattatcttttgaacttctagatttgcttctttggtgcgagggtcatgagcggggattcccatggattgccatataatttctcggcatttctcatccaaaggttcttttcctccccctaatgatgggaaattatcctcgtcaaaaatacaatcggcgaatcgggccgtatgcaattctccggtcattgggtcaaggtgtctaattatggatgcactctcatatccaacatatatccctattttccggagaggacccattgcacttcgctgtggaggtggtataggtacgggtgccatgcatccaaattttcttaggtgagagatttttgggatgactccttgcactagttgcattggtgagtgaatgttgtatgctgatggacggaaattgataagtgctgctgcgtgcaggatggcatggccccaacatgtgttgggtaggttacaactctgcaagagtggtctagcaattagctttattcttttagtcaaagcttcggctagtccattttgcgtatgaacatgaggcacagagtgctcaaccgtaattcccgatgcggtacaataatcatcaaatgccttagatgtaaattctccagcattatccattctaatggactttattcgatggtcagggaaagtatttttaatccggatgatctgcgagatcaactttgcaaatgcatggtttcgagttgatagtaagcatacatgcgaccacttcgaggatgcgtcgattaagaccataaaatatcgaaaaggtcccgaaagtggttgaattggaccacaaatgtcccctggattcgttccaagaaggcgggaatttcattctttactttcaagggggatggtctcaatatcaattttcccatggcacatccctggcacacaaaatcttcttgatttgggaagtgtttcacatttatgctgtgtccttgtgagttagtgatgatatttctcatcattctaagaccagggtgccctagtcgacaatgccatagggagaataattcagaatgtctaaacaccgtctttagggaagtggacactgcaggtgcactaatcttagtataatataaccctgattctagcgatgggaatttttctatgacttctttgtcatattccccatactttatgatgcataggtattccttaccattttcctctgtggtttctacatgaaaaccatttgcacgaatgtccctaaaactcaagagagttctggttgattcggggtacaatagtgcttctttgatttcgatttgagtacccatcgggagtgtaattgtggctttacctgagcctattacacatgaatcgcttcccgcgattgtggtaatactaccaacgttcttcatgatcgtntgaaagtattttgtttcccttaaaatggtatttgtcgtgccactgtcgacaatacatatatcctccatagacctttcataatacaattattgcaattagtaattatcataagggaaatattgcatagtaaatttaaatagttcaacattcatgaaataaagataatgctcttatagagcttacagaccataattatgttttttttcaaactctgaaaaataaatgtgcatgcaagcactcaaatggaatcaaggaaggcatcagtgtcagcctccactagagctatggaggtgttctcttcggtggcaatcatcttcacagcacctgcaagatcaagaggcatgccagatgcttcaagcgtagggtcttcttccatggcttcattgttggttgccatggtgaagtgtgcctcaggtttctgtttggatatgttctttgccttgtatgcttctatgacatgctttggtgactggcatattttggaccaatgtccccacacgccacatttgtagcatgtttggtcttgaagtccgtatggcttatgttgtggcttctctttgcttgttttctttccgtgagcattgatgggattgactgtggtttctttctttcccttnccagcaccatgcttgcctctctttctctggataggctttcttatcttgtatgaggcgacattaactttagtgctaatgccctttccatttggataagcattgaagttcgtcttcaaagcatcatcttgtgcctcatttacttgcattatatcgataagatcgctatactgcttgtatgcgtcttgtcgatagttgcgagcagattggatggcgcttgggtggaaggtagacaaggttttttcaancttttcctcatntgttatcaccttaccacaaagagataatttggtgcatattcggtgcaatgctgcattgtattctcccacagttttaaagtcggcatatctaaggcgagcccagtcttnctgtgcttggggcaagactgtgtactttaacctctcaaaacgttgttgcaatgcattccagagtttgcttgcctttctctctgacatgtactcattcttgagtgtaggcgagagatgatgccgaagaaagtgcaatgcttggtcattttgctcgtcggtagccacttcatctttttggccaagaccgattgcaactttgagcttcttgcccccaagcacaatttgcacatcagatgcccacgtgaggtagttttgaccatgcggggccaacacctcgaattcacggctcacaataccagtcatctacatgtgataaattttatagttagattacttcttgtaatcatttcagaggatgaaaaaaaaatcgcaagaaagcaaatattttaaatgaatgatgcaatatacaaatttaattacacaattatgtaagattacattgtttagtttcatagaaatcaatttctagagtcataataatgcctaaattaaaattctattctatttttccttaagaaaaaaaaacagcccattaaggaccattagaatgcgcgctgctccattttttttatatatagagatatgagttgttgctcactaggccactccaccttgcatgcgtgttctttattacatgaaaaaatgagccgctgcttttgcattaagggcctagagatgtacgagtgcaacgcttcgtattcactgcacgagtaatttttttttaatgcacggaggcgctttgtattcctcagcagctctgcgcgcccgtgcttcgtgtacggcagtgacgaggcagcagcagctctacgtgcccacgtgcctggctgcctgcccaccgtgatggcaaggcttgcttgcttgcgtgcctgcgtgtggcagcgacgaggttgaagctacggcggtggctgcttgcctgcgcgcgtgctagcacggcgacgacgtcgacgctgatgctagcgttgctacttttgtttttgttttctctgtgcttgcgatgatgcagtaaaataaacgtgtgtatctcatgtgattgatcgacgtgtgtcggcgatttcaaatcagtaacaatcacatgtgcatccccatcgacttcgtgtcggcgataaatctgctagggatttgtgcttttcatgtatgtgcttgaatagagaggaaagaataatattacataaaatatgagttcaacatctttcttaataccttttgctcgatctccttagtagagccacgtgcgtgataacgtgttaagaaccccttgctaccgagtgtagtccaagggctgcttaactgaataatagtagaacacaaggagacaagagtgtagagaggaactgattctttgttactatatggtgctgctctccaaaggttacatgatatggggatcttctctctatttatagacaaaactagggtttcaggcatatgggccacataggccttcctggcccaagaaaggtttcttaacactaccatcttccaggcgcggtcgtgcgtgcttcaactccttccctccgcctccagagcggataaataaatacggggtctacggtgcacgcgcacgcatggtgcgccgaggggcatctctgcccggggaatgcgcgcaggccatcgctcgacacgcacgtacgtgtcgcccccgcgaggcctcctcgcacacgcgtcgcgccgcacgggcgccgagggaccttgcaattcgtccgcgtcggtgcacacgtccctggcccggcttgccggctttgccctggcctcgcgcgcgacgtgccgcgtctccccaccggacggctataaaaaggcggcgccacctgatcctccatctcacacaagcaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaaggtttgtatcctacggccggccggccttgtgatcctcttatcttcctttcacttgtgtgtgctataaacccactactactgcgcgtaagtagccaagaagaactgatcatcaattaaacgattgtgttggtctgttcgtgcagggcgcagtcacggcgggcagacccggagtgagcagctgggccatgaggggtacagcgagatgggcagcaagggcgggcagacccgcaaagagcagctgggccacgaagggtacagcgagatggggaggaagggcggcctgagcaccatgcaggagtccggcggcgagcgcgccgcccgggagggcatcgagatcgacgagtccaagttcaggaccaagtcctagatctgatgcgtgcccccgcttagcatgtagtacgtagctgcaggaatgtagtgtcgtcgtagtagtagggtagtcgtacgacgtgccgctcctcgtttggcacgtgtgccctgaataatgtagtgctgtcagtcgtcgtcctagcacgcgtgtaggagaccatacgtgcgcgtatgatcatgcgtgcttcgcttcagttaggttctgatgttggtcgtcgtcaccgtgtttgaagcaggcaggtctcttcaggctttgtcgtcgtagcagcctgtgttctagctctacgaccccatactcatagcgtgtggtggtgggtcgtgatgccttaaggtctccgagtttgtatccgtgcttgtttcgttaaggtagtttggttcataactcaaatcttctctcacttatgttcgactacattttgtttggagtctctccgttcatatacaagaaagggaaggatgtagctagctagctattctgccacaagagagaaaccagaacggaacggaaacatataacagtagcacctcatgtggcagaattgttggttttatgcctgctgcctcaattttacggcttcactgagtttggacattcatctttctatcgacgagaatgcctaatcaaactagctagggactaataaactgcaatttttactagcacatagggggtttgtttggctcgggaaaaactaaccaaactttaaggactggtttgagaatcccaattttccaaaactacccaa

SEQ ID NO: 12286 - DNA, 2290 bp, Zea mays
  misc_feature (2095)..(2095): n is a, c, g, or t
  misc_feature (2264)..(2264): n is a, c, g, or t
  misc_feature (2282)..(2282): n is a, c, g, or t
ggaattcccccgccgacgcgcgaagtcaaatctcacctcaccagtggctgccttctccgctccgcgctgcgcctcccccaaagcttcagtggctgctgcgacccttctgttctccgctcttggtcttgggtgatcgccggcggtacttgtagcggggtatttatctgagggaagaagaaactatacaattcatcatgtcaggagggtcgtctgaatcttccccgttatctggacaaaatagccttagttctctatcaatttccaaggacaatgaactatcttcagagtctggctgcttgtccattgttgtactaggcgcttctggagaccttgctaagaagaaaactttcccagcgctctttcaccttttccagcagggatttctgcaatctggagaagtccatatatttgggtacgcaagatcaaatctttctgatgatggattaagagaacgcattcgtggatacctcaagggagcttcagatgaacatctttctcagtttttgcagttagtaaaatatgttagtggctcctatgatagggtggaaggatttgagttattaaataaggcaatctctgagtatgaaacttcaaaaaacaatgactcgggaagctaccgcagattattttatttggcattgcctccatcagtctacccatcagtatgcaaaatgataagatcatattgcatgagtccatcttcacacactggttggacaagggttattgttgaaaagccctttggaaaggatttgaacactgcagaggaactgagtgctgaacttgggcagttgtttcaagaagaacaactctatagaattgaccactatttaggaaaagagcttgtccaaaacttgcttgtgcttcgttttgcaaaccgcttatttttgcctctctggaaccgtgataacatagctaacgtacagatcgtatttaaggaagactttggaactgaaggacgtggaggatattttgatcaatatggtatcattcgtgatatcattcagaaccacttgttgcaggtcttctgtttggtggctatggaaaagcctgtctctcttaaacccgagcacattagagatgaaaaagtcaaggttctgcaatcggtggagcctataaagcatgaagaggtagtcatcggacaatatgatggctacaaggatgaccctactgtgccagatgactccaacacccctacttttgcatctgttgtactgagggtacacaacgaaagatgggagggggttccattcatcctcaaggctggcaaagcactaaattcgaggaaagcagagatacgtgtacagttcaaggatgctcctggtgacatttttagatgcaagaaacaaggcaggaatgagtttgtcatacgcctgcagccatcagaagccatgtacatgaaactaacggtcaaaaaacccggactggaaatggcaaccgaacagagcgagctggatctatcctatgggatgcggtacaatgacgtaaaaatcccagaagcatacgagcgtctcatcttggacacgataagaggagaccagcagcacttcgttcgccgagatgagctgagggccgcatgggaaatcttcactcctttgcttcacgacatcgatggtggcaagctcaggtccgttccgtacaagccgggaacccgaggaccgcaggaagccgacgagttgagcaggaggatggggtatgtgcagacccatgggtatgtatgggttccgccgaccctttctaaggtttagctgtttgattatcagctgccgtgtaaccacagaatgacagaacgcggggaagatccctttgtaatacgtgggtcgtgtaataagagaaacttctgcttgttgtgagagtgaccctttacggtattggaataaaaaaaagaatgtgatgttatgatctcaaaaaaaaaaaaaaaaaaaaaaagtccgcccgcagtttctgaaggcacaccaaaacgatgagacctgtagacagtactctagtctctagtccacgaagtcctcgtacttgtgttggctggccctcgactagcgtgttgtagcacactagcgccacagtaatcgagagtgctctcccaggtcgaggtggntgtaggtgttttggcggagcagccggggcgttagaatctgaggaggagaagatggtggtgctggtggtggccacgacgtcggacccggcgtccattgggcccgccgccgccttcctcgccatgcccggatggtcccccggcccgcccatcgccgaggcgatggaagagntttactaatggggaatgnttcgatta

SEQ ID NO: 12287 - DNA, 2274 bp, Zea mays
cattgggacctcgagccggcgggagtgtcccctcgggcactcccccatcactagaacccccccgcccggggcgaagtcaaatctcacctcaccagtggctgccttctccgctccgcgctgcgcctcccccaaagcttcagtggctgctgcgacccttctgttctccgctcttggtcttgggtgatcgccggcggtacttgtagcgggcctttgtaggtatttatctgagggaagaagaaactatacaattcatcatgtcaggagggtcgtctgaatcttccccgttatctggacaaaatagccttagttctctatcaatttccaaggacaatgaactatcttcagagtctggctgcttgtccattgttgtactaggcgcttctggagaccttgctaagaagaaaactttcccagcgctctttcaccttttccagcagggatttctgcaatctggagaagtccatatatttgggtacgcaagatcaaatctttctgatgatggattaagagaacgcattcgtggatacctcaagggagcttcagatgaacatctttctcagtttttgcagttagtaaaatatgttagtggctcctatgatagggtggaaggatttgagttattaaataaggcaatctctgagtatgaaacttcaaaaaacaatgactcgggaagctaccgcagattattttatttggcattgcctccatcagtctacccatcagtatgcaaaatgataagatcatattgcatgagtccatcttcacacaccggttggacaagggttattgttgaaaagccctttggaaaggatttgaacactgcagaggaactgagtgctgaacttgggcagctgtttcaagaagaacaactctatagaattgaccactatttaggaaaagagcttgtccaaaacttgcttgtgcttcgttttgcaaaccgcttatttttgcctctctggaaccgtgataacatagctaacgtacagatcgtatttaaggaggactttggaactgaaggacgtggaggatattttgatcaatatggtatcattcgtgatatcattcagaaccacttgttgcaggtaaatatatcttatgaacttcttttgtcgttggtttatgagtgattttccaaacacgtactttttgacttgaatctagactctagaggagtacttgtttagggtggggattgggtacagtccaatataatgcatgattatttggtaatatgattaatactttgtttcatcaccaatctagtgctaatcttctgagcagacacagcagatacctgtaattacattcctcatatatatagcaatgttttgttctggagagagctctggtatgactgtcgctctgattttgcaggtcttctgtttggtggctatggaaaagcctgtctctcttaaacccgagcacattagagatgaaaaagtcaaggttctgcaatcggtggagcctataaagcatgaagaggtagtcatcggacaatatgatggctacaaggatgaccctactgtgccagatgactccaacacccctacttttgcatctgttgtactgagggtacacaacgaaagatgggagggggttccattcatcctcaaggctggcaaagcactaaattcgaggagagcagagatacgtgtacagttcaaggatgctcctggtgacatttttagatgcaagaaacaaggcaggaatgagtttgtcatacgcctgcagccatcagaagccatgtacatgaaactaacggtcaaaaaacccggactggaaatggcaaccgaacaaagcgaactggatctatcgtatgggatgcggtacaatggcgtcaaaatcccagaagcatacgagcgtctcatcttggatacgataagaggagaccagcagcacttcgttcgccgagatgagctgagggccgcatgggaaatcttcactcctttgcttcacgacatcgatggtggcaagctcaggtccgttccgtacaagccgggaacccgaggaccgcaggaagccgacgagttgagcaggaggatggggtatgtgcagacccatgggtatgtatgggttccgccgaccctttctaaggtttagctgtttgattatcagctgccgtgtaaccgcagaatgacagaaagcggggaagatccctttgtaatacgtgggtcgtgtaataagagaaacttctgcttgttgtgagagtgaccctttacggtattggaataaaaaaagaatgtgatgttattatctcaaaaaaaaaaaaaaaaa

SEQ ID NO: 12288 - DNA, 759 bp, Zea mays
ttgggtacctcgaggccggccggggcaaacaaatacgcctctgctttagcagtagtttccaaccagaggcaggcacctcgagaggcgggtgaacatggagggcgataagaaggcgggcgccgtggcagagaagaaggcggcggcggcggatcagagcaaggaggtggccgctggtgatgtgagcctgaaggagctgtccaggaggctcaacgacttcgccaaggagagggactgggagcagtaccatagcccccggaacctgctgctcgccatgatcgctgaggtcggggagctgtcagagctgttcatgtggaaaggggaggtgcgcaagggcctcgccgactgggacgaggcggagaaggagcacctcggcgaggagctctccgacgtgctgctctacctggtccgcctctccgacatgtgcggcgtcgacctcggcgacgccgccctcaggaagatcgtcaagaacgccgtcaagtacccggcgccgtccaaggaacaaggcgcctgatgatgacgaacaataccacctgtgatgccttctttgatgctttgggatagctggtgcctggtagagaaccaggcagcgagatatatgaactgatgcttggaccctttttccccctttttttgcggtgcatgctcgaaggttaataattgatacaattattgctcggctgatatgatagcttttttttgccttttgaaatggagtcgatcggattaaagaataataaaaaaaaaaaaaaaaaagcggcc

SEQ ID NO: 12289 - DNA, 1164 bp, Zea mays
ggctggccgggaagaggaaccctagtccctagcaacgcctacagcgtcacggaacaccggcgaaccaaacctcggagaaaccctagcaaggccgcttgcccctctcaggcgcgacacagcatcggcgactagcgatgacaggatatcgcagccgcagtccgagccgaagctacagcccacggaggcggtacagccggagccctcttaggcgcaagcgctacgacgacccacgcgaccgctaccgctgggccggggccggcggaggcggggaccgacgtggttacggtcggccgttggcgcagtccggtctcctcatccgtaatatctccctcacagccaggccagaagatattcgtgctacatttgagcaattcggccctatcaaggatgtttacctgccaaggaatttccacacgagggaacttcgtggttttggatttgtcaaattccgctaccctgaggatgctgcagttgccaagcgtgagatgcatcatcaagtcattggtgggcgagaaatttcaatagtttatgctgaggagaatcgaaaaacgccacaagaaatgcgcatgagaacaagaactagtggtaggtacatggatgaaagatacacaagactgtcaagatctccaaggtctcgttcccactcttattcaccaccgccttctccagttaggcgtgacttcaggggcagggagcgcccggatagttattcccctcagtactcgcactctccacgccctcgggacagcaggcaccacaggtcagatggtcgctctccaactccaagcctagatgaccacaaacctaaggcgacaccagtcaatggtggacatggtccagcagttgcatccagatagtatgatgccattatggatgccttgaattgtgttcggaggctggagactgcagactatcttttcaccaatcttctctaagagatgagtagggttgtagtaaacagatacttggtagttgtattacaggtgatggtttcggttatgaggtgcgctgttgcttttgtgacgctgctttaatgctttcccaaccgagggtagtagggtaccgtcgtggaattttgcgtgtttgttttttggctacaatattactaatactagtaacttgctcgcttcgagcgcgagtctttatccaaaaaaaaaaaaaaaa

SEQ ID NO: 12290 - DNA, 1836 bp, Zea mays
gccttcgtccattcctatccttcgcgcgctcgcggctcgcccgtccagacgacacgatcacacgacacgatgcatgcgctactctgctgctgccacggacgggcagcaagtaggcaagcacgtatcggccgggccctatatataattcgcgttgcaccgccaggccggccgggatcgacgacgacaaacagcaagagcaagcaagagaggacgacatggcggcgccacggagcctggcggaccgcgcgctgcgcggcgtggcggacctgataaagctgctcccgagcggcacggtgttcctgttccagttcctgagcccgctggcgagcaacaacgggcactgcgccacgctgaacaaggcgctgagcggggcgctggtggcgctgtgcggcgcctcctgcgccttctcctgcttcaccgacagctacgtgggcgcggacgggcgcgtgtactacggcgtggtgacgcggcggggcctgcgcaccttcacgcccgacccggacgccgccgcccgggacctgtcggcgtaccgcctccgcgccggcgacttcgcgcacgccgcgctctcgctgctcgtcttcgccaccctcgcgctcctcgacgccgacaccgtcgcctgcctctacccggcgctggagctcgccgagcccaccatgatggccgtgctcccgcccgtcgtcggcgccgtcgcgggctacgtcttcatggtgttccccaacaaccggcacggcgtcgggtaccagcccacgcccgccaccgaggacttccagcacaaatactagccagccggttcgtcgtcgttgcagagtactgtactgcgcgtgtgtctttgattgtctgtctgtctgattcattcatttgcttggtggtgtgggggtgccgtctttgtacgtcgtctctgcttgttcattcgggctttcattaacttacggaatcaggtctgtaataattaatctgtgtatattcttcccgactgcaatgcatgcatcctcaaacacacaattcctatctgaaactgcggcggacgactcctttgatagtcaccctcaccacacacatctcctccctatacttacacttacaattacaaaaaagaaaaaaaaagaagaggaaagtgaaatgttgtttccaatgcaagccggaatgacctcaatgccttggcgtggtgcgtggtccgctcatgtgtcgctgatcaatcgcatcagtcctagtcgtcttccttcctgatgatcacccagacggcgtagatgacgcccggcaggtagccgaagaagcacaggaggaggcagatccagaactctatctgcacatatacagcaaggggcatgcattcatcagtaccatcgacggcgtgaatcccgccctctccggcgtgtcgttcttcctacgcgcgacggcggatggacggacggacgaacgtaacattaacatatatatgaccttgaggccgtgcttgaggaagacgccgagcggcgggaggatgatggcgaggacgaggcggacgagcgtcaccatgttgtctgccatctctgcctgctactggtgctatggatcggaggaggaggtcgccgcagtcggcgccggagatccttgtgctgggcgtggcgtgtgtgtggaggaaccaagggtcgaggagggctgaggcacgcacggacaaagctgggacccccattccgattccggggaccgcctttggtgtttttgtgttgccttttcgtctgtgttttgatcggatggggctgagcgaggcggccagccacgtaacacgtatatatacaagtcattatgcacggacaaaattagtattatactcccttccgtttctttttattagtc

SEQ ID NO: 12291 - DNA, 970 bp, Zea mays
gccggccgggccgggatgcgctactctgctgctgccacggacgggcagcaagtaggcaagcacgtatcggccgggccctatatatcattgggtacctcgaggccggccgggatcgacgacgacaaacagcaagagcaagcaagcaagcaagagaggacgacatggcggcgccacggagcctggcggaccgcgcgctgcgcggcgtggcggacctgatcaagctgctcccgagcggcacggtgttcctgttccagttcctgagcccgctggcgaccaacaacgggcactgcgccacgctgaacaaggcgctgagcggggcgctggtggcgctgtgcggcgcctcctgcgccttctcctgcttcaccgacagctacgtgggcgcggacgggcgcgtgtactacggcgtggtgacgcggcggggcctgcgcaccttcacgcccgacccggacgccgccgcccgggacctgtcggcgtaccgcctccgcgccggcgacttcgcgcacgccgcgctctcgctgctcgtcttcgccaccctcgcgctcctcgacgccgacaccgtcgcctgcctctacccggcgctggagctcgccgagcccaccatgatggccgtgctcccgcccgtggtcggcgccgtcgcgggctacgtcttcatggtgttccccaacaaccgccacggcgtcgggtaccagcccacgcccgccaccgaggacttccagcacaaatactagccagccggttcttcgtcgttgcagagtactgtactgcgcgtgtgcctttgattgtctgattcattcatttgcttggtggtgtggggtgcctgccgtcggtctttgtacgtcgtctctgcttgttcatttgggctttcattaacttacggaatcaggtctgtaataattaatctgtatattcttcccgactgcaatgcatgcatcctcaaacaaaaaaaaaaaaaaaaaaaaaaaggccccta

SEQ ID NO: 12292 - DNA, 1205 bp, Zea mays
gcccccccgggctgcccgccacctttccttgcggcagtagccccgaaaccccgttcgttgcgtagccaaatcgagatctccgtctcccccgtgacgaatcccacgcccacctctccccgacccggctggccgcagcaacagcgcatcgcaccgggaggcgggagccgaagaaccaaacaggagatggcgtcggcgctgtcctccctgcgctacggcgacagcctctcggtggtgggcatctccgccgcgacggccgtgctctgcgaggccatctcctggcttctcatctaccgcaccgccacctacgactccctccgcgcctccatcgaacgccactcacgcaagctggacgccatgaagtccggctccaactcctccggcgctgcctcctcctccgcgcaggccgcgtcgtcgcgggctaagaagatggaccgcgtcgagaccagcctcaaggacgccgcgcgggagctctcgcttgccaagctcaagtcgggcgccgtcgtcgccgccgtgctcttcgtcgtcttcggcctgctcaactccctcttcgagggccgcaccgtcgccaagctgcccttcgcgcccatcccgctcgtccagcggatgagccaccgcggactgcccgggaacgatcccaccgactgctccatggtcttcctctacttcctctgctccatgagcatccgaaccaacctccagaaactgctcggcttcgccccgccgcgcgcggttgctgcggccggcgggggtctcttccccatgcccgatccgaaagttaactgaggagaaaaatggaagacttattactgttgatgacaaatccttagcactagctcggactctgatcttctggggacttgagaagtgtctctgatgcatggaaatatgcacactttgaatggttatatctagattaaatctcggtatttcagcagtttaaatgaagggcaggtctggcgtagtggtgagagctgtcctcactcatcaggtctctccgcatttacggggaaagacttgcctcgatttatctcttctctagacccaactcggagtctccgacactaagtctgctctttatttcatcagtttatatgacttctctgttcgatttgttagagcaggaatcacatctacagttctgcaaaattttcatcaagggatatggagctataatctaatttttactgtcaaaaaaaaaaaaaaaa

SEQ ID NO: 12293 - DNA, 1114 bp, Zea mays
ccgcccgccgtccccctccccgtctatcccagcacgagcaggccagaaaagcccagccaagcggagccaacccggcccgcggcagtcaaccccccaactccgttcattgcggcaggccggcagccaaatcgagatctcgcccgtgctgaatcccaccactctcgccgacccggccgcagcaagcgcagcgcatcgacaggagccgaagaaccgaagaggagatggcgtcggcgctgtcctccctgcgctacggcgacagcctctcggtggtgggcatctccgccgcgacggccgtgctctgcgaggccatgtcctggctcctcatctaccgcaccgccacctacaactccctccgcgcctccatcgagcgccactcccgcaagctagacgccatgaagtccggctccacctccgcctcctccggcaccgccgcctcctccgcgcagcccgcatcgtcgcgggctaagaagatggaccgcgtcgagaccagcctcaaggacgctgcgcgggagctctcgctcgccaagctcaagtcgggcgccgtcgtcgctgtcatgctcttcgtcgtcttcggcctgctcaactccctcttcgagggccgcaccgtcgccaagctgcccttcgcgcccatcccgctcgtccagcggatgagccaccgcggactgcccgggaacgatcccaccgactgctccatggttttcctctacttcctctgctccatgagcatccgaaccaacctgcagaaactgcttggcttcgcgccgccacgcgcggctgctgcagccggcggtggcctcttccccatgcccgatccgaaagttaattgaggctgatttccaagacgagtgaatccgaaccaaagatagcaatagtcgcccgggaaagactctgtgcgactgcaccgatatccgtacccaattcattttccacagctcaccggtttgttgttgcgcaccggtgattgcaaacctgaaggttggcttatttattgcattgactgaaacaacgaacatgaattacctgctgggaggcagagaaatgtgcagcctaatttttttcggcctctgcgattctctaaataaataatagaattgatgacgtcgataaatcagaa

SEQ ID NO: 12294 - DNA, 721 bp, Zea mays
cctcgaggccggaaaatcacaacccgcactcgcccaaaaccctactgctcccgctccgctcctgcttggtcgagatcacttcgccgccgccgctttcgagatctccgggtggagcaagcgagcaaaggcagcagccatgtcgctccgcgtgctgaaccctaacgccgaggtgctcaacaagtcggcagcgctgcacatgaacatcaacgccgccaagggcctccaggacgtgctcaagaccaacctcggccccaagggcaccatcaagatgcttgtgggtggagctggtgacctgaagctgacgaaggatgggaacaccctcttgaaggaaatgcaaattcagaacccaactgcaatcatgattgcgaggacggctgtggcacaggatgacacaagtggtgatggcacaacctccactgtgctatttatcggggagctaatgaagcagtctgagcggtgcatcgatgaaggaactcatccaagattcttggttgatggttttgatgttgctaagagagcgtgtcttgattttctcgataagttcaagacgccagtcgttactggtgaagaacctgacagagataccttaaaaatggtagcaagaacaacacttaggacaaagttgtatggaagggttggctgatcagttgactgatattgttgtgaatgcagttctgtgcattcgcaaaccagatgaaccaattgatctatttatggggga

SEQ ID NO: 12295 - DNA, 830 bp, Zea mays
aactagcttgcgtcccgggcgcggtccctgcattgcgtcatcgtcgtccatcgttggcgagatggcggcggtggccatgagcccagatctggcgctgttcctgacggcgctgctgctgctagccctggcaggagcaaggccaggagcagcagcaacaaccgacagtagcaccatctgcgacacagccgagtgcggcaagggcacctgcagcgaggtgccggggatcctccccgtggtcatggcttcctacaagtgcacctgcgacccgggctggtcccagccgaagttgctcaacctaacggtcctgcccttcatgccctgcatcatacccgactgcaccttcgactcctcgtgctacaacttcagcctcttctcattgagaggaatacccctcacggacccctgcgtgatcatcgactgcggcctgggcgagtgcaggaagggccagggcttcagctacacctgtgagtgccagccgggatacgtcaacttcctcgaccaaacctaccttccctgcgtcaagaactgttccttcggctcggactgctcgaagcaggggatcgccccgccgccggcgccgccgccttccacagcgtctccacccgcacacggttctgtttcgtcgtggcgcctactgcagctgctgctcccgcacgccatcctcctcctcctcctcctctaggtcgtgtagctacatacgacacgcgagggcggccgatcgagcgcactgtacatgtacgattgatcttacgtgtacgtaaatacttgtactgtacgaccgcatccaattattaattcggcgacgttcaaaaaaaaaaggcatatgtgtg

SEQ ID NO: 12296 - DNA, 1561 bp, Zea mays
aagatgctgagccacataactccggtgggtgtgggtccaacgccccccacctgcacgctggccccccgccccgccgcgggatcaaatacgccgcctccgcccgtccactccctcgccgcccccgtctcctctcctctcctctcccccgcatccacggccgcaggccgcagccagccactcgacgatctagtcgtctctctctccccgctctgccgcctcgctgccgcggcttcccgtcggctggaggatgaaggtcacggtcgtgtcccggagcggccgggaggtcgtcaagggcggcatcgacctcaaggactcggccaaggtcgcggacctgcaggaggccatccatgccaggactaagaagtattatccttctaggcagcggctcaccctcccccttcaacctggaaaaggcgggaagccagttgtcctcagtccgaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcctgtctacaaatacttcgggtacgagggggagcgggccatgcaccctgtccagacctacgccatgtactactggtgcttccactacttcaagcggatcatggagacattcttcgtgcaccgcttcagccacgcgacgtcgccgctctcgaacgtcttcaggaactgtgcctactactggaccttcggcgcctacattgcttactactgcaaccacccgctgtacaccccagtgagtgatctgcagatgaagattgggtttggttttggggtcgtctgccaggtcgcgaacttctactgccacatcctgctgcggaacctcaggagcccaagcggcagcggcgggtaccagatcccccgcggtttcttgttcaacatcgtgacctgcgccaattacaccaccgagatctatcagtgggtcggcttcaacatcgccacgcagaccgtggcaggttacgtcttccttgtcgtggcggcaggcatcatgaccaactgggcgctcggcaagcacagccgtctgaagaagctgtttgacggcaaggatgggaggcccaagtaccctcgccggtgggtgattctccctccgttcctgtgaagaggtggtggtggtcggcctattgtgattcgatgtctacagacagttgtactgtactaatcgtgcctgtttagcggttgaacttggattccgttgtccgaaatttctaatccgaaagatggatttcattgtcttcttcttcttagcattatgtcactatctcacgtcgtcctgtctcaatacagtctaaggttcatgtgatgttatccccatttgtccacgcacaagtgaatgcagtcactatttcgatccgacaaaaaaaaaaaaaaaatgtcccccgaccctgcttatctcgtctgaggcttgtgatgcttgacactgttgccgtcagtttattgttgctcggcatacagattcagggtgaacgatgatgactcgcag

SEQ ID NO: 12297 - DNA, 2006 bp, Zea mays
cgccgtggacacggtccacatcaagatgctgagccacataactccggtgggtgtgggtccaacgccccccacctgcacgctggccccccgccccgccgcgggatcaaatacgccgcctccgcccgtccactccctcgccgcccccgtctcctctcctctcctctcctccgcatccacggccgcaggccgcagccagccactcgacgatctagtcgtctctctctccccgctctgccgcctcgctgccgcggcttcccgtcggctggaggatgaaggtcacggtcgtgtcccggagcggccgggaggtcgtcaagggcggcatcgacctcaaggactcggccaaggtcgcggacctgcaggaggccatccatgccaggactaagaagtattatccttctaggcagcggctcaccctcccccttcaacctggaaaaggcgggaagccagttgtcctcagtccgaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcccgtctacaaatacttcgggtacgagggggagcgggccatgcaccctgtccagacctacgccatgtactactggtgcttccactacttcaagcggatcatggagacgttcttcgtgcaccgcttcagccacgcgacgtcgccgctctcgaacgtcttcaggaactgtgcctactactggaccttcggcgcctacattgcttactactgcaaccacccgctgtacaccccagtgagtgatctgcagatgaagattgggtttggttttggggtcgtctgccaggtcgcgaacttctactgccacatcctgctgcggaacctcaggagcccaagcggcagcggcgggtaccagatcccccgcggtttcttgttcaacatcgtgacctgcgccaattacaccaccgagatctatcagtgggtcggcttcaacatcgccacgcagaccgtggcaggttacgtcttccttgtcgtggcggcaggcatcatgaccaactgggcgctcggcaagcacagccgtctgaagaaggcaagtggctttcttccctgcgtacttttttttgatacgaggatatccccatttctattacatgcgtaacagaaatacagagttcattagaagcatactgacatagacagaacaaggagtgggaaaagggactaccataaaggaaagatctggttcagatcaaccaacaaactagctaacgcaaccagaacctaacagcccaaattatcaccaatcagccaaaagcatcacagaagtttttgtccacgcaggaacatagtcagcataacgacattcagaacacataacaagcagctcctgtttgctcgaacctgcccatgacacaattagagcaccagctcgacaaacagtttcaggaggggggcttgatcacaactctgtcaaaacacatcttatttctagctttccacaaggcccagcatatagcagctactaccccgatgataatacgtacacatcattagcctttggcaaatttccctgcgtactgaccactgccgtcggcgtcgggaatatttcgtagctcatcttcttgacttcttctgcagctgtttgacggcaaggatgggaggcccaagtaccctcgccggtgggtgattctccctccgttcctgtgaagaggtggtggtggtcggcctattgtgattcgatgtctacagacagttgtactgtactaatcgtgcctgtttagcggttgaacttggattccgttgtccgaaatttctaatccgaaagatggatttcattgtcttcttcttcttagcattatgtcactatctcacgtcgtcctgtctcaatacagtctaaggttcatgtgatgttatccccatttgtccacgcacaagtgaatgcagtcactatttcgatccgccc

SEQ ID NO: 12298 - DNA, 2680 bp, Zea mays
cgacctgcagatgtgaagtagagatacttcgagagccaatttacaagcctaatgaccatgatatgatatgggaataataaatgcctaccttccatctggttgttggagccttttttttgaaagagaatagagaagtgtcttgcagtcaatatttggtagatcgtagccaataatcttgattcttgaggatagcaagggcagaataagtgctttgcaattgcaagatgactaacgttgaggcaaaaggatcctgaaacagagcatatcccaaactgcctagacagaggtgatcaaaatttagactatgagatctgcattaaaggggcacttgggtgcaccgtcaacatcacatgggttttgggctccctttttttttcctaacgacagaaatgtactagtgcctacatcttatatggaacaaaaccacagtgaacataatcgtgacacatactgacatacagtacagtatatgccaagaagagttacacccccaagtcggtcgcctctaccccttaactacactaattaatttaaccggtcagatgataacatcactcgtagaaacattgagaagtccgctaccgctatccaattcagccatctctgtaattgcaacctcctgcatttatcactatgaaatgtgttattcgctttggaattaaagataactatttggactgctacaacttttgtaatttatagagataaaaacactataacagcaatagaatccattacgacttaaatccaagcgaaccagtgatcttcttgacggttttagttgccatgagctttggatgctcctcttcttcgttcttgtctcgtgtactccaatgccaaccagcctatcatctaaaggctactgctagcattaagtacaaatcgctacttctccaaagaaaaatgtgtgttttaggataagaatgttactacaattctacctgatgctggtgccgctgctgtggtcgacgaagcggcacggcaagagcgtgtccgtccgtgggccctgccccgggatgatcgtcgggtcagccgccgagctgaacggaggtcgctcaccgttggggggccgttgggccgcccgcgctactccccaaccaactgcggccagatcacgctgcgcagcgcaggccctctttactcagctgtccatgctgctgctgctcccacgcggccgcgccgtggacacggtccacatcaagatgctgagccacataactccggtggggtgtgggtccaacgccccccacctgcacgctgccctcccccgccccgccgcgggatcaaatacgccgcctccgcccgtccactccctcgccgcccccgtctcctctcctctcctctcctctcccccgcatccacggccgcaggcagcagccagccactcgacgatctagtcgtctctctctccccgctctgccgcctcgctgccgcggcttcccgtcggctggaggatgaaggtcacggtcgtgtcccggagcggccgggaggtcgtcaagggcggcatcgacctcaaggactcggccaaggtcgcggacctgcaggaggccatccatgccaggactaagaagtattatccttctaggcagcggctcaccctcccccttcaacctggaaaaggcgggaagccagttgtcctcagtccaaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcccgtctacaagtacttcgggcacgagggggagcgggccatgcaccctgtccagacctacgccatgtactactggtgcttccactacttcaagcggatcatggagacgttcttcgtgcaccgcttcagccacgcgacgtcgccgctctcgaacgtcttcaggaactgtgcctactactggaccttcggcgcttacattgcttactactgcaaccacccgctgtacaccccagtgagtgatctgcagatgaagattgggtttggttttggggtcgtctgccaggtcgcgaacttctactgccacatcctgctgcggaacctcaggagcccaagcggcagcggcgggtaccagatcccccgcggtttcttgttcaacatcgtgacctgcgccaattacaccaccgagatctaccagtgggtcggcttcaacatcgccacacagaccgtggcaggttacgtcttccttgtcgtggcggcgggcatcatgaccaactgggcgctcggcaagcacagccgtctgaagaagctgtttgacggcaaggatgggaggcccaagtaccctcgccggtgggtgattctccctccgttcctgtgaagaggcggtggtggtggctcactgttggtggtcggcccattgtgattcgatgtctacagacagttgtactgtactaatcgtgcctgtttagcggttgaacttggattccgttgtccgaagtttctaatccgaaagatggatttcattttcttcttcttcttcttagcattatgtcactgtctcacgtcgtcctgtctcaatacagtctaaggttcatgtgatgttatccccatttgtccacgcagaagtgaagtgaatgcagtcactatttcgattcgacacttaaaaaaaaa

SEQ ID NO: 12299 - DNA, 2619 bp, Zea mays
ccgcccggtatcatccgtttggccgcttcatttctctccccgcttcggtgctgcctgctggccgaccgccgaagcgacaaccgaggccaccgatcagttgactccctgtctcctcgtcgcagggtctcctcacacgagcacacgaacatcgagccctccccgcaggagcagaagacgcttcgcttgttttctaaaacattgctggggttgcagcatgtgtacttgggcatagagggattgttacaccgagctagtgctttggtctctgctgtagcagagcgcaatgggcatccgggcttgttcggtttgctggttgttctatgtgctggttcttgtctgttccttgtgtcaggtactttatgttggatcagtggcggctcaaactgctcagttgactgtggatgcttcacctcagaatgctcagataatccctggcaatatgtttggcatcttctttgaggaaatcaaccatgctggtgctggtggattgtgggcagagcttgtaagcaacagaggttttgaagctggtggttctaatactccttcaaacattgacccatggttgatcattggggatgaatcaaatattattgtggcaacagatcggtcatcatgttttgctagtaacccaattgcacttcgaatggaagtactttgtggagctagtgaaactaatgcttgcccatcaggaggagttggaatctacaatcctggttactggggcatgaacattgaaagaacaaaggtctatagagttaccatatacatcaggtcatcagaatcggtggagctaatggtttctttaacaagttcagatggtcttcaaaatctagcctctcatacaatcatgggagacaaagaagatttcgttgagtggacgaaggttgaatttgatttgcaatcaaattatataaatactaattcaagacttcagcttacaaccaccaaaagtggcataatttggtttgatcaagtatcacttatgccatcagatacttatatggggcatggtttccgtaaagatcttgcctctatgctggcaaatctgaagcctcgatttctaaaatttccagggggcaactatgtaatgggaaattaccttataaatgcattccgctggagtgaaactgttggaccatgggaagagagacctggccacttcaatgatgcttgggcctattggactgatgatggacttgggttttttgaatttcttcaactagcagaagaccttggcgcttgccccgtttgggtggtaaatgatggggccagcatctatgaaggagttccatcagcaacaatagctgcatttgtaaaggatgttgttaatggtattgagtttgccaggggagaccccgagactgcatggggttcagttcgtgcagcaatggggcatccagagccctttcagctttattacgtttcaataggaaatcaagaatgttcaaagtactattataaagataactatgtgaagttctactctgcaataaaagcatcctatccagacatcaaaatcatatcaagctgtgacagatctgctatttcatcagacaacccagctgatttgtatgatgtccatgtctatacttcatcaggtgatatgttttccaaatctagaatgtttgataatacagcccgtaccggacccaaggcaattgttagtgaatatgctgtaactggaaatgatgctggccgaggaacactaatagctgctttagctgaagctgcatttctcattggattagaaaggaacagcgacgtggttgagatggcaagttgtgctccactctttgtaaacgacaatgaccaaaggtggaacccagatgctatagtctttaactcatggcagcactatggatgtccaaattactggatgctgcactttttcaaagattcaagcagcgccacacttcatccgtccactattcaactaccgaactacgaccaactggtcacatctgctatcacttggaataacccacatgatgggaacacttacatgaaaataaaggttgtaaattttggaagcaaagctgttagtctgaatatatctgtaactgggttggaaactgatattcagacatttggatccataaagacggttctcacgtcgggttggctgcgggatgagaactccttccaacagcccgacaaggtggtgccggcggcaagtccaataaccaacgcgggcaagcaaatgggtgttatattgaactcgtactccctgacctcatttgatctcctcttggactcggagtctcaggttcgagcctccatccaagcttatgattagtgtgagatgtgtcgtgtgcgtgcccacaatactcaataccgagatacgggtccccccaaggctccccacaaggctttcaatagaaaatacgatatttgtgaattattgtgaagtacaggcgtacagctggctatgtgtatgagattcaacaaatggtttctacgaccctaataaaggtataaaagcacctttcctcggatatcacgcatccgttgtagtctgcactcttgacattttctcttttttagagcatgtacagtgtacctaactaccgcaaactttttgtcctggtgcactacagcgaacgccccatatataagaat

SEQ ID NO: 12300 - DNA, 1607 bp, Zea mays
tgtgcaaagacgccagggtgccctaaatcccgtcccccaattccattctcggaagagaccatttccttcctcctgatctctcacggagttcctctccatggcgacgccccgctctccgagcccccgcgccgaagcgcccctcgattccgcgccgctgctgggcggtgcctccggcggcgggagccgtcgccgaggcggagcgctccgccgaccctcgctccgcggtgcggcgcggctgctgcgccgcggcgggcggcgagccatgcgggagccctcggtgctggtgcgggaggcagccgcagagcacctggaggaacggcaggcggactgggcctactcccgccccgtcgtggcgctcgacctgctctggaacctcgccttcatcaccgtcgctgcggtcgtgctcgtgctcagccgcgacgaggactcgcccatgccgctccggacctgggtcgccggctacgccctgcagtgcgtcatacacatggtgtgcgtcgcaatcgagtaccggatgcgccatggccagcgcggcggcgccggcgcagcgcccgctgacgaggaaaggggcagcgacggatcgtcgtcgtctagtgatgaggatgacagggagctcgatcgccatggtcgccgcaccgattacgccagtattgcaaaacacttggagtctgctaatacaatgttctccttcatatggtggataatcggattttattggatatctgctgggggtgaagaggttatccgggacgcacctcagctttactggctctgcatagtcttcctggcatttgatgtgttttttgttgtattctgtgttgctctggcttgtatcattggtattgctgtctgttgttgccttccttgtatcatagcaattctctatgcagtatctgatcaggaaggagcatctgaagatgacattcgtcaaatcccaagatacaaatttcggcggaccgatgagcctgaaaagcaagatgttgaccccatgggtccttttggtggaataatgacagagtgtggcaccaatcaacctattgagaaagtgcttgcagctgaagatgcagagtgttgtatttgcctatctgcttatgatgatggtgcagagttgcgggaactcccttgtgggcaccatttccactgcacctgcatcgataagtggcttcacatcaatgcaacatgccccctgtgcaagtacaacattcggaaaagcaacagtagcagtggaagtgaagaagtatgaatgcaaccgcttgacaatgccaatctgtttaaacttcgtgcctgtgtcgttgctaatgtaactccagggcttgagcagtgtaaatttttgtactaaaagaagtgctgatagagtcaattatgtattaaagttactcaaagtgctgtctatatgtcgtataagttaataaatagttgggtgtgcatctgtatttactgtcaggaatgattagttgcactgtaacttgtattctttcgagtgattcgggcgttttcctgctgggctatgatggcagtttgtcttccatggtttctactgacaaggcggcctcgactggccattatttacagcagcgacatagctgatgaaagaagccaattggtgatgg

SEQ ID NO: 12301 - DNA, 1653 bp, Zea mays
aaattcacgtaatctgttgcaatgatatatttttttagttttattgaaaaatagggaaaggcagaaaaaacgagaaaagattcgagtttctaaacccgtcacggcgtcttgttcagaggaattccattcctacgaagaaagtatttccttcctcctgaatcctgatctctcacggagttcccctgtatggcgacgcctcgctcaccgagccccagcgccgccgcgcgtctcgattctgcgccgctgctgggcggcgcctccggcggcgggtcccgtcgccgagatggagcgcttcgccggccctccctccgcggcgcggcgcggctgctgcgtcgcggcgggcggcgggccatgcgggagccctcggtgctggtgcgggaggccgccgcagagcacctcgaggagcggcaggctgactgggcctactcccgccccgtcgtggcgctcgacctgctgtggaacctcgctttcatcaccgtcgctgcggtcgtgctcgtgctcagccgcgacgaggactcgcccatgccgctccggacctgggtcgccggctacgcccttcagtgcgtcgtacacatgatttgcgtcgcaatcgagtacaggatgcgccacggccagcgcggcggcgccggcgctggcgcagcgcccgcagacgtggaaaggggcagcgacgcatcgtcctcatccagtgacgaggatgacagggagctcgatctccatggtcgccgcactgattacgccagtattgcgaagccccgggtcccccctcgcgcccggttctccttcatatggtggataattggattttattggatatctgctgggggtgaggaggttattcgggatgcacctcaactttactggctttgcatagtctttctggcatttgatgtgttttttgttgtattctgcgttgctctggcttgtattattggtattgctgtctgttgttgccttccttgtatcatagcaattctctatgcagtatctgatcaggaaggagcatctgaagatgacattcgtcaaatcccaagatacaaatttcggcggacggatgagcctgagaagcaagatgttgaccccatgggtccttttggtggaataatgatagagtgtggcaccaatcaacctattgagaaagtgcttgcagctgaagatgcagagtgttgtatttgcctatcggcttacgatgacagtgcagagttgcgcgaactcccctgtgggcaccatttccactgcacctgtatcgataagtggcttcacatcaatgcaacatgccccctgtgcaagtacaacattcggaaaagcagcagtagcagtggaagtgaagaagtatgaatgcagtccgcttgacaatgccaatctgtttcaacttctgttccgttgctaatgtaactccaggccttgatgagtgtaaatttttgtatccaaaaaaatgtgctgatagagtcagttatttatcaaagttactcaaagtgctgtcaatatgtcatataagttaataaacagttgggtatgcttctgtatttactgtcaggaatatattattagttgcattgtaacttgtgtccttttgaatgatccgggtgttttcctgcttggttaatgatgacaaaatgtcttgcatggtttcttatgacaaaaaaaaaaaaaaaa

SEQ ID NO: 12302 - DNA, 1624 bp, Zea mays
cattgggtacctcgaggccggccgggaccagttccgcagaataaacgagcgtgcaagcgctgctgggctggtgtcagtcacctgagcaaggaagagagatggccacgctgcctcgcgagggcgccgcggcggcggactccgaccagcttttggtagaagcacatggctctacacgaacgctgattttgaataggccaaagcagctcaatgcactctcctctgaaatgattaaaggtctcctatggtatttcacagcttttgagaaagatgatggagtcagattgttgattatgaaggggaatagaagagtattttgctctggaggtgatattgctcaatgtgcccggtgtttatataatggaaactggaaatgggtcgatgatttcttccaaaatgaatatttgctaaattacatcattgcgacttacataaaacctcaggtttccattcttagtggaattgtcatgggtggaggagctggtgtttcaatacatggaagatttcgagttgccactgataacacgatttttgcaatgccagaaacagctctaggcctctttccagatgtaggggcctcttattttctatctcggctaccagggttctatggagaatatgttggtctaactggtgccagattggatggtgcggaaatgcttgcctgtggcctggcaactcattttgtcccgtcaaagaggttgccattgcttgaggaatcgcttaaaaagctggacacgtccagtacttttgctgtgtcgggtattatcgaccagttttcacagaggccattagtgaaagatagcagctctttaaataggatggaaaccatcaacaaatgcttctccaaaaggacagttgaagaaatcatagatgctcttgaacaagaaatctcaaatgtttcagacaaatgggttgctgcaacaatcaagtccctgaaaaaggcttcccccaccagcctaaaaatttctctgagatcgataagagaagggagaacacaaactcttggggagtgcctgcgtcgggaatatagagtggtttgccatgtcctgcgtggcaccttcagccgagacttgtctgagggatttagggctgtgctactagaaaaagacaacaagccagagtggattcctccaaggttggaacaagttcctgacgaggcagttgagcaatatttcttgagaattgatgatccccagtgggaagatctgaacctgcctgcgagacttccccaccgaagaaatattgagtccaagatttgattgaggtcttggacgaagagtgagcctcggtcaggataactcgtcaactcatgtttgaagttgtgtgcggaatgttgacgacgattgataaataataaacgcggactgaatatatgtcttataagttcacgtttatcgctaaataatttttgttgcttttgtgtgaagttgtacctgttagccttgttcggttacagggatgaaattctaccatagatataattcgggtctagattggatgaatcgatacctcacccaatcatatggtaagattaaatccatcatttaatacatacacctcccaaaactagttattcttttcatttatggattccaaaaaaagcaaaacaaaaaaatcattaatt

SEQ ID NO: 12303 - DNA, 2296 bp, Zea mays
gccggccggtccggggccgaaaagggaccccgcgcgtcgacatggcgcctggcggaaacacatgagccgcatggcagtcagcgccccgacttttccgccttccttgcaccaccccgtcatatctcggcaacaagttctcggcgccaaccggccgatccatcctcgtcgtaagtctgcgctttcatcccttattgttccaggaacaaacaaaatctacacgtttccaagacaccaggacggagacatcgaggaggcggcggagacgccgccgcgtccttccgcttctgagccgtataacaacaaacccctcggccccgtcccctctgtccatcgatcaccttgaccgtgcctgtgccgcaggccgcagccaggcatctccggcgaatctggtttgaggcgcggagagaggatatttgcatgcgggactgagcaatcaaaacaatggcagtagcgcccatggactgcgctgctggttcgattagtcccggccgggaggttttgggccgtttcggagtacccaacagcagtagattgcgatgggtgggatatgacaggaaaccaaggacagatcagttgattgctagagccgtatccgtggatcggacacagctagacttttcgaatccggactggaagaagcagtttcaagaggatttcgataagcgcttcagcttgccacacttgacagatgtaattgatgtggaaccgaggccaactactttttctctcaagagcagagcccctcttgagaacgcgaatggtaccatgcaaggatcatggaacggctatgtcaatgatgatgacagagcacttttgaaggttattaagtttgcctcaccaacttctgctggagctgactgcattgaccctgattgtagctgggttgaacaatgggtgcaccgtgctggtccacgcaaacaaatatattttgagcctcaatatgtgaaggctgggattgtgtcgtgtggtgggctctgcccaggtctcaatgatgtcattcggcagattgtgcttacacttgaaaaatatggggtgaaaaacattgttgggatacagcatggattccgtggattttttgaggatcacttatcagaagtgccactttctaggcatgtagtccaaaatatcaatcttgctggtggtagcttcttaggagtctctcgcggtggtgcaaacatttcagacattgttgacagtattcaggctaggaggcttgatatgctatttgtgcttggtggaaatggaacacatgctggagctaatgctatacatgatgagtgccgcaagagaaaactgcaagtatcgattgtatgtgtccccaaaactattgacaatgacatattactgatggacaagacctttggatttgatactgcagtggaagctgcacaaagagctatcaactctgcatacattgaggcacattctgcatttcatggcattggactggtcaagctgatgggaagaagcagcggcttcatcacaatgcatgcctccctgtcaagtggccaagtagatatctgtctgatacctgaggtaccattcactgttgatggaccgaatggagttcttcgacatctcgaacacctgatagagaccaagggatttgctctggtttgcgttgctgaaggagcaggacaggaatactttcaaaagtcaaatgcaactgatgcatcagggaacatggttcttagtgacattggtgtgcaccttcagcagaagatcaagtcccattttaaggacataggagtccattctgatgtcaagtatattgatccaacatacatgctccgcgctgtgcgagccaatgcatccgatgccatcctgtgcaccgtgcttggtcagaatgctgttcatggtgcctttgcgggttttagcggcatcacaaccggggtgtgcaacacacacaatgtgtacttgccgataccggaagtgatcaaatccacgaggtttattgatccaaacagtcggatgtggcaccggtgcctgacctcaaccgggcaaccagacttccattgatcaattattaaggaagcttgtagtagcatccgagtgtaaaggaaggttgtgtatagtatagcgaaagggacctaattgctttgtcaggccttgtctagcagcatatggttctgcaaaacattgttttgcattgtagataggctaagtttgaaataagaggtgagataggcaggatagccttagtatggcaaaatgatcatcttgaaggattcatgagtgaatgatagctaataaaatatttacgcttgatcaacctttgcttgattttcggccccta

SEQ ID NO: 12304 - DNA, 2325 bp, Zea mays
gaccctcgcggcttgcccgggcgcgcgctgtcactctagcgtgtctttctccccttcctgctttccctctccagctctcatacacaaacacacggagctagcagcacggatcgagagaacaatggaggaaacaagcaggatccctgggtacttcaagaacaagggcatcctgatcacgggcgcaacaggcttccttggaaagatcctcgtggagaagatactgagggtccagccggacgtaaagaggatctacctccccgtgcgtgcgccggatgctgcatcagccaagaaacgggtggagactgaggtgatcgggaaggagctgtttgggcttctccgagagacgcacggcaagaggttccactccttcatcgaggagaaggtggtcccgttggccggcgacatcatccacgagaacctgggcgtggaggggccccagctgaggcggatgactcgggagctcaacgtcatcgtcaatggagctgccacaacaaacttctacgagaggtacgacgtggccctggacgtgaacgtgatgggagtgaagcatatctgccagttggccaagcagtgccccaatctggaggtcgtcctccatgtgtccacggcctatgtggtgggggagaagcaggggatgatcctggagcgggcgttcaagcagggcgagaccctgcggatggagacggagctggacatggacgccgagctgcgggtggccagggactaccagcagcaggtcgccggggacgacgccgagcagaagaacgagaggaaggccatgaaggagctgggcctcgccagggcccgggagttgggctggcccaacacgtacgtcttcaccaaggcgctaggggagatgatgctggcgcgggagctgggcggcgtcgtccccgccgtgatcgtgcggcccagcatcatcacaagcatccataaggagccgctgccggggtggatggaagggaccaggaccatcgacgccatcctcattggctacgccaagcagagcctctcctgcttcctagccgacctccagctcaccatggacgtgatccccggggacatggtggtgaacgcgatgatggccgcgacggtggcgcacgcgtccgcccccggcggccacaaggaggagtcgccgacggtgtaccacgcgacgtcttccctccgcaaccctgcgccgtacgcggtgctgtaccggacgggaatccgctacttctgcgaccacccgcgcgtgggcaaggacggccgccccgtgcgtacccgcaaggtgcacttcttcggcaccgtcgcagccttcaccgcctacatgctgctccgctacaggctgccgctggagcttctgcgcctgctcagcctcctctccggcggcctcctcttctcgcgcctctacgccgacctggaccgcaagtacaggttcgtcatgcatctcgtcgacctctacgggcccttcgcgctcttcaagggcatcttcgacgacgccaacatggagagactcaggatggccatgcctgtcgccgaccggctggagttcaacttcgacccaaacaccatcgactgggacgactacttctacaagatccacattccaggggtcatgaagtacgtcctcaagtagcagctacatgcactgatcgccgtcgttcgtactacctacatgtacatcatgatccatccagattagtactattaattaattaaatccaccaattggcgcgcgtttgtatacacattgctatatattgttgctacgctcgacgtggatcccacccatcctctctattcctcatcaaaatgtatccagttattagcagctctgctttagctaccactacgtacttctgctctggcttgtttatttagtgttaatttagcaggacctgatgatgatatactcatcctgtgtgttgtcatgtcagtcactgttggttaattgattatacttaagcaggtcgttgcataatcattgtggagaccttcattccaaagatagttctcctatatatacaacatgcatttttgtggttctttcttggcgaccaggtcagatcggcctcgtcttgagaaaccttatgtgtctacctttgtctatgtatggtgtgctcatgtgaatgattgacacttatacagagaagctctatggtggcggttctaaagttatttgcactggcgttttttagtgccgtcagtgctaggggttagtgaaaatcggcattttaactgccggttgttttagaaccgctagtgaaaacgctattttcattgacggttggttaagacaaccgtcgatggaaatagaatttcattggcagtttgtgtcacaacccaacc

SEQ ID NO: 12305 - DNA, 1895 bp, Zea mays
  misc_feature (179)..(179): n is a, c, g, or t
ctctcaccggcccggacagcttctctctctctctggtactgctagagctacctagctagccagagccaggctctctctctgtagctggtcagtgatcaatactgccgccgcccacaaattccacctctcaagaacagcgctgcatggcggtgtcgttgtagctagcgtcgtcctcgcgnccatcgctatataattaagctagctgctaggagccatcgggagagagagagatcgggagagagagagatcgggagagagcattgggtacctcgaggccggccggatcggatcggagctaggtgatcggtgcagctaactagctctagccatgggcaagagctgcgtgccccccgtcgccatggtgctcgtgcagctgggctttgccggcatgaatgtggtgtcaaagctggcgctggacgccggcatgagcccctacgtgctcatcgcctaccgcaacctcatcgccgccgccgtcatctcccccgtcgcctacttgcttgagagacgaagcggggcgacgatcacaaagaaggtgctcctccagatcttcgtctcctccatcttcggggcgacgctgaaccaggtgctgtacttcgtgggcctcaagtccaccagccccaccgtggcgtgcgcgctcaccaacacgctgccggcgctgacgttcgtgatggcggcggcgctgaagatggagtcggtgcggccgggcacgccggcggggcaggccaagctggtgggcacggcggtgtgcgtgggcggctccatggtcatacccttctacaagggccccgtgctggggctgtgggcgtccccgctccactggcgcttcgtcgcggaccacgcgccgtcgcccgccgccgccgccgcacactcgggagccgccgtgctcggggacgtcctcatcatcgccagctgcgtcgcctgggccgtctggttcatcctccacaccaagatgtccgagggcttctccgcgccctacaccagcaccgccatcatgtgcctcatggcgggcgtgcagtgcgcgggcgtcagcgccgccatggaccgcagcctcgacgtctggaagctcggctgcgacatcaggctctactccgtgctctacatcggcatcgttggctccggcatcgggttcacgctcatgtcgtggtgcatccaggtgcgcggcccgttgtacgtgtccatgttcagcccgctgctgctcgtcgtcgtcgccatcatcggctgggccatcctcggcgagaagatacgcgtgggaactgctgtcgggtccgtgctcatcgttgccgggctatacatggtgctctggggcaaagggagggagatggacaggccggacctcgacaacgacgacgacatagccgacgaggagaccgccgtgggccttgttggcttcagcggcaagggcggtggcgcggtcgccatcgcaagcagccgcgtcgaggccatcagcctgccggtgtcgttctccacaactagccccaagcggctgcaacacatccacgggtgaagggtgacgtggccgacgacgtgcgcgcgtgtcactttggacgcgccaagaaatctttcagggagccatggagagagtgagagtgtggtgaaaaaaaaataaggcaaaatagctagtggacggaggcaagacgacggcggcgacgatcggattggagtggcacacataaagacttattgtatacggttggttgcattgccgttgcagcagcgtcacagcgtggtttgttacaaacaggaaacaaacaaacaggagtgtgtgatgatgtgactgtacctagtggaagctaaggattgcttgctagcttggatggccttcttgttctgtctgcccttcccttgcattggattggatgacctgatttagttcctccaaagagtctcattcattg

SEQ ID NO: 12306 - DNA, 2618 bp, Zea mays
gcgcgaccctcgagtgccggccagcacgggcctggcgtattcattggcttccccgccgcgtccggccccgggcaccagcaccagcacggcgaccaaccctctcccaacccgactagtcggactcgcagctccgccccaagtccaggtccaagcatggaagtcgcggcggcgtcggcgaggcccgtcctgcgcgtggctgccatctgcggctccctccgcaaggcctccttcaaccgcggcctcctccgcgccgccgcggaggtgtgcgaggactccatcccggggctccgcatcgacgagctcgacatctccgacctgcccatcatcaacaccgaccttgagaccggcagcggcagcggcaccgtcttcccgcccgccgtcgaggccttccgcgccaaggtctgccaggccgactgcttcctcttcggcgcgcccgagtacaactactccatcgccacccccctgaagaacgcgcttgactgggcctctagaggaaagaactgttgggcagacaaacctgctgcgatcgtgagtgcaggcggcggctttggaggagggaggtcgcagtaccatctccgtcaggtcggggttttcctggatctccatttcatcaacaagccagaactgtgcgtccaagccttccagcagccacccaagtttgacagcgatggaaatctggtcgatgctgaaatcagagagcggctcaagaaagtgctcctatcccttcaggccttcacgctcaggcttcagaaggaggactgaatcaactcggtaccattgtagtacgtgcttccctgagaagcgtttattgctcttggaagtttgtaacgcgttgctgggtggcctggaagtttgtaataaatccaagaagtgttctcgctgaatatttaagatttgatcgcatctatatataataaagattgtgttctagcgtttttgcgtttcccagaaaaaaaaaaaaaaaaaaagtagttgtctcgtcttagcaatttttttttgaattttggtgtttcagtggtgcagcgagccaaagcctatggttgtacaaatacagttgaatgaaatctaatctcgatggccagtgctgcgagccagacttcctgtagttattctccattggttattaaaacttccactgcgcatcaacttttttgtacaaactaatacgtcccagacacctctgcttctgcttttggctttggttaaattctctgtgctgcaggtgcaggtgcatacagcagcatggatggatgacgatctgatgaacaacttcacaaggcagctcttatgttggtgtggagtgtggacagatggaagcttgtcgccccaaagcaggaagaggaggtagcaccggtttccgctatggtatggacgaaacaagtatgggatgacagaacagcaattcctagggggagccaaatgaacagcaattcataagggctacagtgtttccaggtaggacatcttgtccacaagctgtacatgattgtggtttgtcattgactcttggatctggcgcgctcgctgctggaattatactctcctatgcattttgtgaaagactgactggatgaaaccttcttagttcatatactgtcatcatgtatccatgtggaaggagttgggtccagatccagaaggcactgttctggcttattgcataagcttgtacccttttaacattgagtaaaagatgtatatacagtagaaacacagatcgggagtagcaatatcttagacgtctttgttgattcttctctctgcaggattggattcaagagctgtacggtacccctctcggtcagcgtgggggctcctggaagcacactttgtcgctgcgattgcaaaataaaagaaaggaccgacacgggacgggagtgccttgcctgtttggcagctgctcgagtggcaacgaggaccatgcacccagtggcaggatcatggtctctgccaccatctcctccactccactactacttgatggtgcaaaattggagatatttgcatggttcaccactccaggcgtgccactctcgtggaagcgtgccaccaatcgctgcgcgtccatcgcgggcagctcaacgtggacgtgctctgggaatgcgcagctgcgccaagcgcgtcgtcctggatgaccagcttctcggcttcacgcttgttgaattcgacgtgacattcatctcatggtttcttcgtcattactttctgcttgccgattggtatcctcaactcagcgcagattctgggaaagccaagtactcccctaagattgtgcagttgcgcagactttgatatggcaaagaaattcatcagattagagcctccattctaatgtactactacctctattctcgaatatttgaactaaaccacgacaaatattggagaactgaggaggtctgcatcgactggacatggaccatcgtgcatgggtttgtttcagaagcaagcaactgatcgatgagcgcatcattgtttttctgggtcgagcttggcgattggacaagacaggttcatctttgtctttttcatacacaaacacaataaactaaaaaaactgagaaaattcgtaatggcgccagacgccaggccgtggcggtggcattcaggagactagg

SEQ ID NO: 12307 - DNA, 4168 bp, Zea mays
  misc_feature (3808)..(3808): n is a, c, g, or t
aatttcgtagaaaaagtaaacagccacaccggtcaactttacaaatggcagccgaaaccaaagcgcgtctttgtgcgtgtatatcattggggtccccggagccggccgggagcaataagcgcaaacgcacacaagcggaggacaaacaaacagcaagagagcggaacgccgaaaggcaaaggcaaaggcaacggcaacgcaagccagaggcagagcgcgccccgccacgatgaagaaggaggaggtggcctcgccggcggcggcgacggtggtcctgctgctcctgtcgtcgtcgttggcggccgtctccggccagccacagccgcagccgcagcccgggggcagcaagcagactgcggcgaacaacccgcggctgcagaaggcgtacgtggcgctgcaggctttgaagcgcgcggtgacggaggaccccaagaacctgacgcggagctggtgcgggccggacgtgtgcggctacttcggcgtgtactgcgcggcggcgccggacgagccgcgggcgcagacggtggccggggtggacctgaaccacggcgacctggcggggacgctcccggaggagctgggcctgctggcggacctagcgctgctgcacctcaactcgaaccggttcgcggggacgctcccggagtccctccccaagatgcggctcctgcacgagctggacgtgagcaacaaccgcctctcgggcgggttcccgcagcacatcctgtgcctgccaaatgtgaagtacgtggacctgcggttcaacgagctgcgcgggccggtgccgccggcgctcttcgacaagccgctggacgccgtcttcctcaacgacaacgccttcgacttcgagctgccggacagcctgggcaactcgccggcgtccgtgctcgtgctggccaacctgcgcctgcgcgggtgcatcccgcgcagcgtgggccgcatggcgggcacgctggccgagctggtggcgctcaactcgggcctccgctcctgcctcccgcaggagctgggctggctgcgcgagctcaccgtgctggacctcagctccaaccagctgcaggggatgctgccggagtccatggccggcatgcacagcctgcagcagctccacgtggcgcgcaacgagctgtggggccacgtccccgagggcgtctgcgcgctgcccgcgctccgcaacttcacctactcgtacaactacttctgctccgagccaagccgctgcctcgacgtccgccacgtcgacgaccgccagaactgcatcgccgcccgccccgaccagcgccccgcagaccagtgcctcgccttcctccaccgcccgcccgtgcgctgcgacgacagcggctgcttcgccccgccgccgccgcactactagagatccatgcgtactctggctctgccggcggtgggagagagacagaaggagagggagacagtcgccgccggctcgccgcgtcggggcttgtaaacttcgcttgtgtggacgtgtggtgagggatgtgagagtgagaccgagagggggggtaaatccgtaaacagaaaacgaccgtatatattatacagctgtaattctttttttcttcttcttttaccttactttccacaggagtggtgtcgattggagtatttggtgggatatattgtagacagaaactatagtgaattttacagcgttaattcaattacccactgaccagtgaccaacaatctcttgtagtttcccttataccttttttttttccttcagtttcttgatttcttggcttggaaggtacccaagacgggtaccacacagtccatagaacaagtgaacaaagcaatcaggcaatcaaccaatggtaattaatcaatgaagagagaaaagcttcctaacggcaagaagagaaaataaaagaaaggcagcaagaacatgcatccactaacattttatacattaataaaatggctaggaagactaaacaaaagcaggtagcagcaggagcgagtgaataatccaggtcatgagggccaccagcccaccgccaccaccaaatgacgatggctgattaggatgtgtcatgtgtgtgtgggaggggtcaaacaagtacactgccgaattaaataaaagctgcagatgcccatccaatggcgtccaggcgtccagctgcagatgaccacatcaccttggctggctccagcttagtagtacagccgctccattcagatcactgttcaacaactgctgcatgttcttccgacgcgtccatgctgtgcctgcgtgcgttcaatgcgatgcccaatcggacacgtcggtgagacggcttccggcgacggcgacggcgacggcgctgacggcagcgtgcgtgcgtgcgtgcatgggcatgcaagggccggtggcgcgcggtgggaaaggcgcggagcagttgccgtccgtccgagaaagccagtccagccatcctgtttcagctaatcactccattttggtagggtaggtagagagggatgagcattatgtatgtatataatataaatggcctttaggtacccaataatgcgaggcagacaggctggctatggcaggtactaggcgtataacgcgcagtttaattggcaggcatggcacagacacagacgaaagggtgcttgccttgcccaccaaggggctgagatcagcgagtcagcgactactccaatccaaagtctccagcaccagcagagcacgcagtacgtacaactcttcagctcaccatctgccattcggtggccccgtttcatgcccttcgacgacagaacaaagcatcttctgcctgcccgccggaaggttcggcccaaaggttcttcgaacaggcggccgtccaccctggtgctcatggtggatcgatcggcccagtcatcacatcacatgggctgccgatgcgccggcctcactttggcacggcccgtccacttctccaacaccatcaggctttgaccctggtgaaaccttttccctcaattcctgatatacttcagtttcctctcccttgctcaaattcttcacctcctcttcttccacaccaccattgtcagcaggagcatgcttaacattgacactcccctttattgccctctctgtcaatgtcaaatcctccatcttctcatcctccatggatgcctttgaagttccatccaagatccaagcagaattctgtactccaaccatttattgttaccccccaaactgggcccattcatgaaaaaggctcggctcgtcatggatcacgaccaagatccattcagcattcgttttcttctttttcccaaccgtcatctctctctcgtcacgatctttacacagaatttaattgcaagcagaagcagcccagccgcaccgaaacgaaatgtgtaaatgaaatggatgttataatgcgatggttatcccattgtgtaaatggcataggccatggttttcacacaggtaccataatgttataaaatatggtgcacatagttgccatattttgaaacaaatggcatagagcacaacacacactaatgtcatagaccgaatgattttgatgggaatatgcgctgccatggatcgcctgatgaggataacatagagatacagaagcgagtgatgctgcacaaatttcaccgttccctcatagctacagtgcatctgcaccttctggacaaaattgatgatcaatcaaacagctctaggtattgtgaatgcctcataatgcatttaactgtaccacttgtttgggattcaatccctttaaaactaaccctttgggtacgcatgtggcttctttcaggtattgctgagttgccagcaaacaaatgnttggcatatttctcacagtttgggtgcagaatgaaataagagacgatgtgaaagtttcttgtgtgggtagaggactgatgggttatcttggaaataaggtaaatattccttactgtaatattttagtcatcaccagcatgtaaaaaaaacttagtaccatttctattgcagggctcaatttcaataagcatgttgtctttgcaccagacaagcttatgcttagagatggccaaaccggccacccggtccgtcagacacggttagaaaactgggcaaggccgtctaagcccgcgggctcgattttctgtccgcacccggcccagtgcgggtctaaatgggccggaccggcctgtttagcac

SEQ ID NO: 12308 - DNA, 8568 bp, Zea mays
  misc_feature (7760)..(7760): n is a, c, g, or t
tgcatgcctgcaggggatgctgccggagtccatggccggcttgcatagcctgtagcagctccacgtggcgcgcaacgagctgtggggccacgtccccgagggcgtctgcgcgctgcccgcactctgcaacttcaccaactcgtacaactatttctgctccgagccaagccgctgcctcgatgtccgtcaggtcgacgaccgccagaactgcatcgccgccaggttcacgaggcgagtcggcgacactctagcatctgcctcaacagtcgtgccgccttcaccaggcccatctcgccggaagcggagaatacggatctgcggcgccgacgtgtggtctcagctcctccacggagccgggtggcgagaccggggagggggttgttgaagctactgatgtggactatggcagccatctccgcccgcgccactgttcacggacgcaacactctattcgtcgaatccaaacgtaaattcgggtctgatgcacttgggcacacgtggcgagacgcggtgggcggaagcccgccaaatgcggaggagcctccaattcctagtggcttttaacaagaagtaattcacggacacaacactctattagtcgaatccaaacgtaaattcgtgtccgatgcacttaggcacacgtggcgagacgtggtgggcggaagccccaccgaatgcggaggagcctccaattcctagtggcttttaacaagaaagaagtaattgctcagcctctgtgccgctggttatcatttctcccaagtataaataccacccctgtccatccccacctcgctccatcggccagacacgtcgcgccacttgtgtcatgtaacacgaaaccattcttctagatcaaactacaatagagcaatagagctcgtgtcagaggcaaacacaaatggcgtattggcgttccacagaacaatggcacggtgtctatgggtaggcaagaacgcagccgctagcggcgctggcgcggccattcccaaacctccggctccccatcccccggcaccgcgatctctgccggccgtggacgactgcccgactctcgcattcctgcggccgaagccgaccgcggtcgggtacgccaccgcgaccgtcccgctcccggcgcactgcttccccgccctccccgtcggcgaccacctcttccaccgcctccagctcgacgggcttatacctcccgtgagcacggcgacgcggccgccggagcatgcgggcgtgacggtggagcaggcgaggaaggtggcgagggcggccgagatggaggtggcgagggcgaggctgaggtcgaacgcccagagcgtcgtgtccgggtcggaattcgccgcgctctgcgtcgacattgccggcggcgtcgagggaggccgccggctggcccgtgcgctcgacgagtccggcgtcgtcatcgtcctcggcgaggccgtcttcctccgccccgacatggtacgtgctgctaacttctagcatccgagacacggaaccagaggagaaagagtagtcagagccagggagcaaagcagagcatccagcccggccaccgccttacgctttacctttaccgcgtctctgatctctccgtgtgtcgtcgttcaggtagcgaaggccatcgggagcatcctccccgtgaaaaagcagctgcaggcgccccgagccggagacgggagcgaggcgcgcaagcgcgagctggaggctatggaagctcagaaggcggcgatcgacgcggacgcggccgcgcaggtgcggcgcgagctgtggtgcgggctgggcctgctggcgacgcagacgctggggttcatgcggctcaccttctgggagctgtcgtgggacgtgatggagccggtgtgcttctacgccacgtcgctctacttcatgtccggctacgccttcttcatgcgcacggccacggagccgtccttcgagggcttctaccggagccgcttcgcgtccaagcagcgccgcctcatgcgggcgcgcgggttcgacgtcgaccgctacaacgccctgcggaagggccaggggcaggggctcgttccctcgccgaccccgacgcgtgtaggcacgtcagccatgtacaatagcgcgtcgctccgcccggacgaggccgcttggcttgtgccaggggggcacacatgagataaacgtgcgtcgcatcgtcgactcaccgtctaatcgtgaagcaacagctctctgtacagattcaggaggacgagccatggtagaagaaggctcgtcacaacggaaactatatgtttaactaacgtgtgacacacaccctgattcacaatctcacacgcgtgttgagtgaagaagagacgtatcgggaactcgaggttacctatctgagcaaaggaattaggatcacgatcctattggctttttgtcgtcattggggactcggaacatgcttttttatcgtttcgccacatcaggtgcaccagagccgacgagccgtggtctacgtgcaccgtgtacacgcgtgtgcacgaatggcgtgataacatgtcgacacaccgagcataaaacaagaattcgtcaagccccacgctttctatgctctggccagtactcctccgtttctttttattagttgctggatagtgcaattttgtactatctagcgactaataaaaagaaacggagggagtaagtagtaagggctgtttcaaatttcaatccatcgatgccaaagtttaacaatatattttaaataaattttagcacttgtagatccaaatataggtgctaaaagatgttaaaaataaagtgataaaatttagcacctattaaaactttagctctttaataccgtgtccagcattttagccatatattgaccaaaaacattgttttgtactatagactgcattgttcgcagaatgaagtttgaatatggagtagagatgagtaaactgctggagataatctaaggggtgctagagtttagcacgtaggatccaaacaggtcctaagactaaaaccagttatggcccgtttgtttgtccaataatgaaccagaacttattccaactcatcaaaacttaaataaattataaaaacaatccgactaaaaattgttccagcactccaatctaaaaaaccgaacatgccttagtaagaactcgctcacacacggcccacactccataggcacgaccacaaggcccataactctgggcttcgcccgctaccggtgtcccgggcagaaggtgtcgcgcacgcgctctgacacgccacatggcccacatctgacgtcggtggcgaacgtggcgcaccctcccttcccgttgtcgtcgtcttggacatctacaactcggacaggtacaccgcgttcacgtccccaacgcagccggtgtacccgcccatcgcgtaattcgccctggcgcccgtcgccgccacgcgatgccgacattgtacccgtccactaggctcatgtcgtataagtccttgccgttggcgccacgcagggtgaactccaccagcgacgggcggcaccccgtcgaggcagcagctcgcggcggcgctgcattcgctcgtggcgcatgacagcctagagaacagggacacgacgcagcccgtgcacgtccagaggctgcccggccagcctgtcggggcaaggaacgagacggtggcgttgggtgaaagctccaagcccccgccccaatgcccgctgctttgttcccggagaatgtggccggccagatcatgtgggtgcagttgttatgcagcgtgaacaccgtcgtgccggcggcctcggcaccaaacttcactcgtaaccaaattgcccctacatatatgcagacatcagcacgagtgttacctacgacattttgcattatgaatatacaagatgagtatgcgaatgcaccaacaagtagtaaggcgtcgaggcatactcgtgttggttccaaacaaaagtttagtttatgtcgcattgaatgtttgaatggtaattacatatattaaatatagtctaatcatgtgggtacacttgattgctcaatgtgtatcctcactttgtagccctttccttttgccttgaccattacctatactaaattttatgtggagcttgggtaagtggaagtggtagctactcatgttgcttatgttgctaagtcaatgattggtccaaagagagtactaaattgcctctttctcctttaatgatccctcttcccaaggtcttaagatgttgaggaggtctactcttttttgccatacttttgcatgtttttcatatgcccttttggcattttttcttctctatcttttccttttttctatttattatttgagctccacatatgttttccctttttttcttctccaaatattaaaaagtattctataattaattctataacattaatttggaataataagttcatatattttatagttatttagttaaatttaaaatctcaaaacaatgagaattgtattattttttaatggaaggacactagcaaatccttccctgcatcactggtactcccctccgttgttccttttgaaatctccaaacagaagatgacaaatggtagatgaaccctggatttcaaatttgcaaacaaactcgcaccatttaccatttgtcatcttcagtttggaaactagtacgtaaagacaaagagatactagtagtacactataggttgaacatgaactagcttacacagtgcaaaattagcgctcaaagtgaagtaaagtaatgtacagacgtacagtgcaagttcacaaccaaggaactagcagctacttacaaaatttctctgctaaacgaagttgtattttcattttatcgagctgccaccgagccggcaatccggatgttgtcctccgaactgggttgccacagcttctcgaacccgtcggccactgacaacggctgcgccagcacggagaggctgaacacgacctcggtcatgttcggccgccgcgctgcgtcctcctcggtgcaggccctcgccatgctggccaggctaagagccacgtccatgtggtattcgcttcccagagcggggtccatccacttcctcagcttcgcctccctcttgtcgccggtttccagcacgccacggatctccctccacagcatgccgatctccgagccgatgcgcgcctccatcgccctcctgccggataggagctccaggagcagcagcccgaaggcgaacacgtcggagctcgtcgcggcggcgtcgaccatggctggcttggccagggagaagccagatatcttggccctgaaatccgccgtcaggaggatgttccgcgcgcggatgtcgtcgtgcaccatgctcggctgcgtgtgctcgtgcatgtagagtaggccgttcgcgacgtccagcgcgatgctcagcctctgaccccacgagagagttgccacggtgcacgacgacgatggcagcgcggacggtggcttctcgtacagccacttgtcgagcgagcccttctcggcgaactcgtacaccaggaaggcgtagtccccgtcagcgccgatggatatgcccgccagcttgatcaggttggcgtggttgaccatctgcatcatcctcagctccgccgacacgtcacctttcgctggcttcaccgcaaacacctccccgtcgagcttcgcccggtagtacgtgctgccgatcttgcaccgctcgtcaaggttcatcgtggcctccacgatctcctcttccacgaagatgatgggcttgtcgatgaactgcgacacgcccgtgagcagcttgcctcctttcatcacgtgggcgaaggaattgctgccgtcatgaccgaattggttcctggaccaagaaagcttggtgttcacggcgaaccgtgaacccaggcgcatcgacggcttctttcggtacctccggcgcgccaggatcgcgacgaacaaggcggcgagcgcgacgagggaccccgagacgctggcgcctatgacggcagcccgacgtcgcgaccgggacttgccgtcggctgcagcagcagcgtagagcggagccggaagccgcggccgctgtcgaactgggatcagcatcggctgccccacgaaggacgcggaggcggaggtgttggcggttacgttgttcgcctcggcgatctcgtccacggtggcgttcatgagcttgctcacctgggacatggtgtcccctgcttgccacatgtaggtgatgaggctctgcaccccgcggctccgctcagcgcgagccgggcaccggcagaggagcggcaccgtgacctcctggccgatctgtagactggtgggttccgaccccgggttcagattctggatgaggtggtactcggtgaggttctcgtaggaggccttggcgaggttgtagaaggtgtcgccctgccggatggggtacgtgacgttggcgaaggaccaggcgcccgcgcagccgcacctgacgggcacgagcagcggctggccaggctgcagcacgccgtcctcggagctgagaccgttggcgctggcgatccgggcctggctcgtgccgaagaggtccgagatgctgccgaggtctaggtagccaggggactgcgtccggtacacgacgtacgtgtcgcacggcgacgacacgtcacaggcgaactgcgcggggacggtgtagcttgtgctgtcctgggcaccggcccgccggaagccgaggaggagggtaacgaggaggagaagccgcgaagcgcagcagcggaaatggcggagttccatttcgctctcgatcggtgcccgtgtcacgggctgttttttctgtgagctccttggctaaatgaggttgtgaagcagtgaggcaggcgatcgatggcgcgcggcttggttaaactgcatagggtagctaacatgcagtccggcgttccaaggacgaggactgtgcaagtcaatagcgcggtggcctttcttctgtcgcggctcgggtgctttgattcggtcctcggagtctcgctgcgcgatgcagatgccattcgttaatcgttggtcccagccccctgcactgcacctgcactaggccgtattactttatactagcaggcatgatttggtacaaatcggtacagatgtagctaagaattcaacgatcatgctttgaagggtcgctctcatggcgatcgcttccagccggaacaacggaacgggtctgccgctgtctgattgaagcaaagagctgctgtcagatgatgctacgtacggcgtcgttgtcaagagagaggagaaggggattatactatggtgccattaaccagtataataagataacgctaacgaacgaggtgttgatgcacccaatgcctatgtaatttcttttaatctgcagaaagatctgttcatacgcagatggagatgttcagtactttaacatgacacgagaaagttcagagcagctctggatgattgtcagccgatggaaatctgcctgcaaaaccgaaagtttacttggtttggcgggacagaacgttctgcagacctcctgttccccaacctcgcactgaacggtcttgagacttcactggagaatttaaaccgtcgcccggtcattctcagtcggcaaagagaccaacgcaagcaaggctacattctaattcaagaaccacttgtttaaagtggatggtttcagggaagtggtgcaagagacctagaacagacctacagcgtaggggatggtgagctgagcgggatccagaatgaaaacgataacaggtgcttggaaatcaggtcgccccatgttcaggtttaaactgaaagcctcgcaaacaantgcttgtcctctttatcatgcaagacggtaacagataaaagattggcatgaaacaatggagtgaccgatatagcaccacacatatgtcgttaccccacagatgactatgagaaaccactgccacgaagccacacgtattgcagtgtttttaaatagtatcatcctgttaggtgaagcatgatgatagaccgagcgagctataaaaaaagtcgaacttctttttagcttataactttctcgtccttttgactaagataaaatataatatttgttcttatcagtttaatatctagtatgtggactatatgttcgctttgatattattatttttatggctttttttaagagagtccaccacactggtttattggaccctcacgtgtggctcagccgttgcaccgttggtaggacctcgcccaccgcaaccactctctactcctacagagggaaatatgtgtcgttattcccttccttgaataaggcttatgcgcgtcattattccccccacccccacccactcgataagacttatctcaccaaagacaaaactaatcccgctataaatcgctcgcattcctacatagatctagcccccatcttctcacgtaaccaccacaatatcagattaaataggaccaatgtttcaaatagtcgcctatagtggttaaggtggtctggagctaagagatgcactatttaacgctaatcgaaattagttgctaatagccttatttagctcgaaaagggtgtctttggtaaatcgcgtaaaataggggacgcagaactgtaaataataccgtttgacaca

SEQ ID NO: 12309 - DNA, 6343 bp, Zea mays
  misc_feature (4406)..(4406): n is a, c, g, or t
catttctttgttttttaattataccgtactcgtattagttgcaacattaggtttgcacgtacacaactttttactatttgttatgaatctcgattaacgtggcttttgaatagctagcttgcatgttttttgggtgctcgctgaaatgcttgacgtgactgcttcgttctccaggaagtggtagcaacttgccactgtacgtacatccacgtggctgcagctgttatcttgtatctgtagttctgtacacggcgcagtacacctgtaccgtacacaagacgtctcttgctactagcaacgaactgggaaaatcatcaaagccgtgtggccgtgtccattgacctcaactccaggatataatcctgtatagaatactcgctctgtttttaaattatagaatatttttatatttctaaataaattaaaatatcttctcataattaaaaaaacacaaagaagcaacgcactacccttgattctctcctcacggcgaccgactgactccgtcgatccatgcgacttgaaagagtcgacgcaagcaggtagcagggactcccgcccgtctgacttgaacaggccaaaccaagaccccaaggtcacaacatgccgtgccagacagcctcgtgagttcagtcacgcgcaaccaacgagaacgagacgggcatcggtcagaactcaggtactccctgctggcagctgcgtccgtagccatccagacaagccactcgccggagaacgagtcgcatgtcctccacctatataacactacatcagagccccagctactggagatcggaggttcggattcggagtgtaccacttccaggtgccacactgccacccacctcgctcccgagagcagagctacgacgtgcaagacagcgagaagcaacccgtacgtacgtttgatccctcgaggccagcagaccgtaccatggcggcggcggtgacggcgagcagggggacgcgcgcgctggccatcttagggcggtgcgtgcgcgcgccgttccgcgccctggtccgcgcgcgggacctgtacgtgagccggatggcggcctgcgcggggggcggcggcggccggggaggcctggcccccgtggggctggtggcgatgccgcggtgccagagccacgggttctaccgctcggcggcgggcggtggcaccgacgaggacgtgcgggagctcatcagggcggcctcccgtgccggcccgcccagggcccccgccggcgtcgggccgcggagccagagcgtggccatcggccggatcgacgaggaccggccgtgcgagttcgggctgggcgaggaggagaaggcgcaggcgctgatggggcccaggagcaagagctgcgccgtggggccgtcgtccaggacggcggctcgtagggctggcgtcgccgtcgcggcttagcttaataaatccaacgccggccggccgacgttgcattgcaccagaaaatccgcgtgcgctgtactagtaccacaacataaaatctgctgttttgtgataaaaaagaaacgcgaaaaatacgtgcgtccgtctgtgggttgcttaattcagtacagatttcggctctgcagctgtccatgttcatctactgtccagtgttgtatttatatattattgacatattgtgtaccaccagtagagaagctgaaaaaaagagagctatataccatgagtcaaggaccaaaaaggccccgtctccccggtgtctcggtgccgactgatgtctgcatttttcaaaagatcgggcaaaaccatgtcgggtgcacgtgacatgtccccggccgtgaagtcgattgaacgccgccgatcgtgaagtatgcgatgcgaccatgagagcttgttgttgtgtccttcgtttgcgccggcatatgttgacgcaatcttcttggaccgaaaaaaaaagggtcattttttttacttcgataacgggcggcgaaatctgcatgctgccgcccgtccagtccagtgatctttgactccgtttctcgtccatgcaggagctttatgatttccatgactgaaccaatagttataattatagatttaaggcatgtttggatcaccgctccggtttccacgccgcgccacagttgtggcggccgtatcggccgccgcaccttaggcttgatgtggcattggaggtcagacctccaaacaggcccttaatatgaaagggaatgaaggccgacgttgactccagatgcgggttcaggaccgcagcatgtctcggaccagtctagtagtcctcgaatgcattttttaatgtcggcggagccaggatttagactggatatgatataaaaaatttatactagccaaaaaataaattgtatatatatatatatatatatatatatatatatatatatatatatatatatatatatataatggcacatataaacatcatttaaacatgataattatagtttaacgtaaaactgccttaactaataaataactgaatccgtggctgaccatgccgtggaagcctcagaaggcaagcaacaagccagcaagcatggatgcggcaccggcgtgccacctcccatcgctcgtggtcgctgatccgccatcgtgaccgctcgcctcgatccgccgctcgtaagcacgtctggtctaccgttgctcatgcagcgccgcggctcgcacacccgccgacgccgacgccttctgatgcctgtgagccgccacgccaaaactctagctagcacacgttactacttggtcgcacctactcgttagttgggctaagagtagggctcaggcccctagtggccatagagagctgtactatagacacatgaattatgctccagaccacggaccaaatggtgcggagcttgtatccgcccctggttcactcctctgaatctgaatcacttaaactaagggacaaccaactcatgaatagtagcaaactactaagtgcggaataaataaactaccaccctgctaatgagggctgcaccacaaacctacagtttgcgacgcttcaccattactgtcttcattgcgatatatgatggtgtcatcaaatcatccaacattagtccgtccaaaatatttccagatcaccctgaagagaacacagcaggcttaagcaacttgtggatgatagtcaaataagcaatctattagttattaaaaggtaacaaggtttaatccagtcgggcaggattactgaaagaaaactttcatgtaacagatttatcttaattaccctttacgtgattggcgaagctgtgcaaacaacaacaacaaaatttcaagcacccttattgaatcattcagagaatcagaggtggcaaaatagtggataacatcctaaaagaacccgccaaatacttgtacacaaatggttcttgctaattagatattcacgtagcaaagtgtcagacatgctaatattgcaggtgaactgtgcatcgtgactttcatggaatcacaacagacaggaccatgaaatttgtcagcaacacaaaggcacagttcaagatatggtataacaagaaaaagaaaaactaagcatggataggaaaaaggttgctgaagaactatgatctgtttggcataacttatttcttagttttcacaaattaagcagttgtgcgtaacaacaaaaatctgcagccgcgtatcaataaccaaactaggaactaactgaaaaggcaaactacacttttcaccagcttctcataaaagaaaattgtgctcaattacaagttgtgccacacaaggcctatactacagttcaactctctttacatatctaagaatcaaaagtaccggtcactccttgctgttacgaatcaatacgacacaaagtaaatcaaacacagagaagacacagatttaacgtggaaaactcatccaggcgaagggggaaaaaccacgggcgtcggccagcaacaatatcactatttttcgggtggttacggatcgcaagaggtttacaatgaggtgccgatctcctgcatattacaagtgaatttataaaggcgaaaccctaatttgagtagggaaggtccaagcctccggcgacgggcctccgcttcgctcgccgacttgaccgctttcttcagaatttggatcacaaactcaacacttgcctctagcaaataagttgtttggtacaagaatttttttaattataatcaacatgaggtccggggaaacggataaaccgaggcaagcaatcctcccgcgaatgcgggtttgaagcggcctttccgcatttgaaggggaaagcttgactcagtttctctctttcccggactctacttatgtgggagccttcggcactaggtctatcgttttttattcaccataggacaaaacttgaaagatctaaccacaagttttcttcttttcttacaagaatatttctttgcangtatagcaaggttcatgcataacaaatatattaggggcacttgcaaaattgcaattgattcttaaaaaccatgaaaataaataatattgtaataacaggacaatgttttagttatagctgaatgtaccatggaatctcaaggagcaagactctttttgagcttgagggttttaacatgttcacaaaaccaccgatgtttctcttgcacttcagctatcgccttttcagcagcttcttcattctttgctagaaggtatttctcgatctgaacaaaccactcccccagtgtcatattctccaatctgtgtcttcctttgggctccccgaccccaacatggcctctctctccactggcaccaacagcttccctcttttcattcttttccacttctccaacaccatcaggctttgaccctggtgaaaccttttccctcaattcctgatatacttcagtttcctctcccttgctcaaattcttcacctcctcttcttccacaccaccattgtcagcaggagcatgcttaacattggcactcccctttattgccctctctgtcaatgtcaaatcctccatcttctcatcttccatggatgcctttgaagttccatccaacttgtcctcagttgccaccttatccacttcagaaccatcattcacggccaacaccctcaatggactcccccctcgttctctgccatcagccatatccctttcctcttgctcattttcatcgttctcagcaaccgcatcctcagccttccttgtacttgccgtcgtagcccttcctcggcctctgcctcctctgctcctctttgcttgaactctcccagccgccggcaccacctcatccttgcccccggcagctgtcccttcccgatctctggccacagccacctcaccctcctcttcctcctgagtaacacctgtatcattccttgcacttgaccttgtaacccgtcctcgcccccttccggtcctcatcactttcccctcatcgttttcgcaccccaatacgtcacctttccttgcagcagctctcgttgacctcgtattttgcggctgtggaggaaggacgaccgtggctgcagccttcctcgacctgccacggcgcggtattgccgcttcctcctcttcatcttccgcttccgtctctaccctagcgggctcaacggtcttcctccgcccgcctcggcgagtcggcaatgcagcttcctcctccacttcattcccagcttcgggggcttccgtcgcaccagccttcctccgtccagccctgcgaggaacagccgggccctgttcatccgccgccgccgctgcgtttcgcctggaacgccttgtcgcgacggggcccggtcccgggcctgcatcggtcgatatggagacggcgagcacggttgtctccccgatcttgatgagatccccgtcggatagcggagcggggatagtggccacgagaggcgtagcgttgaggagggtgccgttcgaggagcctagatcggtgacggtccaccgggccgcaggcggcgggaggaactcgacggagagatgcctctgcgacgcgcccgcgtcgcccacggagaggtcgttgcccttggcaacgcggccgacacggagcgcctcggtgccggcgcagcgctgcagggtattccccttgcaggggcccttcttcaccaggagagtaagcacaggcggcggatccgccatcgagggggggctcaggggtcggaggtctgtgaagagggaagcgaaaaggatttcaaatttctgggcagagttggggaaaagtactggccgctgctatggagtgtggagcacggtttacaaaaaaccgtttagccttaaaaaaccgctacccaccggtaacggtttaccgtcgataaaccgatggaaaccggtaaaaacggttttaccaattcaaatcgatttgaattcgaac

SEQ ID NO: 12310 - DNA, 1049 bp, Zea mays
cgagttaaatgtgtacctctaccgacgaggagggtcgagtcgagggaacacttccttgacgagaatcgctaacaactccttcttactccttcccgcggagtccgaggctactcgtggccttcggtgcctcctccgcatcggcgacctcgcctgacacggctgccgtctctcagtcacccttcggcctggtctgtggtgccctctcttttctggttgttccctatggatggttggcgcctgaagggcggatggatccgatggaaagctagcttctccggatccggtcagatcatatctcccggtatcccgttccgatcaacctcttccggtattttttcagaggaaaggttggccaacggcgttccggtggttggatttgtatttggtggcggtggactccggttatgtccactgattgcttgctgttcggttcgcttaagtggtaaagctgatgtctttaggttagaagaataactaaggccgcgtttggttacaccagattatcagaatctgcatcattcacgtaatccaaaaaaatccaactcaagcttgatttttatggatagtctctggcagcacattatccaaggtaaaaaatctgctacgtttggttgagcctatagattctactagccagattctgactatccataggaaccaaacgctccctaagattgggtaggaaggaaggatggtggattggttagctagctgctggctgcttggttcaggagttggggttaaattagcgtctgaaatacttgtttggtttaggtattcctatgtagacgacctgattatgattcagggtggtttatcgtagcagtaatctgaagtttggtgtggtgtttgatctgtgtgagtcttgtgttaggtgagtcatgaacaaatttatgtggtctttattagtaggtcaaggtgaagttcttctctttatgtatctatatcagcttagctgtgatacgcgtgtgagtcgtaaatttcgatatatgaaagtctgttcttgcatctgatcaggaattgtaacaacctcttactacaaaaaaaaa

SEQ ID NO: 12311 - DNA, 2036 bp, Zea mays
gtagcctcacggctcaccgctcaccgtgccgaataatcgggccggccaccatgctgatcacaccgatgagtcacccggccgcgtgcgggccccgctcaacaaaggcgggcggcgccagaaaggggcccaccgcgaacccgcgtcgggcacggcatccgcggccgccgtccgttcgtatccgacggctcccctccccgccacgcacaacccaaaaaatctccccatttaaaaatcagtacgaccaggtaaattcggtttccttttcttcaccatcatttgaaacataaaaataaaaataaaaataatgaaacgaattctggccacgcacgcaacgcaatcgcacgagaccattacctagcgccgccccggcccggagtatttgctttgcttcctcttctccccctcctccgcgcccgcctcctctcccctaacgcttagggttagccaggcagcgacctccctcgcgaatcctccatagccgccatggccacggcggttctcagatcccacgatgcgctcaacaaccgcctgcatctcgacgcgtacaccccgtccccggcgaagccgcgccggcgccgtagccccaagccggcggccgcgtcttcgccgcccgcaagggccgcggcgcccatagcctcgacgtcgccgccgaagcctgctgcggcgcagaagacggcgacgcccgttaagggtcctgcagcgtctggacgccgttcgccggtggctaggccggctgcttcggcgcggaagcagctgtcccccgttaaggagaatcccaaccggcggcttgtcatggaggaggtccggatcttgaagcgcggcgaggaaccgcccgctccagctcccgcgccagcccctacgccggtgatagcagcgccccccgctgcgcaagccgcggcggttgaccagcgcgccctctgctccactggtcggatcgggccgcaggcgcccgccgtggtgccgacgaagaagatggtgtcgctccccgctgcatctccagccaacgcgcccgtgttcgcgcgccgggtgttttctgccgcggtgcccgccgtggtgccgacgaagaagacggcgacggtccccgccccatcttcagccaaagcccccgtgtacgctggcctggcgttttctaccgcagcgcctgagcccagctccctcccgatgccctccttcgtactccttcccgcggagtccgaggccactcgtggccttcggtgcctcctccgcatcggcgacctcgcctgacacggctgccgtctctcagtcggcctctcttcaccattcggcctggtctctgctcccctctcttttctggttgttccctatggatggttggcgcctgaagggcggatggatccgatggaaagctagcttctccggatccggtcagatcatatctcccggtaacacgttccgatcaacctcttccggtattttttcagaggaaaggttggccaacggcgttccggtggttggatttgtatttggtggcggtggactccggttatgtccactgattgcttgctgttcggttcgcttaagtggtaaagctgatgtctttaggttagaagaataactaagattgggtaggaaggatggaaggatggtggattgggtagctagctgctggctgcttggttcaggagttcgggttaaattagcgtctgaaatacttgtttggtttaggtattcctatgtagacgacctgattatgattcagggtggtttatcgtagcagtaatctgaagtttggtgtggtgtttgatctgtgtgagtcttgtgttaggtgagtcatgaacaaatttatatggtctttattagttggtcaaggtgaagttcttctctttatgtatcgtcatgaacaaagttatgtggtctttattagtaggtcaaggtgaagttcttctctttatgtatctatatcagcttagctgtgatatgcgtgtgagtcgtaaatttcgatatatgaaagtctgttcttgcgaaaaaaaaaaaaaaaagaaataaaaaaaaaaaaaactcgagggggggcccgg

SEQ ID NO: 12312 - DNA, 1335 bp, Zea mays
agatagggctgttttgcagcggtggcccaaaacatgcagaaaggctgcaagggccgaatttttttccaaatcgttccttctacacactgtcgaggagggcagcgggaagggacgagtcgacgccggtgtgcggtggcggcggtcgcgcggtaacgtttcccttcagcttcgatcatgttggtggcggcgccggccacaaaaggctcacccaccaaggatttgacggctgtcgagcccggggacgagggcatgccctgagtcgtgagaggtgacaggaaacttgttcatagtcgttttcgctaccgtaggtggcgcagtcggtgttcgacgcagggggagctatgggttcggtctcggtttgtcaggcgaatggcaaccaccagccgccgccgccgcaggcagaagcggagcaggtcgtcgaggatggcgttgccgtcgacaggatcaatggcaactaccagccgctggagctggtggctgaggcggggcaggtcgtcgaggagggcgatgccggcgtgaccatggaaggcgtcgcttccatcgccttgctgcctaccggtgccatctccggccatttcattcgcctccctgactccatctgctacgggctacacggcaccccaatatcttgcgagagggaatgtagccgaggagaggactaccgccttataaagctcaccatcattgattttaagagcaagagagagaaggtgcttgtggtggaatgcaggggccatgatgctgctcgattacaaaacattgaccatttgcatgggtgggaagatgacattgttggtttggttgagaaggagcacggaaatcagaaagtcttgctctcctttgaatgcgagacgctgaaggctgataaagacgcggaagatcatattgccaaatatatgccaaatctgtgtggactggacgcagttgtaaatatagggaaaatgagcatctcaggcatcaatctcgacgaggacgccgaaccaagaggggacaactgagcgtgtgaacagtggtcattgttcatcagcactggtaaactctgcacgaatcacatcaaacgcttacactgcactacatatggcagtttgatacgtgtctcattaccagtgcctgtacttaaaattctgtggctgtgaatcggattcaaaaccctttatacgtttcaactttcaagttaccacgtcgcttcttgcacgaatcccaagggtcggttgctcctgctgggtgcatttcttgtctgtggcggtactgtttgtcacgctttgtacgtatgactagcattgcttgtctgtttatgagagtggtgctgtgtttcgccaaaaaaaaaaaaaaaaa

SEQ ID NO: 12313 - DNA, 1143 bp, Zea mays
ggcgattgggatttttttttttttttttaaaatcgttccttctacacactgtcgaggagggcagcgggaagggacgagtcgacgccggtgtgcggtggcggcggtcgcgcggtaacgtttcccttcagcttcgatcatgttggtggcggcgccggccacaaaaggctcacccaccaaggatttgacggctgtcgagcccggggacgaggtggcgcagtcggtgttcgacgcagggggagctatgggttcggtctcggtttgtcaggcgaatggcaaccaccagccgccgccgccgcaggcagaagcggagcaggtcgtcgaggatggcgttgccgtcgacaggatcaatggcaactaccagccgctggagctggtggctgaggcggggcaggtcgtcgaggagggcgatgccggcgtgaccatggaaggcgtcgcttccatcgccttgctgcctaccggtgccatctccggccatttcattcgcctccctgactccatctgctacgggctacacggcaccccaatatcttgcgagagggaatgtagccgaggagaggactaccgccttataaagctcaccatcattgattttaagagcaagagagagaaggtgcttgtggtggaatgcaggggccatgatgctgctcgattacaaaacattgaccatttgcatgggtgggaagatgacattgttggtttggttgagaaggagcacgggaatcagaaagtcttgctctcctttgaatgcgagacgctgaaggctgataaagatgcggaagatcatattgccaaatatatgccaaatctgtgtggactggacgcagttgaatctgctcggatgaacagcattagatagcatggattaccattaaggtgctgtttgtttcaaagcagtaaatatagggaaaatgagcatctcaggcatcaatctcgacgaggacgccgaaccaagaggggacaactgagcgtgtgaacagtggtcattgttcatcagcactggtaaactctgcacgaatcacatcaaacgcttacactgcactacatatggcagtttgatacgtgtctcattaccagtgcctgtacttaaaattctgtggctgtgaatcggattcaaaaccctttatacgtttcaactttcaagtt

SEQ ID NO: 12314 - DNA, 2181 bp, Zea mays
tgcagttgtagaagtcatggctgggaattcaagttctagcaattgttcttctggtaagatatttacatggggtgatggtgataaaggtcgcttaggtcatggtgacaaggacccaaaacttgtcccaacttgtgtggctgctttggtggagcccaatttttgtcaggttgcttgtgggcattgcttgacagtagccctaacaacttctgggcatgtgtatacaatgggcagtgctgtctatggtcaacttgggaatgcacaagctgatggcatgcttcctgtgcgtgttgaaggcaagctatacaaaaactttgtggaggagatttcatgtggtgcttatcatgtggctgtattgacttctaggactgaggtgtacacatggggaaaaggtgcaaatggccggttaggtcatggcgatactgaggataagaatactcctacattggttgaagcactgaaagataaacaagtcagaaatgttgtttgtggaattaatttcactgcagcaatatgcattcacaaatgggtatctggagttgatcaatcaatgtgctcaggttgccgtcagccattcaacttgaggagaaaacgccataattgctacaactgtgctctagtattttgtcattcctgcagcagtaaaaaatctctgaaggcttcattagcacctaatggaaacaagccttaccgtgtctgcgatacctgctacagcaaactgacaaagggacttgagacagatatgcatttttcagcgaaacgggctgctaccgtaccaggattcagtgatacaattgaggaggatctggaaacaaggtcaaatgctcaactatcaaggttgtcgtcaatggaatcttttaagcatttggatagcagatattccaagaaaaacaagaagtttgaatttaatagcacccgtgtttcccctgtgcccaatgggagttcacattggagtggactaaacatttcaagatctttcaatcctgtatttggatcttcaaagaagtttttctcagcatcagttcctggatcaagaattgtttctagggcaacatcacctatttcaagaagaacaagccctccacgatctacaacaccaacacctactctgggtggcctaacgtctcccagagttcccactgacggcaagccaacaaatgatgcattaagccaagaggttctgaatttgagatctcaggtggagagtcttaccaggaagtctcaactcctggagttggagctggaaagaactaccaaacaattgaaggaagctatttccattgccggcgaggaaactgcaaagtgcaaggcggcaaaggaagtaatcaagtcactcactgcacagttgaaggggatggcagagagattacctggaggagcagccaagaacactaagttgccacctcttcctggaatttccattccaagtgacatctcgtctttggctatggagagtgtgggcagcccaagcagctccggagaacaaatcataaatggtcataatggattgcttgcgtctaatggaccaagttctgttaggaataagacaagccatccagaagtgggtaagaatggaagtaggccgcctgatgctgaatcttgccatgatgctgaatgggtagagcaagatgaaccaggtgtttacattactctcaccgcgttgcctggaggcgccagagatctcaagcgggttcggttcagccggaagagattcagcgagacacaagcagaacagtggtggcaggagaaccgggcgagggtataccagcagtacaatgtccgcgtggttgacaaatcaacggccagtgccgacaatgacattgcagctaactgacactagactgacctggagaaacatatctgattacaagtggagctgaggccatgtaccctacctacgtgaaggctctctagtcagtcaagctgggttgctaacgtggctaccattttacctaggtggttttcgctcccaggaaaacaggaggtttttttaatccggttttacataattctttctcttactcccttctcttttctccttgtgtggaaagtagagtgcttgagcagaggtaatgtaaatgcttagtagaagcaggctaatctaccttgtaaatgcataagcaagcatcgattttagaatgtcttggaaattttctgatatggttgcaaatggcaaaaaaaaaa

SEQ ID NO: 12315 - DNA, 1189 bp, Zea mays
cattgggcccctcgaggccggccgggagacgtcatcattcctctcgagtagtcgatcggagtcaggagatgggcgcgtctggtggtgaaaagcttggtactcttgtgtgtgttcttgcacatgtatcgttattattggtgctcgtgctagcaccgtgtgtgtgcaaggcgactggtggtgactacggcggcctctccaacgaccactacaccgagtcctgcccggagctggagaccatcgtcaagaagtccctggcgccgatcttcgccgtggacatcacctcgccggccgccctcctccgcctgctcttccacgactgccaagtccacggatgtgacggctccatattgctcaactccgacgagcgccggcacataacctcggaactgggctcacgcaagaacctcgggatccggcacgtcggcaccgtcgggctcgtgaaggcggccgtggaagcggcctgccctggccgggtctcctgcgccgacatcgtcgtcctggcggcgagggaggccgtggcgcacaccggcggcccgcgcgtcgccagcgtgccccttggccggagggacgccacgaccaccagcacgcaggccgccgatgcgcagcttccgtcctgtttcctcgggattgacggcgcgctcgacatctttaccagccgcggcatgaccgtcgaggagacagtcgccattctagggagccacacgctggggggtggccattgcgtcaacatagacaccggtcgcgcgcgacgcgacaaggcatttgaggccctgctgcacctgcagtgcccaaagaccatgccgcctctgatcacagaggccgtcgtctttgtacccagcgacctgacgccgacatggttcgacacccactactaccggggcgccgccgcaggccgggggctcttcaacgtcgacgacgaggcctccacctacgcgcgcacggcggggtacgtgcggcggttcgctgaggacagggagggcttcttcggggtcttcgcctcggccttcgtcaagctcgctgggtttggcgtgctcaccggtgagcagggtgagatcaggaagaaatgcgacgtcgttaactactgatctgctagcattattttggtggtatatcgaaagataatattgtgattgtgaatttgtgattctactgtcatggcatggattgaataataagttgaaataatatc

SEQ ID NO: 12316 - DNA, 1748 bp, Zea mays
gacgagatcaggatcaataggaggactcttccggccgggttagacctcaaattacatatatgtaggtggaaacaacttaagtggacctgtgccttctgaaattgttcaatcatcagtttccttggatgtttcgtataactattatgttgacggatccctttctaacaatccttctggtcagaagcagttcataaattatcttggaacatcaattgatgcaagtggaagaatcaacagtggaaatcttacaatcctgaactgccttcgcatgaacgaatgcaacataaataatttaactaatcgtgcaacttccttcgctataaactgtggtggcaagcaagtggagtattcagatctaatgccaattatgttctctgaagactccactgatcttggaggatcaggctttcatgttaatgctactagtcattgggtagttagtcatgtgggttctgatccatttaacgaatccaccggtattgtaaatacaagtgatatttttgaaaccaacatgcaagagctctaccaaacagcaagaacttcaacaagttcgttgtggtactatgtggtaggtttagctaacgggaactacacagtccaactcttctttgcagagatagtcataactcatggacctggaaagcgcttatttgacattgatattcaggaccagaatatcaggaaggactttgacattactaaggaagcagggggttccagaaaagccactaacataacctacgaagtgactgttgataactccatactggcaatacatctgtattggagtggacgcggcacctgttgtattccatatgaaggagcttacgggccactagtttcagcaataaaagttacccattcccaagacccgaaaaccagtcccccacaagcaccacattctgattctgcccgagatgatgtaaagcgaagaggagtggttgcaggcattgcagcactttccatagctgctgcggtgatatcttcatctgttgtctacctttggtggaaatgggtttcacttgtgaagcgcccaatggcatgagttcgtcagatgtttgcatatagttgattctcccacaaatttccatgtcatgcgaaggactctatgtatttgtcttttagcgttggctgctagcaactagccaactagcatagccaagatgactgatgtacagttgacgttgcgatcacggttttaggtctcaagttttgtttcacgattattgtaacctaggaaattatctaagacattctgctgctaatatgttgtttgtttgttgatcaaagtgattcaaatcgcattgtgatatattgtttgtttgtcgatcaaagtcattgtaaaactattctcgcccgaatgtcacatttcacgtgttggccaacttactgatcgccttccagttgcagtgtgtgtatttgtttcgcatgagtagaaaggtccgatataactatctaaccccatattctttgttcgcgaaaatgaagcctacgacacaaatccggaagttttgatcactggttagtccagttcagctccgagtcaaaacatttcgttactcctcaccgagtcagagttattagataggctaacctgtaacaaaaactcaatggactaacaaaaatttgttattgtcttattcaggcaaactgaagcacgttcttgactaggcaatgtgaacccgtcgctaagcaacagaccgaccgggctacttacagccacagcacagatcaaacggaaaagggat

SEQ ID NO: 12317 - DNA, 983 bp, Zea mays
atttatgatggctgggctggctctcggagcaactctctccaatgagggctttccgtcattgatgccggtgcagaccgtttttcttcgccttgctctcaggcagcagctagctctttgatccctgttggattggatggaggtccgtggcagtgcacccagcatgaagccaaaggtggagccgccgttggaggcttcacacgactgggaggtgaccccgctgtccggcgacaaccccttcttcaccagcgtcatgcgcaagagccaagtccagaacccctttcagctggtcatcccggttcgcttccaccgccacctcccggaggcgcgcgcgcccgcggtgctcctctgccgcgaccggtcgtggacggtgagctacgcgggcgtcggcaagtggaagaggctccagggggcgtggagggacttcgcccgcgacaacgggctccgcctcggggacgcctgcgtcttcgagctccttgtgcccagtactgatgcaacccaaggagacggagacggcagcaaggatcagggggaggtggtgttccgtgtgcaggtgctccgcggcggcctgccggctgagatcacctcccggggcgccacctccgacgatccactcgtcattgtggactagatccaactgcggggagagtagtacgtagtagactagtagtggtgcagtgcagtctgtagaggagacgagacgctcaggagctaggtagcatcgtcgttgtattttgttgttgcccctgctctagctagctcgctggtcctcgtggatcttgtagccagtttctttctttcagctgcagaccttcctcttcctgtggacacggttgctccatcaccaagtgtgctgatgctaccagctttctgctgtgacagtacatagtagacgctatcaccaagtgtgctgatgctaccacattccagtagacgcggcatgcttgaagagatgtgttcaatgagcatcatcctttgtgtccatc

SEQ ID NO: 12318 - DNA, 1814 bp, Zea mays
ggcaccctggcatactgacttgccgaacttacggatgcattggcttcaatctatttccttgttattattggtacatttttcactagccggccgggacgatggtcgcatttgtgcggccgtgaggcctcgacgcctcgtccaacaggagccggcgacgtcgcccccttcgtcccctccgctgcgcccacgccacgaatccattccattcccattcctccccacgccgcgcgcctccataataccacaccgccacccccatgccgctcgcccaccaccacaatccccagccctcacgcgccattggaattgacattcgattcccagcgcagctatcgagctccctttccccgccttgttggcgcgcgttagagcgcgagagagaaccggctaacccccggcggcgaagaagttcatgaaggtgctgtgcagtgcatgcgaggcggcggaggcgagcgtcctctgctgcgccgacgacgccgcactctgcgcgcgctgcgaccgagaggtccacgcggcgaaccgattggcaggcaaacaccagcgcctgcctctcctcgcccccggcggccaaggcgccgccgccgtgtcgccgcccaagtgcgacatatgccaggaatgcgacgcctacttcttctgcctggaggaccgcgcgctgctctgccggagctgcgacgtcgccgtgcacactgccaactccttcgtctcggcgcaccgccggttcttgttaaccggcgtccaggtcggccaggagctcgagcctgacgacctctccctggagcagcgagaggcagaggcgtcgtctcccccgccggcgaagagcgagccgaccccgccgctctacagcgagagcgacttcggctgggcggccggcgccggcgccggtgccaccgggagcctcacggactggtcggccgtggaggaggagttcggctcccctgccccccgcctcgcggaggtggcgcccagggccacgccgaagcggactccgcgggcgccggctttcggtgccgggcagggccgcatcgccggcggggtcatggattggccactgggcgagttcttccgtggcgttagcgacttcaacggcggcttcagcttcggcgagagcggcaactccaaggccgacagcgggaagctcggggacagcgcgggtggctccccgtactaccgctcgtcggaggaggagcgggacgccaacgagctcttcggccaggtgccggagatccagtggtcggtgccggcgctgccctccccgccgaccgcgtccggcctccactggcaacacggcggccccgacagcggcgccttcgtgccggacatctgcaccccggacggcgccggccgctgcttcccgaccgccagtggcgccgcgaagcgccagaggaaccgctagctccgcgaggacacaggaggttcatactgccggtcgctatgttccagatcgttcttgcagctaagctaagcaacaggagatcacagtgaatgctcctattagtgaggagtacgtcgcaccgcgtcgtcgatcacatccctgatccaaggtgaaggccttgagctcgtgcgcctgtttaacggatgcatcagatctggacgatgctagaaacaacttgtgctagtgctacctagcctttgacttccaatgacgctttgaaagattgaaactgatgcgctaaccgatagcttagacattggacagtagtatgatgctgatgcttcgttttcttgtccgttcaatcaatgtaacaaagagaagttggggatgctgctctgcttccagattaccatggtgatatgctaactaatcagtttgcctc

SEQ ID NO: 12319 - DNA, 1454 bp, Zea mays
tggttcagggtccggattcgtttccgaatggtacacagcagcgagcagccgagcaccagcgatggcgaggcgcggcctaaaccgagtcttgcgcccctccacacgggacgacgtgacacagaggctgctgtctttgtgctctgagctctgaatttactgaactctgatgaaaccaagccgtggccgtggccgtggccgtggtcgtccgtcgtcgactcgccgtgtgactcacgaggccacgacggcatcgcgcacggaactcgggatcacataatacggcccgtagaattttcttggcccgcggaaaccattgaattgatggcccagaacgcacgagcctgcaaaacctcctgccctagtctcctctctgtctcacagcacagcccctgctttccccccaccgtcccacggccgccacgccgccacgcttcttcttccctttcccgtccaacctccaaccctgccggctgccgcggcggcggattaacacaataccttggcgagagacgtaatagtttctgaactcaccgcgctacgcccgatgtcggagacggcggcgccgatcggcctgtcatgggctcccaagcttccttcctttgcaacgaccagcggcggcagcaagatcgaccacgcgccggatccgagcaccgcgcagggctcgctctggaagcgcacgagcgagctcgtggacgggctgttcgtgcccccgagggaccctaggcagctgaataagctggctaggaagaacgtcaaggacaccgccggcaagggctggttcgacatgcccgcgccgaccatcactcccgagttgaagaaggatctcgagattttgcagctgaggcatgtaattgacccaaaaaggcacttcaagcgggcaggaaagtccaaggcccttcccaagtacttccaagttggtacggttgttgagcctgcatctgagttctactcaagtaggctgaaaaatagggaacgcaaggcaacattggtggacgagctgctatcagatcaatctcttaagagctacaggatgcgcaaggtacgggaaattcaggagatccgtacaccaggaggcaaccaaaagtggaagaacaagggcaagaaaacactgaagagggcgaaggataggagaaaatgagactggtgcgcccagctttgtgctccagttgtgagggaaccaaggaacgccttcaagtcgctctagtgcttttctctcaactttgcagtatagattctggttccagtgtagtgttgtggacttcatgatgaattgatttgtatttctataaattttataatattgctgtaacagcggaattcagaaatatgagttggtagactctttcaagttagctagcttcatatatgggagaagcactgtctcagctcatttttcttgctggccgccgtctgcttatgatcatatctacagtttcatctttcttttgctttaaaaa

SEQ ID NO: 12320 - DNA, 1108 bp, Zea mays
cattgggtacctcggcccccgtgggcctctcctgttgtttcccggccccctccttcctcccacggtcccaccatcccagggccgccgcgctgcttctctttcccgtcgcacctccaacgctgccgccgcggcagattaatccaacaccgggccgggatacgtgacaggtttctgagctcgcagctctacgccagcgatgccggagacggcggcgccgatcggcctgtcatgggcgcccaagcttccttccttcgcaacgaccagcggcggcagcaagagcgaccacgcgccgaacccgagcgctgcgcagggatcgctctggaaccgcgcgagcgacctcgtggacgggctgttcgttgccccgagggaccctaggcagctgaataagctggccaggaagaacgtcaaggacactgccggcaagggctggttcgacatgccagctccgaccatcactcccgagttgaagaaggatctcgagattttgcagctgaggcatgtaattgacccaaaaaggcacttcaagcgggcaggaaaatccaaggcccttcccaagtacttccaagtcggtacggtcgttgagcctgcatctgagttctactcaagtaggctgaaaaatagggaacgcaaggcaacattggttgacgagctgttatcagatcaatctctgaagagctacaggatgcgcaaggtacgtgaaattcaggagatccgtacaccaggaggcaaccaaaagtggaagaacaagggcaagaaaacgctcaagagggccaaggataggaggaaatgagactggcgtgctagccttgtggtccagttgtgagagaacagattggagaagtgaaccaaggagcgccttcaaataccccctctctcgatttgtgcggggtatatagattctggttccagtgtagtgtggtgaacttcagtaacatgatgaattgctttagatacttcaaaaaatgttgctgtaagtctgtaacacacatgtatggttttcagcccgtggttatcaattctgtcggttgggagcagccaaaaaaaagaagaaaggaggggggggaaaaaaaaaaaaaaaaaaaaaaaaaaaataaaaaaaaaaaaaaaa

SEQ ID NO: 12321 - DNA, 1066 bp, Zea mays
ggccgggggccgggatctctcacagcccctgctttcctcccaccgtcccacggccgccacgccgccgcgcttcttctccccctttcccgtccaacctccaaccctgccgcggcggcggattaacacaataatacctcggcgagatacgtaatagtttctgaactcaccgcgctacgcccgatgtcggagacggcggcgccgatcggcctgtcatgggcgcccaagcttccttcctttgcaacgaccagcggaggcagcaagatcgaccacgcgccggatccgagcaccgcgcagggctcgctctggaagcgcacgagcgagctcgtggacgggctgttcgtgcccccgagggaccctaggcagctgaataagctggctaggaagaacgtcaaggacaccgccggcaagggctggttcgacatgcccgcgccgaccatcactcccgagttgaagaaggatctcgagattttgcagctgaggcatgtaattgacccaaaaaggcacttcaagcgggcaggaaagtccaaggcccttcccaagtacttccaagtttggtacggttgttgagcctgcatctgagttctactcaagtaggctgaaaaatagggaacgcaaggcaacattggtggacgagctgctatcagatcaatctcttaagagctacaggatgcgcaaggtacgggaaattcaggagatccgtacaccaggaggcaaccaaaagtggaagaacaagggcaagaaaacactgaaagagggcgaaggataggagaaaatgagactggtgcgcccagctttgtgctccagttgtgagggaacccaaggaacgccttcaagtctctctagtacttttctctcaactttgcagcatagattctggttccagtgtagtgttgtggacttcatgatgaattgatttgtatttctagattactttaaaactgtaacagcggtattcagaaatatgggttggtacactctttcaagttagctagcttcatatctatactacctattaaggctgtaaggggtaggctgcctcccccggttctgccttcagccaatctac

SEQ ID NO: 12322 - DNA, 1885 bp, Zea mays
ctcgaggccggccgggaatttttcgagagtgagtggataggaggatatgcgcgacattggggaccctcgaggccggccggggcccacctttgaacgatagcctttctcactccgacacttgaaacacgttcatcaggagctcgtcctcaggcttgctagtagcttatattacctacctagctagctagctagtcaagactcaagatccatccatgcctgcaaacatgatctccaagatccttgagaagtcgtctgtccttccgctggtggacgatgttattgcacccatccatgtgaagaccgctggaggagctcctcggaccagtgtgctgcgcaatccgaacatggagaagcttcagaagggctacctgttcccggagattagcatcaagcgtgaagctcacctgaagaagtaccctgatgccaaggtcatcagcctgggcatcggcgacacaaccgaacccattccaagcgtcgtaacgtcagctatggccgagtatgtacttgcgttatccactccagaagggtaccagggttatgggccggagcaggggcaaatgaatctgcgcaaggtcatagctgaggaagtgtacccagacatggggattcaagagtccgaggtgttcatctcggacggagcgcagtgtgacatcgcccgcctccagacgctgttcgggcccaacgtgaccatagccgtccaagatcccaccttcccgggctacgtggacaacggcgtgatcgtggggcagaccggcagcgcggacgaggccggcaagtacgccggcatcgcgtacatgcggtgcgcgccggagaacacttcttcccggacctctcccgcgtgccgcgcaccgacgtcatcttcttctgctcgcccaaaaccccacggggcacgcgcgtcggcggcgcagctgcgcgagctggtggacttcgcgcgccgcaacggctccatcatcgtgttcgacacggcgtacgcgtggtacgtgtcgtcgtcgtcggaggccgctggcgacggggacaagatgaagccgcggtccatctacgaggtgcccggcgcccgggaggtggccatcgagatctccttccttctccaagttcgccggcttcacgggcgtccgcctcggctgggcggtggtgcccgacgagctgcgctacgcggacggctccccccgtcgcgcgcgacttcgaccgcatcgtctgcacctgcttcaacggcgcctccagcgtcgcgcaggccggcggcctcgcctgcctctccacggaggaaggccgggacgccgtgcgccgcgtcgtgggcgtctacaaggagaacgcgcgggtgcttgtggacaccttcgcgtcgctcggcaaggaggtgtacggtggcaccgactcgccctacgtctgggtgcgcttcccgggccgccgctcctgggacgtgttcgccgagatactcgacaagacgcacgtcatcaccgtgccgggcagcggcttcggccccggcggcgagggcttcatccgtgtcagcgcgttcaacagcagggacagggtgctggaggccgcagctaggctcaagaagttccttcctggactcagcgctgttccgctctaagctccacgtacagatcctgcacctgcatggctgatgatatacctgccccgtactgataatctacatcgataataacattgtgcctcgtactgataatgtacattggtacatggctaataataacattgccatgcgctgagacgcagccatagtatcggatcaaaaaaaaaaacaaaaaatggggcggtggggggggtgtgaatgagcaagtgtacaaggattcttttcgaacgatgcgtacaacgtcagaactcagaacgaaaagaccacttctattagacgacagtgaatgaccag

SEQ ID NO: 12323 - DNA, 1727 bp, Zea mays
gaatcgaaggccggccggggccggggaccccacaccaaaagaaaccaactaaaatcccaaaagagaggaaaggcacaaacagacggtacaaagaaagggacgctcgtctcgtctcgtcacgtgccgccgccatggctgctctgggccgtggcctgcccctcctcctcctgctcctcctcctcgccgtatcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcgccgacctcaccaacgacgagttccgcgccgcgtacctcggcgccatggtccccgccgcccgccggggagccgtcgtgggggagaggtaccgccacgacggcgccgccgaggagctgccggagagcgtcgactggagggagaagggcgccgtcgcgcccgtcaagaaccaggggcaatgcggaagttgctgggctttctctgcagtaagctcagtggaaagcgttaaccagatcgtcaccggtgagatggtgacactgtctgaacaggagctcgtagagtgctcgactgacggagggaacagcggctgcaacggcgggctcatggacgccgctttcgatttcatcataaagaacgggggcatcgataccgaagatgactacccttacagagccgtggacgggaagtgcgacatgaacaggaaaaatgccagggttgtgagcatcgatggctttgaagacgtgcctgagaacgacgagaagtcgctgcagaaggcggttgctcaccagccagttagcgttgccattgaggccggaggccgggagttccagctctacaaatcgggtgtcttcagcggaagctgcaccacgaaccttgaccatggtgtcgtcgcggtcggctacggcgccgagaacgggaaggactactggatcgtccgcaactcgtggggcccgaagtggggcgaggctggttacatccgtatggagaggaacgtcaacgccagcactgggaagtgcgggatcgcgatgatggcgtcctacccgacgaagaagggcgcgaaccctcccaggccgtctccaaccccgccaacaccgccggctgcccctgacaatgtctgcgacgagaacttctcgtgctccgcgggcagcacctgctgctgcgcgtttggcttcaggaacgtctgcttggtctggggctgctgcccggtcgagggcgccacctgctgcaaggatcacgccagctgctgcccgccgggctaccctgtctgcaacgtcagagctggaacttgctcggtgagcaagaacagcccactgagcgtcaaggccttgaagcgcactctcgccaagctgagcaccgcatgaggacctcgatctgggactgcccattgctttttctgactcatgggcgttcagatcaccaagagcaagatttcatagattatctatatgtttgtataagtactattaccgtcccatgaatccgctgtaaataactagtacctctgattaaaaggataatattatttgtcaaaaaaaaaaaaaaaa

SEQ ID NO: 12324 - DNA, 1816 bp, Zea mays
caatcacctctgtcgcatcattctcgaactcatataaagcacgagaccattacctagaacatcctaatcgaaacaccaaaagaaagaaaccaactaaaatcccaaaagagaggaaaggcacaaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcgccgacctcaccaacgacgagttccgcgccgcgtacctcggcgccatggtccccgccgcccgccggggagccgtcgtgggggagaggtaccgccacgacggcgccgccgaggagctgccggagagcgtcgactggagggagaagggcgccgtcgcgcccgtcaagaaccaggggcaatgcggaagttgctgggctttctctgcagtaagctcagtggaaagcgttaaccagatcgtcaccggtgagatggtgacactgtctgaacaggagctcgtagagtgctcgactgacggagggaacagcggctgcaacggcgggctcatggacgccgctttcgatttcatcataaagaacgggggcatcgataccgaagatgactacccttacagagccgtggacgggaagtgcgacatgaacaggaaaaatgccagggttgtgagcatcgatggctttgaagatgtgcctgagaacgacgagaagtcgctgcagaaggcggttgctcaccagccagttagcgttgccattgaggccggtggccgggagttccagctctacaaatcgggtgtcttcagcggaagctgcaccacgaaccttgaccatggtgtcgtcgcggtcggctacggcgccgagaacgggaaggactactggatcgtccgcaactcgtggggcccgaagtggggcgaggctggttacatccgtatggagaggaacgttaacgccagcactgggaagtgcgggatcgcgatgatggcgtcctacccgacgaagaagggcgcgaaccctcccaggccgtctccaaccccgccaacaccgccggctgcccctgacaatgtctgcgacgagaacttctcgtgctccgcgggcagcacctgctgctgcgcgtttggcttcaggaacgtctgcttggtctggggctgctgccctgtcgagggcgccacctgctgcaaggatcacgccagctgctgcccgccgggctaccctgtctgcaacgtcagagctggaacttgctcggtgagcaagaacagcccactgagcgtcaaggccttgaagcgcaccctcgccaagctgagcaccgcatgaggacctcgatctgggactgcccagtgcttttctgactcaccaagagcaagatttcatagattatctatatgtttgtataagtactgttaccgttccatgaatccgctgtaaataactagtacctcttattaaaaggataatattatttgtcacggatggagtttttcgagccccaaccaaaaaaaaaaaaaggggcggccaaaaaaaaaaaaaaaaaaaaaaaaaaa

SEQ ID NO: 12325 - DNA, 834 bp, Zea mays
  misc_feature (571)..(571): n is a, c, g, or t
  misc_feature (595)..(595): n is a, c, g, or t
  misc_feature (663)..(663): n is a, c, g, or t
cattgggacctcgagccggcgccggccgggaaggagagcacacaccgaccgaaccaaaaaaaacagagaatccaatagaaaggaacaggaaagggacgcccgtctcatcacgtcccgcaccccccgccgccgccatggctgccctgggcctgctcctcctcctcctcgccgtcgccggtgccgccaacgccgcggcgcccggcggcagaatgtccatcatctcctacaacgaggagcacgccgcgcgcgggctggagcggacggagccggaggcccggacgctgtacgagctctggctcgccgagcacggccgcgcctacaacgcgctcggcgagcgcgaccgccgcttccgcgtgttctgggacaacctccgcttcgtcgacgcgcacaacgagcgcgccgcggagcacggcttccgcctcggcatgaaccagttcgccgacctcaccaacgacgagttccgcgccgcgtacctcggcgccaggatccccgccgcccggagaaggggaaccgccgtgggggagaggtaccgccacggcggtggcgccgaggagctgccggagagcgcacnggaaaggggagaaaaaggccccgnttgcgccccgtcaagaaccccagggcagtgcgggaagttgctggggcttttctctgcagtaagctcangtagaaagcgttaaccaaattgttactgggtgagatggtgaccttgtccgagcaggagcttgtagagtgctcgactgatggaggggacagcggctgcaatggtgggcttatggatgccgcatttgattttatcataaagaacgggggcattgatactgaaagagactaccc

SEQ ID NO: 12326 - DNA, 1716 bp, Zea mays
ccgggacacaccgacctaacagaaaaaaacagagtccaaaagaaggaacagggaggtgggggaaaagcgcagggacaaagaaaggaaagggacgcccgtctcgtcacgtcctccacccccgccgccatggctgccctgggcctgctcctcctcgccgtcgtcggtgccaccaacgccgcggcgccgggcggtagaatgtccatcatctcctacaacgaggagcacgccgcgcgcgggctggagcggacggagccggaggcccggacgctgtacgagctctggctcgccgagcacggccgcgcctacaacgcgctcggcgagcgcgaccgccgcttccgcgtgttctgggacaacctacgcttcgtcgacgcgcacaacgagcgcgccgcggagcacggcttccgcctcggcatgaaccagttcgccgacctcaccaacgacgagttccgcgccgcgtacctcggcgccaggatccccgccgcccggagaaggggaaccgccgtgggggagaggtaccgccacggcggtggcgccgaggagctgccggagagcgtcgactggagggagaagggcgccgttgcgcccgtcaagaaccaggggcagtgcggaagttgctgggctttctctgcagtaagctcagtagaaagcgttaaccaaattgttactggtgagatggtgaccttgtccgagcaggagcttgtagagtgctcgactgatggagggaacagcggctgcaatggtgggcttatggatgccgcatttgattttatcataaagaacgggggcattgatactgaaggagactacccttacaaagctgtggatgggaagtgtgacatcaacagggaaaatgccaaggttgtgagcatcgatggctttgaagatgtgcctgaaaacgacgagaaatcattgcagaaggcagttgctcaccagcccgtcagcgttgccattgaggctggtggccgggagttccagctgtacaaagcgggtgtctttagtggaacttgcaccacaaatcttgaccacggtgtcgtcgctgtcggctacggcaccgaaaatgggaaggactactggattgtccgcaactcttggggtgcaaagtggggcgaggatggttacatccgtatggagaggaacgtcaatgccaccactgggaagtgcgggattgctatgatggcatcctaccctaccaagaagggcgcaaaccctcccaagccgtctccaacccctccaacgccgccgcctcccccggttgcccctgacaatgtctgcgatgagaacttctcttgcgcagcgggcagcacctgctgctgtgcgtttggtttcaggaacgtctgcttggtctggggttgctgtccgatggaaggtgccacctgctgcaaggaccacgccagctgctgcccgccgggttaccctgtgtgcaacgtcagagccggaacttgctcagtgagcaagaacagcccgctgagcgtgaaggccttgaagcgcaccctcgccaagctgaacagcgcatgagctcgtccagacatcatggatctggagaggaatgggaccgcccggagcttttcagactctgcgtcctgatacaagctttcatagataacattatattgtatatctaagtattacttggcgtcccatgaatccgttgtaaatatcaagctataatttctactatcttcgttctcaaaaaaaaaaaaaaaactaatttattgt

SEQ ID NO: 12327 - DNA, 840 bp, Zea mays
cgaggccggccgggtgcgcacacaccgaccgaaccaaaaaaaacagagaatccaatagaaaggaacaggaaagggacgcccgtctcatcacgtcccgcaccccccgccgccgccatggctgccctgggcctgctcctcctcctcctcgccgtcgccggtgccgccaacgccgcggcgcccggcggcagaatgtccatcatctcctacaacgaggagcacgccgcgcgcgggctggagcggacggagccggaggcccggacgctgtacgagctctggctcgccgagcacggccgcgcctacaacgcgctcggcgagcgcgaccgccgcttccgcgtgttctgggacaacctccgcttcgtcgacgcgcacaacgagcgcgccgcggagcacggcttccgcctcggcatgaaccagttcgccgacctcaccaacgacgagttccgcgccgcgtacctcggcgccaggatccccgccgcccggagaaggggaaccgccgtgggggagaggtaccgccacggcggtggcgccgaggagctgccggagagcgtcgactggagggagaagggcgccgttgcgcccgtcaagaaccaggggcagtgcggaagttgctgggctttctctgcagtaagctcagtagaaagcgttaaccaaattgttactggtgagatggtgaccttgtccgagcaggagcttgtagagtgctcgactgatggagggaacagcggctgcaatggtgggcttatggatgccgcatttgattttatcataaagaacgggggcattgatactgaaggagactacccttacaaagctgtggatgggaagtgtgacattcacagg

SEQ ID NO: 12328 - DNA, 842 bp, Zea mays
aagatgtgcctgaaaacgacgataaatcttgcagaaggcagttgctcaccatcccgtcagcgttgccattgaggctggtggccgggagttccagctgtacaaagcgggtgtctttactggaacttgcaccacgaatcttgaccacggtgtcgtctctgtcggctacggcaccgaaaatgggaaggactactggattgtccgcaactcttggggtgcaaagtggtgcgaggatggttacatccgtatggagaccaacgtcaatgccaccactgggaagtgcgggattgctatgatggcatcctaccctaccaagaagggcgcaaaccctcccaagccgtctccaacccctccaacgccgccgcctcccccggttgccccggacaatgtctgcgatgagaacttctcctgcgcagcgggcagcacctgctgctgtgcgtttggtttcaggaacgtctgcttggtctggggttgctgtccgatggaaggtgccacctgctgcaaggaccacgccagctgttgcccgccgggttaccctgtgtgcaacgtcagagccggaacttgctcggtgagcaagaacagcccgctgagcgtgaaggccttgaagcgcaccctcgccaagctgaacagcgcatgagctcgtccagacatcagggatcatcgatctggagaggaatgggaccaccgcccggagcttttcagactctgcgtcctgatacaagctttcatagataacattatattgtatctaagtattacttggcgtcccatgaatccgttgtaaatatcaagctataatttctactatcttcgttctcgaaaaaaaaaaaaaaaaaggggcggcc

SEQ ID NO: 12329 - DNA, 1597 bp, Zea mays
  misc_feature (1575)..(1575): n is a, c, g, or t
  misc_feature (1582)..(1582): n is a, c, g, or t
atcccaagtgtcgtccatctagagactatccgtgaaactgccactttgccaggcgggcgggttctgcggtcaacagagagaacagcactgtctccgtctatactcgtcaggcatcatcaccgccttctcccgaggctttcgagatggcggcggcggaagcttcgaggacttcggaggcccgccgtgacgccgtgttcgggcggtgggtcgtcttctcgccggcgcgctcgcgccgccccaccgacctcaagtcccacaaccccaccaaccctagcccgggcccaggggccgacgcgccgcccaagccgtcctgccccttctgcgccggccgcgagtccgagtgcgcgccccagatcttccgcgtgccgcccgacggctcgctgccgtggcggatccgcgtcatccagaacctctaccccgcgctgcgccgcgacgtggacccgccgccgcgccgcgacgtggacccgccgcctgtgccagaggcagagggggatgtctcctcggacgagcctggggagcgcgccgtccccggcttcggcttccacgatgtggtcatcgagacaccgcgccacgacgtgcgcctctgggacctggacgccgagggggtccgcgacgtgctgctcgcctacgcggagcgcgtgcggcagctcggggagcaccctgcggtgcagtatgttcaggtgtttaagaaccatggggcatctgctggagcttcgatggcgcattcacacagccaaatgttgggaactccctttgtccctccctctgttacaactcggcttaactgcatgaaggagatttttgacagatcagggaactgtagcctttgtgagattaggcccaaagatatcctgatcagtgaaacacctaatttttctgccattgttccttttgcagcatcatatccatttgagatatggattattcctcgacaacatatttcttattttcatgaaatagatcaagataaggcactggaccttgggtctctgttaaagactatgctgcaaaagttgtctaagcagcttaatgacccaccattcaattttatggtccacagcgcaccatttaagatttcatcatcctgcctgccttatacacactggttcctccagattgtgccccagttaagtgtagtaggtggatttgagcttggaagtgggtgctacatcaacccagttttccctgaggatgctgcaaagattctcagggaactcgactgctcagtctagtggtggtcgacgtctaaccttttaactagataggaacgagggatgtgttcctctgtacttttctcggaatcaaaaataccatgctaataatacaagcagacagttaacttgattatgtaacatcaggccctgctttggcgagggtgatctgctggggtatctttcttgcccttgcttcaaacaggaagcatgccaagttgggctttctttcttggccctgagattgatgttgcctgtctgtacagactacagagtggttaagaacagagttttcgtttgactgactaataagttgtttgatatctttttaaaaaaaaaaaaaaattatgctaaaaaaaaaaanaaaaaanaaaaaaaaaccaccc

SEQ ID NO: 12330 - DNA, 1339 bp, Zea mays
aataaagagtctcttagatatgatcttatcccttttagttacctcttacggcactagcgactaaaacaatttagtctctattttagttctatcagcaatttaaagattaaaataaagggagtaatttttagtctgtcaaatgaaacggcggggtcaaacaatttagaaaaaacggtcaaactcttttgcagctgtgcctgtgccccattgcgatttgcgaccgaccgaccaacccagcgtagggctcgctgccccaagtgacatgtgggtcccagcggtcagcgaaacagccccatcccaagtgtcgtccatctagagactatccgtgaaactgccactctgccaggcgggcgggttgtgcggtcaacagagagagcagcactgtctccgtctctactcgtcaggcatcaccgttcatcatcaccgccttctcccgaggctttcgagatggcggcggcggaagcttcgaggacttcggaggcccgccgtgacgccgtgttcgggcggtgggtcgtcttctctccggcgcgctcgcgccgccccaccgacctcaagtcccacaaccccaccaaccctagcccgggcccgggggccgacgcgccgcccaagccgtcctgccccttctgcgccggccgcgagtccgagtgcgcgccccagatcttccgcgtgccgcccgacggctcgctgccgtggcggatccgcgtcatccagaacctctaccccgcgctgcgccgcgacgtggacccgccgcctgtgccagaggcagagggggatgtctcctcggacgagcctggggagcgcgccgtccccggcttcggcttccacgatgtggtcatcgagacaccgcgccacgacgtgcgcctctgggacctggacgccgagggggtccgcgacgtgctgctcgcctacgcggagcgcgtgcggcagctcggggagcaccccgcggtgcagtatgttcaggtgtttaagaaccatggggcatctgctggagcttcgatggcacattcacacagccaaatgttgggaactccctttgtccctccctctgttacaactcggcttaactgcatgaaggagatttttgacagatcagggaactgcagcctttgtgagattaggccccaagatatcctgatcagtgaaccccctaatttttctgcccttgttccttttgcagcatcatatccctttgagatatggattattcctcgacaacatatttcttattttcatgaaatagatcaagataaggtatggagtgttttcaaatcagctagatatttcattttttactgaccaatagtggtttagacttgtgtatacgattatcactacatgt

SEQ ID NO: 12331 - DNA, 2049 bp, Zea mays
  misc_feature (347)..(347): n is a, c, g, or t
ccgggaagggagaccgagacatcgggatcagcccgtgctcagtgctgacgtcgtcactcaaatgctgtttcgtccccgtccgcccatgtccatctagaattcgatccagctgtccaaactacctttcccggcttggtcaatcctgtcgccttcggtccatctcacacagactccggccggcggctccactccactgccccgccgctcggtgccgtacgtcgtcgtgctccaccgcctctcgatgatccttggtttattgctttgctgcatagcttccttggctagctaggtctcgtttcatcagtctcgatctgctgctcgttggccgccggcggctacgagcatgngaaacgtacactacggacgacgcgctgacggccatggggtttggcaagttccaggcgcttgttcttgtgtacgcagggacgggctggctggcggactccatggagctcatgctgctctccttcgtcggaccgctggttcggcagcagtggaacgtctctgcccagcacgagagcctgctctccagcgtcgtcttcacgggcatgctcctgggagcctgttcctggggctatatttccgacaaatacggaaggaggaccgctctattgttctccgttactcttaccgctggagcagggttgacaagtgctctatctcctaactacatatccctgctggcacttcggtttcttgtgggtgtaggagttggtggcacgcatgtattttcgtcttggtttctggaatttgtccctaccaagaaccgtggtgcctggatgcttgtgttctctgctttctggaccatcggaaccatcttcgaggcttcgcttgcgtgggtcgtgttgtcaagactgagctggcggtggctgctggcgttcacctccctcccatgcttcgccttgctcgtgtttttcgtcgtcgcaccggagtcgccacggtacctctgcgcgcagaacagaatatccgacgcgacccttgttcttgagaggatgtccaggacgaacaaggccgctcttcctcccggagctctggcataccaccacacggaaacgcagctgggactgggagagagtacaacagacgacgcctccaaatccggttccggtggcatggctgccctgcgcaggctgttctcgcgcaaactgctgagatccacgcttctcatctggttcgtttggtttgcaaactcctttgcctattacggcctagtgttgctgacgtcgcagctgagtgacgcgaaccggaggtgcgcatcgtcgtctgctcacaaatctcaagcgcacgaaggaaacccgaatctctataaagatgtcttcataactagcttagcagagtttccggggctggttatttctgccattatcgttgattggcttggccggaaagctacaatgtggatcttgctgtttggatgctgtggcttcctcggacctctggctgttcatcagaaggagtcggtgacaaccgctcttctgttcggtgctcgcgcctgtggcatggggagctctacggtcttgtgcttatacgcaccagaggtgtacccaacatcagcgcgctccacaggtgttggcattgccaccgccatcggaaaaattggcggcatcgtttgccccctcatcgctgtcggcatgctgcggagctgccaccaaatgcaagccgtcctggtctttgagcttgtcctaggcctcgcgggagtagcctgcatcctcttccctgtggagaccaagggccgcgagatgaaatgacagacccttcacagcacccaaagcgaccactactttcagcggcgtacgttcgaacataaagtatttttgttgaagacgcgtactcagaaaattgctcaagctatatctttaatgaaatattctgagtatcctttttatcaattagttttttctaccctatgtctttttagttttcactattttgattagattttgttttctaattaaaatcttaatacaacctgcgtggagttagtttgctaacgcatgtgccatgatatggttacaggataatgaaaaacagttaaaaaaaaaaaaaaaa

SEQ ID NO: 12332 - DNA, 907 bp, Zea mays
cctcgaggccggccgggaaaaattcaaaaaaaaaataaaaaaaaaaaaaaaaaccttctagaattcgatccagtccaaaccgacctttcccggcttggtcaccctgtcgccttcggccatctacacagactccggccggcggctccactccactgccccgccgctcggtgccgtacgtcgtcgtgctccaccgcctcgatcctcggtttattgctttgctgcatagcttccttagctagctaggtctcgtttcatcagtctcgatctgctgctcgttggccgccggcggctacgagcatggaaacgtacactacggacgacgcgctgacggccatggggtttggcaagttccaggcgcttgttcttgtgtacgcagggacgggctggctggcggactccatggagctcatgctgctctccttcgtcggaccgctggttcggcagcagtggaacgtctctgcccagcacgagagcctgctctccagcgtcgtcttcactggcatgctcctgggagcctgttcctggggctatatttccgacaaatacggaaggaggaccgctctattgttctccgttactcttaccgctggagcagggttgacaagtgctctatctcctaactacatatccctgctggcacttcggtttcttgtgggtgtaggagttggtggcacgcatgtattttcgtcttggtttctggaatttgtccctaccaagaaccgtggtgcctggatgcttgtgttctctgctttctggaccatcggaaccatcttcgaggcttcgcttgcgtgggtcgtgttgtcaagactaagctggcggtggctgctggcgttcacctccctcccatgcttcgcctttgccgtgtttttcgtcgtcgcaccggagtcgccacggtacctctgcgcgc

SEQ ID NO: 12333 - DNA, 2957 bp, Zea mays
cgccgttaatccatgtggattgggtggtattgagtcggtttaattccatagcaagtcaaaatacatcccaatccatcccaatacacaccaatacacatggaattgaaataaccgaacaaggccttaaatggcttggtttgcatccgcccatgcaaaccaacttgattttaattcacttagttctctaaagaccccttaataaatgtctcatttaattaggttatacatatcccaagtctctaaaaatctttgaagagacgtcttatttaattaggttgcacatgttctaattgcgggtgggaagcccaatcaaatggcccatcaacacagcttcttaatttccgcctccagttcaagtgttgatggtgattggggcagccaactcaggagaagaccgggcggggccccggcccccgccgggcccccggtcccaacaaaaactgaccgctactcggcgtaggctaaccaaaccaaaccccaccaggccacccaagcgcaaagcgctagcggtcgaactcgagcccaatccagcggaaacccccaaccctagctcccgactcgagccgatcgaccccgatccgatctaatgttccccaccgtcgacgagccctccgccgccggcgccatggtctcgtcctccttccctgacgccgacgcctacggcaacggcgactccgacggcctcgacttccccgtcgaccccaaccccaaccccgtcttctcctccccggccgctgccgcggcccccgggtccgctggcgcggctggggagcggcgccagctgttccagcgcctgtggacggacgaggacgagatcgtgatcctgcgcgccttcgcggagttcacggcgcagcgtggcacctccttcgcgtcgcaccagtacgacaccacccccttctacgaggacatgcgccgccgcctcaacaccggcttcaccaagaaccagctcgccgagaagatccgccgcctcaagcgcaagtaccgtaactgcgtcgagcgcctccgcgtcgccggctccggcttcaccttccgctccccgcacgagcaggccatctttgagatcgcccgcaccatctggcgccccgcctccgacaagcacggccgcgactccgacgacgagggcggcggcggcaacgtccacgacgccaccttcgcccccttcgccatcgacgccgccgccaacggtgagtccgccaagtcttccaggccacgccgtggccggcgccgccgcacgggcgacttccccgccgacgcggtcgcgctgccgccggcgcccatgccgatgcaggtgatgaccgaggacgcgctcccgtcgttcccgcaggcgactgcggcggcggtcatgaacgggggctgcggcctcatcgtggacccagcctctggtctgccaaccgcgctgtcatcagctgcggcggcggcaacggccgtgtccggcggcagcaccacggagaaccccatcctcacggcgctgttcaaggagatggtacgcgcgatgctgagcgtcgtcggcagcggcggtggcaccacggcacttcaggggctggagccaccgccccctatcgcgggggtgccgatggaaggggagaagtggcggcagcagcggatccgggagctggaggtgtacctgcgtcggatggacctgctgcaggaccaggccagggcggcgctggaggaactcaggtccgcgccgcacgccgggggcatgaacacttgattgtcttgggttcagcagctcctccagcgtcgcgtcttcttgcagatagcgcatcgtccataaccattagaaagaaagggtcatcttactggtaggtttctctaggctcgagcagcagtagaacaaggtgttttcgtctgtaatcctgattttctgtctgcgctgcagactagccgcgcgtcgtcgttcttatttatatagagcaactggtataaagagcttcctatcgtgccctatttatcctatttaaaatttatatacaaaagaatgtgagatgaggtattgcactttgcaaacagttgtaacagtcacatcacatgagtacatgatactgtctgaagactgacgaaaaaacgaagccatactttggtcctcggagtcggagcatcgtcgtgttcagcaaacctagtccttaccatggatggactcatgtggtgctttcacttgatgcaaatgagcagaagctgtaggcctttgagctgatgaatgagcagaagctgtagtctttgcagaaccaaccaaatgtggacgtgtcttctgtacatacatctgaagtggcttcaacccatgtcaattggctgcatttcccttgttactgcctgttgtaaactcagaatgaagcttattatgtgcttcagatcatctgaaattctgagacatttgactacattgaccattactggcaccaaacttaagtgttgcatttcttggtctagaagagcaggtctggtgcaatggtaggagttctcgctgaatcaacagatcacaggttcaaagcagtctttctgtatttgggagaagacttaacacttttatctctgcttttatctctcctccagagcccactcatgtggaggcctccggcattgagagcctatcatttttacagtcacacataccataatcgaaacgaaccctgctgctatgtgagctcttcaaggtatctgaactgttcagatgcagcttgcaacctagcacacttcttgcaggcggcggctctggtagcagcagctctcctgctgtaaggttttcccagagctagaccgaccatcttagctgcagctccacgcgcccgggatgatgcattgggaggttgtactagcaggatatcagagagttccattcctaagactgcgaaggagatcagagaggttatgccccactagaaaagtaagtagttgaccttgcccggtggaggattgttgaatgcctatgacaacatgtgacaagctcctctaaggcg

SEQ ID NO: 12334 - DNA, 2662 bp, Zea mays
attctcaaattatagcccggtaaagaaacatgtgcccctattctttttaggctcctattcttactaggctctagagaatacagtaaaaagggggagtgtcatccaaaattatatgcaaggagaagattgatgtaatggatgagttcaaaggtttgcgtttaagacattgaggggagcagggactaaaatttagtctatatcggatatctaaatattagttaattataagtctaataatggcataaaccatggataattaatgccattgacgatgtgacatgtgagaaataaaaattacatagagttataagtacgtatgtgttcaatgcttcaagcacttcagactaaaagagagagttgtgaaatctgagagcatgggtgtaaagtattttcacattttctatgcaatactatgatttttagtaataccataatattttatagcataagacgtttgtttgcattcctaaaactatattagataccctgatattttttagagtattagaaactctaatctaatccaattttttcgtggcatagctatcttttggctaatcaatatcaaacatttgatttggccaggactaaatctaatccgtggaatcaaacggagcagagtagggatgcggtggagggggcttggtagcgtgttaccccggtccaaccataccgctagtccgccgcgtaggctaaccaaaccaaccaaggttccggccgggaaacccacccgggccgccgggcgcaagcggtcgagctcgagctcgagcccaatccatcggaaacccccaaccctagcctccgactcgagccgatcgaccccgatccgatctaatgttccccaccgtcgacgacccctccgccgccggcgccatggtgtcggcctccttccctgacgccgacgcctacggcaacggcgactccgacgacctcgacttccccgtggacccaaaccctaaccccgtgttctcctctcccgccgcccccgcgtccgccggcgcggccggggagcggcgcccactgttccagcgcctgtggacggacgaggacgagatcgtgatcctgcgcgccttcgccgagttcacggcgcagcggggcaccgccttcgcgtcgcaccaatacgacaccacccccttctacgaggacatgcgccgccgcctcaacaccggcttcaccaagaaccagctcgtggagaagatccgccgcctcaagcgcaagtaccgcaactgcgtcgagcgcctccgcgtcgccggcgccggcttcaacttccgctccccgcacgagcaggccatcttcgagatcgcccgcaccatctggcgccccgcctccgacaagcacggccgcgactccgacgacgagggcggcggcggggcggcaacaacgcccacgacgccaccttcgccatggacgccgccaccttcgccatcgacgccgccctcgccgccgccaacggggggtccgccaagtccccgacctcgaggccacgacgtggccgccgccgccgcacgggcgacttccccgccgacgctgtcccggagacgacgctcgcgctgccgccggcgcccatgccggtgatgaccgaggacgtgctcccctcgttcccgcaggtgactgcggcagcggtcatggacggcggctgcggcgtcagcgtggacccagcctctgggctgcctgccgcgctgtcaacagctgcggcggcagcggccgtctccggcagcagcaccgcggagaaccccatcctggcggcgctgttcaaggagatggtgcacgcgatgctgagcgtcggcgtcggcggcagcacggcgcttctggggctggagccgccgccccccatcgcgggggtgccgatggaaggggagaagtggcggcagcagcggatccaggagctggaggtgtacctgcgtcggatcgacctgctgcaagaccaggcgagggcggcgctggacgaactcaggtccgccccgcacgccggaggaatgaacacctgatgatcagcagctccagagtcgcgtcgtcttgcagatagcgcatcgtccataaccatgagaaaagatcatttttaccggtagatttctctaggctcgagcagcagcagcagaaggggagcttcgtctgtaattctcattttctgtctgcgctgcagactaagccgcctggtcttctcttattttatatataataacttatataaagattgtcctatcgtgcgtgcctaatgtatcctatttaaaatttacaaaagaacgtgacctgagctactaatgccagtcttttcactgcacatggaatatcttcgcatcgctagctgttgatgcaaccagacagtagccaagggtatcgaacagctccccaccccagatacaggagacgcctcatggttgctagtaattggatacaatgaatattggaggaaagtttgagtgcatcaaagaatttcgcatcactctaaaaaaagtgatgctaaacggttgtatgatagtcacatactcacatgacactatctcagacttatcagctagtagcatcaactgtctatagggacaaaatattgtagaaaccgtatccgcagctagattaaagccgcaacaaacatggtggatgatactttggtcctcggagtcgaagcatcgtcgtgatcaacaatgaatatcagagagatgac

SEQ ID NO: 12335 - DNA, 1821 bp, Zea mays
gccggccgggccggcacggatcgattctcctccctgccgcgcatgcgcgtcaatggcgccgccagtcgccggcgtcgtgcgtcttgccgcggcctcccgcgtattagttctgtccctctacctgctcgcccgcctcctcttgtgcccctacgacacctccgctactctccacccaccgcctctcctcgttccccccggccccgccgcccaacacgcccgtctccgccgctatctcgtcgctggccgtgtgggacggtgtccacttcgcccgccccgctgagtgcggctacgagtacgagcagtccttcgccttcctcccactcctccccgcctccctcgtgctcctcgcacgaccgttgttcgcgccgctagtaccgatactagggtacagggccgtgctcgtgctctccggctatgtcctcaacaacgtcgcattcgttgctgctgcggcctacttctacagattgtctgtgctgattttgaaggaccagaaagctgcttaccgagcatctgttctgttttgtttcaaccctgcttctgtgttctactcatcattgtattcagaaagtctttatgcacttttttctcttgggggcatcttctacgtgttttccggccttgctacaagcatatgatgctactgtacaaaagaaaaggcccttgttggcaattcaggcccttgtggctggagctttgcgctccattttcatatttctacctttctttgctttccaagcatatggatatttgaacatatgtgtacatgggagctcagacgaattgaggccatggtgcaaagcaaaagttcccctattgtatggcttcatccaaagccactactggggagttggtttcttgaggtacttccaagtgaagcagctgccgaactttctcttggcctcaccagtgctttctctcgcggtttattctattgtccattacgcaaaactgcttcaccggtgtttccagagaactagcgtccacacgcagattatcactgctctagagaaaaggccagttgtgtcgtatagaagatcagatgacgcgacaattttgagtgaacctcctgctggactcaccaagaaagcacaagggagctctaaggctaaacagagaaaaccagttgctaccgagatagctcctgcgacattccatgacagtaccacgccagctaaccaaaacatcgaagaggatcaggacgcgtgctccatactactactcccattcgttctgcatctggccttcatggcattcacagccttgttcgtgatgcacgtccaggtgtccacacggttcctatccgctagccccgcggtttactgggctgccgcgcacgttctggcttctccgagccgcgccaacagacgatggggctacctgatctgtgtctatttcatcgcgtacattcttctaggtagcctgctcttctccaacttctaccctttcacgtaacgtaagaacggcggagtggggggtgtccccggatgcgttatccagtagcgagccactcccgcagtggatggctcatctgtttatcaggtggattatctcgaccagctttgcctgaaggtttccctaggttggtaggtgcttccctggttcagtaattgagcgttggctactcgaatcgcttggaatctgctgggctgattcggttatcctgtggccacgagctttttcatatgttttcttagaatcagaagttggagagcagaagacataataacatcagtcccaactcccaactcggaagatcacaaacttgttcttctcagagcaacatgtatgcaaacatcttgggggggtcgatcttctccaatt

SEQ ID NO: 12336 - DNA, 823 bp, Zea mays
  misc_feature (662)..(663): n is a, c, g, or t
tccacgttccaactttattgtgtttaaacacctagaacatccttctcgaaaaaattttgagtgaacctcctgctggacgcaccaagaaagcacaagggagctctatggctacacatagaaaaccagttgctaccgagatggcttctgcagcattccatgacgccacgccagctaaccaaaacatcgaagaggatcaggacgcgtgctccatatccatactactactcccattcgttctgcatctggccttcatggcattcacagccttgttcgtgatgcacgtccaggtgtccacacggttcctatccgctagccccccggtttactgggctgccgcgcacgttctggcttctccgagccgcgccaacagacgatggggctacctgatctgtgtctatttcatcgcgtacattcttctaggtagcctgctcttctccaacttctaccctttcacgtaacgtaagaacggcggtggattttctcgaccagctttgcctgaaggtttccctaggttggtagtggtaggtgtttcctttggttcagtaattgagcgttggctactcgaatcgcttggaatctgctcggctgatgtatcttggggggtcgatcttctccaattattcaatggcactatctatctccatttgacgagggaacgtgannaaaaaaaaaaaaaaaaaaaaaaaaaaagaaattttaaaaattaaaaaaggttttcgatccggtcacctcggggggggcccgaacccatccccccaaagggccgaataacccgcccccggccccgttttaaaggcgggagtggaacccctggggtctccat

SEQ ID NO: 12337 - DNA, 936 bp, Zea mays
cctcgaggccgcccgcatgagtatctgggacaggtgccaatagctgaaatctctccacggatcgattctcctccctgccgcgcatgcgcgtcaatggcgccgccagtcgccggcgtcgtgcgtcttgccgcggcctcccgcgtattagttctgtccctctacctgctcgcccgcctcctcttgcgcccctacgacacctccgctactctccacccaccctgcctctcctctttctcctcttccccggatcccaacacgcccgtctccgccgctatctcgtcgctggccgtgtgggacggtgtccacttcgcccgccccgctgagtgcggctacgagtacgagcagtccttcgccttcctcccactcctccccgcctccctcgtgctcctcgcacgatcgttgttcgcgccgctagtaccgatactagggtacagggccgtgctcgtgctctccggctatgtcctcaacaacgtcgcattcgttgctgctgcggcctacttctacagattgtctgtgctgattttgaaggaccagaaagctgcttaccgagcatctgttctgttttgtttcaaccctgcttctgtgttctactcatcattgtattcagaaagtctttatgcacttttttctcttgggggcatcttctacgtgttttccggtgctaatactgttgcagtgataatgctcgctctgtctggttcagctaggtcaaatggagcacttaatgctggctatttctgttttcaggccttgctacaagcatatgatgctactgtacaaaagaaaaggcccttggtatgttccacttcagttattattatgagtaacagtatttggcatgaagagactaaatgacataccatattgcacggattatattttgtttccataagaagcaatcagcaaaaacatgtttgttcaaaaaaaaaaaaaaaa

SEQ ID NO: 12338 - DNA, 1041 bp, Zea mays
ttgggtacctcgaggccggcccggccgggagctagcaaatgaaccagccacaataatcctgatcctcgatcttgcgttgtcgtcgtcaaagagacgactcgatcatcatctcatctcagagcacgcaagcaacaatggttactagcatccgcgtcatagttggaatcataggatctgtagtctgtgtgctcctctacgcggttccagtgctgacgtttaagagagtggtgaaggaggccagcgttggggagttctcgtgcgtgccatacatcctcgcccttttcagcgccttcacctggggctggtacggcttccccatcgtcagtgacgggtgggagaacctgtcgctcttcggcacgtgcgccgtcggagtgctcttcgaagcttcgttcgtcgtcatatacgtatggtttgcgccgagagacaaaaagaaatctgtcgtcctaatggtgtctctggttgtggcaacgctctgcgtcatcgtatccttgtcaagcttcgtgttccacacgcaccatacgcgcaagctatttgttggtagcattggtatagtcacctccatatccatgtacagcgctccgcttgtagccgtgaagcaagtcatcctgaccaagagcgtggagttcatgcctttctacctgtcgttgttctccttgctgaccagttttacatggatgctgtacggcatcctaggaagggatccctatcttacggcaccaaacggcgccgggtgtttaactggacttcttcagatcgctgtgtactgcatttacagcagaagcaatcggccgccgaaagcagtcaatggtgcgacaacaactagccgtgaagatgcaaatgattgcaaggtttgacttcgagagccttaagaaactgcctctctccgacgctagtaggaggttgatactaaagtggcgctattcgcgtgtgcagttattattattatctaattgtaaactgctccagtgttctttctttttgttatctaatcaatgggcatagcacctgcaaccagtaattaaccaaaaaaaaaaaaaaaaa

SEQ ID NO: 12339 - DNA, 1006 bp, Zea mays
ccggatcgatcttgcgttgtcgtcgtctaacagacgactcgatcatcatctcatctcagagcacgcaagcaacaatggttactagcatccgcgtcatagttggaatcataggatctgtagtctgtgtgctcctctacgcggttccagtgctgacgtttaagagagtggtgaaggaggccagcgttggggagttctcgtgcgtgccatacatcctcgcccttttcagcgccttcacctggggctggtacggcttccccatcgtcagtgacgggtgggagaacctgtcgctcttcggcacgtgcgccgtcggagtgctcttcgaagcttcgttcgtcgtcgtatacgtgtggtttgcgccaagagacaaaaagaaatctgtcgtcctaatggtgtctctggttgtggcaacgctctgcgtcatcgtatccttgtcaagcttcgtgttccacacgcaccatatgcgcaagcaatttgttggtagcattggtatagtcacctccatatccatgtacagcgctccgcttgtagccgtgaagcaagtcatcctgaccaagagcgtggagttcatgcctttctacctgtcgttgttctccttgctgaccagttttacatggatgctgtacggcatcctaggaagggatccctatcttacggcaccaaacggcgccgggtgtttaactggacttcttcagatcgctgtgtactgcatttacagcagatgcaatcgaccgccgaaagcagtcaatggtgcgacaactagccgtgaagatgcaaatgattgcaaggtttgacttggagagtcttaagaaactgcctctctccgacgacgctagatactacagtggcgctattaattcgcatgtgtgcagttattattatctaattgtagccttcgctagctgtgtctgttgtaagactagtttgttttacttggggcaaatcaatgggcatagcaccagcaaccagtaattaacaaaaaaaaaaaaaaaaaaaaaaaaaaaaaaaa

SEQ ID NO: 12340 - DNA, 2198 bp, Zea mays
ctaacaaccgaacacggcctaatttgttctgaggttcaggacggaaaattaacggacgagcactacgtccatggatggaccggtccgcgtagccaccaccccttgcgctaccaccatagcggtgccagaggtcgcaggttgcaacgtaatacttttccactagcaggccccatttctttccaatttgttagcagccggcagtcaccttgcctattacttagctgtataattaaaaaatcatatagcctgatatgatgggtaattgacaacgtactcgtaaactaaatattagctggctacttcccttgcaacgattggttgtgttgtgtggctacaaatacgaatacacagcagccctctgctcccggccccggcgcattttgtaaaggtacgaggagcaaggtgaggcaccaccagtaccaaccgggctccgagttcatcacgcacgcatggaaggctcggcggcacaggcgccggggaagaccgtcctgagggtggtggcgatctccggctcgctgcgcagggcgtcggccaacaccggcctcatccgcgccggtaagctcgctccatgcccacccccaccacgccttatctaaacattatccgaagcttcgagcgccagccagcgttctgtgtgtgtggcctgcagtgtgccgtgccgctgccgggcaaactaataaatttaacctaacgcgcccgcgcccgcgcgcagccgcggagatctgcagggagtcgatcccggggctggaggtggagcacgtggacatctcggagctgccgctgctgaacaccgacctggagggcccgggccccggcgcgttcccggcggccgtcgaggcgttccgcggcaaggtgcgcgccgccgactgcttcctgttcgcgtcgcccgagtacaactactccatctcgggcccgctcaagaacgcgctggactgggggtcgcgcccgcccaactgctggggcgacagggccgccgccatcctcagcgcgtcgggcgggtcggggggcagccgctcgcagtaccacgtccgccaggtcggcgtcttcctcgacctccacttcgtcaacaagcccgaggtgttcaccagggcgcaccagccgcccagcaagttcgacgacgacggcaacctcgtcgacccggacaccaaggaccaggtcaccaaggtgctcctggcgctgcaggctctcgcgctcaggctgcacctggggaagctcgctgttgctgcacactcttcttgaacgtcgtcgtcgtcgggggtgcactaaactacactacacatcgtcgccgagctccaaatgccgtgccgtgtccgtgtgtgcgcgcttcaataaattctcggcgtccaacttttaatgagtgatgcacaatcgtgttcatttgtgagatgccctgatcgaatcgatccgtttgcgttttgccacgatcatcaaagaccaaaaggttagctggttgaaaacaaattggctttgtcatttgctaggagatactgcgacttgagtaccctgcgtgcattcttggtctcatcgaagtcgccttgtaatttgactcagagaaagaagaagaggaggaggaagcttccgtgctgacagtaccaacatcagcaagcaacctcctccaagaacaggggaaacagccacgccattgctgccgtaagcaagaggtcgacaggtgcgtgcgttacgtgcgtgctcgtcatgtatattcatgccgtcagagtcaacctccggcgtcaaccggttcctgttgcatcatccctcggttcagtgatacggagtagaatcgaacgtatctactgtgttctaataagttaaaaggtggttgatctcactcagggagttaatatagatcctcactaacttataagatagagtccaatgtacactatccctaaaattatttaaaaaaaaaagggagatatacgtgctacacgcgcgttcactcgccctgccaaagccgccatggccaagacgttccgtgaagggggcgtgatgtgctagaattcaatctcatcaatagcgtctaagttcttcatgcttactcttttctcgcctataataaggacatgtcacacacacacctccctcttagatcacattctctgacaactcgtgtattcctgcatacaagacatctcgctttcttcctcaaagcttcctgatattaccgagaagagcatctccatcaccaaggctctacg

SEQ ID NO: 12341 - DNA, 916 bp, Zea mays
aaacgtactcgcaacgattggttgtgttgtgtggctacaaatacgagtgcaccccccccccggccgcggcacctgcgcattttgtaaaggtacgaggagctaggtgaggcaccaccaccaaccgggctccgactccgagttcatcacgcacgcatggaaggctcggcggcacaggcgccggggaagaccgtcctgagggtggtggcgatctccggctcgctgcgcagggcgtcggccaacaccggcctcatccgcgccgccgcggagatctgcagggagtcgatcccggggctggaggtggagcacgtggacatctcggagctgccgctgctgaacaccgacctggagggcccgggccccggcgcgttcccggcggccgtcgaggcgttccgcgccaaggtgcgcgccgccgactgcttcctgttcgcgtcgcccgagtacaactactccatctcgggcccgctgaagaacgcgctggactgggggtcgcgcccgcccaactgctggggcgacagggccgccgccatcctcagcgcgtcgggcgggtcggggggcagccgctcgcagtaccacgtccgccaggtcggcgtcttcctcgacctccacttcgtcaacaagcccgaggtgttcaccagggcgcaccagccgcccagaaagttcgaccacgacggcaacctcgtcgacccggacaccaaggaccaggtcaccaaggtgctcctggcgctgcaggctctcgcgctcaggctgcagctggggaagctcgctgttgctgcacactcttcttgaacgtcgtcgtcgtcgggggtgcactaaactacactacacatcgtcgccgagctccaaatgccgtggccgtgtccgtgtgtgcgcgcttcattaaattctcggcgtccaacttttattgagtgatgcacaa

SEQ ID NO: 12342 - DNA, 1707 bp, Zea mays
cattgggtacctcggggccgcccgcatatactttctgacctcttctggaatcctgcgacgaggggaccgaaatggcctcgtcctcctctgactccggccgcatcgccggaaccctagccttgcgtacgagctcggccttagcggcggcgtcgctaatcccggggctcccggacgacgttgcagctgtcattctctgcctgctcaccttccccgaccagtcccgcctccgcgccacctcgcgcgcttggtgcttgctcctctctgcggctacgctcctcccgctccgccgtagcctccgtctcccgcgccgccaccttctctgcctcttccccaccgacccatccctcgcctccccgatcctgctcgaccccgccgcacctaccacctggtggcccctcccgccgctcccctgttcgccgcagctttacggcctcgccaactttaccgccctcgccgttggccgccacctctacgtcctcggcgggtcttgcttcgacgcccgcagctaccctttggggcaaccctccgcctcggcggcggtctaccggcttgaccttgccaactctcgacattgctgggaacgccttcccgacatgcagctcccgcggggaagcttcgcgtgtgcccacgcgcccagtgctggcgggctcctcgtcgccggtggcgggtcccgacaccccatgttcccctccaacggcagccgcaccggcagcaccgagtggtatgatgccaccacgcactcgtggcaccttggtgcctcgatgcctcgtgatcgggctgggtgtgttgggttcctggcacgcggagcaggggatggtggtgaggatgagttctgggtgatgggcggctatgatggatacaccacgttgggaggagtggtgccaaatgacgtgtactgtcgggacgcggtggcgttgggactatggagtggtaagtggagggtgattggagacatgtgggaggaaggggagaggaggcgtcttggtcccattgcagctttatctgcagatgatggaagaattaccgaggtgttcatgctagacggcaatgatgtcttcaggtatgacttcgcttcaaataggtggctgaaagaggcaaccacgagaagaaagatcccaaacactgaatcttgcggcttcgtaccaatgaacggggaactgtacgtgctcagatctgcaaaagttcgtgttgaatcctctggtccgtggaggcagctgaagaagaagctggctatggagtttcaggtgtacaaccctggggcaaagaaatggagagtgctcaccacgtatccacctgttgatgcacccattgatttcaggactgcagctctgtgtacagttgagttgtagatccattagtagtcaccattaactgtacatattcaggtggcaagcgcaacaatcgattgcaaatatagacatgaaaatgcctaatgcttcaagtgctcccagcagatagtttgttctagcgtgtttatatacagtagagataacattctggagtatatcgcaagaattggtgttttttggtgctgaatgtgattgctgctaacaagatatgaattgtaccagcctgttattattgcgtcagaatcactgtttagctacacagccgtttcgcctatttacatgccgtgtaactggtgtacattggattgtgtctgtttaatcaactgtttatgctgcttaatcattgtttagttcattt

SEQ ID NO: 12343 - DNA, 1665 bp, Zea mays
ctagttctagatcgcgaacgcgaccggcctcgtcctaccaccggtcgatagggatctcggcctcgtgccccaccgccctctgtctgcccatcaccggatcacccctcgtccccacccagcgcgtcacgggcacgagctcgagccctcgtaccctcgcgtccgcgctctccctccctcgctcgccgcgctccgatcgaactcccgtccccgcgtggaggagagcagggccccacgagggccctctcgcgcggcgaccccgtggcgttcctgcgcggctgcttctcgttcgggtcggcggggcggaggcggcccaaggcctcgcccttgccctccccgccgcgcctgaccgcggctgcggcggcagcggacgacggggccaagatgaagggcctcttcaagtccaagccgcggacgcccgtggacatcgtgcggcagacgcgcgagtgcctcgtctacctcgacctccactcggactccaggagcggcgatgccaagcgcgaggagaagatgacagagctaagcaaaaatatcagggatatgaagtctatcctttacggcaatggtgaatcagagcctgtaactgaagcatgtgtacaattgacccaagaattcttcagggagaacactttacggctattaatcatacatcttccaaaactaaatttggagactaggaaagatgctactcaagttgttgcaaacttgcaaagacagcaagtatcctcaaagatagtagcgtctgagtacctagagtcaaataaagatctcttggacattttaattttagggtatgagaacatggacatcgctttacattatggtgctatgttgagggaatgtattcgccaccaaagcattgcaaggtatgttttagagtctgaacacatgaagaagttctttgactatatacagcttccaaattttgacatagcttctgatgcttcggctacctttaaggaactgttgacaaggcataaagcaaccgtggctgaatttctctccaacaattatgattggttctttgaagaatttaactctaggttgctgtcatcaaccaactacataacaaaaaggcaagctatcaagttgttgggagatatgctgctggatagatcaaatgctgcagtcatgatgcgctatgttagctccaaagacaaccttatgattttgatgaatctcttaagggattcgagtaaaaatattcaaattgaagcatttcacgtgttcaagctgtttgctgcgaataaaaacaaaccgcctgaggtcgtgaacatactggtcaccaatagaagcaagctacttcggttttttgctggattcaagattgacaaagaggatgaacagtttgaagcagacaaggagcaagtcataaaagaaatatcggcactttgagtatgcttgaggttgtaattagtttttgtgatgaattttcttttgctaagaaagtgcatgtgaaataataaacttctgtgtaatattctgttggaccaagaggaacaatgttactcattgactctagtacttggatactgccagcaaatgtgataattttaatagattttgtggttatccatgcccttattttatgggcgtgttccactgatacaaaaaaaaaaaaaaaaaagactcgagatccaattccatccatagtactctgtctagcag

SEQ ID NO: 12344 - DNA, 1556 bp, Zea mays
tggtgggctctcttggctgggccggcacccctcttcccgtcccttccatcacgtattcacgggcacgagctcgagccctcgtaccctccttcccttcctcgcgcgcggtcctccgatcgaactgccggacccgagcggaggagagcagggccctcccgagggccctcccgcgcggcgaccccgtggcgttcctgcgaggctgctgctcgttcgggtcggcggggcggaagcggcccaaggcctcgcccttgccctccccaccgcgcctgtccgccgctgcagcggcagcggacgacggggccaagatgaagggcctcttcaagaccaagccgcggacgcccgtcgacatcgtgcggcagacgcgtgagtgcctcgtccacctcgacctccactcgggctcccggagcggcgacgccaagcgcgacgagaagatgacggagctaagcaaaaatatcagggatatgaagtctatcctttacggcaatggtgaatcagagcctgtaactgaagcatgtgtgcaactgacccaagaattcttcagggagaacactttacggctattaatcatacatcttccaaaactaaatttggagactaggaaagatgctactcaagttgttgcaaacttgcaaagacaacaagtatcctcaaagatagttgcatctgagtacctagagtcaaataaagatctcttggacattttaattttagggtatgagaatatggacattgctttacattatggtgctatgttgagggaatgtattcgccaccaaagcattgcaaggtatgttttagagtccgaacatatgaagaagttcttcgactatatacagcttccaaattttgacatagcttctgatgcttctgctacctttaaggaactattgacaagacataaagcaaccgttgctgaatttctctccaacaattatgattggttttttgaagaattcaactctaggttgctgtcatcaaccaactatataacaaaaaggcaagctatcaagttgttgggagatatgctgctggatagatcaaatgttgcagtgatgatgcgctatgttagttccaaagacaatcttatgattctgatgaatctcttaagggattcgagtaaaaatatccaaatcgaggcatttcacgtgttcaagctgtttgctgcgaataaaaacaaaccacctgaggtcgtgaacatactggtcaccaatagaaacaagctacttcgtttttttgctggattcaagattgacaaagaggatgaacagtttgaagcagacaaggagcatgtcataaaagaaatatcggcgctttgagtatgtctgaggttgtaattagtcattctgatgattttcttttctcgagaaagtgcatgtaaaataataaactttttgtatattattctgttgggcttagaggaacaatatgactcgttgactcgagttgcacttggatactgccagcaaatgtgatagtttttaatagattgcgtggttgcccttgccctttttatgggcttgtttcaatgacaaaaaatatccaaggatttagagatg

SEQ ID NO: 12345 - DNA, 1207 bp, Zea mays
cattgggtacctcgaggccggccgggattttcaactgaactcatcaattccttcatcatccatggaggccatgcccaggccaagtgtagctccctcgttgcagttgcagccccgcccgtgcccgaggtggccgcgccggaagcactgcccaccgtcctccgtgccaagccggagggttgcttgctcggcctcggcggccgacgccgacgtggtcgacctcttcgacgccgctaagctcactgtggacaagttcgtgacgagcggcatggtggtggggctcggctccggccctgcgtccgccctggccatccagtacctcggcacgcgcctccgccggggctctctcgcgggcatcaccgcagtgacctcgtccgtgctcagtgcgagcgaggcagacaaggcagggatacgggctaacagctaccaggaaggcacccagattgattttgctttcactgatgctgaagcgatcgaggagggcacgctggccgcagtcatcgggcggcggaagaccgagagcggagagccctctttcatggcggagaaggcgatggctaaatcagctcacaagcttgccttcatcactggaaacgacaagtacgtgacgacgggcgtcgagggttctattccggtcctgattaaaagtgggaactggatagacactgctgaagagatcgacgatttgtttctaggagacgcagaggtttggaggaggccgtcgtttggaactgctggtccacttgggggtgaccacccactggttaccaaggagggccatcacgtgctcgatgttatcttcacaacaccaatccaagatcttggtcaggttgcagagaagttggacaaagttgatggcgttgtggatcacgggattatttgcagcaaccaaccatacgctgtcattgcatccaagggggaagtgcaggtcctggacgagaaatcttcggtgatacattagcggtgaaacctttttggctgctctgcagattgttgcgcttttcggaacaggagtctactaccagctagctggaaaaaaaatgccatgagttaatcatgtacaaccagagctcttgttcaccactggacaattcagccggcatcagttgaagtctgtgtttcgcataaacttttttgaactggtactcagttaaccagattcgatgaatgtgaggcagagctacagcttcaactaaaaaaaaaaaaaaaa

SEQ ID NO: 12346 - DNA, 1430 bp, Zea mays
ttcaactgaactcatcaattccttcatcttccatggaggccatgcccaggccaagtgtagctccctcgttgcagttgcaggcccgtccgtgcccgaggtggccgcgccggaagcactgcccaccgtcctccgtggcaagccggagggttgcttgctcggcctcggcggccgacgccgacgtggtcgacctcttcgacgccgctaagctaactgtggacaagttcgtgacgagcggcatggtggtggggctcggctccggccctgcgtccgccctggccatccagtacctcggcacgcgcctccggcggggctctctcgcgggcatcaccgcagtgacctcgtccgtgctcagtgcgagcgaggcagacaaggcagggatacgggctaacagctaccaggaaggcacccagattgattttgctttcactgatgctgaagcgatcgaggagggcacgctggccgcagtcatcgggcggcggaagaccgagagcggagagccctctttcatggcggagaaggcgatggctaaatcagctcacaagcttgccttcatcactggaaacgacaagtacgtgacgacgggcgtcgagggttctattccggtcctgattaaaagtgccattttcaggggaactggatagacactgctgaagagatcgacgatttgtttctaggagacgcagaggtttggaggaggccgtcgtttggaactgctggtccacttgggggtgaccacccactggttaccaaggagggccatcacgtgctcgatgttatcttcacaacaccaatccaagatcttggtcaggttgcagagaagttggacaaagttgatggcgttgtggatcacgggattatttgcagcaaccaaccatacgctgtcattgcatccaagggggaagtgcaggtcctggacgagaaatcttcggtgatacagtagcggtgaaacctttttggctgctctgcagattgttgcgcttttcggaacaggagtctactaccagctagctggaaaaaaaatgccatgagttaatcatgtacaaccagagctcttgttcaccactggacaattcagccggcatcagttgaagtctgtgtttcgcataaacttttttgaactggtactcagttaaccagattcgatgaatgtgaggcagagctacagcttcaactactcttctagtgtttcaggagttcgtctcttttcatatgattggttgcccgcggcatctcatctcctatatgtttggttgcttgtgtttggcgggtgattaaattagcacatgccttcataacgtttattagtgtttggaaagataaaagtaaccgcgcataggcgctggaatatatggattagatgaaaaaaaaaaaaaaaaacaaaaaaaaataaaaaataaaaaaaaaaaaaaaaagaataataaaaaataaat

SEQ ID NO: 12347 - DNA, 1009 bp, Zea mays
tcgaggccggccgggccagcacccaacttcttcctcccaccccccagctcaatcaacacaatcagacacaatggctgaccgaggaacttctcgcggtggaggctttgcttcccgaggtggtgaccgtggcagaggtcgcggacgaggccgtggccgcggtcgcggtaagaacgaggagaaggagtggcagcccgtcaccaagctcggtcgtctcgtaaaggccggcaagatcaacagcatggaggagatctacctgcactctctgcccatcaaggagtaccagatcgtcgacaacttcctgcccaagctcaaggatgaggtcatgaagatcaagcccgtccagaagcagacccgtgccggtcagcgaacccgattcaaggccattgtcatcattggtgactccgagggccacgtcggtctcggtatcaagacctccaaggaggttgccaccgctatccgtgccgccatcatcatcgctaagctcagcgtcatccccgtccgtcgtggttactggggtaccaaccttggtgccgtccactctctgcccaccaaggagagcggaaagtgtggttccgtcaccgtccgtctcatccccgccccccgtggtactggcctcgttgcctcccccgctgtcaagcgattcctccagctcgccggtgtcgaggacgcctacacatcctctgccggttccaccaagaccctcgagaacaccctcaaggctactttcgttgccgtctccaacacctacggtttcctcacccccaacctctggaaggagaccaagctcatccgaagtcccctggacgagttcgccgatactctgcgcgagggcaagcgatactagagcgggaatgttttatgaactgatgggagctggaaactggtgccgcggagtcacgaatcaattgtgtttcattgcataggttggccggttaggacacttcagatcgtataggctatggtgactgatggcttaacggtctgaaatgaaaaagaaatttcatccttc

SEQ ID NO: 12348 - DNA, 1364 bp, Zea mays
gaggtctggccctcgaacggcgagacgggcgcgtggccgcatatgcatacatttcttccgcattgactgtggcgccaccgacggccacagagagaaacgttgagacagggagagagagagagagagcgagctccacgcctccacgctccactacaccagccaggcagcagcccccaacgactggctcgccgctcgcgagaacccgagtctatttctgcacgcgcttccaggttttagctgcagcggcatcagggcagggagagagcgatagttctgttctactgcaggaagagcagggagcaagatggggtccggatctttcctcaaggtgctggccaataacttcgatgtccttgccgggccactcatatcacttgcttatcctctatatgcttctgttagagctatagagacaaaaaatcctgtagatgatcagcagtggctcacttactgggtgttgtactcatttatcactttgtttgagctaacttttgctccaattatcgagtggcttccattttggtcgtatgcaaagctgttctttaactgctggttggtcttgccttggttcaatggtgctgcctatgtttacgaccattttgtgcggccaatgtttgtgaaccgccaaatagtgaacatatggtatattccaagaaatgagaagctaggtaaatctgatgatgttctgtcagctgcagagagatatattgaacaaaacggaccagaagcatttgagaagctcatcagcaagtctacgaagtcttcgaagtcaaggaacacaaagcggttgaacttggaggatggagaggctgaaaatcgagctaaagccgagagagaatcgtggggcgaaaatcccttctacgacaaaaactacagatactaaaccagttcaaaatccactcagcagtttgaagatgaccttgctcacgagcctcatgcaagctttagttgcgtcggaccgaagacgacattcccatatttctgactctgaatattgtaccttgttacatccactgctactacataatgatgagttctagagcaattgtggactgtgtaaatggaggtagatgctagcgttaatcgtttatgtgctttttggatggtgtccttatcacccgttttactacatctttagcaaggagcgagccttgattttcagtttggctttcgtatttttgtaattgaatgctacttttagataactgaaatatgagggagttcgagcttctaggaagaaacttaacatgtgctattgcatcgagtgccaacaacgttatcatcgtcacaatttttgtacagggctcttctacaataacttgagtaacccgttcatttcggctggtttaaaaaaaaaaaaaaaa

SEQ ID NO: 12349 - DNA, 1350 bp, Zea mays
  misc_feature (1318)..(1318): n is a, c, g, or t
  misc_feature (1320)..(1320): n is a, c, g, or t
  misc_feature (1329)..(1330): n is a, c, g, or t
  misc_feature (1343)..(1343): n is a, c, g, or t
  misc_feature (1345)..(1345): n is a, c, g, or t
  misc_feature (1347)..(1347): n is a, c, g, or t
tgggaccctcgaggccggccgggccggggagaaccaaagaagagagaggaagacaggaagagagagagccccccccccccccccccggagaaccaaaagaagagagaggaagacaggaagagagagagagagcgcgcgcttccaggtttttagctgcaggggaggccgatagttctgttctactggaggaggagcagagagcaagatggggtccggatctttcctcaaggtgctggccaagaacttcgatgtccttgccgggccactcatatcacttgcttatcctctatatgcttctgttagagcaatagagacaaaaaatcctgtagatgatcagcagtggctcacttactgggtgttgtactcatttgtcactttgtttgagctaacttttgctccaattatcgagtggcttccattttggtcatatgcaaaactgttctttaactgctggttggtcttaccttggttcaatggtgctgcttatgtttacgaccattttgtgcggccaatgtttgtgaaccgccgaatagtgaacatatggtatgttccaagaaatgagaagctaggtaaatctgatgatgtgctgtcagctgcagagagatatattgaacaaaatggacctgaagcatttgagaagctcatcagcaagtctaccaagtcttcaaaatcaagaagcacaaagcggtcgatcttggaggaggcagaggctgaaagagaatcatggggtgaaaatcccttctacgacaaagattacagacactaaacctcttcaaaatccacctagcagcttgaagacaacctttgcccacgagcctcatgcaagctttttagttgcatcagactgaagacgaccttcccaaatttctgactctcagtatactgtaccttgttacattcactgccagtctgtcgctggacaatgatgagttctagagcaattgtggactgtgtttgtaaatggaggcagatgctagcgttgatcatttttcactgtacgtttcttccttctggttggtggtacgtgctctgctgcaatttcaagcgaacagatttcagcacctcgtgtcatttttttttataaatttgttatttctgtcaacggatttcttccgaaaaaaaaaaaaaaaaaaagcggcctcacgattcaggatattagattcacgctgaactcccggtgaagatttgggttaggccattagggttgaggggttcagggtgttgtgtggcttcttggctgtagagggaggacgcagatcaagtgcaaagaaaaggcgtcgttacgacggccgatgacggagtgtctttctttgtcgananaaaaaaaannaaaaaaaaaaaanananaag

SEQ ID NO: 12350 - DNA, 3021 bp, Zea mays
ctaattttcttgttttccactgtcgacccttttacaaaatacgagtatacaccgtgagtgtttttgagctcccgaactcccgtctgaatgggccgaagagatgcattcatgcattagaaaataatgttgatgggaaagatgtaaaaaatggttattttttctccaacaacctttcagaagttgcacggctcgtcaatagcaatcttcatggcccattaacaatgcgctaacaaatagacagagtccaattcatcgaggcccacgcaacgcgggcacacaaagattctacaatccgtggcggagccggtggggggatcccaatgtcgtaaatagctgcggagccggtggcggagcccgtagcgggcgctcgaaaatatctcggcacggctgggagctctggaaccttcgctggcggctccaacccccgacgaggcgacgaccacagcactcccctcctatttatttcagagaaagaagacgagagatatttttctcacgccctccccgcggaattatacctttttttttctctctctctcgcctcgcttccttcgaatccatccatctctcgcctccctttccaattcgatgcctttgtagcgctgctgcctcgcccccgccgcgtcgtcgcgggtccccggcttcgcttgctgctgcgcttccagcgtcatggacgggggatccggcaatgcctccagcggcggagcggcggtgtgctgctactacgcgctcctcggcgtccgcaagagcgcctccgccaccgacatacgcaccgcgtaccggaggctcgcgatggtgagttgagttcgcatgctgtgcgtgcagcgtgctatgcgccggtgtgttttggttgggttctgtcttctgtgtcctctcctccacccctgctgctcacaccttccgatctcttgcctgccgtgggcgcgcagaagtggcacccggaccggtgggccagcgatcccggcgcggccggcgaggccaagcggcggttccagcggatccaggaggcctactcaggtaaggggccctacatacacctgttttggttacgcttggcttcacgagaattgaccgaattgcggcttgttgtttttggttggcgcagttttatcggacaaggggaagaaggccatgtacgacgccgggctcttcgatcccctcgacgacgacgaccaggtgaatgagcaaatgagtttcctgctgcttattggcttgtagaaattaatcaatttttttttgccattttggttccgaatattatatgtgtatcatgtatagtatagccctgagcaggaaattaaaaaaaaactaatttctctgctctgctatcggacggccaggatttctccgacttcatgcaggagatgctggtgatgatggataacgtgaaaaacgaggtaggcgcgacgtaaccacccaccacggggaattattatttgcttgctggtgatgctgggcgtgatggataacgtgaaaaacgagaagccggacacgctagaggacctgcagaagatgctggcggacatcgtgaacggcgacggcggggacggcgtaggcgggcgcgtgccgccggcgccgccggacgttgctcggcgaacgcgcgtcgcgccccacccgcagccgcagcaggcgcgtaggtgaccgccgcgccgccgtagctgcggagtacgtacgcttttggtgaaagggactggagaaggatcagaaacgggaggctctctggaaaaaggagaataaaaatttcaggccatcctttgatcataatctaccaatcctttattgtagcagtggtcgattgtgtaagctaccggccgcgccgccgcaataactgtcggtcgtggccgggtattcttactttttttttatttatctcgtcgacgtttcgatttattgtctactgccattttcgctcgtgtgctgtgctgcggtctctgtcacgtccatttctcgatttgtttgttaatcgtccgtcccaggcgctgtcagctgcatggtgtaccgagtcgacagggcacgtggccctgtcagctgcatggtgtcactgggccgacgacggttccaattgcagctaccactacgaagtacgaacgcgcacttgtaaccaggcaaggcattataattgttgagaaatctgttctaactcaaaacaagaaaaaaaactttctccagaatatgcaatatgaaacaatctaaaatgctcaaaaacattcctaagggcaattggaacttattcaaaccttggaaaagccatggttcaattcctttaagatttaccctattttgcccctatttgagctagatatggagttgtgtgtcacaatttgatttttatggacctgcgagtgcacaattagcaaactaattagatcgcaaggttgtgttggacattaaccatcaaaactaagttagaaatggcatataacacatttttccttccaaaaacctaactgtaaatggacattggtccattttacttatagactctatgggtgtgtttggtttgaggaatgaagtgatccatcttcttctcactcctcacatttttatttggtttgttgaatagaatgatttgatccatcaccacctcattcctcatatgctaataattagtgtatacatgaggagtgggttgattccaccaaaattgatagaatgaatttatgatgcatcatctaatgatgcattgggtgactccataaaccaaacacaccatatatgagagctttgagtactctagccatggactttgttttagattcatgctctcacaaagagattcatttagcaactatagaggcgaacatgtgtctatacattttatgacttaaacatcttaataatgaccttcgttgtttgccaaaccataggaccatttgttgttttgtattcctagatttataatacacaagcattgctaggatttttcatattcaagaagaacttcaacgtgagctaactcacgagcagaattatttctctacaagagtatgataagagttttatcacgtataatgtgagttg

SEQ ID NO: 12351 - DNA, 1535 bp, Zea mays
  misc_feature (1420)..(1422): n is a, c, g, or t
  misc_feature (1449)..(1449): n is a, c, g, or t
  misc_feature (1451)..(1451): n is a, c, g, or t
  misc_feature (1453)..(1453): n is a, c, g, or t
  misc_feature (1455)..(1455): n is a, c, g, or t
tgcatgcctgcagtccggctagaagcactttactaagggcctgttcgattcttgaggattggccacccgtaattattcctagccagattgcttgtctaatttatataaggtttgattagctgaaacaatttcgagatgaattccggcacaaacgaacaggtcctaaatggttttacaagtggagggagacggttttgataacaaaacctatactgtgacgatagtttagaatgtaaaaaaatgttttttagaaaaaacttttagaagctgcacggctcgtcaatagcaaccttcatggcccaataatagtgaactactagcaaataaacagagcccaagtcatcgaggcccgcgcagtgtgtctagaaggcaaaggttccacaatacggaaggggtcccattttcgtaaatagacgcgaagcccggtggcgaaggggggagctggcgctcgaaaatatctcgccgccgcacgcgctctggaaccttcattggccccaaccctcccgacgaccaaaactctccccgcggaataaaagaagagatattttttttgtcacgccctcggccctccccgcggaataaaagctttttctctggcctcccttcctccgaatccatccatccatccatctattgtctcccttccaattcgatgcctttgtagcgctgctgcctcgccgcgtcgtcgcgggtccccgatttccgcttgctgctgcgcttccaacaccatggacggcgggggatccggcaatgcctccggcggcagcggcggcgcatcgacgtgctgctactacgcgctcctcggcatccgcaagaacgcctccgccaccgacatacgcgccgcttaccggaggctcgcgatgaagtggcacccggaccggtgggccagcgaccccggcgcggccggcgaggccaatcagcggttccagcggatccaggaggcatactccgttctgtcggacaaggggaagaaggccatgtacgacgccgggctcttcgaccccctcgacgacgacgaccaggatttctccgacttcatgcaggagatgctggtgatgatggatagcgtgaaaaacgagaagccggacacgctggaggacctgcagaagatgctggaggacatcgtgaagggcgacggcgggggcgggagcggcgcaggcgggcgggcgccgacggacggtgctcgacggacgcgcgttgcgccctacccgcgccccagcgtgcgcgcaggtgaccggcgagcccgtgtacgagcgacgtacgcttcccttttggcgaaagggaccggaccccagcaacggacgggaggctctggaaaagaagaataaaaagtttcacctttctttttagttttaggccatcttcggatggtaatctacgcatcctttcatgtagcagtggtcgattgtgtaagctgggnnntggggttgggtggtggtggtggtggantnancntgcgccgctgcaataacttgcggacgcgcggcggggactctgatttttttttatctcggcgacatttcgatttcgtgccc

SEQ ID NO: 12352 - DNA, 1021 bp, Zea mays
gccacgccctcggccctccccgcggaattaaagctttttctctggcctcccgtccgccgaatccatccatccatccatctattgtctcccttccaattcgatgcctttgtagcgctgctgcctcgccgcgtcgtcgcgggtccccgatttccgcttgctgctgcgcttccaacaccatggacggcgggggatccggcaatgcctccggcggcagcggcggcgcatcgacgtgctgctactacgcgctcctcggcatccgcaagaacgcctccgccaccgacatacgcgccgcttaccggaggctcgcgatgaagtggcacccggaccggtgggccagcgaccccggcgcggccggcgaggccaatcagcggttccagcggatccaggaggcatactccgttctgtcggacaaggggaagaaggccatgtacgacgccgggctcttcgaccccctcgacgacgacgaccaggatttctccgacttcatgcaggagatgctggtgatgatggatagcgtgaaaaacgagaagccggacacgctggaggacctgcagaagatgctggaggacatcgtgaagggcgacggcgggggcgggagcggcgcaggcgggcgggcgccgacggacggtgctcgacggacgcgcgttgcgccctacccgcagccgcagcgtgcgcgcaggtgaccggcgagcccgtgtacgagcgacgtacgcttcccttttggcgaaagggaccggaccccagcaacggacgggaggctctggaaaagaagaataaaaagtttcacctttctttttagttttaggccatcttcggatggtaatctacgcatcctttcatgtagcagtggtcgattgtgtaagctggggtttggggttgggtggtggtggtggtggataccggctgcgccgctgcaataacttgcggacgcgcggcggggactctgatttttttttatctcggcgacatttcgatttcgtgcccaaaaaaaaaaaaaaaaaaaatgaggcggccggccgct

SEQ ID NO: 12353 - DNA, 1009 bp, Zea mays
atttatttcagagaaagaagacgagagatatttttctcacgccctccccgcggaattataccttttttttctctctcgctcgcctcgcttccttcgaatccatccatctctcgcctccctttccaattcgatgcctttgtagcgctgctgcctcgcccccgccgcgtcgtcgcgggtccccggcttcgcttgctgctgcgcttccagcgtcatggacgggggatccggcaatgcctccagcggcggagcggcggtgtgctgctactacgcgctcctcggcgtccgcaagagcgcctccgccaccgacatacgcaccgcgtaccggaggctcgcgatgaagtggcacccggaccggtgggccagcgatcccggcgcggccggcgaggccaagcggcggttccagcggatccaggaggcctactcagttttatcggacaaggggaagaaggccatgtacgacgccgggctcttcgatcccctcgacgacgacgaccaggatttctccgacttcatgcaggagatgctggtgatgatggataacgtgaaaaacgagaagccggacacgctagaggacctgcagaagatgctggcggacatcgtgaacggcgacggcggggacggcgtaggcgggcgcgtgccgccggcgccgccggacgttgctcggcgaacgcgcgtcgcgccccacccgcagccgcagcaggcgcgtaggtgaccgccgcgccgccgtagctgcggagtacgtacgcttttggtgaaagggactggagaaggatcagaaacgggaggctctctggaaaaaggagaataaaaatttcaggccatcttttgatcataatctaccaatcctttattgtagcagtggtcgattgtgtaagctaccggccgcgccgccgcaataactgtcggtcgtggccgggtattcttacttttttttatttgtctcgtcgacatttcgcccccttgtctactgccattttcccttgggcgccgctcgcgatctagacaagca

SEQ ID NO: 12354 - DNA, 1737 bp, Zea mays
ctgctctgctctcggacggctaggatttctccgacttcatgcaggagatgctggtgatgatggatagcgtgaaaaacgaggtaggcgcaacgcaacgcaaccacccaccgccagcacgcggatttgttgtttatctcatgcaggagatgctggtgatgatggatagcgtgaaaacgagaagccggacacgctggaggacctgcagaagatgctggaggacatcgtgaagggcgacggcgggggcgggagcggcgcaggcgggcgggcgccgacggacggtgctcgacggacgcgcgttgcgccctacccgcagccgcagcgtgcgcgcaggtgaccggcgagcccgtgtacgagcgacgtacgcttcccttttggcgaaagggaccggaccccagcaacggacgggaggctctggaaaagaagaataaaaagtttcacctttctttttagttttaggccatcttcggatggtaatctacgcatcctttcatgtagcagtggtcgattgtgtaagctggggtttggggttgggtggtggtggtggtggataccggctgcgccgctgcaataacttgcggacgcgcggcggggactctgatttttttttatctcggcgacatttcgatttcgtgcccaattgtcactgaagatgatcctgactgttccattgccaattttgctcagcgttgcgtgtcgccattttcggtcagtgtcacgtgtcgtccgtccccggcgccgagcgaccgacgttgccttctttacggtaaccgatagtggacgtggccttgtcagccatggctcagagtacttacccctgtcatcattagtaatgacgttgggattggcaacttgcgtccgcgtcgaaatcggcggggccgcgttctggactcctcccggatctgctgtgcgtacgaacgaaagcgaaaacagcgctgtggtgctgggatttgttgcttgatctcctgccatccatcagccgcccgcttgagccggagcaaatgcatgcgtcgccggtcgagtagctctctagttgtgtcccgggactccgtggaccacggaaacgtctcaactcccaaccagagcggaatgcgttcttggtcccccctctctctccctgctcgcttctgtgaaagcgaaggaacaggcagggttccgccattcgtctggactagctgcctcatttcgtttttttttttgctttaattgcttattctgtcagtgctgcaacatgggcacaagtgccgagaacgcgatctcatgctttgttcatttttttcatcttttgattgaggcgtagcgttgtacagcaatgcctccttcctgaagtatccatgcttcagagaaaaatatcagtttcggctagaacagtacggacccgcttagggtttgaggtttatcctatgtaattaccctcttacctttgtataattggacagacacagctaactcatgctattaatacaacatttaatcctgatagtattattgtttcctacatggtataagtaggttttcctttctccttccctccctaatccgtagccgccgctgcacaaccgcatccgccgcacgcccccactttctttcctgtcgtggacgccccagccgcggcctctcctccctaagtagcggccgtctccttaccctgcgcccccctcctctcccctgtagctgcggccgccaccaccaccgaggtgactgttgacaaccctagctagaaataccctgagcactagt

SEQ ID NO: 12355 - DNA, 2410 bp, Zea mays
agaaaatccgcagctcgagtcccgtccccgccccctcctactcaaagaccggaaaggcgctgcccaaacaaacgcggaggaagaagggaactcgccgcctagggttccgccgccgcctactcttccgccgatcaaggagcgggaatcattgcgcgatgccgcagtcggtgctggtggaacgcgcgacgagcgagtcgctcatcggccctgactggtctctcaaccttgagatctgcgacatcctcaaccacgacccctcgcaagccaaagatgtagtgaagactatcaagaaacggattgcacacaagaactcaaaggtccagcttcttgcattaacgttgctggagaccttgattaaaaattgtggtgattttgttcatatgcaagttgctgagaaggatatgcttcatgaaatggtgaagatagctaagaagaagcctgactatcacgtcaaagagaagatattaattctgatagacacttggcaagaagcttttggtggtgcccgtgcaagatatccccagtattacgcagcatatcaagagatgctgcgtgctggagctgtatttcctcaaaggccggagagtactgtgccaatctatactcctccacagacacagcctctacggaactatccgcctcctgcattgcgtaacactgattatcgacatgatgtgcctgaatcctcttctgcaccagaagtgcctgcattaagcttgacagaaattcagaatgcacgtggggtcatggatgttctttcagagatgttaaatgctatcgatcctggtaacagagagggtctaaggcaggaggtcattgtggaccttgtggaccaatgtcgttcatacaagcaaagagtggtgcagcttgtcaactcaacatcggatgaggacctattaagtcagggccttactttgaatgatgatttacaacgtgttttagcaaagcacgatgcaattgctgctggcatagccattcgattacaaaaaccaaaatcagccccggcccgcgtagacagttctccaacgaagcctgagccgacaaaggaaacagaacaaaggtctgctaaagttgccagtagtgtgactccatttgagcagttagcacttcctgcaccaccatcatcaagtgcttcaaagtctcatggagaatcagctgttagcccaaatattgatttgcttagtggtgatgagttttttaaaccagaacctgttcattcccaagctcttgttcctttagtcactcaggcttcagcttcttcaagccccagtactttagaccttttagacatgttttctgatagcaatgctatcaataacaccagccagaaccctaccatactttctatatctaactcaaatcctaatacatcagtacaagcctatcctgttccacagcaacctgttccaccacaccatccttcaccatatgctaatggcttaaattcagatacaatgacaccctttgatcaaggctctaagttaacctcagcaagttcatggaatgaacagattgcccatggaatgattccaccacagcagtttgcccatggtcaaggtgaacaaagcaacgaccttccactaccaccctgggaagctctgcctgcagaaactgagcaattagaagctgaccatcctggtgggttgtcagctctgccacaatttggagttagtcaaccccagccagtccaaattacacattctgggcagcaagtgttaccatcgcaattaatgccaactggacaaccgggagggcagttccagcctagatttggggctcaacaaccatatgctacagaaaatacgcagtatggaggaatgtatccgccagtgcaaggcaaccaaccaacgggtatttatccccagcaaatggctggagatgtctaccagcaacagatgtttggtggccagatgataggttatggctatggtccgcagcctggaggctactacgtgccgaacgccgcatatgcatatgccggtgcaaatgatctttctcagaggatgaatggcctctcgatgcaaggcaacagtctgtatggcacacccgcgtcgtcttccctccagcagcgtaacaggccaagcagacctgaagattcgctctttagtgatcttgttagcatcgccaaaacaaagccttgtaaaactgcttccaacaaggctggtaacttgtaaacatgagtttctgctcatagtatataaaattcttgaaatttttttcctattggaaagtagtgggcgagatttgtatatcctgatattgataaagatgtttacatcttttcaagaaattatattttgtttacaagtattctgtaccattaatgtcttatgtatatacataggagcaaaaaaaaaaaagactccagtatgctgattcctctttgaaattttggcatacgccttccgcc

SEQ ID NO: 12356 - DNA, 2507 bp, Zea mays
gcttgcatgcctgcagctcctcaaagacaacctagccaaggcacaaaaccgtatgaaaatgtatgtcgacagtcaccgtacagacaggtagttccaagtgggtgaacatgtcatcctcaagcttcaaccttaaacccaacaatctgtcatcagtcaacctttccccaagttggcatacaaatattttggcccatttgaggtgttggcacgagttggcagcgcatcctacaaagctcaaactaccggacgaaagtctgatacattcagtatttcacatgtctctcaacacaaacccttcacttcaaattatgcacatgtttttactgacttccaagctttggttgatctgagtgcacatgatcttgtccgtgagaaaatcctggtgcagtggcataagcttcctgttaccgccgctacttgggaagattggtatgtgttacagtccaagtttctaggagcagttgcttgtggtcaagcaacatccgaagggttcgatgatgttgtgcccggggccggtacatggcgtgccaatcagcaacagtaagagtatacgtgtatttcagcatttctacgttctagtataaagtaatacgggggcagttgtgggcccagcttgtaagagagagcacaccggattgtataaggaaagtagtaggtgaactcagagtaaggcataccagaaacagaatcgtaatacaacttcggagagcaacttcctctgcaaattcgtcgtacccgcgtgttctctctctccactgtctcactcacgtcgccggcgatcgccgaggccacgggcacgacaagaacttgatggccaaagaaacagtcacaatatctttcaatttagcgaggttgggttagccaaaatgttacacggttagcaataagaatggtgtgcatatacaaatcagtacaaatactgcttgctcttgtgaaaatgattggccgagaagttacacaacaccaagattagcttaaccatcatgaacagcaaatataaacatgtgtatatgtctgaacatgacagtaaatagcctcataaaccttcaatccaaattttgtacatctgagagaattacatgatataaccctctaacacttgctgcctaccaatgagagatgggcatttaccgagtggaacataacccattgtgacataaaaaaagaaaaggttagactctttgctcccagtaagaaaacatcagtagctccaattacaacacttttagcagggtatgttacgcagtgagggattgggaggattctaatgtcaactagtgtggaacagtagcgcatatgaaccatacaacgaagccatgaatatcaatgacaccgtgaaaagtaagttttttgtcccaacttggaatcaaattcttaacctctaaatcatgtctctggagtaccaacataatctaatagccaccaggttaggcagcacaagagtcatattttcagttaccaatcatatgaccggggtgagtatatagttcctttaatccttttcatggtcacaagtgatttaggatgaacagcaccctgccttcttcacagcagagacatcatccttgccaccaacattgatggtttgccctcttggtggagcagcagggtcatcgccaatgtcaagggccttcttgctgacgacacgatagatctgagttaggacctcggtgaaagcgctctcaacattcatggactccagcgcggatgtttccatgaagaaggtcatttccctctcagcgaagcccttggcatcctccacggatacagctctaaggtgtcgcagatcagctttgttgccaacaagcattatgacaatgtttgcatcagtgtgatcccggagctcctttaaccacctctccacattctcaaaggtcacatgacgtgtcacatcatacacgacaagtgcaccaacagcccctctatagtacgcacttgtaattgcccgatacctctcctggccggcggtgtcccagatctgggccttgacgaccttgtcgtcgaccctgatgctcctggtggcaaactcgaccccgatggtggacttggactcgaggctgaactcgttgcgtgtgaacctggagagcaggttggatttgccgacgccggagtcgccgataagaacgaccttgaagaggtagtcgtagtcgtcctccgccctgtacgccatcgcgcgctgctgagccccggcaccggcaggcacttgcctttcctccttccttccttcctgaaccgcggttcctggggcaggaggacgggaaggtgaggcctgcagcgcttctcggggcgcgggacgctggagaatggggaggtgtaggcggggaggcggacgcgaggcgtgtgggtggcgcgtaggaggaagcggaggtggggcggggaggagggagaacgttggcggcggaaaatagcaagcggggcactgcggcctgtgggtagccgggaccgggaaggaggtgagccgcgctacctcgctggacgcgtcccggccggcctcgaggtacccaatg

SEQ ID NO: 12357 - DNA, 3694 bp, Zea mays
  misc_feature (66)..(67): n is a, c, g, or t
aaattgttttagcccctttttaacctttgtgtttgatactttatcccttaatatggctaaattttnncctattttctttagctcaggaagaccaaacagacccatagacggatgcacgcatagccacgtttggtgtccaccttctaaaaagtttgactaaacgattttgaaaatattcagctagcttgtaaatataaaaaaaacatatgcgtagatttaccttcttaaaacacaaatgcagagcaggcctagcacaaagtaaggccttcacatatgatccggacaagttcaaacaataaatatgcatgggaactttccgctgaatacccagcggccagcgtcgtgcttaaggcatgccaatcaagattgcttacattatggtaggttggtcatgacaaacctgttacaacgtgatgatgcacttatccaattgtcgagcaaaattactatatatcagctgtagacaaagcattctgcagtaaggcacaacaatcagtccataaaatccgtaaaaataatgcctactgcattcaatggccaactgattcctgaaagtatttaccctccagcgtctggtacacttatctgaaacatcatctcaatatgtataactgatcacttgatactgcaactgactaaaaggtactccatccgttctaaaatagtagtcgttttagctcttaatttttatgtatatattcaaataaataaagatgaaacctagacacatgtaaaacacatacatcaattattgtatgaacctatcaataatctaaaatgaattttaatttaggacggagggagtaatagagaacttggtggccaaagaatcagtgacaatatcaataaaatttagtgagattgagttagccaaaaaggttacactgttagcaacaagaacggtttgcatatacaaatcagtacaaatactacctgctcatgtgaaaatgatccaacgggaaaggtgcataaaatcaaattagcttcaccatcatgaacagcaaatataaacgtctgcatatgtctgaacatgtcgataaataagctgttgcagaacataaacttccaacccaaattttgtacatctgtgagaattacatgatataacactctaaaacacttgctgcctaccaacgatagatgggcatttaccgagtggaacataatccctcgtgacataaaaagaaaaagttacactctttgctcccagtaaggaaacatcagtagctccaattacaacatgtttagcaaggtatgttaagctgtgaggtgtggggaggattctaatgtcaattagtgtggaacactataaaccatagaaagaaaccatgaatatcaatgacaccacggaaagaacgttcttgtcccagcttggaatcaaattcttaacatctaatcatttctctggagcaccaacataatctcataaccaacaggttaggaagcacaagagagtcctattttcagttaccaatcatatgatcggagagtatatggttccttttcatggtcataagtgatttaggatgaacagcaccctgacttcttcacagcagagacatcatccttgccaccaacgttgatggtttgccctcttggtggagcagcggggtcatcgccaatgtcaagggccttcttgctgaccacacgatagatctgagttaggacctcggtgaaagcgctctcgacattcatggactccagtgcggatgtttccatgaagaatgtgctttccctctcggcgaagcccttggcatcctccacggatacagctctaaggtgtcgcagatcagctttgttgccaacaagcatgatgacaatgtttgcatcagtgtgatcccggagctcctttaaccacctctccacattctcaaaggtcacatggcgtgtcacatcatacacgacaagtgctccaacagcccctctatagtacgcacttgtaattgcccgatacctacagggggaggatgatgcatgacaaacttaagctccactgaaatactgaaagttccaaagaaaattcgatagcgaaattaggcaagaaatatacagctgagcagaccaaataaaacaagtcacattggagacggttacacagaacgtaatttgatggcatgctgacaaaatcagcattatattcttatggaaatggtaaacgaaagtcaaacaaaggctggcctacattccacatcaggtgctactatttggcaggaagcatcacacaaaaaaaatgaagacagaaatggaactgcacaaacaataggaaacagtcctagaatatcttcagttccagataacaactgcagaatttacattttgcaggagagctgaccgggcgcctccatataaggttaatttagagacagtgagacagactaccaaacaagagttgcctgcctaattgcccatttccatcacctacagaggctgctgcaacagaacatttttttaatgcagccaggagggcagtacaaaacgtataatcacccaacatattaccagatatgacaatgacaggacatgacgacacggggaaccttgtggacggcgacggtagaaattggaataactatgaggacaagagtattgcgattgcaaggttgttgtgttcatagaagcagagaatgcctcatgaatactattaacattcaaaatcaatgtaaatccaggactacatataggaggacaacaaggcgtggacgattgcaatttgcacaaggaggaaggcgaccattttactcgtcgtgtgtcctgcgcggtcctaactaggacaacgttgcattgcattgcatggggtagatgaatactatgtagctaattttcgatccaacacgatgatgcctagcatagcagaccaggaaactaaatagatcgagaaaacggaaggggaagaggacggttgagtacctctcctggccagcagtgtcccagatctgggccttgacgaccttgtcgtcgaccctgatgctcctggtagcaaactcgaccccgatggtggacttggactctaggctgaactcgttgcgcgtgaacctggagagcaggttggatttgccgacgccagagtcgccgatgagaacgaccttgaagaggtagtcgtagtcgtcctccgccctgtacgccatcggtgctgagccccggcaggcacttgccttcccttccttcctgaaccgcggttcctgagaggcaggaggacgggcaggtgaggcccgcagcgcttctcggggcgcgggagggggagaatggcgaggtggtgggaggcggacgcgatgcgtgtggtggcgcgtataataaagaagaggagcaaggcgagggccaaggggccggcggaaaaatagcaagcgcgctgcggcctgcgccgcgccgaagctgcctccctggccctggccgcctgtgtcaggttgccgttcggcggccttggtgtcatctcgttctgatctgcacatgcggccgacccggcataggacgccggccgagggtaaccatcacatattcagatggcaggaatgcctccacatgatgagtacatgacgaaggagaatccaacagaaatgttggggactaccaactagtactactaccctagagcaggtattttgcttgttcaagttcatgaatcaacgtgtaacaactttatgcctgacactgccaaagtttaggaccgacagattaaagtcaattatttggactgata

SEQ ID NO: 12358 - DNA, 3558 bp, Zea mays
ccacgaactaccatctgcctttaaaatcaaaattacagagagatgatctttaagaatgtatttggtttgagattaaagtggaatgatgatgtgtggacgacaccgtctcctcgattttttagcatcacgccgccactaaaaattaatccaatgtttaactcgttcccacgtgactctcgttcaaacaatacagaaactgtgactgccccttctattgtacatccaatcaaacacatcttaaaattagcctcgatataccacgtcggtaggacgataggagtaccatgccttagagtttcggtaccaaacagcaccgtagtaacacggcggatgtacgcgcgccgcacatgcacattgtaccactggcctggctatggcttccagccgatctaaaggcaagacggatagagacagacatgtattgcagttgaagtgttttaagtaaccgggcaatttgatcctgcagggtagggcgcgcgccatgcgctcacggactggaaactctgccggccctgtggcgtgtcggcccacgcatgtacagatgtactacgtaaccaccgcgcgcgatggggcacagggcactatataactcagaagcgcagtgtgtgctgggacaccatcgacatcgacgacagcacagctagcccaatcccaaagcaatcttccatggcgccggcgaccttgctactggcgagactggccgtggcgtgcgcgctggcgctcggcgccatggcgcagctgtcgccgacgttctacgacgcgagctgccccagcctgcaggccatcgtgcgggccgggatggccgccgccgtgcagcaggagccgcggatgggggcctccatcctccgcctcttcttccacgactgcttcgtccaggtaagcatgcatgtcgtggcgccttgggcttgctgctggtcgtcagtatgcgtcgcgccgcgccatccatccaacactccattattattattattattgcccatgcaggggtgcgacgcgtccgtgctcctcgacgactcgccgacgctgacgggggagaagaacgcggggcccaacgccaactccctgcgcggcttcgaggtcatcgactccatcaagtcccaggtggaggccgcctgccccggcaccgtctcctgcgccgacatcctcgccctcgccgcgcgcgacggcgtcaacctggtcagtgacagtgagccatgcatccttatcctttgtttgcctggtatcgatcatcgcacggtcgccccgaccactgctggctggctggcgctaccagtacagagtactacaccacctgccgacaccccgtgctgattgctgccacgatgcatgcatgtccatccatcagtcatcagtaaaaaaaagaaaggaagaaaaaaaaagcatagccatacccatgcattgcatgcaactcggctggatcggtcccgtcaaacaagctggtcagcaacgtgcgggccagcaagccttcaccaaccgttctgtcgtcaaacgctcgctcgctcagcagtcgtgcatgtggctactgtacgtcggtagctgttccgtttgtcagtcaccacatatactcacagtcacagtaacaagtaacactcgagatcgacgacaaagcagttgtttacatttggatttggttgcagtgtaacgtaggacagtagcatttcactgacacgatgtatgacaaacactgcactgcaatattaattaatgcagctgagcggtccgacgtgggcggtgcagctgggtcgccgggacacgcgcacggcgagccagtcggcggcgaacagcaacctgccgtcgccgtcgtcgagcgcggcggcgctggtgtcggcgttcgcgtccaaggggctggactcgcgggacctggtggcgctgtcgggcgcgcacacgatcggcgcggcgcggtgcgccaccttccgttcccgcgtgtacaacgacaccaacatcagcgccgggttcgcggcgaagcggaggcagatctgccaggcgcaggccggggccagcgacggcaacctggcgccgctggacgccatgagctccgtcaggttcgacaacggctacttccgcaacctcgtggcccagttcggcctgctccactccgaccaggagctcttcggcagcggcgccgtcgactccatcacggcgcagtacgcgcgcaacggcgccgccttctcgcgggacttcgtcacggccgtcctcaagatgggcagcatcggcccgctcaccggctccagcggcgagatccgcgccaactgccggaagcccaactagacagacgtctacgtataccatagcatagacagacatcagtggcagtggtcagtttcgagattcgtgcgacacggacggacggtctggattcctcgacatggccagctaagagggccgtggctttttgcgtggaaagtgtggagtgcgttggaagggagcggcggaggcgatgatgattccgggcgatttggtgggtggagcgccgctgtcaggactagtactcatttcaggggagaggggagagctggggggggggggccagcgtgccgtcacacatcgatcaacccgcatatgagaccattgctgattttcattcttttttattttatttggccgcgttattctttcttttctctttcgtttctttgtgccacgattttagcctgtgatgagtctgtacgtacactgggcgattcatgattattattctttttttttgttcaagaaatgtacacatgcatatccaatgtgcaaccgatcatgcatgattaataataactctctggtcagaacaacatcgatcatgtgcataaggagtaacgaacaacaggattgggcaggtgcaaccgcgccaagggtacgtacgtgccacgagctaccctagctaggagtagcatagtagcaccatatgcaccataataatggcagctgcttcctgcactattagacgacgacggggcagggtggtgtgcgtgttgatgcgagatgtctatcgctcggtcatgaccaaaatcaaacgtgccatccgtgaccttataccatgtcacacgcgccgacgacgtacgcagacggccggcggtcagagaagcggcaaaccctgtgattagcagaggatcctcgactcgctacggcgatgtgatttgcgtacgtggctgtcctttctgtaggctgtagcagctggtttgccggacggacgtctggtcagacagaacgaggtgattacagctagcgactgaatggaataaaaagggtgctttggatcgtgatccatcagttccctccgatccctttgtctaacaacagcgacgtatacggctggagatatgagatctatgtatgcatgtccaagggtccgtaatattattcacgtaaacaaattttcaattaaaaaaactctcaattccggtgtgtagttttgaagtttcgaatatttataaacatcaaaagaacaggctgcaagaagaaactatatatgctcctttttgaaacctaatacattatgttagggttgttttataaaactatcatgggtacttgtaagatttgtaccaagagtgatgcttgatttga

SEQ ID NO: 12359 - DNA, 1555 bp, Zea mays
  misc_feature (23)..(23): n is a, c, g, or t
tgggtacctcgaggccggccggngacatccaccgacgacagcacagctagcccaatcccaattcccaaagcaatcttccatggcgccggcgaccttgctactggcgagactggccgtggcgtgcgcgctggcgctcggcgccatggcgcagctgtcgccgacgttctacgacgcgagctgccccagcctgcaggccatcgtgcgggccgggatggccgccgccgtgcagcaggagccgcggatgggggcctccatcctccgcctcttcttccacgactgcttcgtccaggggtgcgacgcgtccgtgctcctcgacgactcgccgacgctgacgggggagaagaacgcggggcccaacgccaactccctgcgcggcttcgaggtcatcgactccatcaagtcccaggtggaggccgcctgccccggcaccgtctcctgcgccgacatcctcgccctcgccgcgcgcgacggcgtcaacctgctgagcggtccgacgtgggcggtgcagctgggtcgccgggacacgcgcacggcgagccagtcggcggctaacagcaacctgccgtcgccgtcgtcgagcgcggcggcgctggtgtcggcgttcgcgtccaaggggctggactcgcgggacctggtggcgctgtcgggcgcgcacacgatcggcgcggccgcggtgcgccaccttccgcgcccgcgtgtacaacgacaccaacatcagcgccgggttcgcggcgaagcggaggcagatctgccaggcgcaggccggggccagcgacggcaacctggcgccgctggacgccatgagctccgtcaggttcgacaacggctacttccgcaacctcgtggcccagttcggcctgctccactccgaccaggagctcttcggcggcggcgccgtcgactccatcacggcgcagtacgcgcgcaacggcgccgccttctcgcgggacttcgtcacggccgtcctcaagatgggcagcatcggcccgctcaccggctccagcggcgagatccgcgccaactgccggaagcccaactaatagacagacgtctacgtataccatagcatagacagacatcagtttcgagattcgtgcgacacggacggacggtctggatccgtcgacatggccagctaagaggaccgtggctttttgcgtggaaagtgtggagtgcgttggaagggagcggcggaggcgatgatgattccgggcgatttggtgggtggagcgccgctgtcaggactagtactcatttcaggggagaggggagagctgggggggcccagcgtgccgtcacacatcgatcaacccgcatatgagaccattgctgattttcattcttttttattttatttggccgcgttattctttcttttctctttcgtttctttgtgccacgattttagcctgtgatgagtctgtacgtacactgggcgattcatgattattattctttttttttgttcaagaaatgtacacatgcatatccaatgtgcaaccgatcatgcatgattaataataactctctggtcagaacaacatcgatcatgtgc

SEQ ID NO: 12360 - DNA, 2182 bp, Zea mays
cgggagaaagggacgggaaggtgccaataaattgcgaggatgccgctttatctcttctctcccgccgccgccaagctcgccaccggcccacacgcgtccctgcaccggcggcgccagttcctcttccgagttccccaccgccccagccgccgcgccccactgctaacttcggcggctgagcgtccagcagggcgcaccatggctactgcggataccggagcgtccacggtgaccgattcgaggctccgagctacaggagtgaagcaagcactgatatcattgtcagataaaacagacctggctaatcttggaaatggtcttcagcgtttggggttttctattatttccactggtggcacggcatcaagtttggaagcatctggtgttaatgttacaaaagttgaagaaattacacagtttcctgaaatgcttgatggaagagtaaaaacattgcaccccagtatacatggtggtattcttgcgcgaagagaccaggagcaccatctgaaagcactgaaagagcatggcattgggacatttgatgtggttgtagtgaatttgtatccattctatgataaggtcacctcaggtgcaatatcttttgaggatggcattgaaaatattgatattggtgggcctacattgatccgagctgctgccaagaatcataaggacgttcttgtcgttgttgatcataaagactatcctgctctactggaatatctagaagggaaacaagatgaccctgatttccgcaggacacttgcatggaaagcattccaacatgttgcttcctatgattctgctatctcggagtggttgtggaagcaatctaataaagattcatttcctcccagctttactgtgcccctcacaatgaagtctacacttcgctatggtgagaatcctcatcaaaaggctgccttttatggtgacaggagtctttctctagtaaatgctggcggtattgcaacagcaattcagcaccatggaaaggaaatgtcctacaacaactatctggacgcggacgctgcgtggaactgcgtctcggagtttgagagcccgacttgcgtcgtggttaagcacacaaatccgtgtggcgtagcgtctcggcacgacatcctggaagcgtacaggttggctgtgagggcagaccccgtgagcgcgttcggaggcatagtcgccttcaacacgacggtcgacgaggatctcgcgagggagatccgggagttcaggaggccgacggacggcgagacgaggatgttctacgagatcgtggtggcgcctgggtacacggcggagggcctggaggtgctgaaagggaagtcgaagacgctgaggatactggaggcgaagcggaggaggagcgggaagggcacgctgctgtcgctgcggcaggtcggcggcggctggctggcccaggagcccgacgacgtgaccccggaggacgtggccttcacgaacgtgtccgagagggctcccgacgcccgtgagctctcggacgccaagttcgcgtgcctctgcgtcaagcacgtgaagagcaacgccattgtgatcgccaagaacagttgcatgctgggcatgggcagtggccagccgaaccggctggagagcctgaggatcgctttcaggaaggcaggggaggaggccaagggagctgctttggccagcgacgccttcttcccgttcgcttggaacgacgcggtggaggaggcgtgccagcgcggcgtggcggtgatcgcagagcccggcggcagcatccgggaccaggacgccgtggagtgctgcaacaagtacggggtggccctcgtcttcaccggcgtccggcacttcaggcactgatcgacggcgacggcgagggtggcaacgtagaccgtcacggacgatggtacctgtagctgcgtcgacctgatgcccgctggcgtttcttggctagggagactgatgacgctgaagcaaccaaatgtcgcctcctctagtctggagaggatgggtcggtgggtcccggtttgtatatataacgtcgtcagcctggcaagaggttgactgagcttagtgactcttgcggtggatggaaatcggaaacggtcgctgacccggtgggaccgcacagtctgttgcttggctacatgccgtgttattattattaatactatttattgctgtcacgttacatgacacc

SEQ ID NO: 12361 - DNA, 1083 bp, Zea mays
catcgcctcatcttcctcttctcgcacctgcgaagtccccccgctttctatccccccgcctggccgcctctaagacaacagagacagcaatggccgtgcgcgccatcgatacgccgctcctcctgtgcaccatggtggtggtgctgaccggcctcgtgtccccgtccaccgccgggctcagcctggacacggtgagggacttcctgacgcgggaggaggacaccattgtgttcagcctcatcgagagggccaagtacccgctcaaccggccggcctacgaccccctccactccgccgccggccgccgcctcaacgcctctttcgtcgagctcttcatccgcgagtccgaggccgttcagtccaaggccggaaggtaccaaagcctacaggagattccattcttcgcttacagagttccttccgctctggcgcctccatacaacttcacaagcgatctgtatcccgctgccgcgtcagtcaacgttaacgacgccatatggagcatgtacttcgacgagctgctccctcggctggctaagaatggcgatgatggcaactacgccgtagctgctgatgcagatcttgcgtgtcttcaggtgctttcaaggaggatcaactacggcaggtacgtagctgaagtgaagttcagaggagaccagcagacctataccagcttaatccaggcgaaggacagagacgctctggtgaagctactgacgtctgaagcccaagaggacgtggtgaagagaagggtagagaagaaggcggccgtgttcgggcaaagcgtaacgttggacggaccagtccaaacggatgccaacagccaggctaactctagcttattcaaagtcgacccttcggtcgtttacgagctgtatggccagcgggtgattccgttgacgaaacaggtggaggtcgagtaccttctccatcgcctcgactgagactgatcactgatcgatcgcgtcaaatgtgtatatatccggctgacggatttgtatacccgtaacgtatttacatacatacatacgcaataagaaatatacaggactgttgtcctcagttttaaaaaaaaaaaaaaaa

SEQ ID NO: 12362 - DNA, 1200 bp, Zea mays
aaaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgacaattggattcaacgttgagacggccttcttcgggcggctggagcagcgcggcatcgtgagcgcggggcccgggttcccggagagctcgtggttcgcggacttcgcggagatggcgcgccgcgtgtggctgctgcactgcctcttcttcgcgttcgacggcggcgccgaggaggacggcgcgtccatcttccaggtgcgcacgggggcgcgcttctcggaggtgtacatggagagcgccagcgacgggcgcgccggcgacgacgccgaggagcgcgtggtcggcttcaccgttctgccggggttcagagtcgggcggacactgatccagtgccgcgtctacctgtccaagccggggcggcggccgtgatcgatgatggctcgtggctgtgagagaccgaagagagaagaagatgatgggagggggaatagtgcccattttgggtcggccgtcgaggtctcccgccggcagccggccggggcagtggccattatgatgatgatgacgggggtggctgctatgtatgtaaatctatccagacatgtagggatgttctaatccgtaatataaatggtattttcagttccgaaaaaaaaaaaaaaaacgttgtttgctctctgctctccccgtcatttgccattgttggatagatggtgctcccgtgttttgttttctcgcggatctgggatcggaaatcgtaggctacaaaccaatggtagtgacaggaagctcctgggattgggttgctgaaatcctgcggtgaatctgaccatggatggattgcaaccattccttcccgcatctgctgaaaccctgtggtcgttgaagcgatgccatggtggtggctttgtttgttcatggcctccctcgtgggggaggaggaagagggagaggaacaaacaacaatggattctttttggacgtttgtcgatacggaccttgctgtgttggaacttgtgatttgctgttttgcag

SEQ ID NO: 12363 - DNA, 2701 bp, Zea mays
gtcgttctcgtctttcggtactcgcgcgcgccagctcacttctctacttcccttcccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgacaattggattcaacgttgagacggtgcagtacaacaacatcaagttccaagtatgggatcttggtggtcaaacaagcatcaggtaccggctctttatcatgatagtaaattcctgactgtcatttctgaagtaaataatactattgcatttatttaatcaccgatgaaaagcagtgcaatagaggtactctactactacctttttgtttattataagtaattggtggagagtggagacagtaccttgttattaccctgccacttcagtttccacaagctaaattatgaggctgtaagaatggacatgtttaatgaagataagaaaattttatttttttcccataacaggatgagcctgaatttaattgataatgcaacgaattagaaaggttcctcattgcagtgtttaatgtctcccaaaccatgtaaagatcaatctttttctaagacatgctgtaaagattattagatcatgctgactaatctagttgtttttgacatggaagcctggtctatggctttactgctatatgtacatcgtgcctgtcttggatgtaatgcttttaggttgatctttgccaccatggagataaaaaagaacttgaccatgagagagatatgcccctcgtgttcccttaagtaatagctacacaaagattggaagaattagacagctttatgttaataagaaaaggcacccaatttcacctaaatgagtactcgttggtggcctggacttaagtccacatcctcaaccagttgatcaaggctgtcacactatgatcccaagtgttatggtttggccttggatcatttcataatttggtgtcacaaccgcacaacatatatgacattcatgtatagtgtagtggatacacaatgaaaaatagttgtgtagttgaaggctagtaattccagtagaactagtttatagagtcgaaaatgtgagcaaggtatggtagtctagtctctatgacgctgtgtctagattcatttgtaacattatcctcagttgccaataatttgtttctatattcctttccatgtgagctccgctttaggggggaaacttggatagtgtttggttctggtgctggcaacatgacttatttacggagggtaatagatcctgttgcatgctgtttgagcgtaacgctcctgccactgtgctatctgataccaccattgtctttgctagccatgacagcatgtctccgtcaggttccctcacgtggccgttggatcaggatagcgtgtcgaaaacaaaatgacaggcggagccccactctgctttgttgtccagtagctactgtgttaaagttaccaatatctaaccaaacggatcaagtaattgcttaccatatttacgttagcgctgtttatccattccccttacatttgtgtttctttatcctaaccaaacactaccttaagggcatttcaagtattctactagttgtaagtattttttttctttttatacttgcataagtgttggaatggcccgtgatgacatatagcatgattttttcaatcctgagactttttgggtttcttagagaaaactaacatgtcaacttgtttgaattttcattgccacttctgtgcttttgaacatcagaactataaccattacttttgcatgatgcattttttcatgaactaatacatttaagtttccaagtatgggatcttggtggtcaaacaagcatcaggccatactggcggtgctactttccaaacacccaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaattaagagccgccaatgggcgattttcaaaacatctgcaataaagggagaggggctcttcgaaggtttggactggctcagtaacacgctcaaatctggaagcagctaaggagcctccgcctcgtcatgaatcatttgctggaggctaaagaatagccgatgcttgcaagtcagcgcgcaaatcccattctctttgttttaactccagaagttctacaccgccatcaattatctgtaaagtgcgtgttaaattttttggatactacattagatgtacccccaggttgagatcaagaataggtctgtggaaaatgacgagcaaactgtgctactgtctttacccgtaaatctcatggatcatgacaagtttttttttgtaccccaatatgattaaacttactccacatttctatgttttcgtatcagtgatcattacagaaactgctcttaaaaaaaaaaaaaaaaa

SEQ ID NO: 12364 - DNA, 3006 bp, Zea mays
tgcggtggttttagcagtctaccctacttgccgagtaaaggcagaatgagctttcaatttcgagcaaaaacagctagacacaagaattggcaaaacaaactcatgtagcatctagaagccatcctaacacacacgcaactatttggagtttcagacgaacaaataagggacgcacgcgtgatgcaaccttctcaatatatagtaggggtgtggtcatatgggcaaataattcgtgtgttgatatgtagcattgagatgaattaatagtatagaatacgttcaatctacaaacacatgacacgcattgatttgacggtacttattcagtctatcagatgtagagagtacaaagttgtcattgcatgcaggctaaattttagcctatcagatggttgcaatatctccttcttcacgtcataaacagatgccacgtagtagcacggaatgaatgacgacccacaacgacgacctcaagtactactaaacaggtgtactcgatcgccataaaataccacgcttgggtttaattggggttctcttgggtaggtgaggatcagattcagtgtccttttctctgtccgagaaatggatttcggatccaatttaattaaaattccagagcccagaagagaggaggggccgttgatttgaaaccgacacatcgaatacttactcacacgcacgcatgtgcttgccgtccatggcggattagtgggaaaaggcctgtcaggttgtgtgcgctcattgcgtgctggcggcgctttagctcgcggcgagatttccggaaaccttctccgaacacccaggtggtcactggcctggccttggactttcgactccgccacgccagctgctgcgcgcattgcggctgattcaattcaagacgacggagccgctggtaggttggttcgtttggttggcaggtactagttcgtgcttggttagaggaagcaaggggaaggaacagctagctgtgattttgttgattcagcaactgcgattagacagagaagaaacaattatctcgtgactgtttccaagtgatatatttacgtactgttaaaaaaaagctagctcgacacggacatatcacatatataagaatgttactagtacatgctgctacggatattacaatggaatatgctcggaaaggtggacaacaaccgagctgtccttgcacgacgaattttccatcaacgtaaactacttacagtctattggagtagtaattattattatgtgtggaccctgctggcgcgtgttaactgctcacgaatttgctctggtgaaatggcacgtcgctcggaaagcttgacgggaaagcgagtctcggctggctatagtgctagtctagctcatcgaatcagatgcgctgctggtgttggtgttgacgcgtttgtgaagcataataatcgttgcatatattgcaaaaaaataatactccctcaattccaatttataattctcgtttgaatgtggtttcggatttttttttgaaaaaaaaataaataagatgtgtcttttttttatagagaaaaaaagtcaaacaaattataatttgaaaccgaaggagtaatagtttacaagaatagagctagcacaagtacttctgcagagcatggtattagcagagtaagtgttgacgtataaggaaatgaaaagaaaatagagaaaagctacatcatcatcctctctagatctttacacttgatatccacgatcatcacaaatttttcgccatcgtcaacagctagatgcatcgtcctcccaccctggcccatgtctctctcgccacagagcttcaagcagaaacgggagagatccggagagggaggacgagccacaccaaaggctggttaatcaagtagtaaaacaagcagcagcgaccgcctcgacggacggacggacggaccgtgtcgtcaggcgcggaagcagccaacgaagcgcggcaggtggaggtggtgctggtgctggtgctgcgcggcggcggcggcgccgccgtcgaggtcgacgaggtggtgggcgcaggcgccgtggaggtcccggccgatgaggcgctcgagctggacgaagcggtcgacgcggcaggggatggcgagggcgccctggtgccggaagccgtactcgcgctcggcctcctccagcagcgcgccgaagagcgggtgcttgaggtggcccagcggcaccgcgaaccggcgctgctcctccccctccaggcccacgcgcaccgtcacgcaccccttgggcgctgctgccgccgccgccgccgttgccgttgccgtcatgtgctgctggtgctttccgggcatgacggtcgccagatcggtggagctctcgatcggtgtcgcttgcttggttggtcgctgctcggttgcaagaagaacaaggggaagggacggactcgaggggctggtggttagaggcaggaagagaagggccacgggtcggagctggagatggcgaggcggaagacggtgaggggggagtcgcgtagggaggtgggcacgttggacatggccgcctactcctccactagtatgtctcttcgcaacaacgacgacgaagacgattcgggtctgccttgccttgtgtggactggagtcagtcggtttgctgtttgtgaggagagctagctgcggtgccgagccccggccggccgcgcggggcccgctgttatagccccccgcgcacgccgccaggtggggttggtgttcggttcccagttcccaccgccgggtcccgtcccgtgcgtgtttgtgtcgtcccgggggcgacgcaacgctactggaaggtgccatatgcgtgtgcgcggcgtgcgcctggccgcctgcgcgttgtgtttcttccctttctttagggataagcaaccagtccaaagggtgcgagcgcgctgggttcagatagcgccggtcaggcttatcatttttttgtagaacttggatgggacgttttggagttagctggaacgcgtggggatgtttggagtcattttcaagttcgcgc

SEQ ID NO: 12365 - DNA, 2263 bp, Zea mays
taggtctaaatgtgattttacttctgtttaagggctaaaatacaaaaaattctgggggaaaaggacgacgagccaaaccaaagtgctagttaatcaaccaaagcaagcaaccacctcgctcgacgcgcggcccgccgtcgatcaggcgccggaagcagccgacgaggcgcggcaggtgcaggtggtggtgctggtggtggtggtgcgccccgccgccgccgccgccgccgcttgccagggcgccgtcgaggtccacgaggtgctgggcgcagctggtcccgcggaggtcctggccgatgaggtgctccacctggacgaagcggtcgacgcggcaggggatggcgagggcgccctggtgccggaagccgtactcgcgctcggcctcctccagcagcgcgccgaagagcgggtgcttgaggtggcccagcgggaccgcgaaccggcgctgctcctcgccctccaggcccacgcgcaccgtcacgcaccccttgggcgccaccgccgccagctgctgctgctgctgatgatgatgatgcctgccgggcatgatggtcaccaggaaggagctcggtgttctttttgcttgcttgtggtggttgctcgatcaggaaggaggacgaagaagccggccggccgggggctgatggtggttacaggcaggaagagaagggccaggggtcggagctggagatggcgaggcggaagacggtgagggaggaatcgcggagggaggtgggcacgttggacatggcctactcctccactttgtctcttctcaacgacgacgacggcggtgattcgggtcgggtctgcctctgcctcccttgtggattctgtttgtttgcggtgccgagcgagggaggttgggaggcgagggccacgccttttatagcccccgcgcacgccgccaagtgggcccgcgaggtcccgtgcgccgtgtgtgtctcatcgagccgagccagggccagggagctggggcgccgtggagacagtgcgcgtcgcggcccgcgccgcgctgtatctcaaaaccataattttgcaataccatagttttagaatgctatgacatgactacattattttttctacagcagtttaactcaggacatgtttgaagacaaagtgtttcttacatcagtttccattcaaaacagaggtagaagaaaatgctaagtactctgcatatttcagagcacctgctaacggcgtcgcatatttcagaatgctgaaacatggaaaatctacagaataaaaaaaacctcctcggagcaatccactgttgcataacagcacagtcaagaattagattatagctttgatgcacatatatctaaagcagcaaaatattacgactgcgtacgtaaaataaaattccagatgccatggtttgtttgtctagctatgcaactacggcacaacatttatcaaaagttctccaaaaatgacatatcagaagtccacccgtatcctgctttcctaaatctgaaagaaaacccaacttgagcactttcatcaaacaaggtttaaaaagttaaaaaataaataaataggcaagattatttgcctttatggcctcgttgaatcatgatatggttttcccaagtgttgactatgaccattgaattcaggttatggttttacaagtattgactatgacgacggaagaagagaactgcaatactcttctctgctctctctctctccttgttaaatgtggattgtttatatatcttctaaccatagactgcacgataggttagtagtgaatgcaacaagagagatgtggagaattttctttctatggaaagagaagagatgaaggaatggagattgtgaaggagtgctcagctagtaattcttctcataaacgtacacatatccacacttttattcctataggaaagaagcatgtcgaagaacttctccaaggccataaactataacctaagtaggaactttcgcatggaaatgaaagttttttcaagctcatagggtccttcatgacaagattcttcttgcaaatagtagagaagtttcagttgaagaagaattgactattttttctattttgcctttcaataaaatgcaagtaatcgctcagttcaagaacgattttagcatagtggtaagattgttagtctatacttcaatgttgttcttgaggccatcatttcatcgtcaccaaggttgatacaatttccctcaataaacactccaatctaaatttctagcaattccaagttcatgccatattttaaggtaa

SEQ ID NO: 12366 - DNA, 1123 bp, Zea mays
tcgagcaatcgcccttccggttttctccgcagcccccgccccggtcgcggagccgtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgacaattggattcaacgttgagacggtgcagtacaacaacatcaagttccaagtatgggatcttggtggtcaaacaagcatcaggccatactggcggtgctactttccaaacactcaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaattaagagccgccaatgggcgattttcaaaacatctgcaataaagggagaggggctcttcgaaggtttggactggctcagtaacacgctcaaatctggaagcagctaaggagcctccgcctcgtcatgaatcatttgctggaggctaaagaatagccgatgcttgcaagtcagcgcgcaaatcccattctctttgttttaactccagaagttctacaccgccatcaattatctgtaaagtgcgtgttaaattttttggatactacattagatgtacccccaggttgagatcaagaataggtctgtggaaaatgacgagcaaactgtgccactgtctttacccgtaaatctcatggatcatgacaagtttttttttgtaccccaatatgattaaacttactccacatttctatgttttcgtatcagtgatcattacagaaactgctcttaagcccgttctgctacc

SEQ ID NO: 12367 - DNA, 1034 bp, Zea mays
  misc_feature (868)..(868): n is a, c, g, or t
actccataggccgtggggtccccccggcccggcccggcccaaatcacagatctctctcggccccgtgcccagcgctccgaaaccctagcgccgccgcgggtgccaggccgcgagcgtcgccatgggcatcgtgtttacgcggctcttctcgtcggtcttcggcaaccgcgaggctcgcatcctcgtcctcggcctggacaatgctggcaagaccaccatactctatagactgcaaatgggagaggtcgtctccacgatcccgacaattggattcaacgtcgagacggtgcagtacaacaacatcaagttccaagtatgggatcttggtggtcaaacaagcatcaggccatactggcggtgctactttccaaacactcaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaattaagagccgccaatgggcgattttcaaaacatctgcaataaagggagaggggctcttcgaaggtttggactggctcagtaacacgctcaaatctggaagcagctaaggagcctccgcctcgtcatgaatcatttgctggaggctaaagaatagccgatgcttgcaagtcagcgcgcaaatcccattctctttgttttaactccagaagttctacaccgccatcaattatctgtaaagtgcgtggttaaattttttggatactacattagatgtacccccaggttgagatcaaagaataggtctngtggaaaatgacgagcaaactgtgctactgtctttacccgtaaatctcatggatcatgccaagtttttttttgtaccccaatatgattaaacttgctccccaaaaaaaaaaaaaaaaaaaaaaaaaaaaaaaaaaaaaaaataaaaaaaaaaaaaaaaaagcggcc

SEQ ID NO: 12368 - DNA, 986 bp, Zea mays
cattgggtacctcgaggccggccgggcttttttttttacatgtggtcaggaattggatagaaccaggcctcagaaccgtatccattggaagacaggaaccagggggttttgctgctgttctttggaggagaagagaaatgggaggcttgctcttgccgcatcaccgaacctttccaaattctttgcaagcttccatcccgggacctctctctcttcacaaaggcgaccgcaaaaaccttcattacttggcacctgatgtgcacctcttctgttccctgcggcaaggctttccacgctcatcttggtcggccgtcatcagatcagaagccagcggcgacgcggtggtggcgtcgccaggcacggtcatcaagcgtagcaaggaggagctcatcaccttcttcagagacattcagacatccattgccgagtgctcgcgtaaagcttccaagaggacgaggaagcagccgcctgatccgttccaagaggtccgcaggagggaggagcagtcacacggtggaggagatagcggcaccgacgacgtttcagagggaccgaggaaagtgaagagtcttgaggacatgaacgtggctggattgagagagttggcgagggccagaaggatgaggggttactccaagcttaagaagggcgagctcattgatcggttgagaggggctactacgtaataaactaccatgatgcagagcagcttcgcagttaatagggacacatgttcttttcgaacgtatgatgagattaccgaccaaaaaattgtatgatgatgagattaccgactttccaaacgatctagtcagttcattgataagaactagaacaatgtgtgtagttattatactatagaaccggtggagctgtattgttgtactacgccgaaacttttgtgtaggcatggcaatctcctgttgttacgtaagttactttgttatgtacggaattaggtttctctaaaaaaaaaaaaaaaaaaa

SEQ ID NO: 12369 - DNA, 1147 bp, Zea mays
agcagtggtaacaacgcagagtacttttttttttttttttttttttttttttggaacacatggtataatagtttataggaattgagctagtacaggcacttctgcatagcatggtattagcaaagtatgtgtgtggacgtataacaaaaaagaaaagaaaatagagaaaagctacatcatcatcctctatagatctttacacttgatatccacgatcatcacaaatttttcgtcatcgtcaacagctagatgcatcgtcctcccaccccggccaatgtctctctcgccacagagcttcaaaccgatcgagaaacgggagagatccggagagggaggacgagccaaaccaaaggctggttaatcaagtagtaaaacaagcagcagcgaccgcctcgacggacggacggacggaccgtgtcgtcaggcgcggaagcagccgacgaagcgcggcaggtggaggtggtgctggtgctggtgctgcgcggcggcggcggcggcgccgtcgaggtcgacgaggtggtgggcgcaggcgccgtggaggtcccggccgatgaggcgctcgagctggacgaagcggtcgacgcggcaggggatggcgagggcgccctggtgccggaagccgtactcgcgctcggcctcctccagcagcgcgccgaagagcgggtgcttgaggtgacccagcggcaccgcgaaccggcgctgctcctccccctccaggcccacgcgcaccgtcacgcaccccttgggcgctgctgccgccgccgccgccgttgccgtcatgtgctgctggtgctttccgggcatgacggtcgccagatcggtggagctctcgatcggtacggtgtcccttgcttggctggtcgcttgctcggttgcaagaagaacaaggggaagggacggactcgaggggctggtggttagaggcaggaagagaagggccacgggtcggagctggagatggcgaggcggaagacggtgaggggggagtcgcgtagggaggtgggcacgttggacatggccgcctagctactcctccactagtatgtctcttcgcaacaacgacgacgaagacgattcaggtctgccttgccctgtgtggagtcggtcggtttgctgtttgtgaggagagctagctgcggtgccgagc

SEQ ID NO: 12370 - DNA, 2232 bp, Zea mays
tgcagggattcaaactgattttaagaagcgccatggctaaactaataatgttacactttcttaatgcagtatatgacacgtggagttcaaaagaatcttgccataagattatttgacaaccaaacacttgttaacttgctcaaacttatttaaggtgaagtgcggcgaagtgtgatgtgagtagcaaccaaacgtcggttgttagtgttgaattttttatatataaattcggtcaaagttaagattagtttggattttaatcagtccgcgcgttgccaactcattacagaattgacccgttaccctgtaaacgcaaaccatctgccaagaattggtcaacaattatagctttcttgcagcagaaggtgacgatgtggatgataaacaaacacggtggcaagccccccggacagacaaaaggcccttcaatcgatcgcgaactctgcggtagtcctcgccaacgtgaagcaatggaggtcgggggcggcgagaagcacttcgtgctggtgcacggcctctgcctcggcgcgtggagctggtacaaggttgccacggcgctggaatccgccgggcaccgcgtgacggcgctggacctggcggcgtcgggcgcgcacccggcgcgcctgcacgaggtgcgctcgttcgaggagtactcgcgcccgctgctggacgcggtcgccgcggcgcccgacggcgacaggctggtcctcgtcggccacagccatggcggcgccagcctcgcgctcgccatggagaggttcccgcgcaaggtcgccgccgccgtgttcgtggacgccgcgatgccgtgggtcggcaagcacatcggcgtcaccaccgagggggtacgcacgcacgcacaaccattattgtttcgccactaatccactatatatatatgcctctagcatgatcagctagctcatgtcgaagttggaaacttgaacgcttgcagttcatgaagaaagctgcatccaaagggctgctcatggactgccaaatcgtggccatcaccgacggcaccggcagcgaagaaggcgccgggcagcgagggacagcgatcgtgatgggtccagagttcttgaagaagtgctacaaggagagccccgcggaggacctgaccctggcgacgctgctggtgaggcccggcaaccagttcatggacgacccggtgatgaaggacgaggcgctgctcacggccgccaactacgggtccgttaagaaggtgttcgtggtcgccaaggccgcccatggatccagcgccagcgccgaggaggtgcagagctggttagcggccacgaaccccggcacggagatgcaggagatcgccggcgccgaccacgctgtcatgaactccaagccgagggaactttgtgacgtccttgtcgggatagccagcagatacgactaataagaatgtcgaacactattattgccgccgcgcaactaggcgtgcatgatcggttgatgatgtgtaatttgtgctatctttaaaatagttattatgcttaaattttacccaaaaaaaaaaaaaaaatcaaattccatactataaatattgcagactataatgtaaaaaatattttgcataattatatatgcgattggttggctatagccttacaataaaaaatagcttcaaacatctcccactactaaactgtttggtagtccaaatcatcggagaccagaccttgcaacaaaccccaccaaacacgtgttaaataaaatatttaggtttccttttaaatacaagtccatttgtcttctctaaattctccctcaggttttctctctcgtagcatctccaaaatgagaccctaagtagagtcgcttctttattttacaggttggaggaaaaaaacaaaatataattgtctcaaatcaagtctctatattatttttatcaagaccctcaaattattcccttggccccatcttcgagggatgtgaaggttcgttctctcggtttttctttaagtactagttttggaaccccattttttcaaggggtttctatttttccaaagaaaattagtttattttctcttggaaaaatagagatcccttggaaaaaatggagttcccaaactagtcctaattatttttttttccaaccaactccttccctcgtttcctttttttgtttctgtcgttttctttctttcgcttgtgtcatctccgccttccatgtccaggattgagatcctccactgtcgactgcaatagctgcag

SEQ ID NO: 12371 - DNA, 4625 bp, Zea mays
ccccttttgaaaccagcagtagctagctcaagtagtgctgctgctcgtcggaggactgcgtcgccacaaaagatattcagagaaagaagaagaagatgcagaaaacagaaacagctcaagcttccattgctttgttttcaacttctatctctctcacacacacacgcacatgacaactgcgtcttagttttttttattaaaaaaaagaacatgccagttctgtcttttcgccttgttatctgtcacaatgcactggttttcctaatcccgttaatccattgtttggttatcgtcatcccatatagattaggtgagactgaaaatgattttgacttgcttggaatttacgcctaccaaatttcatccaaaccacgttgattgagattaaaacgaacaggctctaattgatccagaggaggagttatgagaagttatggtcagcaagttccacaatgtggcagaaggaattgttttttatatattttgcgccagggggggtaaagaaccagatttgttctttgattaaaatgtagctagcaggaccaagaactctggttttatgaaatgtagctagcaagcaagtcaacagaagcaaaatttaaccattgggcccccccgaagcctaagcaggtggaaatagtcccctcataggtttgacaaccagatggatcctgggtttctgatgttgcgggatcatgaagcaaaccacgaagcaaaatccttctttgggtctcttatatatgcggagaattgcaggcgcaaaaattcgagatgcaagctcagactgagagggacagacacaggcacacgaaaagagagactgagagagagagaaaagaagtatatttttttttaattatgcagcgtccatggctctgtctcctgttgcagagctcaccgtgagtaggtcccggcgaatgaggtggagttgcagcggcaagtagaactctggctccgagcaccaatcatcagcggccgctaaagaagaataatgcttgcaagcgagctgcaaactgaacatcgtgctctgcggctgcgctcgacgtgtctgcgtcgacgtgtttttttctgaatctattacgacaactttgtgagaagaatcgttgtgaactggtgagtggcgaggggttgtgttgcttcaggcagcacaaggggccggccatcttgccaactgtcctttgcaaactctttcatccttggattgccaacagaagacgcggcaaaaagttgattcgatcagtgccatttttcagcgttgctatctgatgcaaacttgatccagtgacaattttttttttgtctgtgttcattcataggatcttcagcactgcacttcgtcctacgttggttgacctgcagcctgatacgctacgcctgatttataaaaaaaaggggtcggtcttacatcttctctctgatatgtgaacaggagcaagattccatttcatccccgtcaaacactgccaccgtgtggcgcagttggagacgccatgaactcctactagatcctaatccattgaaccctctccagcagcagaagcctatgctttggcgagccaagaaacattcttagaagggaccgaactaaactgttgcaacaacataatctcattaaacttctcacaatagccagatataataatacgcatagtgagaaatatggtattaaattttagaggacgctttagagggctctatggatcgggagcggtagaccgccgtgtttagcaccataccaaacacattttttctaggttttcgcgtttgcatgctgcaacaagcagaagaagaggactaccgtctacgtataaactagaccgagttcctttcctgcttacatcaagcagcaggcaataattggtgtgctccgtgcaatcaagcgatgcgacgtcggcatacacaaccaatcatcgccggcaagtccgagtttgattttggcctcggattccactcactactcggatgggttgtttatgtggccgttcagatggtgaagtatcatcaagcaggtgcagatcggaagaggcatgcttctttctgatgcttgctacacggcagcagcagcagcagcagtcctctcctgctaagcatatatgcatgtttatactagttagattagatattgtgtgtacagtacagactgctgatacaaccatccaattactcactaattctattctggtttaagcagtggtgcactagtacgagcagcagcagcagcgtcgtgaggtcacaactcacaactcatgacgaaggggatcaagcgaccagacacaagtcactgtttattaatgcgtcatttggagcagcgatgagacgcttagtgatcttgtcattgaacaggctggatatataaatggacacacatgtgagtgtgtgtgcctttgtaagcatgtcgatgtaatcttttttgtgtttttctcttggcctgttggcctagttgtctttaaaaaaaaactgagctgacagaggatgtctgcagggccattgcaataagtgataattcagtgggagacggtgtgttggcagcaatgtaatgatttctagttagtactaacatgaggaatgatgtcatctcaccaaatttgagaaatagactcacatcttagatgaagtgatttctcaaaccaaacacttcctaattattcaacctcaggggctatgagattctagaagtgttagatatctcaactcttaaccatctcgtcactgtttgtactctctctggaatgcgaattgtaactttcttgttgacagtaagtacgaacgaccagcttttctttcttgatactagctagattggtttctaccattttctggtggtgattcagagactggatatggaagctatggctttaaaacatagaaacggagatgcatgatatacagtccatcgtcctctcgatcagagagagtatcctgtctaaaaggattcagaggattagtttgtacaagaacaggacaggtttccagagacgaagcagccattgaccggacgtaatctatctccaagccctcgtagaagccatgaactgcaaaagtcagaagaagcagctgagtcagtaacaattaatcctgatctgattcccagccgaagcttctttctgtccctccaacggaatctgtccatggttcatcaaccatgcgtgtgctgccgtggcacggcgtcgactcggcgcgaatcgacgccgtctgcacttgcctctgtgcccaatcatcgtcgctactgcacgccgcagctgcgaatcgatccacataaaacaactccgtgtcagtaagcatgcagaagccaactgattcttcgtctccttcgaaagccagcttgtgatttgtttatctttaaccctttcagctccagctccagcctagctaatactaacagttatagagctgagtgactgacacccattggcggctggactattaatttatgcttggcgtttgtaatgctcggcctataaatacgcctgctcagtgatctgatgctccttaattcagatatatacagataagattttcttgctagcctcgaatcgcgatcgagtagctcatcagctgattcacaagtgcaagcatttgatgaagaggtttgcagttcaggagagcgagatggcgcgcatgctggtgctcatgtcgcgctcgcacggccaggaccaggcgctgccactgtcggcctgcctcgccggcggccagcaaggcgaggaccggcaggcgccggagcgcgtgttcgtgtgcaagacgtgcaaccgcgtgttcccgtcgttccaggcgctgggcggccaccgcgccagccacaagaagccgcggctggacggggacggcggcggcgacccctcgctcgccaagcccaagctgcacggctgctccgtctgcggcctcgagttcgccatcggccaggcccttggcggccacatgaggcgccaccgcgccatgacgggcggcgtgccggcggtgccgcccgcgacgacgaggatcgtcgtcgacgagaagccggacggcgacgtcgtcggcatcatccgccacgaccacggcggcgtcaagcagcccggcggcgggctgtggctcgacctcaactacccgccgtgcgacgacggccgcgacgcggtggaggcggagtgtggccgcaatgccgccgccgccacggggatcacgttccatcagttcctcgacactgccaccatggccgtcgactgccttggctactagatagatagatatataccaccaagctccatgattcttctcccctgccgcgtactactggtgcaccggtctcttcttcttcttctttcttttcttttcttttctggaatcttcttcctcatttgcttctgggcggagggggagaaatccacattttgtagcagtagtagaatgaaggtgcctaatgcatgcatgggcttggctgatgtgcatgaaggttttgggatgtctttgagctgctcggtggataatctggaggattgattccaccaaagctagcttattttgccttgggtttcatgttattatggataaaaaccctttggtcaaaatggctttgatcgttgtaattatttaatctgagcaagataaacattatatatacagagcttgtggttgtgggtttcttcaggggtaccgag

SEQ ID NO: 12372 - DNA, 5012 bp, Zea mays
  misc_feature (2805)..(2805): n is a, c, g, or t
  misc_feature (4113)..(4113): n is a, c, g, or t
cccacgcgtccggtagatccaccacccctccccttgtcgcatcaccttttctactgcaaaggggcacaaaaggtcctctaaaccccaccagcagcttcccctccgatctcaccccaccgccgccggcgagatctccaggatgccgttggccgggcggcgggacggccccctaatgctgcgaggcggcggaggcgggaaacccctgtcacgcgggtcccgcatcgcggtggccgtcgctgtcggcgtcgcactcggctgcgtctgcgccttcctctaccccaacggcctcttcttccgcccgtctgcctctgccctccaatggacgcaccaggttgattcaactgcttgcgaatcatcaagacgagttaccaaccttaagtcccaggtgtcatcattggagagagagaatgttgaacttaggaggcagattaatgaattatccatgaagcttcaaatcgctggacaagggaaaaatgagactttgtacaagcctggtccttttggagctgtcaaggctttgagaacaaatccaactgtaatccctgataactctgttaaccccaggttggccaagatattggaagaggttgctgtgaaaaaggaactcattgttgcgttggcaaacaccaatgtgagggagatgcttgaagtttggtttagcaatatcaaacgagttagtattccaaactacctggttgtggcattggatgacaatatagaaagcttatgcaaatctaaaggggtgccagtctaccggcgtgatcctgatgaaggcatcgacaacattgcaaaaactggtggaaaccatgccgtttctggactcaagtttcgtgttttaagggagttcttgcaacttgggtatagtattctcctctctgacattgatattattttcttgaggaatccatttgatcatctttatagagattctgatgtggagtccatgagtgatggccacaacaacatgacagcgtatggtttcaacgacgtgttcgacgaaccttctatgggttgggccagatatgctcacacgatgcggatttgggtgtacaactctggatttttctatataagaccaacggttccttctattgaacttcttgatcgtgtggctggccgtctttctcgtgagccaaagtcatgggaccaggcagttttcaacgaggagctgttcttcccgtcccatcctggttatgagggccttcatgcatccaggagaaccatggatttttatcttttaatgaacagcaaagtcctcttcaagacagtgaggaaagacgccgggctcaagaagctaaagccagtgattgtgcatttgaactaccaccctaacaaactagagcgaatgaaagcggttatcgagttctatgtcaacggcaaacaagatgcactggatcatttccctgacgggtcagaatgaggaaattacagatagttgccggtaaagaaacctataccctctgtatcctactcattttggggtgttctggcgtttggatctacatgtcgcagatgtgggatctccacacgtgcgagaatgtttggcgagtgcaacatggatggatgcattggctttgaggtatttggatatctccttggtctctagtccctactaacctcaaccgttctgtagcaaatttgtacaagcttagatagatggctcatcacgttttttccctttttccgtacaattttttgaggttcgaattttggaagtcgaggcggtttgttctggactggtgatacgttttgatgctggtgtttcttgtgtggtggtttattgcttgtggtttgagaaccttttacggtttcatttttttaacgaaacaatattgtgggcaggatttgagcacgtggtcctcctgtgcctgtcatgcgttctgggtttagatttagaggtagcacagctagcgatgtggtcctgtttgtttgtttctgcagcgtcgcttgaacaaaaggcaacgtggggccgggacaagcagcgcagtcatgtatagattcccagcatagtgccagcatatgcttgtttgtccgatgtcaacgtcggccaggcgcctgctagcgccctgcgccctacgtagcgggccgtgctatcaaattgcctagggccctgttttttgtttgtttttttaacatacgacaaactatgataaagtaggcagcaaatcaaacatgtcctaattattcttgagttctgttctattttttaaacatatgtagttctaaaaactctgctctagaaaaaagaaagataaagttgagaaagcagagttaggggagcggtaccaaacgaactctgaacactactccgctctctactgtgtgtaggtcggtaatggatcacgatctaaatgttttttcacaatttgttagggttctaagttatttctagttcaaaaatgaatataaatagagctcgatcctaatccaatcattttatagtgtaaaatttaaagcacattgtcacttctaaatgtgcatgtggcgttcatgccaaaacattctcgccaacttaattttgttttctacactttgtgaaagtggctcatacggttcatttatttagatgtcagatatccagatacagcctaactaggcattagcgtaatcgcgcccaagttgagcaaggttacgtccatctgagatttgtctcagctattgttctaccagttcataacaatttatttccaattgtccattttgtaggtaaccacgatgtatcctttttcttgcagtttcagttggtaagttctaggtgttaagggcagtcgctctgtctgtttcttttattttcttgctcgttantactattttagatcgcttgccactagtttggtgatttatattatagtctacaaggaactctgtccaagagctagtttgggaaccacaatgtaccaagagatttctattttcgaatggagaaatgaactaatttcccttggaaaaatataaattccttgggaaattgtggttcccaaactagccctaattctgttaatgaaacacgagctttatttcccgactgcgaaaaagtaaactagcatggagaagtagcaacctaaaaatctcaatgcaatgtaacagttacgtgacgaagcggcaacataaaagtctataaaagtctaatatgtggtttggttaatatattgataatataacgagataatataataagtaatcgatgacattaaatcatgtttgtttaagtctaatcataatcgataccacactatacatggatatcgtcttattcaaatttattatcgtcggtattcgagtgtgaatcgttatcattaccatttacgttatatttcgtgaaccaaaagacactcaatgcaatctctacatttttaaagtgtaagtgtcatcgtgcgtcctccctactacccttctacgtgtgtctgctctcaaaaaaattgaggcgtggccgcgtgggggactaaacctgtgctcatggaagaggaaaccaattgaaaaacattagcaaagaacagcaccacagttcatttgctggcgcgcacctttgcttcggccaaggccatgaccactggttttccatcatcgtcgtgcgtcgccccttcctcccgcatttaaaagttttaaaagctgaaattatacataaatgaaaattcaaaccttggttattggcttcaagtccacattcacacacacctagccaactaaacatatatatatctttgtattttatactatatactcgagtatagatgaaaaatagtagcaatggacgacacattgctagtgaaacaaatgtacgactcatggtcaccgaaagggttccgtcggtggctttcccaatcccaaccacatgggctcagtggaagcacaaccaaaataagtgtagccgagcggaaccaatggttttgaacacagcagtaaactgaaactcggttctggatcatttgtggagacaggttgggattgcttttcatttttatatttttaaaaatcaaaatttcaaatatatatgcaatgatccctatttgtaagaatgtgtacctacctcgtaggggaagacagagacctattagtcattttttttgcatttcagtccctgttgctggggcgcaagtctccctccccaagccnaacctacaacccaggacttcatttgagccattttcattctagtgaaaatctagagaggggtgagggatgtgagagaaggaaagctcttaaacctgtcgaatttcatgtatgttgtgtcttagtaaattgtgttgtcctgttttatttcaatttatattgtacattgccatcattaattacttgaatttttaatatatttttcatatcttattttagccatgcacatgtgtcgtcgtttcagaaaccagggacacagtagaatttgtgttcggttggggaggctagcatagactcactccgaatagtgaatcaagagactcaaacagggggtttatactggttcaggcttgcgccctagtctagtgtagtggtgatcgtagtattgctctgttacaatggctgcaagtgtgagaatgagtggaagcggagagcttaggtcagatgctcctgcattgttgtttcgtcgtccccccttttatagttaaagggcaggctcttacaaggggatttgtcgtccgaagtagggcacgtcctaatgtctatggcggtctcgctgacgtagttctactaacgtcactttctagtacgtgcatagccgtatgcctggcatggcagattgcttttgtctacatggtatgtgtgtcactatagggacttcgacgttgagtttccttgtagtgacacctggcgcctggtgggacccacatgacgaagttgggggatattgagggccatacgtggtgacgactcgtcccattgtcatagactctccatcaccctattggcacgctgtggcgtcatccaagacagtgtgtggtggcgacgtgtcttaccgaggctggtgtgggaaaacagtgcatgccttaactccacgtcaagcaggtacaggcgtgccacta

SEQ ID NO: 12373 - DNA, 1813 bp, Zea mays
  misc_feature (1552)..(1552): n is a, c, g, or t
gggtacctcgaggccggccggggtcgatcaccttttctactgcagaggggcacaaaaggtcctctaaaccccaccagcagcttcccctccgatctcaccccacagccgccggcgagatctccaggatgccgttggccgggcggcgggacggccccctaatgctgcgaggcgggaaacccctgtcacgcgggtcccgcatcgcggtggccgtcgctgtcggcgtcgcactcggctgcgtctgcgccttcctctaccccaacggcctcttcttccgcccgtctgcctctgccctccaatggacgcaccaggttgattcaactgcttgcgaatcatcaagacgagttaccaacctcaagtcccaggtgtcatcattggagagagagaatgttgaacttaggaggcagattaatgaattatccatgaagcttcaaatcgctggacaagggaaaaatgagactttgtacaagcctggtccttttggagctgtcaaggctttgagaacaaatccaactgtaatccctgataactctgttaaccccaggttggccaagatattggaagaggttgctgtgaaaaaggaactcattgttgcgttggcaaacaccaatgtgagggagatgcttgaagtttggtttagcaatatcaaacgagttggaattccaaactacctggttgtggcattggatgataatatagaaagcttatgcagatctaaaggggtgccagtctaccggcgtgatcctgatgaaggcatcgacaacattgcaaaaactggtggaaaccatgctgtttctggactcaagtttcgtgttttaagggagttcttgcaacttgggtatagtattctcctctctgacattgatattattttcttgaggaatccatttgatcatctttatagagattctgatgtggagtccatgagtgatggccacaacaacatgacagcgtatggtttcaacgacgtgttcgacgaaccttctatgggttgggccagatatgctcacacgatgcggatttgggtgtacaactctggatttttctatataagaccaacggttccttctattgaacttcttgatcgtgtggctggccgtctttctcgtgagccaaagtcatgggaccaggcagttttcaacgaggagctgttcttcccgtcccatcctggttatgagggccttcatgcatccaggagaaccatggatttttatcttttaatgaacagcaaagtcctcttcaagacagtgaggaaagacgccgggctcaagaagctaaagccagtgattgtgcatttgaactaccaccctaacaaactagagcgaatgaaagcggttatcgagttctatgtcaacggcaaacaagatgcactggatcatttccctgacgggtcagaatgaggaaattacagatagttgccagtaaagaaacctataccctctgtatcctactcattttgggatgttctgccatttgggatctacatgtcgcagatgtgggatctctccacacgtgcgagaatgtttggcgagtgcaacatggatggatgcattgnctttgaggtatttggatatctccttggtctctagtccctactaacctcaaccgttctgtagcaaatttgtacaagcttagatagatggctgatcacgttttttccccccttttccgtacgattttttgaggttcgaattttggaagtcgaggcggtttgttctggactggtgatacgttttgatgctggtgtttcttgtgtggtggtttattgcttgtggtttgagaaccttttacggtttcattttttaacaaaaaaaaa

SEQ ID NO: 12374 - DNA, 1309 bp, Zea mays
  misc_feature (1287)..(1287): n is a, c, g, or t
ccgcttcaactgttgacccatcatacggtcatacggagtcgaaccggacaggatggccgccgctcgcgcacgggtgctgcgcgagctgccggcaaggtgctggacgaaatgcctccgccgcgcttcccctttcccctccacctcgcccgccgcctcctcgctctccagcctcagccgtgcttccacgtctccctttccgctcgcctctcgctcccggcgccttctacactcgctgccctcggcggcggtgcgcgtgcgcgtgcgcgcgcagctgcagacgcgcttcttggcgagcgaagccgcgcggggcggtgtcggcgggcgcgggccagcagcggacagcgaggaggaggcgcaggagtgggcggtggagtgggaggacagcgaggacgacggctacgagcccgagatcggcgacggcggggacggcggcggggtcgcgctgcggggcgtcggttggggcgagcgtgccctcgtggcggccgaggaggttctcgccggccattttggggatgacatcgcaatgttcgccttcaaggtgtcgcccaagggatacgtctacgtgcgcctcgacaagctgaccgacgtgtacgggtgccctgacattgaggaaatagagaaattcaatagactctacaagcagaaactggatgagatcgtcgaaagaggcgaaatatccctggacctggcactagaggtatcatcgccaggcgcagagaggcttctgaaggtgcctgaggatctggaccgcttcaaggacatggctatgagggtgcagtacctcgctgaaggcaacagtgaccttgcgtcgaagcagagcctgctgaaggacggcatcttcttgctcgagtccgttaacgctgaggctgggcactgtgtctggaggctggcagatgtgaaggaaaaccgagcagaagctgggaagggaaggccgctgaacaggaagcagagagactggaggctgcagacttgcttcaccgcagtgaagaaggtgaccttgtacttggacgccaactagtaaatccgggccaggaggactattatggcttgtgaaaactatcctaaccctagcagattatgtagaataagaatgttgggttttctttatatagagtagagctatgttggtaggctgcacaaattggatatccatgaaattgctttgctatgagttgctagtgcgaaattgactgatgtttctcacacttgcagtataatgacacctttttctttacaaaaaaaaaaaaaaaaaaattataagatgctttattatttttagatccacanaaaaaaaaaaaaataaatttat

SEQ ID NO: 12375 - DNA, 2112 bp, Zea mays
  misc_feature (2063)..(2063): n is a, c, g, or t
cccctgctgcggcgacgagtacgcgctcgtggacctgcagtccgtctgctactaccccacgtccaacgccaagcccaagctcaatagcctcgacgaggtcgacccgaagctgcccaagaccttcatcccgctcaccgagcagaagcacctctccgacgtcgccatcgacgccgtcatcgactccgcctccatcaccatcacccaccacgaggcgctgatggccaagggtgtcatcttctgctccatccccaagtccatatgtgagtacccagaccttgtcaggcactacctgggcagcatcgtactgccaggcgacaactactatgccgccctcaattcagcggtgttcagcgacgggtccttttgcttcgttcccaaggacacagtctgccccatggaaatctcgacctactttaggatcaacaacaaggagaccaaccagttcgagaggactctgattgtggccgatgagagatgcacctatgtcttgctcattgagttgtgtcttcaggttgatggtgttaaagttcggcttccgccttggccaccacctgtttggacattctggctgccttatgatgtgtgcagcggcatgcattacaactgcagagactgtgcctggttcaagggtatttggcagccactatttttggtgaccccattttatattcgacagctgaagcttggttgggacgtttttctggggaaggaagttggagagccgcagggactgaagtggttggctgttagttcggggaatatggctgagaagatgcaaaaagggggggcaagtatgattatgcctatgaatttttggagtttgcaactgaattctcgagttcagataatggtgaagatggtgctactttactgatgtataaacattatgctgcaactgctatttccaaaggaatccattgcttgtctctgcgccttactgatgaatactcctcaaatgcccatgcacggaaccggttactgccaccagaactattatttttgctttctgatacgaaaacacattctcggatgcattcgtggattgctctcaattccatttctcctgcaatagtcgaagtaaaaggtgttcaccagtttgactggctgacaagagaaaatgtctcagtactagaggctatagaaagccaccgaggagtcagaaatcactatcatggagatcatggaacagtttctagtgcaagtgacaatcctagtattattgcttcaaagttgcaagctcgaagccccaaatacatatccctgctgaaccatcttcgcatttacttgccccagctctttcccaacctcaacaaggtggttttcctcgatgatgacattgttgttcagcgtgacttgtctcccctttgggctatcaatcttgaagggaaggtaaatggagctgtggaaacatgcagaggggaagacagctgggtgatgtctaagcgtttcaggacatatttcaacttctcgcatcctgtgatagctcggagccttgacccagatgaatgtgcttgggcatatggtatgaatatatttgatctggcagtttggaggaagacaaacatcagggatacataccatttctggttgaaggaggtaatgcattttacacccacatatccatttcccagtcttactcgatgttccattgttcgttgactatgtttgtgaactgaaatcgttctggtatttttgcatgcagaatttgtactgtacggtattccaaaatcttaaaaggaaaccttgattcaacactcttgtgcaaatgtgaaaaatgaatttccttttctgctatccggctcttgtcaccatgtgcttatatattataacagacacagaaaattataaataaataaaaaaacataggtaactgctgcttaaaacataataagagttgttggttgtcaattgtcattacctgtcttcacatttatttcaatctcttctgcaggcccgcaaatctggtcttacactctggaaatttggtaccttaccaccagcccttatagcatttaggggtcatgtgcatggtatagacccatcatggcacctgcttggcttangatacccagacaagacagatattgagagtgtcaggagggctgcagtgat

SEQ ID NO: 12376 - DNA, 2185 bp, Zea mays
gctggagctccaccgcggtggcggccgctctagaactagtggatcccccgggctgcaggaattcggcacgagagagagagctcactagtcccccccccccccaccccccccgccttcatcctcgctgccgtccccgcgctcgaggcaggcggaagcaagtgctcctccgtcgattgcttggggaggcgaatagggcctagtttccttggtaggcagggaggtgattctacaaggctggtgcaagatttgtatagattttttgatcaagttaacaaggaggaattcccacctgatgaaaagttaccagaatcattcagggattttcttttggagatgaaggataaccattatgatgctagaacatttgccgttaggttgaaagctacgatggaaaccatggataaggaggtaaagaggtcaaggttggcagaacagctgtataaacattatgctgcaacagctattcccaaaggaatccattgtttgtctctgcgccttacggatgaatactcctcaaatgctcatgcacggaaacagttaccgccaccagaactgttacctttgctttctgataattccctccaacattatattctagccagtgataatattcttgctgcttcagttgttgtcagctcaactgtacgatcttcctcactgcctgagaaagtagtctttcatgttattaccgataagaaaacatatcctgggatgcattcatggtttgctcttaattccatagctcctgcaatagttgaagtaaaaggtgttcaccagtttgactggctgacaagagaaaatgtcccggtactagaggctatagaaaaccatcgaggagtcagaaatcactatcatggggatcatggaacagtttccagtgcaagcgacaatcctagggtgcttgcttcaaagttgcaggctcggagccctaaatacatatccctgctgaaccatctccgtatttatttgcctgagctctttcccaacctcaacaaggtggtcttcctcgatgatgacattgttgttcagcgtgacttgtctcccctttgggcgatcaatcttgaagggaaggtgaatggagctgtggaaacatgcagaggggaagacagctgggtgatgtctaagcgtttcaggacatatttcaacttctcgcatcccgtgatagctcggagtcttgacccagatgaatgtgcttgggcatatggtatgaatatatttgatctggcagcttggaggaagacaaatatcagggatacatatcatttctggttgaaggagaatctaaaatctggtcttacactctggaaatttggtactttaccaccatcccttatagcatttaggggtcatgtgcatggcatagacccatcatggcacctgcttggcttaggataccaagacaagacagatattgagagtgtcaggagggctgcagtgatacattacaatggacaggcaagccatggctagacattgcttttaagaacctacaaccattttggacaaagcatgtaaactactccaacgactttgttaaaaactgccatattttggagcctcagcatgtcaaggaatgacctgtaggctgtagcaaataccggacacacggagggagtatagtttatgattcgtttgttggctggagagactgactgttgctggatgataagtatactggttaatcaagaaagcaaccagcattcaatggaactgaccatcccctgtgaaaactgccaggagttttcatctgtaccataggggaacacaattcttaccatctgtatcatattggtgcatcattctttcctatactgtagctgcgcaaaaaggggctctgggactgggctgatccttggtcgcagaacaacatcagaaggctagaagattgaatgcttggttgatcaagacgaagaaaggaggcggatattatgaggtggcaagtttatatgctttacatccatccatttaattctttttacactcgagcattgaaattttgttctggtagttttgtgattgcttcggtaggttcgagatgattgtagtagagatgccattgtttctggagtaacctacaggatattgttacgattgttgacatactaaagatgtgcagataattctttcaagagtataaaaaaaaaagaaaaaaaaaaaaaaaaaacctcgagggggggcccggtac

SEQ ID NO: 12377 - DNA, 7069 bp, Zea mays
  misc_feature (6748)..(6748): n is a, c, g, or t
agataatgggcctgtagtataaatacaggaggagtaggcggagggacgaagaaaaattaacaagagaaaaaaaaaacgttagggtgcgttagatgttgatcggacagctggtgtttaatttggcatccgaagcaagcaagcaagcgcctgtagaggtaggttgctcatagctagagtcttggatcgctttgctctgcctttgtgcgttccggccgggtttggtgtgtagtgcatggatgggtcgatggtgtcaaaagctggggcacttgcgtttcctttttttttatttttgaacaggaaaaaaaaaaagagaagaagaagaagaagaaaacacacacacacacacaactagcttgcgttgcggccttttctgtcgtttgagcgttgaggaacacggggattgggttgggttgcagccgcagctacagctagcagcttgatggatccgcggatgtgagcagagagcgcatgcatggcacgctttgggggacataaaaaccgggcagagcaacttgaagggcgtctcgtatgggtgacggattcgcatcctctctttctctttgtgtgtgtgtgtgacgctgcctaggtttaattgtatgttccaacagtgtgggcctgtttcttccgagactgaaacttttatctacacagcatttatatacaacttgcttgtgtgggcctgcgcgctgtaacaaacaaaggagaatgtttcgtttaaggccaaaagaaaaaaaaagttcgtgacccgtatatatatggcggtatatatatggtttcctaaccccgtgcacctggtgtgatgaccacaccttttgcgtacgcaagttgatgccctggttaattaataatatgcatgcatggagatgattgtgcagcgtagcaatatacagtagcatatatatagccgtagcatcttggaaagctcaactttggctcgccgagctgctctttcttgttgctgttgtgaaaccgtggtggtgcagatgataagacgcacgtagacgtagggttgcgatcctatgtatatctcccccatcgaatgcagtgatggatcacgaactcgagacgtcgtcggcgccatgccgtagccgtagccgtagcttgggccacgtagtaagtatgttattgtagggctaccatacagccgttccgttccccagtagaaccctacgtacgggtcgggtgtcgcgtggcgtatctcctcacgaactcgagatgcgcggctagcggtggatggatggagacgcagacgcagacgctgttcccttagaggtggcgctcgcaatcgcaaccgccttttatcttttctttttctttccccggtcgcttagcttgcttgctgcagcgggagattattccacttggcagcgcccggttcggtcgtccgtgcgtgccttgtggatcgtgctctgctttgtacttggcacactcttctttccttttcagtcgaaacggggaacgcctcttgggcttggctcttgcttctcccccgacgcgagcctctttgatttggcgtctctttttccttctcccccgacgaaacgggaaccctgaagtgagccggtcgggccacgggaatccgcgcgaccggacgcggcgagcgcacgctacatgattccaccacactcacacttcgtcttcatcccccggccgtggccgatatgcgctctgattggctgcgatggcgagctatgttaagttgttgtgaaccgatcggtctctctcgttagtctacgcttgcattgcattgcattgcatgctttgggcgtgggccggtatctggcactctacccgatcagattagcggcgcccgacccgaatcagatgccgtcacgaccacgctatccgacctgatcccacaccagtacaccacaccgcacgggacctcggcctccttccggggaagcgacggggcgggcggctgcgggccgttgcttgggctcaattagcctggcagaccgatgcccgtctgctcgagcttagcgacgctgcacggacgatacgggccgggcctcagtacagcacagtacagtgacagtaataatgggctgggccggccatgcgaagtcattgctggagagagaagaaccgaacggaacggaacggaacggaggaagggccgagcgggtggggtggcgtaccgggaacggagaggaaggacagcatcgcaacaataagctacgcgcggaggaggagtcagcggatcctggtgaatctttctggaagctccaaccgcgcggcccagctttcggagtggtcctatcctactccgtccggatggattggttttggttttggtttcgggcaccgatcgagctgaggcctgaggctgagctagcagcgaaagaagcgcccgcgcgatctcatcttttcgttcccgtcgcttgtggctggtcctggggtggacacgagaaagatatatagggttgttagatacatggtgacacacgaaagagagggagaagctagggggggttgcattgcattgcagctgatcgatacgtatatgcatgcctgtgctgagatcccggtgagatcttaaccgatgatgtacgtgcgtgtgttgctatactttactgtgagcagagcaggtggtggatggatggacgagtcaccatgcctgctagcttcttgatttgtcgtcagcatgcacctgcctgtgtgctatgtatatacgagacatgagctagacatccggattctccttggctggttaaaaacagaaacacccctacgcctatcctatgattcctatccatccccagcgctgcagtagataaacctaaacggcgagctagctggagtacaagtaaataaagcgcctgaacatccgagatgagctgtccagctgtaattggacgacacactaccaactctcctatctctagctactcccttagcttcccttcacttcacctgcatacagggggctatcatgggaaaaggggacgacaacctttgtgtgccgtcgtgcaaccactacctggaccatacacacacaagagcactagctatgctataatgccatctcacgccacacacacacaagagcactagtagcttgttagccttgcccagtacagcaaggactacttgggacgtggaccacaaggtacgtacgtcgaccgatctacccgtatcctagcctagccacgcactatcgatcgcgccgcgccagaaataaaccctgcccagtgtccagtccaggtacacacaagacgcacgcacgcacgcatgcaccgctcctgctcgttgccccgtccatggatctcgcggatcctacgcgcacgcggtgaatccacggggggagaggtaggtcgctcacatggacctcgtgcacgcagcgcagcgcagcgcagggcagcaaggccgcgcggggcgagatcaggacgagatcgcggtccagatcagcggagatcgcggtccagtctaggctgtggcggagtgtgcgtatctgtatctccgtgagatggacgggtggacggaaagctcgcgcgctttgctttgtcctggctcaccgaaactgtttcggcccggtgcctcgcagcagcgctagctagctctcgccgtcgcccggatgtggaaaccggggccagtgccgcagcgcattattgtgccctctgtatggaaaccttggcaggcgcgcgggaccaccaccggccggccaaaggttaggtgtgtccctaaggttcggcggcctccctgctttgctccgctttgctttcgctgatgggtgaacggacgaacacgatggccgggcttgggcgacaacaacgactggtgctgctgcgtgtctgtacaccatgcattgcagagtgcagactgacagctcgcaacggcgactggagtgtctctagcctgtccagccacctcgcatgctcctgggactgtgcgctggctggctggctggctcctcagctccatccaccatcctcctgcaacctcggaggagacagccaggccagcgcggccgccggccgggcgtgtggcgtgggcgcgtgggcgtatcaccgtgtacgtgatccgagagaaccgtgagcagggtggagcgtgcgttacggcgacggagggaggcaagattccacgattctcgccgtagatcacccaccaggccggccaccgccaccgatcggcagcccccgcactacatccagattccagatcacacacacaccgccactcgcgctcgcgctccgacaagtacgtctataaatacctccgcaccctgctcgtgcgctcccctgagccacaggtacacctccatttggtggcctgcaatgcaaaacccctgcctcgtggtgctcatccctcctccgcctccctctatctcgctgctcgatcttgccacctgcaggggaatcggacgaaatcggtgcctgaacttgcgtcttgtcagtctgaccacgcgcatgggctgttcttgatctcaacccggcgcgcgttgtcactcgccacttctcttcagttgagtgtccatggagctgggagctccacacgcaccgtcgtcctgcatttgttcctcgcatcctttcctcgttctgtgacggcccggtcggatcatccaagaccgaccgacccacacacacacacacaacaaagaaccctcgcgccctcccccggtcggccgaccggtggttagatgcaacgggagatggtgcatgggcacggcgacggcaaccaccaccaacaccagcagctgccgaggtacagcgccgccgcggccgccaccggcgtggcgcgggcgtcgaagaagagcaagcccaagaagatcccgcagcgcggcctcggcgtggcgcagctcgagaagctccggatcgaggagcagaagatggagggatccatgccggtgtcggggcccacgcacctcggcgtcggcgtcggcgggttcggccacctactcccgatgcaccctccgccacacgcgccgctcccgcttctgccgaggcccggcgcggacggcggcgtgcactgcggctacccttcggtgctctgggacccagcgtcggcgtcggcggtggcggaccccatgaagcacccgttctacaagaggagcctgtgcccgctccctccgcttccaacggtacgcgcgccccatctcgtcttcctcttctccaggcggccatgcgtgcagagtgcacatgctgctggctaccgtcaccagagctgacggtgaagcagtggcatgggcaggtgagcgtgggcctgtcgctgacggcggcgtcgtcgagccacccaacggagcccccttcaaaccaaatgtacagcagcggcggcggcggcgcggagactgcggcggcggaggacgacgaggacagggtacacgctgtcgttgaggtttcacaactctgtacttctttattactgcgtctgccggtctgcgtgcagtgaaaatattctcgcgcttgggggtcactcgctgctaagtgtgggttggccagagtgtaggaggcggccggcgtggacagaccctggcccttggtgttcgagggcttgaacacgaccgccttccggacgacggcggcggggaaggcccctctcgcagtcgccgccaggacaacgagagaggccgccgccgccgccgctggcttgccagacgcctgtgccgccgccgacctgagcagatacgagttcagcagagccaccacgaactattacaggttaaatttgtagagctcactcgcatgtttgtggtttcccccagtgtgggttttgttgagtgtgtgccttcatctgagctcgaatttctgcataaggactagcccggcctccgcctgcagctcgaacgcgggggttccagactggtcatcgccggagttggggcactgcaagagcagcaaggagaagggagcctgcccctgcctacctcaccttgagcgcgcagcctgcgccacgcgggaagcagcctcctcctgcgctcccctcgatcaaactcccggagttgggtcactggggcgtcatgcagcctcctcaggcaagtagggttttgcttgcgtcgccgtcttctgctgaaacctgtttgctcgctgcgacgccctttcctcctgacggactgacctaaccggccggtggcctcctctgacagcacgggagcgcttcggcgtcgtcgtccgcgtcggcgtcgcggccgttctacagcttcatgccggctggtccggttcgcatcgacagaccccggatcgggatcaaggccgacgacgcctctgacggcgtcgacctggaactgaagctgtgaaggcgctcatcgctggacccctctgttcctagctggtaaatttgacgccgaacctgaagcgggaactgggaacagagctcgtcgtcgtcgagaagaaaagtttctggcgccgtgttctcggtttgtaacctgaaacacgatgtatcggtatttgcgttcttttttttttctcctcaacattttcccgctcccaataaacatctggtgcgcatggagatggagtgtgtgcagcgtcgagcaggtcttcagtgaggaaaggagagcacgtgcacgatcggggttgcaagcttgcagtgcagctggcctctgtggggggtcttttctgtacagatctagcaaggcagcgtcgtggcacacccagatacgcaccagacagtcaggtagatgtctgccaagatatgcaaatatggttgtagatgttctggttttcctttggatcatttgtgtttgtggatgtagtgctacgtgcaatggaatcaccacatttcccattctatttgacactttaattacatngaaactctatcactcatggatgtttgaatgcactagagtcaatgattagttggctaaaaaaattgtgagttgaattagctaggtaacaaatctagttaattattagctaatttgctataaatagctaatagtggaagtattagctagactgtttagatgtatttagctaatgttagcaattaattattagctctattgcattcaagcattgcatctcactattaaagtcgtacaatgaactctccacgtacgctaatcctcgtggaggaaccctacaaaattgggcgttcttgaaattcttgtgaatgataaaagatacat

SEQ ID NO: 12378 - DNA, 1595 bp, Zea mays
  misc_feature (9)..(10): n is a, c, g, or t
cggccgagnngctgtcacggcctccagccccgccggccgcgaaaccgtcgtctccaccgcccgcggcgccagctgggaagccatcgccatctcccagcccggctccaacgaggtctccggcagtggcgacacccgcgccaagagcgtcgcctccgccgcccccccccgcgccgccgccaaagccaccatctcctccacctaaaacggcgccggctccaaaaccatccccgtccgtggcgccggcgccaaggccatctcctccacctgtcacaccggtaccaccagctccaaagccgccgccaccgccgccgccgccaccggctccgctgcagcctccgtcgaactccacgccgacgacgtcctccgcattgggccagctctcgcccagcttctacgcgcagtcctgcccggacgttgagctggcagtgagggacgtcgttaggtcggcctccaccctggacccctccatccccggcaagcttcttaggctggtcttccatgactgcttcgtcgagggatgcgatgcatcggtgctgatacaaggtaacggtaccgagaggacggatcctgcaaacctctcgcttggtgggttcaatgtcatcgatgcagcaaagaggttgcttgaagctgtgtgccctgcgactgtttcttgcagcgacattgtcgtcctcgccgcaagagatgctgttgtgtttactggaggaccggctgtgcctgtcgcgctgggaagacgagacggcctcgtctcgttggcatccaacgtccgaagaaacatcatcgacacgggcttctccgtggacgccatggcggccagcttcaccgccaaggggctcaccttggacgacctcgtcaccctctcaggggggcacaccatcgggtcggcgcactgcaacacgttccgggagcggttccagcaggtggcgaacgggagcatgacgcccgtcgacgggtcgatgaacgccgactacgcgaacgagctgatccaggcgtgctcggcgaacggcaccgtgccggcgggcacggccgccgtgggctgcgactccggctcggcgtccgtcttcgacaacacctacttcgcgaacctgctgggcgggcggggcctgctgcgcacggacgccgcgctggtgcagaacgcgacgacgagggccaaggtggcggagttcgcgcagagccaggacggcttcttcgcgagctgggccagctcgtacgccaggctcaccagcctcggcgtgaaggtcggcgccgacggcgaggtccggcggacctgctccagcgtcaacggctgacgagggggcgggggaggctgcagaaacttatggtgtagttgtagagcaaggaaaggtgaggtgaggtgtggtgtcggctagttcttgttcttggcccggcgatgcttcggtgggtgagcgaggtgttgccgtgtagccggcgtcaccgtttttagtgaaaaggagcgaaaagaaaatgcagaaacctgtgtagatgacgtgcctgatctgcgtctgcaaccaagggcatagttcactcatgacgatggacactgtactttgacctgataaatgacatagcaagcgaggcgaacgtgctcacgcggttcc

SEQ ID NO: 12379 - DNA, 1502 bp, Zea mays
gcacgagaccattacctagaacatcctaatcgaaaaatcacacaaagccgccaagagtcccagcatcgatcgaacagctagctagctagctatatagcgagagggctccatccatatccatccatctgctactgctagcagctgctggctgttgctgcttgcattgagatgtggatgatcagcgcagggcgcatggagcagtgggcgccgacggcggcaatggtggccaccaacgtcgtgatcgccgtcatgacggcgctgatcaagcaggcactgagcctgggcatgaacaggctggtcctcatcactttccgccagatggtggccaccctgttccttggacccatcgcctacttcaaggaaaggaggatgagaccgaagttcacttccgagatcttcgtgtacatgtttctcagtggaattcttgggccggtgctgcttcagtacacactgtttgtcggattggattacacgacggcaacgttcgctgcaacgttcggaaatatgcttccagtggttactttcctgatatcacttgctttcaggttcgaagcactggaggtgaagagcaagtcggggagcgccaagatctcagggacgctcatctccctcggcggcgcaatgatgctcaccttctacaagggttcagcactgacacaaaccaccaccgccgccacgtcgtctccagcatccagcggcggcggccacatcaggcaacaagccggagagcacggcacggtccggtgggtgctgggctccgtctccatgctggccaacgtcgtcggcttcgcgctgtggctgctcctgcagcggaagttcacccgcaagtacccggccgtgtactcggccacggcgttcatgtcgctattcagcttcgtccaggccggggcgctggccctgtcgatccagaggaccagccttgccgttgggccctcagggggaccgtggagatcgccacggtggtgtactgtggtgtagtggcgtctggcattgggtacctgctgctcacctactgcgtggagaagagaggccccgtgttcactgccgccttcagcccgctcgcccagatcttcgtcgccggcatcgatctcttcatcctccacgagcctctctacctcggaagcgtgctgggatcagtgctggttattcttgggctctaccttgtactgtggggcaagagagaggaagctgctgctgctgctgcttcggcaaagccagtgcaggccgaggtagaacagcaagagaaagtgtgattttttccctttattgttcatcacagtacagcgtgccagagcagagggacgaacataattaactagaagcggaagcctgtgtgagtatgtgacagagagtgcatatgatcttcgagccctaaatctatgtatactactgaccaatataacgcaagaaaatgtatgctgatcgatcgatcgatcgaaatgctgtgaaattctctctcaagtacgtgctgagaaagaggttgggcaaaaaaaaaaaaaaaa

SEQ ID NO: 12380 - DNA, 1933 bp, Zea mays
aacttatttttgcattcactgttttacatttttcgagtggcttgcagttcaaatcagaactatctgaaggaattcaattaaacgaactaaatctaatagttatagctaacactttgataattgtgccaaaattaaatatgtaggtctatatactataggaacacaccacaaaaagtttaattatgtcaaaattaaatatgtaggtctatatactataggaacgcaccacaaaaagttcggtgaaaaaaagaaaaaaatattttaccaagtgttaaggaaaagacattcgacaaacactctctttgccgagtgcccaccaaggaacactcgacaaagaagttaatttgcccagtgtcaactccgaacatgcggcataggttaaggtcaccaactatagatagctgctgacggtcctttaccgtgcgtctcgtttcgccgagagacactggacaaagactcttttgctgagtgccagcgtgtgccgagagttttgtgctcggcaaaggaggtctaagccgagtgtcattattcaccgagagtggcactcggcaaaacttgtttcgtcaagtgcccgataaattgctctcgacaaaaagagcctaattccggtaatgcatccacattttatgggttatagctattgtatatatactcaaatataagaaactgcaaagttttgtgtgtgacagggtcaacacgggatcgaagtagttagcactgaagttgaagagcagcgaatttagaatacctgtggcacctgaaactgaccatatcttgagtggaggcacgacaggccaaatacatacatggcgcggatgaaaaggtcagcacgccaaccaatccgcctcgatcgctgccgattcgccgccgttgaaacaacatacgtctatgtttgactcggaccaagtgtacacactaattttcgatcgactctatcggaccaagtatggtcacagcttaatatactagcacattactagtccacaacgcaaagcaagccctgacgtctgagggtacgtacgttacgtataccttgtcacctaccgcgctcccgtggattacatatactcctatgctatatacctcgaggccggccgggatgcgcccaaatccaacccgcacgtccaaaccatcacaagctctagttttccagctctgcagcacacaagctagttaagctcctgcaacctccaagaaactaggcaatcgtttcctcctctgcttcagtatctccccttccagcagtagctaagctgccatatggcgacaagcaggcttgcgctcgtgtccgtgtttgccgcagccgtcctgctgggcatggcgtcggcggcgacctacaacgtcggcgagccgggcgggtcctgggacctgcgtaccaactacggcacctgggtctcctccaagaggttccacccgggtgaccagatcgtgttcaagtactcgccccaggcgcacgacgtggtggaggtgaacaaggcggactacgactcctgctcaatcgccagccccgtcgccacccacaactccggcaacgacgccatcgccctggcctcccccggcacccgctacttcatctgcggcttccctggccactgcgccgcgggcatgaagatccagatcaacgtcgtgcccagcgccaactccctcggccccgccagcgctcccgccgccaactctcccgtctctcccccgcccatgtctgcgccctcttccgccgctaccaaggccaccggtttcgccgccctggccgccgtcatgatcgccgcaggcctcgtggcttactagatactctgtcgcttgctgcgtacatttaggttcccttggattattatacacgttgtattgtattcttttgagagatcagaatatatatacattattcacttcagttttagttcttcggtgtatgtgtccataattcagatagagatgg

SEQ ID NO: 12381 - DNA, 2007 bp, Zea mays
cgtggagtggaaaatatgccgtagaggttgaagccagagcaccacttcatgaccaacaacatgtcggacataaaatattattatcaatattactttgaatttccataaagtttataattgagtttgagagaattaatctgcgaaaaaaggttactataaccgaaattatgaagtctttataatttgacatactttgtttggtatttgtttccccagattaaccggagaactgggtcgatttttccatcctcgttttatgtgttataccgtaggctgctttatactcaaatgtaaaaagggaactgcaaaattatacatgacatagtccacacgggaccggagtagctagcgtgtttggaataccacctgtagcaacagaaactgacccgatctgactggaggcactacgcggatgaaaaggtcagctcgccaaccgccccgcctcgctgccattgaaagagcatcgcggtcggtccatctacccttcggagttcggaccatgtgtacacactaaattttggattgactctgaccaagtatactagtcacagcttttatactagcacaatgctagtcaagtctacaacggaaagcaagctctgacgtctgacgttacgtataccttgtcacagcggcatttccttgccacctaccgcgctcccgtcccgtacgtggattacacatactcatatcatcctatgctaatgctatacctgtgcgccgcccgccgcgcccgcgccgcgaaacatcacaagctctagttttccagctctgcagcacacaagctagttaagctcctgcaacctccaagaaactaggcaatcgtttcctcctctgcttcagtatctccccttccagcagtagctaagctgccatatggcgacaagcaggcttgcgctcgtgtccgtgtttgccgcagccgtcctgctgggcatggcgtcggcggcgacctacaacgtcggcgagccggccgggtcctgggacctgcgtaccaactacggcacctgggtctcctccaagaggttccacccgggtgaccagaccgtgttcaagtactcgccccaggcgcacgacgtggtggaggtgaacaaggcggactacgactcctgctcaatcgccagccccgtcgccacccacaactccggcaacgacgccatcgccctggcctcccccggcacccgctacttcatctgcggcttccctggccactgcgacgcgggcatgaagatccagatcaacgtcgtgcccagcgccaactccctcggccccgccagcgctcctgccgccaactctcccgtctctcccccgcccatgtccgcgccctcttccgccgctaccaaggccaccggtttcggcgcccttgccgccgtcatgatcgccgcaggcctcatggcttactagatactctgtcgcttgctgcgtacatttagttttccttagatattatatatacgttgtattgtattcttttgagagatcagagttcagacgaatgacatggcatacatgtatctacgtaaagacagatgactagtttatacattattcatattgtatatcattcaggtttcgctcaaaaaagaaaaaaaaaatattaattcagatagatagagatgactagtaatttcgctggctccaggtttctcggtcgtgggcgtcaccgagaaactagagtatataaggttcttgtttctagctagtgtaacgacatatattttaatggtacattaaaataaaaggttataagatacaaaccatttaaatgctccatagtagtccaaaacagccaatagtcaatagctaaatagcgttgacatcaatataagctggtgtaaaagacaaagatgaagtaacctgaaaatagaaatttaatgtgtcatatattgaagtactgatatgaaataatttgataattaacaatactactattctttcaaataaatcatagatatttacctctcataaaagcatttgcggttacgattctccatcttttggaatcggtct

SEQ ID NO: 12382 - DNA, 1196 bp, Zea mays
  misc_feature (1031)..(1031): n is a, c, g, or t
gtatccagatgagcccgcggatcataaaagagtcggctggggttgagtacctgcagaaggcttttgctgatcgctatggacctcctgagacagcaccagcttctcttcccctaactctgcaatggattttgacatcgaagaacattgcggaagaagaatggagtgaacattcagactgtctttcagtaatgccagcagcagggcaggctcctgctcttgttccggtactccgatctggtcatggagctccagtagggcaaccatctccttctgcaggagacacctctggtcaaccagagtgcaagggtgagaagcttgacaagctaataaggattggcctgttgcaactcattagtagtgtggagggcttgcaattgcagtcaactcctgaaagttttcagattaatctgctgaggctgagggctgtgcagagccaattccaacaggtgatcgtgatcgccacaagcatgctcgtcctgcgccaagttctgatgagcgagaactcgagggccactcctctggaactggaaaatgccatctcagaactcgtcaaggctctcgcggacatactgcacagctcacccgattccggcacggaagagattgtgcaggcgatggtcaatgcatcagcctcagttggctcaccatcagaggagaaggttcaggccaggatgcagatgatcacccgggtgttcctcaagagcctccagcccggtgacgtggtcttcaagaaggtatcccgtgcggtctactgcgccttccgtggcatcatcttaggtggcagtggtcccaagggccagaagctggcggacgctgcattgcgccgcatcggcgccaccaatgttgtcgacagggtgttgaaggctgctgaggtgctgatcaaggtggcaacggtatcagagaaggtccacggcccctggtacaaagctctgatagtctgatgtgagcatgaatgtgaatggtttggcttttgtgaatacagacggtgaaagtgtaaatccttgttccactgggtgggatgggagatatgngtgggttggacagcaatttataagttgttggtcagtaggcagttcaggatttagtcaggctcgatggatggatgctaaaacgcgtctggaaatgtaaattgtggcaccttgtttgattttcgaactgaaataatgtaaataattgattgcaagttatttgtgctc

SEQ ID NO: 12383 - DNA, 3905 bp, Zea mays
  misc_feature (2)..(2): n is a, c, g, or t
  misc_feature (46)..(46): n is a, c, g, or t
  misc_feature (3875)..(3876): n is a, c, g, or t
gnggtagaagagggagagtaaagtagcgcgccgcagccgcagcggnaggaaaggcaagggcggcgagggaacacgcggttgcttgcggaaacccgctcgactcggtctctccgcccgcgagttgggttgatcggagggtttgatgacgggggcgcgggagccggtggccatggagataccagcggaggaagggccagcggcggcgagggcgccgccgcggcggattaggaggaggctggtggagggggcgcgcggcggtggggcgccggcgagcgtggaggagatcgaggccaggcttagggaggccgagctccggaggcagcaattccgtgaatggttggcctgcaaagcaaggaagaagccacggagcccgtcgtggtcctctcaagaggaagaccatgggcagcgccttgaagcgaagcttctggctgctgagcagaaaaggctaagcctcttggcgaaggcacagaaccgactcgccaagttggatgaactcagacaagctgctaagaatgatgtggaaatgaggtttgagaaggaaagggaagaactcgagaccagagttgagtctcgtgtccgacaggcagaggagaaccgcatgcgccttctgcatgccgatatgcagaagcgggccgcactgaaggagaggacagcgaggtccctggtgcagaaggcaaaatcagagcccacgcgcccgccgctcgtgcgctctgcaatttctctgaagcgcgctgctgctgtgaagaaacgactggggttgctggaagctgaaaagaccaaggctcaagctaggcttttacgcatccaaaaagctgccatgactgtatgcagccggagagaatcagagaggagaaaactgaaagaacagctggacaacaaacttcaaagggcgaagaggcagagggctgagtatttgaaacaaagaggaagtcctcgtggttcaacccatgctgattacttaaagcatgcatatgccctttcaagaaaactagcaagacactggagaatatttgtgaagtccaggaagacaacatttgctttggctcaagcttatgatgccttggggattaatgagaagtctgtgaaaaatatgccttttgaaaaattggccatgtcaatggaatctcctgtagttcttcggagcacgaaggcattactcgaccgattggagaaacgccttgtcatttctcattcagtagcatcttcatcagtagaaaatgttgatcatctactgaaacgccttggttctcccccaaggaggagggctcctcctagcagagaaggaaaaactcgggcagtggtaaaaagaccagctaaaagttctgaggcaagcatcaaattgcccagatactcactgagggtggtgctctgtgcttacatgatactggctcatcccagtgctgttttaagtgggcaaggtgagcgggagaaacagcttatcgagtcggcagcaaactttatcaaggagttcgagctgttgattaaggtaatccttgatggaccagggcagtcatctggtgttactggccagaggaagttcagggcacagttggctaatttggacaaggcgtggtgttcgtatctttacagctttgtggtgtggaaggtaaaagatgcaagattattggaggaagatcttgtcagggctgcatgcaagcttgagttgtcaatgatgcaaacatgcaagctaactgcagacaggcactcgcaaaacaatcttacacatgacatgaaggcaattcagaaacaggttattgatgatcaaaagcttttacgtgataaggttcaacacctgagtggcgatgctggccttgagcggatgaactctgctctttccgatacgagatcaaagttctttgaagcaaaggagaatgggagtccattgacagcacctgttgcaaatgtgtctacccctttgagcatcaattcgtctgggaaagcaccactttctgaggttcctgaaagttccaggacaaatgttgttgggacaagctctgtagtccgttctttgttcagtgcttcttcgtcatcagtcagttcatcaccagaaaagcagccgacagagaatgaaaaaatggtcaatgaaatgcttcatgaggatgccagtgcttttgctggcaggtctgatagtgctagtactgctgaggaggagttccagaacaaagtgagagaaaccatggagaaagctttctgggatatggtcaccaactccatgaggggagaaagacctgattatagtcaattgatcaacctagtaaaggaagtgagggattcgttgcatgacctggctccaaaagaatggaaggagaaaattcttgagaacattgaccttgaaattctgtctcaggtacttgggtcaggttcccaggatgcacaatacttggggcagattttggagtattctctggatatggttcgcaagctctctgctgctgcaaaggaggatgagatgaagaaaaaccatgataaattattgagtgaattgtctacgaattctgaagttaacggcgatggcatcaactcatttgtcattgctgttatcaagggccttcgtttcatcctggaagaaataaaggaactgaaagcagaagtgagtaaagcacgtatccagatgatgcaacagatcataaaagagtcggctggggttgagtacctgcagaaggcttttgctgatcgctatggacctcctgagacggcaccagcttctcttcccctaactctgcaatggattttgacatcgaagaacattgcggaagaagaatggagtgaacattcagactgtctttcagtaatgccagcagcgggccgggccccccctcgagtcagctacctaggccccccccccggagctccagtagggcaaccatctccttctgcaggagacacctctggtcaaccagagtgcaagggtgagaagcttgacaagctaataaggattggcctgttgcaactcattagtagtgtggagggcttgcaattgcagtcaactcctgaaagttttcagattaatctgctgaggctgagggccgtgcagagccaattccaacaggtgatcgtgatcgccacaagcatgctcgtcctgcgccaagttctgatgagcgagaactcgagggccactcctctggaactggaaaatgccatctcagaactcgtcaaggctctcgcggacatactggacagctcacccgattccggcacggaagagattgtgcaggcgatggtcaatgcatcagcctcagttggctcaccatcagaggagaaggttcaggccaggatgcagatgatcacccgggtgttcctcaagagcctccagcccggtgacgtggtcttcaagaaggtatcccgtgcggtctactgcgccttccgtggcatcatcttaggtggcagtggtcccaagggccagaagctggcggacgcggcattgcgccgcatcggcgccaccaaggttgtcgacagggtgttgaaggctgctgaggtgctgatcaaggtggcaacggtatcagagaaggtccacggtccctggtacaaagctctgatagtctgatgtgagcgtgaatgtgaatggtttggcttttgtgaatacagacagtgaaagtgtaaattccttgttccactgggtgggatgggagatatggtgttgtacagcaatttatagttgttggtcagtaggcagttcaggatgtgaagaattctggtgagctgggcgaatatggatgctctttcaccaggatttagtcaggctcgatggatggatgctaaaacgcgtctggaaatgtaaattgtggcaccttgtttgattttcgaactgaaataatgtaaataattgattgcaagttattaaagaaaagcaaatattggttgcttagttgggagtnnctatgccaataaagtctaaactgccagaa

SEQ ID NO: 12384 - DNA, 2614 bp, Zea mays
  misc_feature (218)..(218): n is a, c, g, or t
tcgccgttgtaccgcgggaccgatttgtgtcgcagagtcccgatatatgggtcatgcacgggtgaaagcccagataggtccgggctttaggtggtctgtggagaaaatatggatcacaaatcgtgtctatttacaacctattttgggtttaagttggatttggatcctttgttggactcagtcttagagcttgaaaaaaagtccgaccgagagctctnacctgcctcgtcccttctgagttctggcggctctcccgcttggtcactcctgcttccttgccgttcgagagctatctgacacctgaacggagttccggttcctctatcggcctgaggtcagatttttctccttttctcctccatcatcgtatttatctaattaattatcttctgtttctccgtcttttcaagccgctgggcttgcgatgcttcgtattccattcatgtctgggtgacttttctagggcattgggtttcttgatgggagacagcaggaggcacgaaccgtgggttatcctccaaccggatggctggctgcgcaggcctgcgttgggattgaacagcctgatgcagattcccgataagattcagagctctcttaaggtcggcttatcaaaaggaaaagatctaggggttcggaactggtcgtgcagatgtgaatttgttgttgcctacatcttgcaataggtgcaatttgggcgtttcttgaacaaggatggtgctggccgccgcatgagtgctgagatatcgtcagagaaagcgaaacagtcgtgttctgctgctgcttccgcggagggtcgcttggataggcatctccaagcttggtgggacaatcctagctggacccgcgagcctccagaaataaaggtgtccacgttgattgctgcagaacacttttatggggactgcttctttatcgttgctttagtgccaaacttacaccgaatcagaataccttaaatgtgttaggacgcttcgtagagttagcttcagttaatctcgaggctgaaagaatgactgacatactttcaagaatgttcatacagtttaagaacttatgtttacattatcaaatgtttacaggtgaatgtaccagaaggatccctttgcaacctcaatctgagatttaaggccggattaccaccagatgcagtatacaatatcataattgatccagagaacaaaagggtgttcaagaatattaaggtgtgtacaggtgtacttttactattcagattgagcaaactgatatggtgcagctgactgaatggtagctctgtttctttattccctttgattgaagatgtcttgaaaatattctgttaattggattccttttcaaattgttttgtgttggatgccaaagcttcagtagttcagttgaacacctcctagctagaacagctcgatagtcggtgctcttgcatagttacacaaggagcttttggatagttcaatgatgggccatgtctacttactactccatgagtcaagaaaaacatgaggtcccatgcatacttaatgtttgtatactgaaaataataagtcattgaaatttctcataagaagaaaagggaccaggaatgtccaggacctcaccatagagctaggcattcatggcaaggatattgtttcacttttttcaggaagtaatatcaaggaaagtcttgctcgacgaaggatcaagacaagtagtcgaagtggagcaggcagcaatctggaagttcctctggtggtctggcaccttttccgttcatgtttttgttgatcagaacagaaaaaaacacactgtaaaaaactgaaacactgacattatcctttggtcagcaaatgcaatactttgcctgatattttgatccatgcaataccttctgcaggtaaagtttaggcaagggcgagctggctttatgaggaagtttgagggttgctggacgatagaacccctttttgttgacaaggaattatgccttcctctgaacccacattcattggaggaatatgaatcttgtactggtggcagggggagagttggatctgccattaccttggaccagcttatcgagcctgctcttttacccccaccacccatttcgtggtacttgagagggattacttcaaggacaactgagatgctggtgaacgatctgatagcggaaactgctcgattgcgcaccatctcaaacaacgcgaatgccaagcaaggtactgaagaaaccggtgatgctaacataggtgatccagttagagagtgtggtgacattaaggaaaggtggcgacagagaagaaaaagtggacgtcatggatcatcccttagattaacaagtcgattcttgtaagataagctatgaagcagtgctcattttaggacccgttttacctgtatcttagtttgtaaggttttggttgtaggtaacattgtgtaagatgtctctttgtgaacatgtagaagctagttgttcaatacttatatatgttttatttatatgaataaaggtttacttgctccaaaaaaaaaaaaaaatggttttgattgtctttagtcccattctaatctccctgaatattaccctaactgccagttgcctgaaaggtaacttgcttcaaccttacatcag

SEQ ID NO: 12385 - DNA, 1355 bp, Zea mays
ctctcacctgcctcgtcccttctgagttctggcggctctcccgcttggtcactcctgcttccttgccgttcgagagctatccgacacctgaacagagctccagttcctctatcgacctgagggcattgggttcttgatgggagacagcaggaggcacgaaccgagggttagcctccaaccggatggctggctgcgcaggcctgcgttgggattgaacagcctgatgcagattcccgataagattcagagctctcttaaggtgcaatttgggcgtttcttgaacaaggatggtgctgtccgccgcatgagtgctgagatatcgtcagagaaagcgaaaccgtcgtgttctgctgctgcttccgcggaggttcgcttggataggcatctccaagcttggtgggacaatcctagctggaccgacgagccaccagaaataaaggtgactgtaccagaaggttccctttgcaacctcaatctgagatttaaggccggattaccaccagatgcagtatacaatatcataattgatccagagaacaaaagggtgttcaagaatattaaggaagtaatatcaaggaaagtcttgctcgacgaaggatcaagacaagtagtcgaagtggagcaggcagcaatctggaagttcctctggtggtctggcaccttttccgttcatgtttttgttgatcagaacagaaaaaaacacaccgtaaagtttaggcaagggcgagctggctttatgaggaagtttgagggttgctggacgatagaacccctttttgttgacaaggaattatgccttcctctgaacccacattcattggaggaatatgaatcttgtactggtggcagggggagagttggatctgccattaccttggaccagcttatcgagcctgctcttttacccccaccacccatttcgtggtacttgagaggaattactacaaggacaactgagatgctggtgaacgatctgatagcggaaactgctcgattgcgcaccatctcaaacaacgctaatgccaagcaaggtactgaagaaaccggtgatgctaacataggtgatccagctagagagtgtggtgacattaaggaaaggtggcgacagagaagaaaaagtggacgtcacggatcatcccttagattaacaagtctattcttgtaagataagctatgaagcagtgctcattttaggacccgatttacctgtatcttacttagtttgtaaggttttggttgtaggtaatattgtgtaagatggctgtttgtgaacatgtagaggctggttgttcaatacttatatatgttttatttatatgaataaaggtttacttgattcaaaaaaaaaaaaaaaa

SEQ ID NO: 12386 - DNA, 911 bp, Zea mays
ccggccggggtttcttcgtagtttttccggcccaatgtcaaaaatgtcgggtcctaaaaatcaattttctcctcggggactccactcggttgccggccatggcggagaatttggcccccgagaagcgccacaccttcgtgcacaacgggcagaaggtgttcgagtgggaccagacgctagaggaggtgaacatgtacatcgagctccccaagggcgtgcccaccaagctcttccactgcaccatccaggccagccacgtcgaggtcggcatccgcggcaacccgccatatctcaaccatgacctgatgcaccccgtgaagaccgactcgtcgttctggacaatagaggatgctgagatgcatataacactgcaaaaaagagagaaggggaaaacatggtcatccccaatacaagggcaagggattttggatccatatgctgcagatcaagagcaaaagcggcttatgctccaaaggtttcaggaagagaacccagggttcgacttttcgcaggctcagttcagtggaacctgccctgacccaagaaccttcatgggaggaatacgctctgagtgaagctccctacctgcccatgttggtgttgtattcccggttggtgtctatcatggaaataatcgtgatgtgtaaccattttgtgtgcaagctcattaattggctgtaaacccttttggcaacctttgcgtgctaaattctagttatagttgtgatcgtcattcagtgttcgtttttagatgtatattaataatatttaggaagagttgatggcaacctctgcatgctaaattctagttatagttgtgatcatcattcagtgctagactgctcgttttttgatgtatttatatttgggggtgagctcatgactaaggctatcttcaaccattctccctc

SEQ ID NO: 12387 - DNA, 837 bp, Zea mays
ccggcatccaatccctcgtcgcagcaaccgtcctcgctccctgcctccctcagttccgctcttcgtctttgggggccattgcccgtgcggccgtgcgtcacccgagcccgtgcccggaatctttgtagaagcgtctggaggactcccacccggctgccagccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacattcaggctagccacgtcgaggtcggcatccgcggcaacccgccatacctcaaccatgacctgacacacccagtgaagactgactcgtcgttctggacaatagaagatggtgagatgcatatcacactgcaaaaaagagagaaggggaaaacatggtcatctccaatacaagggcaagggattttggatccatatgctgcagatcaagagcaaaagcggcttatgctccaaaggtttcaggaagagaaccctgggttcgacttttcacaggctcagttcagtggaacctgccctgacccaagaaccttcatgggagggatacgctccgagtgaagcaccctacctgcctatgtacgtttctactatatcctcggcatcttgatagatgcagcaggcgtgcttattatgtctgtaaatcggttggtgtctgttatggagataattgtcatggaaataattgtgatgtgtgaccatttgtgtgcaagcacattttgcgtgcttaattctagtttatagttgtgatcttcattt

SEQ ID NO: 12388 - DNA, 880 bp, Zea mays
acttaccaggtcggcttcttcatccaatccctcgtcgcagcaaccgtcctcgctccctgcctccctcagttccgctcttcgtctttggggggcattgcccgtgcgtcacccgagcccgtgcccggaatccttgtagaagcgtctggaggactcccaccgacccacccggctgccagccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacatccaggctagccacgtcgaggtcggcatccgcggcaacccgccatacctcaaccatgacctgacacacccagtgaagactgactcgtcgttctggacaatagaagacggtgagatgcatataacactgcaaaaaagagagaaggggaaaacatggtcatctccaatacaagggcaagggattttggatccatatgctgcagatcaagagcaaaagcggcttatgctccaaaggtttcaggaagagaaccctgggttcgacttttcacaggctcagttcagtggaacctgccctgacccaagaaccttcatgggagggatacgctccgagtgaagcaccatacctgcctatgtacgtttctactatatccttggcatcttgatagatgcagcaggcgtgcttattatgtctgtaaatcggttggtgtctgttatagagataattgtcatggaaataattgtgatgtgtgaccatttgtgtgcaagcacattttgcgtgcttaattctagttttagttgtgatctccatccaaaaaaaaaaaaaaaagggccctagggc

SEQ ID NO: 12389 - DNA, 1521 bp, Zea mays
gcattgagcgcgattcattcccctcgtgggctcccagttcagtaaaccctacgccctgcggcacacacccatctcgccgcgccgccgcgtaaaccccacccgagcccatctcgccctcgcgcctccccgccctcgcgcaggcgcaacaatggcggccgcctcgaggggcctgctcgcgcgcctccgtgtcctctcactctccggcggcgggagcccgtggctccgcttcccgccttcccggctcttctccgcggaggccttcgtctcccattccgatgacgacgacgctgggggcgagggaggaggcgggggccggatcatcgaggcacggtccggggtgatgggccccacctcgcggcgcaccggcgtcatcggcgtcaagtgcgggatgtcggcgatgtgggacaagtggggcgccaaggtgcccatcaccgtcctctgggtcgacgacaacgttgttacccaggtcaagaccgccgagaaggagggtttcttcgccctacagcttggagcaggtcaaaagaaggaaaaacacctaacaaagcctgaagttggccactttagagcacagggagtgcctctgaaaagaaagctaagggaatttcctgtcactgaggatgcgcttcttcctgttggcacaagcatcacagttcgtcactttgttcctggacaatttgttgatgtcactggaatcacgaaggggaaaggttttgcaggtgtaatgaaaagatatggtttcggtgggatgcctgcatcacatggaacatctttggcgcatcgcagtggtggctctactggtcaaagagatgctcctggaagggttttcaaaaacagaaaaatgcctggacgcatgggtggtgtgcaacgcacagtgaagaatgtatgggtctatcaaatagacccagccaggaacttactgtatctgaagggccaggttcctggtcctcaaggtagctttgttttcgttaaggattctatatataagaaacctgacacggctttgctcccatttcctacatacttcacgcgtgaaggtgagcctgaagacttggagcccctgattgctgatcttggtgatgttgacccattcatggcagccgattaagacaatgcacaaagttggttaattcctttttgtgttctaagcactccttgagctcgtccattccacgagattgtcaaactctcgatggatgtgagcaattcctgaatcacaagctatatccggttactggccagcctgatcaatgttgttccatgtacattacctggcaagtataccagtgctctaatggtttttagatgattgttttgattgaccgaatataacctttttctcaataagttgtacgcggagccacaagtagtatataaaatcagaatatttcacacaaaaaaaaaaaaaaaagttttacgcaaaaaaaaaatgttattgctagctgttagtttattacctgtcattcttactttctatttataatacaaccttttctttttctaaaaaaaaaaagaaaaaaaaaa

SEQ ID NO: 12390 - DNA, 3689 bp, Zea mays
gtgtcgtctgggagaaggtgtcatctgccagcaagtacagctaggtgactggagggacgtactgagcagtctccccgcccccgcaaacgtgtgcgcgccacatacggcctcccctcccgctcccagtcccgacgaaggccaccgcattccggggcggggctgcccgcggtccgcaccggggtggaccgtggacgccgatctgccgacgcggccagtgcacatctagcctgaccgcgatgcgacgcacgaacagccagaccaattgtgcatgtcaggcgtagcaattttttgagatccatcgtcggctggctcgatgtgttgattgtgctccctgacaggctgacactatggaaaagatgagatccgcagccggggtggcgaaacaagctctgtcgcgccgtctgttcgtggtaatccgctgacctgcactttgtttatgttctgtatgagtatcccttctagagtctagagacccacccaaacagctcatcaggacgtgtaccaatactacttgcaagatgctacgacctcgctacaagccctagccggctgtcccttgagatccgcacaacgttagacggcacacggcagtaaagcatcggggaacacacgagtgcgtctgacttcagtgtaccaaagggccaatggcattagtataaatgtgtggttctgcacttcagtttggttcatctcactcatcagctagcaccaccaggaagtaggaacacacctcccaccagtccactgtttcatcgctcatcactaggctgcaatggctgcaaagtcacctgtgcttgcagcactggtactgctcctgagctccgcccagctgtccacgggggcaaggaggcgcatggagctgtaccagcccgatccggcggacatgctctcctaccacaacggatccgtgctccactccgacatcttcgtgtccgtgctctggtacggcagcttcacgcaggtgcagaaggcgatcatctacgacttcctgctctcgctcaccaccacgccccaggccgcctcgccgtccgtcgcggagtggtgggacatgatcgagcagcagtacctgtccaaggcggcgcagaccaccaagcataccaccacccgggtgatgctggacaccacccaggtgtcgtccgacgacggctgctccatgggcacgtccctcaccctggcgcaggtctccgccctcgccgcgcgggccaggcccaggaagggcggcgtcgcgctggtgctcacggcgcaggacgtcgccgtggagggcttctgcacgagccagtgcggcctgcacggcgcggagtccggcgccggcgccgcctccgcgtacgtctgggtcggcaactcggccgcgcagtgccccggccagtgcgcgtggccgttccaccagcccgagtacggcccgcagaccccgcccctcgtcccgcctaacggcgacgccgccgtcgacggcatggtcgtcagcctcgccaccgcgttcgccggcgccgtcaccaacccgttccgcgacgcctactaccagggctccagcgacgcgcccctggaggccgccacggcgtgccccggacagttcggcagcggctcgtacccggggtaccccggcaacctcaagatcgaccaggccagcggtgccagctacaacgccaatggcgcgcaggggaggaaatacctcctccccgcgctctacaacccttccacttctgcctgcagcacgctggtctagcgaaaacaccgatgcagtgtattatcgtcttagcttgtttgttcagaaggttccgtttatgggtgtatgtatatatgcaagttcacatcaggtgtaattctttcgttttaaagatccaaatgttcttcgtagcaaaaaaaaaaaaaaacatggcaaagttggttcaattcaatcaagaaccactgagtttttaagttttaaaccatagcaactagcaagatggttcacaaaagtattttttgtaaagaaaaaactagcaacgccaatgacgcccagatgttctctaatgtcttttctttctatctgtgttgtgtttgtgctgcagggtttccatttaatttaactatgcaagacttcgacttgcttgacagagtttccaaaaaaaaagaatgcacgtatctaggtcattgccatgaaagatttgatccagaagacagagacacctaggtccggtcctgtgccgaagatgacggagtctgactgcatcaacgacactgctaggaatgggaggatctgcaatgctggcacgatgcaagtactcgactttccgggactccgcacaaattgtgggcagggcagagcagagtagcccccaagtagcgtgctctgaattctgaaatgaagccagtgcgcggcagcagatcagagtcgtggactcatggttccctagtccttgaaccccgttttgccgcgcccaggctggccgctgcgacgacatcgcggcccgggaccgcacggggcgctggctgtggcaacgcaatatataaaaatgtctcccactagcgagcgatgctggtcgccgttggccggcgcggcgctgcggccgtccaaacaattccgacgcgtcttctcggcggacgcgcacgaggcacctcgaatctcagggcggacaggctgtgtgcccgtgccagtgcacgtccttcaccttgcgtaaaaagcccgtcacggctcaggttatttacgagtcccgtcacgcgttcggcggcctcgtcgaagggtgcccggccacctcatcgtttgtttatggatggagtcagtctttgctcggcgcccatgcatcgggtcgccgttcacttcgtgtgttcagtacaggtcttcaggcgtcccacgagctatcaaaatccaagaagcacatgcgccctacgccgtttaccaataatccaagaagctgcggtttggccggcataacttgtgcacggccgcccgcgccatgcgaccctccctccattcccccgaagcatatctatccacatgtcggtcccggacaacaaaaatctcggcagcgcacgcgaccatgcttgccgcgcgccggaacagctgttgctcctcgataggcggtggcagaccacgcgcggcagtctgcccggcactgtctctggacccgtgctcggaagcaactggacagcgcaaagcagcgcgtacggcgagcgacacacggtggcgtgcgagggcgagggatgcaccgcacctcgttgccttgcctccacgacgcggtctccgcccatccaggctcacgcagttgttgaaatgaagaaattcacctaaagacgtcttcccggtgtaactgcaagttgttgaaattcagctatctcgtggtaccgaatatgtaaagaattatatggccaaacttccaatactttcgaggacttggatcattctcttgaatggcatagtacaaactacaatctggttgtagcaggaaggcttcatttcgctgcacattactgaactttaaaaagtccatgctcgctcgcacctctgaaagagcaaaattaggtgggaacagaacaacgagaattccatgtttgaccagcaatactaggtgcaataataatgtcaattgtagtcctgaacactgaaatagtcagtacaaacaaaataactaatttaagcattgcattacaaagtaaccttatacacgcgaaaagagctagtgagttgacactatgaccctgttggcacagctggt

SEQ ID NO: 12391 - DNA, 4105 bp, Zea mays
  misc_feature (22)..(22): n is a, c, g, or t
  misc_feature (35)..(35): n is a, c, g, or t
ttagacaaaggtaaacgggtanttcaaatgatcancgcatcaagcatagacatcagaaaacgtgttgaagaccttcaagcgcatgcaagtctaagacacaagttgaaagaatccaagatggacacacaaagaaatgaagaagaatataatactaagcatcacttaacatgtcggcgaagcactggatacgagtagtattgtaccaaagaagggctactgtaatagagtacaccagaacgccacaccgaatatgacactcatagaagactgtagcttgtttggaggaatataaaggcatcagatgcatccggtaacaccgaataccccccatcagacaatataacccaagaggttgcaaagcgacttggatggccatgaggcatttaacgtatctagtaaggcacaaggatacccaatctccaatggcgatagttaacatgggcaacaccagcatatccaatgacagcatcgtcgtttaaagtgtatggaagttgaagaacattaagacccttttctaatagctctatatacctcaatacaaacgatcatattttacgtgattaacctatgctatcatgtagtatattgtgtaggctctatttgtttaagcaagcatctggaaagtttctcaaatgtaaaaagccagaagctaaaacaacaatctagctttttggtttagctttcgaagatcagaaaagttaaatttgtatggcaagctgaaaagcctgattttttaaacttttttagctttctaagtttaggaaactaatagcatcatcaaaaagctatcattaactactcaagatcaaaatcccagtagcacctttttagaaaagttctagctcaaacaaacagtctttagactgtctccagtaggtagtgtaaaatatgggacataaaactatagatataatgaagtttaaaatagaaaatagaataggggataaaatcgaggatctactggagacagccttaaccaactaatcttgtgctatgttgtgtcatgattcaaagtcacagtcaggatgctatgtaggagactttgaatcacctatcatctttggctatcctcaccatgtatcctatctcattccctattttaaactttactatacaaatagtatcatctaagtgcaaatctcttgctttatacggtccactgaagacaaccttggtgcccggacacacgacggaagaaactcaagaaagcaactttcactctcattttttttttttttttggctgatcatatccacacaccacacaaggacgcctccaaacctgtttgttgtgtttcatcatcaatttctactctcctttccacaatacaaatgccatccacggccatagttggtttcgaattacatgcatacatacatcacacacggcctcactcatcaaaacaaaacaataaaataaataaacaaataaataaatagtttcaagaactgcagctacgtctatgtgcgtggccacctttgcacgacactgacccggtcacaaacgcacgcacgcactctgcgtgcgctctgctggcggctgctgccctgcccactcaaaattgtgctgctatatgttggcaaggtctacccgacgttcgccacaaatggcaccagccgcttgtgatccctcttgcgcccaagcgcgcaggtatcaagaactcgcccaagcagcagccgggtgttctgcagcgctacatcccgtgccaccaacccgctatctgcggcgctgctgctgccaccgccgccttgccccatcaaggaccccaaccccgaccccgcagcgtactgcagcggcccactccttgccttgaaagacgactgaggaagcagcatgctctggaggaccttctccccgcttccatgcccgccgttatcaccaaacccagcctcctcgccttgcccgccgccgccgcagctccgcagcagcgcctccagcacgttcagcgcctccgagcataatgtgctctccaccagctgcgacacgaagttgtacacctggggtatctgtgacggatccacaggggtttgctgcagcagcgatttaagcatcagaagaaccacccgctggtaatccagagggcctctctccaggagcctcagcaggtgcccaaaggccaaagatgagtgcctagggaaccactccgcacagattggtggtgaagctcgtgcaaacagatcttccaacgacatgatttccccgaaggaatacgctctgaacacttcggccaaatcgtccagagacttggcacggcaccatgccgaaatattggatgacacatagtaagctttctggttctgctcttgcagtggcgaagctgacccaagggaaggtggtgcttccctcgtgagctgcaatccgagccatggaagaaggcctgtgatgtgcatcagtaaccttgtatcggggctcccaaatatagagtcgcacgtaggtatcgtgatcctagatagcaactcgattgcagatccatggctaactgtggacatgagccccttcagcaccagcggctgcaccccttcaaaagcaggcaccttcccggtcccagtcacagatagcaatctctctgaagtagttctagactccagcctgtggaggtcacttgcatacccattgatgtcaaactcatcacgtggcatgcttgagagcaacacgttttctgttgtccggtcacggaatgtcaagcgatcgattactctacaaaacaactcaagcacctggcagtagatgtgcacaaagtcggtatgcatcagtgcaacgcagccccaaaagagctgcgggtaaagtataaccttctcaggctccatgttttcaaccatgacctgtaaagtcagcagtatctccattgcaaagcccagaacgtttttattaggatgttctaggtaatggtctcgtgctctcagaagcaatacgcagctatcacttttaacactgggacgcaaggcacggtatatctggtgcgaccggcaagccaggtgacgagatgtgcactccatggcccacttaagagcttcagaaccccaagtctcacgaaggtccccttggaagaaaatagcactaaccatgctttgcacaagtgctgataagagtgaagcgctgggaagttcgatccggaaaagggtagggtcctcgttctcccacatcaagctgcccctcttagactggatgtatttgatcaagctcaccacatgatgcttattctctctttcactactttcgatctcatacagttcaagatgacgtccagccaacgagtagaggagattcacgagcaaatcttggcaatgctcgagcacaatgtcttctgagctatccatcgaaacacatgtgacgtggaacaacagaggtaaattttcacgaaagtcttcatcattttcataagcaatttcagccagaagaatcaaagctatgtcagcacgtgaaagcaagtgttggtgcccttgtagtgctgactggagctcattggcattgatcccgtgaattccactgcccccttgatgcaaaatatcatctgttgagtttggggtatcaaagtagtagtcaccactatctctggaaacatggcggctcctcagattaccagcagagcttcgaacaccactcaatggccccgacatagtaattaacgctggaagtagctgtcctgatcggcctgccgttgggtttggaatgcttacctcatgagccaacggactcaatgggccagatacacttcggccggtaactgcagatgtccgccagctcaggtttccactgacatttctaactgcaccatcaagtgaaccgcgcccggccggcggggacatgtgaggctggctatccacaactgttgcaacctgagaggcagtaggcccttgagaaaactccaatacaacatttgcagagacatcaaccttcccaagcctgactggttcttcgtcgtcctcgagcattctctgagatagctcgaagaccaagtgatcgatggtctgctgtgggcagatccgagcaagatatagattaacacgctttgcaacagaaaaataagttgcaaatgcaccagtgatctctgccgatggattggcatcgcagtcctcaatccctctggtgatcaagaagtcaaaac

SEQ ID NO: 12392 - DNA, 1910 bp, Zea mays
tatttagaagctctaagactatatttagaagcgcccggtttttaagaaactagtttatagaaattaagttggtttcaaacataccaatttataactcagtttatataaattagattaccagtaaaaaaccaacaagctgacctctcctagctaaaaaataaaaattagtttattaaaaactagattgcttctaaacaaggtctaagaggctctattatataattgaatgtctataaatatagtatattaataaatacataagtaaatacgtctgtatcctatcgaattgatagaacaaacaacgaattcatatagcgagaagtctattgctacttaggttacgagagagacgtcactttacggagagacggttctacgatttttttacagatactccatttaaacatttcaagagcctctacattaaacaccgctatacatgctcttagccagatcagctcctaccgtcatccaaacgtccatcgtagtaggaatggagattggagaatgtactcgcaagattacagatttgctatagcaagtgacagtaacaggtgaattcccaaagacaaatcgagctaaacgagtttgcagaacctttctttacaacagcaagacctgaaactgctatgtacagtattgcttctcgctaattaagtgaactgttacattaggactaacacaacattacttctccctaacttcctgacaacaacaacaactgcgacaaccaaagaggctccagccaaagagactgcagctcccttcgtgagctagctgtggaacctttctttacagcagcaacagatctgaaactgctatgtacatcaagtgaactgtaatattaggactacacatcattacttctccctagcttccttgtgatacacgctgaaggagcgctacaaaattttctgccgctggtctaggtgatcaggcggcacggaattagtgaagtgcgtgctatccacagatgcaacatatggtgcgtcaccggcctgaaattccaagctccagcgactccctcttcttgtgggcagttagtttggccttctctttctctgcttccgcttgtgctcttttcttctccagctccatctgcttaacattctccgcatgggcccgctcgaacgtcttcgtgaagcttagcaacgttgagacaacttgctcgaaaggacaccgcacgggatcttcaccaaaataatgtgctagagaatcggcacttttccccgcactgctgtaaagcgaagctaacgaccttccttcagcttgggcatcagcaaggaataaattcagtttcctgtaaaatatctctgtctctgaaggatccttttcagctgttgccagttcctgctccactttttccagtcctttagttatcgcttgcatttcttctgccaactccttcagttgtatctttgaggcaggttctaaatttgcaagatccctgctgaagtcaagcacttcaggaagcttgtccgaaagaaccttgcatagataatgcatgagagtcatcctattattacgtgctcgtatatcactgagcttaagaagactatccaatctaaatccaacagctgcaccccttgcagttccttggtttaatgcgtttcccaaagaaagaattgtctgcatcactcgcttaagtttcacagagctcctaacctcttcagcaaccaaattgatggtattcaaattactttttaggtccgcaacctgtgtaacaaactttatcttaaatgacaaaattctcagttttgattccacccttggtactttcatcatctccatgaagaactgttcacagttccctaggttctcctttttgcccgtataacttttgagtagttccatttgtaccttagttggacagaacttcattattgaaatacttgcccggccggcctcga

SEQ ID NO: 12393 - DNA, 1275 bp, Zea mays
ccctcgtaggctggccgggaaaaaaaaagaaaagatgacgcagaaccaggatgctgacgtcatcagtgcctttccccttccttgtttgctgaagtccctggtgtggaccgtggagtctcagggagaagcgcatgcgcacgccaatcggcaatccaccaaagattccgttctcccagtcgcctctcccagtcccagatctcgttcactcgcactcgcgcaaccccgcggccccgcgcctaatggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggcctcaacggcctcctcacccccgagcagttcctcgaggagcgcgagagcatgctccaagcgctcttcccatcctgtaccaagctgccaggagtactacgtttggtgcatcatcttcatgccaacggagtaccaatggctgttgcgacaggatcccataaacgccattttgcactgaagacccagaatcaccaggaaatgttttccctgatgcatcacgttgtcatgggtgatgatccagaggtgaaggctggcaaaccatcccctgatatttttcttgctgctatgaggaggtttgagggcggcgtagaacctagcaagtgcttggtttttgaagacgctccttcgggtgtagctgcagcgaaaaatgccggaatgtctgtagtgatggtcccggatccaaggctggatgtttcgtatcacaaaggagctgaccaagttctcagttcattgctggacttcaaacctgccgaatggggcttgccggcatttaaagagtagacattccatacaagataacaagattataagagtctagtgaagaagaatgtgagatactccctaagatgcaaattaaagagtacaattctttaagatgctgctcaaggaaaattccataaaatgttggtcaaacatacaattgaacattcttgtcgcctcctaactatgtgtcaccaaattactctgaataagttcgttccgattccgatataataatatccctgtctttgttttccctgaacaggaggcgcactttcgtgtgcagccctacagtgaccatggctatgatgaatagctattttgttctggg

SEQ ID NO: 12394 - DNA, 2422 bp, Zea mays
tttgctctgcttgttcgtttatgtgatttttctgccatttatctgcacgcgcgcgacatgagggaggtgcgttcctgcagaaccaagccacactgaaacgaggcctacgacatgagcccgtacgtttgcagtgcacagttcatctgtcggtcttgaacttatgtcttactacaggttacacaatttacaagcagtgcagttaataagtatatccacagctagctgctgctaacaaggcaaacaatgcctacgcaagacatgcatgggcccatcgcggtagccggtagtgctggttcctccttggcgcacgggatgcgcgcgcgcgcgcggcggcgagtttggcgcttgctttgccgcatgcatgcggcatgtctgtgccagcgtgcacggtcttccagggggcgagacgcctttgccctttcccctcgcgctggccactggccgcagcagcggaacttgcacgcgagttcgtgcttgcagaaacccggccggccgaaggagccagcggatgctgacggacggaccggacgagtgaatccatcacgattcaccagacgagcttctcgtccacggccactatccttccggcctgcagcagcggccgcgactctatcacgtctgtcgatctgtctgtctctggctgggacgggggggtggccatatatatagccgcgtctcgctgggcatcggccactagatttgggcgtcgtttttggtgtgtgcgctcgcgtgcaggggcaggcgtgtcgtgcgtaccgcgtgtacgtgtatgtgcaccggaccgggacacaaccggtgctggttggtgcggccgcgtgtgccagcgccaccagtgcagtacgtgctgcatgtctcgctagatcgtcgcgggccttctggcggcattccatcgtcaagatgtcggcaaaaaaaacatatttacataccatgaaaagtgcatacggaatttcaaaacggtttactttgtcaaagcgggtacgtgcatatatgcatgaacacagcattacgtacgtacgtgggggcgtctctctctttctctgcgccagatctagagacctttaatttgtatcaatggtggtcaggttccattccaactgggcacggcatcgtgcggccgcctgtactgtgtgttcatgcaccagcgcgtccgcaccgcaccggacgccgatgccacgctgtgcggtgcccggcggtagtggtgaggtgggggcactctactgccagtgccccggccccaaggctagccgccgcccaggaccaggcccccaagctataaggctgccgcgtccggttcgtttcatccatccgcaggagccaggaagcaaggccaattcaccaggagaaaatcgtggctctaggctgctgtagcctgtactagctagctataggtgcgtcgtgaatcatgtactgtactctacgtacgacggggggctagtgatccagcccagccatccaaaataatcgcacgtctgaggttgtggagtatttgcctggtccagaccagagctccagctcgagcgcacgcagcatgcagtggggcgcgctcgccatgcatggtgatgctaggcccgcccactagctagcggccagtctgcctcaggtagccagggtgcatgtgatcctagccctagccctagccatgttctatatacctagctatgcaggcacagcggcctgcgatgtgatcgtatacgacggctttcatttcgagatctatctcagctcagaccgttggggcctcgccatcggcaacacgtgtctcggctgagatttgagagctccaggtcgatggatccaagtacacatgcccaattccgatcccgccgtcgtcggcccgtcagctccagtgctccacggccggattgcggggaaaaccgggccgttccgctcgcggttttgcggaacccccaagccgtaaacgacgctgtcgtacgtggcgcgttccccgtgcacacttcggctaaaaaaaaaaaacttagcatatgtaggaaccacttgaagataaataaaacaaaacgtagctacaatcgtctatgaatgttgaacaatttcaagcgttgaaagataacatggccaaatatttggcacctccaaagagtgacataaaccatataattgattaaagctaattgggtgtacaaacttaaaaggaaaacatatgtgtgaatatattgatcgatcgatacaaagagctcgactagtggccaacatgctcaagcaaagatattttttaagtcatgatgtgaaggttgctactatttggcctgtgtgttgtgagttttattattatctcaaaagttgtcactgacgactagacgtgcagagagtagggatgaaaacggtcggaaacggtatttattcggtaatcagtttttcctttgattgtgaacaaataggatatagaatatacaatacaaatttg

SEQ ID NO: 12395 - DNA, 1218 bp, Zea mays
gggtacctcgaggccggccgggccgggagtccgtgccacgggtcagataagcttttctctccccttcgcagctgcaaccgctcgccgcgtgctccctttgtgactgaaccgcatcctccccgcgccgacctgctccggcgagttaaacatggccgtcctcctccgcggcacctccgccgccgcctcgactgctggcccctcctcggcgctgctcgccaccaccttccgccgctcccgcggctgccttctgccccgtgccgcgccgcagcgccgcttgtatgtggcccgcgcctcggcccagccccttgaggtctgcgctaaggagtccatcaccatccctggccgcctcggagactgtcctttcacacagagggttttgttgactatagaggagaagcatctgccttatgatctgaagctagttgatctagctaataagccagattggttatttgaaatcaacccagaaggtaaagtgcctatcgtgaagctcgaggaaaaatggatcggtgattctgatgttataacacaagcattagaggagaaataccctgaaccacccttggcaactccaccagaaaaagcttcagttggatcaaaaatattttccactttcattggtttcctcaaaagcaaagatccaagcgatggaacagaagaggcactacttaatgagcttacttcatttgatagttatctaaaagacaatggtccatttattaatggtggaataatttctgctgctgatctctctctgggtcctaaactatatcacatggagataactctgggccactacaagaattggtctgttccagattcactttcttatgtaaaaacatatatgaagtcgattttctcaatggattcttttgtcaaaactcaagctctgacagaggatgtaattgctggatggcgcccaaaagtcatgggttaaattcatttctaaagttagacgttaaggagagggagagaggtgtcgattggcgaatggagggtctagatgcaaaggtttgtcgcatggctgtaatatgtacatgaattgtggtggattttgttaggaattttctagggcatagcatatctggtattcatatccaatctcctttgctttgtatgtcaaatggaaaacatctatacaattgtaaaacatatattttatgtaaatgagcattctcgttgaacttaaaaaaaaaaaaaaaaggagcgccctctcag

SEQ ID NO: 12396 - DNA, 3163 bp, Zea mays
  misc_feature (3124)..(3124): n is a, c, g, or t
  misc_feature (3163)..(3163): n is a, c, g, or t
attgggtaccgcgcccccggcccgcacgcgctaccttttctctctctacgaccttccccttacctattcgccgtccctctctcctgctgccctccccccgccgccgccctacggcccaccccgccgacgcgccacctccgtatctctcttccccgcctacgcgggcggcggatctccggatccgcgcgggggagggagatctggattggatggtcctctccggccgcggctagtccggcctgatctgatccgacccgtcccggcggcgcagtccgggcaggttgtctgggaaatttcggactcgggcggtgttgatcccggggagaggtcgtgcctcgctcgatctccgcataaaagctgtgattttgtggcggcgcggctgcgagttaccgggattttcccagggtttccggcggccgatccgcgctagttacgctattctgttccgtcagggcggcctcgtgttgggggctcgtttatttgccgcgtcccggaggagggttttgtgttcttctgtcgttggctccatggccagcggctctgatgccccgaagcagtatggaataaccaagccgttgtcgttgctcggaccggtggaggccgacctccagaggacggaggagctagagaagttcttgctcgagtcgggtctctatgagagccctgacgaatctgctaggcgggaggaggtgctggggaagcttgaccagattgtaaaagactgggtaaaacaattgactagtcagagaggatacactgatcaaatggttgaagaggcaaatgctgtactcttcacctttggctcataccgtcttggggttcatggacctggagctgatattgataccctctgtgttggaccttcatatgtgaaccgtgaggaagatttttttattgtactgcatgggatattagcacaaacagaggatgtgaccgagctgcagcctgtacctgatgcacatgtccctgttatgaaattcaagttccatggaatatctattgaccttctttatgccagtgtctccctcttagtagtaccagctgacttggatatctcccaaggatcagtgctttatgatgttgatgaagctactgtccgtagtcttaatgggtgcagagtagcagaccaaatcattagacttgttccaaattttgagaattttcgcacggcattaagatgtttgaagtactgggcaaaaaggagaggtgtttactctaatgttactggctttcttggtggtgtcaactgggctttactggttgcgcgtgtctgccagctctatcccaatgctgtgccaagtatgctggtctcacggttttttagagtttttacacaatggcagtggccaaacccggttatgctttgttctatagaagaggaagaacttggtttccctgtttgggatccacgcaaaaatcctcgagatagatgtcatcatatgcctattataacccctgcgtacccatgcatgaattcaagctataatgtttccacaagcacactgagggttatgttggaacaattccagtttggtaatagaatttgccaggaaattgaaatgaataagaccagctggcctgctctgtttgagccttttcaattttttgaagcatacaagaattatctacaggttgacatcattgctgaggatgatgaagaccttaggctttggaaaggatgggttgaatctcgattgcggcaactaactttgaagattgaacgtgatacatatggaatgctacagtgtcatccttacccacatgaatatgcagacccttctaggcagtgtgctcattgtgctttcttcatgggcttgtcaaggaaagaaggtgtgaaaatacaggaaggacaacagttcgatattcgaggaacggtggatgagttcaggcatgaaatcaacatgtatatgttctggaagcctgggatggagttagctgtttctcatgttcgtaggaagcaggtcccagcttatgtgtttccagagggttataaaagacctcgcccttcaagacatgtgaaccatcagtctgataaaaatgacactgaagatggcacagcgaccaggtctccagacagtcaactgaagagaaagcatgattctgttggaactgatgatatcaggtatgcaaagaggtcatcgaccagcccagttcatccgaaaaattcacctcaatctggaagcactggcgatgagactagatgtaacaaccaaataaaaagggctcctagcgatgcaagtggtggcagtccggcttcacctcaggcatcagagagaagcccagatactattctgtctgcccctaggtgcacgacaacaggagcagtgtgttctggtgatgcaattagtaagcatagtagtgttcctcttgttgagaactgcaccactccgactgtagcagtgtgcacaactttgaagcgcgtagctgagaaagttgtttcagagctagttggaagtgaaaggctggggagcaacaacagtgcggaattgttggagagtatggaaaaggaggatgtccttgctgaaaatgttcgttttggcgggaatggagttgcgcaaggtggccttccagaagagttagaggtatgaacaagtgtacattgtggaagtcgtcactgagggttagtggcatcaaccacacaagattggggaaaaaatggtgtagagatggataagttctacccccttgctggagggaatggtaagtagctcaactcacaagtttccttctggacacagattcgcaattacgggggtttctatgatgatggatgatgggagattatcggatatcatgtcttgcacaacggcatggcaaaaaaaaaacgacgaagaagattttgtggaaggccatggtcgaatgtcatgtcttgctggtacactctagatgagcatgaaccttaagttttcgtttttttttaacttgttgagcagctgactcttgtgtatgaactgagctgcagcgggcttccctgagttgacttgtttgggtctgagatgcttctgccatgttctaggtctagaatagaactagatgcggtggtgtgttctctaccctaagtccccttttgtgccctttccttctgtaatataagatctttgactgtttcaagaaaaaaaaaaanaaaaaaaaaaaaaaaaaaaaaaaaaaaaaaaaaaaaaan

SEQ ID NO: 12397 - DNA, 1054 bp, Zea mays
gatgatattgaacccagctggcctgctaagaggtcatcagtcagcccagttcatccgaaaaattcacctcaatcagggagctctggtgatgagactagatgtaacaaccaaataaaaagggctcctagtgatgcgactggtgccagtccggcttcacctcaggcatcagagagaagcccagatactattatgtctgcccctaggtgtacgactgcaggagcagtgtgttctggtgatgcaattagtaagcatgatgttcctcatgttgagaactgcaacactccaactgtagccgtgtgcacaactttgaagcgtgtagcggagaaagttgtatcagagctagttggaagtgaaaggatggggagcaacaacagtgctgaattgctggagagtatggaaaaggctgaaaatgtttgttttggtgggaatggagttagtcaaggtggccttccagaagagttagaggtatgaacaaggatacatcgtggaaatcattactgaggatcagtggcgtcaacgacacaaaattgaaggaagaattgtggagatagacaagttctaccgcttgctgggtggaatggtaagtagctcaactcacaagtttccttctggacacagatttgcaattgcggaggtttctctgacaggagatggtcgaaaatcatgccttgtaacggcatggcaaaaaacaacaaagaagatttcgtgtaagggcatagtcgaatattatgtcttgctggtacactctagatcagcatggacttttagtttttagtttttacttgttgagcagctggcttcccagagttgacttgtttgagtctgtgatgcccctgccatgctgttttctagaatagaactagatgagatgctgtgtcccctaaggcccttttgtacctctcctttgtaatataagattttttttgactttcttgttagtggtacctagggatgaaaacggtcggaaacggtatttattcggtaatcagttttttctttgattgcgaataaataggatatggaatatacaatacaaatttgtattcttgttttt

SEQ ID NO: 12398 - DNA, 1275 bp, Zea mays
ctcgaggccggccgggagccactcaaagggcacgagaccgttgcctcgagcgccccggagggaaaaaaaaagatggcccctaaattagtctttgttcttcctgttgtgctcctcgccttggcgctgcaggcgatcctccggccaccgccgccaaagctctgtggctccccaggtggccctcctctgacatctcccaggatcaagctcagggacggaaggtaccttgcgtacaaagaggatggagtacagagagacaaggccaggtacaagatcatcacagtgcacgcatttgatagcaccaaggacttcccctcgcctgtttctaaggagctcgtggaaggactgggaatttacctccttgcttatgacagagctggatatggggaaagtgaccccaatcccaaccggcatgtcaagagcgaggcgctagatatcgaggagcttgccgaccagctgggccttggccacaagttctatgtgctaggggcctcaatgggaggatactcggtttggggatgcctccagtatatacctcacaggcttgcaggagctgcgctggttgtgccaattatcaactactggtggccttcgttcccagctgaattatccaagcaggccttcaacagactgattgtgccagagcagagaactctttggattgcacacaacataccttccttgctttacctgtggatgacccagaggtggttcccttcttctgcagcagccatgcaccaccctgaaatatttagcaagcatgacatggaggttcttcagaagatgatggcaatgccaagaaccattgagaacaaatcaaggcagcaaggcatttatgaatcgatccaccgtgatttacttgtcgcttttggaacttgggagttcgatccaatgaatgtcaccaatccatttcctcaaaatgagggctctgtgcacatctggcaaggacgcgaagataggttggtgcttgttgagctgcagaggtacattgccaagaagcttccgtggatcaagtatcatgaagtcccagaaggtggacacatgttcgtgatggtagatggatggacagaccgaattctcaaggcactcttgttaggagaagagcccctagatgtgtgacagtagttccattttcaaaatgtcaaaaactgcagctgccagctgttattttacttaattttattcccaatttgtacacttgtattcctacaacaccaagactagtctaattcataatccgatagactttccatcatgtcaactcattacaccagcaaa

SEQ ID NO: 12399 - DNA, 972 bp, Zea mays
aacagaaaaccacgcgccctgcaggggttcttgccctcgcctggcttatataaacccagcccctcctgcccccctactacgcagtgcatacatcctcaccacactgcaccatcattgcattagcaagcagtgaagcacaaagcacaaacaaagcaagccgatcgaattaataggtgcagcatagtgctcgatagcttgctcagcagcaagcaagcaagctaggtagccgtgtgaggttggtcgatcgacgagatgaagaagggagcaatggcctcattggtccctctggttgttgcgctcctcttgtgcccgtcgtcgtcgctggcaatggcatccggcgccggccctgcgcagtgggggaagaagctggacccgcacttctacgaccagtcgtgccctcacgcgcagcacatcgtggcgtccatcgtggggaaggcgcaccaccaggacccccgcatggccgcctccctcctccgcctccacttccacgactgcttcgtcaagggctgcgacgcttcgctgctgctggacagcagcgggtccatcgtgagcgaaaagcggtccaaccccaaccgggactccgccaggggcttcgaggtcatcgacgagatcaaggccgcgctcgaggctgcctgcccggccaccgtctcctgcgccgacatcctggcgcttgcagcccgcgactccaccgtcatgactggcggccctggggtggatcgtgccgctggggcggagggactcccgtggcgctagcgtgcagggctccaacaacgacatccctgctcccaacaacactctccccaccatcatcacaaagttcaagctccagggcctcgacatcgtcgacctcgtcgcactcctcggtagccacaccatcggcgactcccggtgcacaagcttccggcagcgcctgtacaaccagacggggaacggcctcccggacttcaccctggacgcgtcctacgcggccgc

SEQ ID NO: 12400 - DNA, 3788 bp, Zea mays
gtaaattatgtgaatatgaaacagatcactctcaacggaggtttcacacggttttcaagaccttagaaacaaattgacatagtttcctctcaaaaaatctgatgcggctctctattttttgtgcatgaaaccaccattaaaaatagccttagacgaaggaacaaatatataattacatcattaacgaggtccacccaaaaccagcgtcttaattctaaatcttgtctcaactagaccgaacaaagaaaaaaaggtacgtactagtagtaataaagagaccatgcgatgcgacacatcgatttggaagcattctattacgatcagcaggacaagacgatgacggcagcagcgaggaagaccagaagcagactgccatgggcggaggacatcgatgcggacgtggcgccgttaatctgcgaggaggcgacggccactggtagctcatcgtcggcggggagcgagcaggtggccgggtggcccgcgccggcctcgtcggccgccatgagcgcctggatgaccgccgtggccgcctcgcggtaccgcgtggggttccggttcagcagccatgtcaggcccatgaggtggcagtcctcgcggtgctcctgcttcgccttcgccgacgacgtggcgttgctcctcccacccagctgcagcccaggaaacccagtacagggagtcagtaaacaaattaacagcgacggtaattttttacatcgcgaaaggacagagattcctgcggaggtaaaggacacaagactccgagagaggacggggccaccggccatggcaatggcggtcctcgtgccatcgctctcggaacagttggcgcacgcggaatcggcgtgatgtcactgctatcacaagctgctttctcgggaactctgaatcctcatgtgaccacgcatggtgacatggtgcgtccatgtccaggccgcagcaacatgctccgtagtaaaacaaggcagatgaaatgggctcgacatctctgtcgtccttcacggtcgtaaagctcacggtcagattagtagcaaaagcagatgactcggtgcagtcccgagggggggtaatggaggctctgtgactgcgatgctttctaggtgaaaaaaaaagagatgagtggaaagaaaaggagcgtctcgagtccagacgctgagtggtaaaggcagcggccaaagtgaaagtgagaataaaggtcccggcatggcgttctggagcagatcatgctgcaggccctacccaatacccatccatgagccccggatttctcgctacaaatctcattggagtaatgcgagttcacgtgcaccggctcattgcagtaatgctgctactgtactctactctacactctgtgagagtactccagtaactactcctaccatgcagttaatcttccgttacagtcttacagagagtgcaagtctgccgattacatactagtataaaagtgtatgagtataaagtaacatgcatatgtaagtaagtggaacaagcttatgatttaataaactattttagatcataaaatgttttagcttttctagatacatattattttctacagatttatgtataaactatatatttttagtaaaaatacatctcataattttagaatagagggactatatgaaattttgcctgaacattttctgtctttctgagacggcctctactgcaggtcagacgccctctactgcaggtcagggactagcattttctatgtgcgcatgtgatgggcacggctaaaggataatagaaggcaattccctgctagtacatgagaagcatcagctgctcacaatggggggaaaacccctttcatcatgtttaatctgtactcgattcagaaacacactaaactctttctgacttacagtacagaatactaataaggcagcgatctactactttgcattctactaccggagaccttgtgtgaactcttcgtggctttttttctcgaattttgtttgctctcaacaaatactgggaccgcctatttgtcgattgtcatggatatacattccttattaattttatatcttccaagatactgaaagctgcaggtttgtcatgtttctcacataacgggtcgtacaaaatgaaaatgtcatacataaatacatggatctaccaagttacatggtcacacctgttttattccagattcctctaaaagtggaacagacactgttgatgcatgaaacagatagtgtattatactatttgtctagataggagtatgcaatatactaatacaatggagaaccccacttctgatagttcagtttaggatagtacatacataataagcatgcatttcatcaatagaagatgccgtcaaaatatctttttgaaatcatattggatgcgattatattctattttctgctctttcatatagaacgtaaatcagtagttaaaaactaaaaatgttcacaattttgacacctacagaccataaaaacataatcttcatgactcatgaacaattcaacattttgagtagatgcaattaatattgcgtttcccattagaaaggatggtagtttaggcaagtgcacattccaatgcagcagacaagatgcattcatgcatcaacgccttcgccgacgacgtggcgttgctcctcccacccagcttgctgagcgcccgcaggcacctggagcagccggcgagccccggcagcgcgcagtccctctccagtctccttgccatccggccctgcggcgccgcgcacgcaggccgccgcagcctcaccccgcagtagcagaacgctacgtcgcacgccgccgtcccgttgccagtgccggtgctttcgccccaatgcggccgcggtagcgccaccccggccgcccgcagcgcacggtccgccgcgccggcgcattcctccgcgtcgtccggcagcactggcaagtccaccacggcggcggcctcggccgacgcggccaccgacgcttctccgacgccgctgcccgagagcgcggtgggcgcgtacgcagtgtacagccacgcggcgagcgccgggcagcatcttaggcgcggcgggagcgtcacgccactcccgccggcattggcgttgcacgatgctaggacagcgggaaggagcggaggcgacggggtgagctggcagacggaggtggcagcagccgcggcggcctctgactgctccgggaaggccgggattgtggaggcgaccccggctgactgggtctgcgtgggcgaggtggcgccggcggacgggaaaagcagcgacggctcgagcgacgctggggcgggcaatgccggccacgccgtggccagcagcaggaggcgggtaatgatggtgagcagcaccagcagctcggcggtgtagcggtggatgcccggcatcgttggttcctgacctgcaggtgactgagaacgttcggctgctcaggtgactgagaatggacaatggaaacagaatctagcactccaaggctcacatcaaaccttcgagtcgaatacacgtttgggactttttgtgtgttggagtgccgcttcgcccgagaagcatcatgtcagtctttgttattttcctgagctagcttaacagctcaactgaaatatctgaaatgccctgcctggtaatcatccatggactgaaacatgaacatcatcctggttcaaatgataattgcactaaaagtccgtaaattattttttggttatgaacccttctggttcctaatttttaatagtatctcaaatggttaaattttaccctttatgtttaaatttctctaaggccccgtttgtttcgt

SEQ ID NO: 12401 - DNA, 1451 bp, Zea mays
aagcaaagtggtcggcgtacgtacgtgaacacacatcgatctccatatatctgtctagttagctagctagctagtagacatatggtgggctcgcagtacgacgacgacgatgacaatgttgttggtcgccggaagacgaggtggtacgctgtgaccggcggccgggggttcatggcgaggcacctggtggcggccttgctccgctccggtgagtggcgtgtccgggtcactgacctcgcccctactctagccctcggccctggagagacggatgggattctgagcgacgctctccgtgatggccgtgctgtctatgcctcggttgatgtctgcaaccttgaccagcttgccaaagcctttgaaggggtagacgttgttttccacacagctgctgcggatcctagcaagaacaacctgcaacttcactacaaggttaacgtggagggaacgaagaatgtaattgacgcttgcaagatatgcaaggtgaagaggctgatccacaccagtactagtgctgttgtgtttgacggcgttcatggactttttgacgcggatgagtcattgccatacccagataagtttcctgatgcatatgcacaaacaaaggcagaagcagagaagttagtcatcaaggccaatggcattaatggccttctaacttgttgcatacgtcctggtagtatgtttgacccaggtgacattatgatgccaactttggatcgttatggatggtcaaatgttactattggtgaagggaagaactatgatgattttgtgtatgttgaaaatgttgtccatggtcatctttgtgctgataagactctttctactattgagggtgcaagaaccagtggaggaaaagcatactttataactaatatggagccaatgaatatgtgggacttcttatatcttgttcaagaagaacttggatacaaaagaatattcaagataagggtacctataattgttatcaagccagcaagctatttgatagagtgggcatatagggctgttttctctcattttggaacttgccagcctcaaatactaacaccggcgaggattagatatgtaacgctcaatagaacatttagttgcaataaagctgttgaagaacttggctacaaacctattgtgacactacaggatggtttgaagaaagcggtgaaattgtatattcaactgagggataaagatttacctaaaatatagtgaagttgtgatgtaaaacaactctaccaaaatatcataagccaaagccagaggtgatcgatgatgtcccatcaataaaaatcgggtttgtgttttttattataataaaaaaagctatgtaaaggactacgaaatattgttgtaatgctctaatggtcaggcatgtatttatgttatctgggacgtagacgatattatatttgcttttatgttcctctctaaaaaaaaaaaaaaaa

SEQ ID NO: 12402 - DNA, 1679 bp, Zea mays
ccgggagggtcttcacttgatcgccgtatcgtgtgttgtcgcggcgggtctgcgtaatgtagactatatagacggtgcttggtttggtctgtagttcgtgagtacgtgctcaatcgtttgtgttctcttaagacacgaactactgttcatatgaactttgaattttcgcataataagagatggcgctctactaataatttgtgtcaaaaaaaaaaaaaaaaaagaaaatgggaccccccgagccggccgcctagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaggacgtgcggcagtgcctcatcttcgacgggcccggcgccggcgcgcgcctcatcggcgtggagtacatcgtctccgagacggtgttcctgacgctgcccgacgccgagaagccgctgtggcacacgcacgagttcgaggtgaagggcggggtgctgttcatgccgggggtgcccggcgtggtggagcgccgggacctggagaaggtgtgcaagacctacggcaagaccatccacttctggcaggtggaccgcggcgacgcgctcccgctcggcctcccgcagatcatgatggtgctcacccgcgagggccagcttcggcaggacctcgctgactgtgtggagaagaagttcggtgtctccttccagaaggagagggagaaccgggcgtacatgagcggaccggagcatggtatccacccgctagcgaacgctaccggcaagggcctgaggaccgagatccgtgaggtcgatttgccggcgagtactaccgccggcgccgggagggtcttcacttgatcgccgtatcgtgtgttgccgcggcgggtctgcgtaatgtagactatatagacggtgcttggtttggtctgtagttcgtgagtacgtgctcaatcgtttgtgttctcttaagacacgaactactgttcatatgaactttgaattttcgcataataagagatggcgctctactaaaaaaaaaaaaaaaaaactaatgagatctaaacaaatactgaagacatttgaaaaaaaaaaaaacatatagaaaaaaagctcgtgcttgcccccctgagccccactgttcaaacacccaaaggcaaactttgttactttgagagagacaaaacctcccacataactcccgcccgctccccgatggggcaaaactggccaaaacggggaaattcccggcaagccaacgtagacagacacggagcttgtgaaaaccgtaacattcaccatccagggtttgcccgccgtgatccaaatccaccagcacctgtgcgcttcccacttttacccgtacgacatggggcgtcaggtggaggcccaccacttttgcccccacctgaacgaggacctgcgtctaagcctaattttctatgggcccggtagccggtgcgcgcc

SEQ ID NO: 12403 - DNA, 1006 bp, Zea mays
aaaaaaaataaaaaaaccggctagctcgtgcatgccgccctgagcgccactgcacagacgcgcagagacagacattggcgagagacaaaacctcccagataacgcccgcgcgcggcccgatggcgtcgtcgtgccagagcgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaggacgtgcggcagtgcctcatcttcgacgggcccggcgccggcgcgcgcctcatcggcgtggagtacatcgtctccgagacggtgttcctgacgctgcccgacggcgagaagccgctgtggcacacgcacgagttcgaggtgaagggcggggtgctgttcatgccgggggtgcccggcgtcgtggagcgccgggacctggagaaggtgtgcaagacctacggcaagaccgtccacttctggcaggtggaccgcggcgacgcgctcccgctcggcctcccgcagatcatgatggcgctcacccgcgagggccagcttcggcaggacctcgctgactgtgtggagaagaagttcggtgtctccttccagaaggagagggagaaccgggcgtacatgagcggaccggagcatggtatccacccgctagcgaacgctgccggcaagggcctgaggaccgagatccgtgaggtcgatttgccggcgagtactaccgccggcgccgggagggtcttcacttgatcgccgtacgtgcgttgccgcggcgggtctgcgtaataatgcagactatatagatggtgcttggtttggtctgtagttcgtgattacgtactcaatcgtttctgttctctgagacacggactactgttcatatgaactttgaattttcgcataataagagatggcgccct

SEQ ID NO: 12404 - DNA, 2556 bp, Zea mays
gctgcttccggtagcctgaagcagaaaaaaactgaaagaaacatgacagataattccctcggagaaacttggcatgtttcccgttggtcatgtaggacgacgataatgataaattggtaagcaaagaaaaaggctactaagctcgagcagtagaagctacctagctcgtcgtaacgaagaaacttctcgtccttcaggtagacccttgcttgtttgcagtactttagttagggttcggtctttaattcttttgctgggcagcagtaaacggagatgagaagcgcgagctgatcattgttgccattctgtgcaacgaagctaggggaccaatgctgactcgcacgagggcatagttgctgatggtcatagacgacgcgttcacttaaaataataaagaattataaattgttgtcataagtcgtgcagcctaatataggagagtgcggcattgctgtagctaattaagagagtattccggtcatgcttgagcttggagaatttttgagggtccgttcgcttggagagtcggagatttttgagggcccgttcgcttgcacaataataaacaaagatttgttctagctcatccaaatctatataaattaaagaagtaattcggttaggaatcaatccagagctctaattcttaaaaaccgaacagggcctgagttgtttgtctagacgacattatctgattaagttattttcatcttcaatttcaaatgtgatctagcggcataaaacttgttgtctgacagatatttgacttccacacgggccacagctcaattacaaacatacttcaaacatcaggcagaggcagagcactagcagcattcgctacgtggcggtgggcagcagtggccagcacattcgacaactgccacggatcccgtactacttcaaacacgtatcgcttccagaatccagagtcacacgtgtgcagctgcatgaacccacctcactcccttaagaacagctcgacgctcacctgtctaggctagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaggacgtgcggcagtgcctcatcttcgacgggcccggcgccggcgcgcgcctcatcggcgtggagtacatcgtctccgagacggtgttcctgacgctgcccgacgccgagaagccgctgtggcacacgcacgagttcgaggtgaagggcggggtgctgttcatgccgggggtgcccggcgtggtggagcgccgggacctggagaaggtgtgcaagacctacggcaagaccatccacttctggcaggtggaccgcggcgacgcgctcccgctcggcctcccgcagatcatgatggtgctcacccgcgagggccagcttcggcaggacctcgctgactgtacggcgtgctcgcagattgagtatctgtgatctctctctgatctctctttttttactgatggatttgaacctgcaatgtacgtgcaggtgtggagaagaagttcggtgtctccttccagaaggagagggagaaccgggcgtacatgagcggaccggagcatggtatccacccgctagcgaacgctaccggcaagggcctgaggaccgagatccgtgaggtcgatttgccggcgagtactaccgccggcgccgggagggtcttcacttgatcgccgtatcgtgtgttgccgcggcgggtctgcgtaatgtagactatatagacggtgcttggtttggtctgtagttcgtgagtacgtgctcaatcgtttgtgttctcttaagacacgaactactgttcatatgaactttgaattttcgcataataagagatggcgctctactaataatttgtgtcaaaaccgttttggttgaactcttggatttaggatgggataatgaatttcatacagtttgcatatattaatgccaaatatctcctagaaacttgtccttaaaatgataccaattggtgaatgggaaggtaaacatcttcacaagatgttttaaaatagtcccccaaatattaagacactacaatcatttaaattgcttattacatagttaagtcctaaatcatttattttgttatataggggaaagagggtgagtcatttattttgttatatatgggaaagagggtgaggtagaaaataaggattgtgcattaatctgtgggtgtaaattacattatacttgagaaaacgttgaggatgatggggtgtaaattacattatagaaaaacaaggatacgacactgataggacattaacccattaacctagggtgtaaattacattatatttaggtcactttt

SEQ ID NO: 12405 - DNA, 1645 bp, Zea mays
tttttacccaatccatgcccgtgtctttttattcgcggccgccgacctccggagcatgagaaaaatagaaaattcctccaaaccctaagcccctctctgctcacctctgtactccgaatctgctcccaagtctgctagggtttaacgctcgcgtcctcctcacgcattcggtctggtcgctgatcttcgcttgttcgattccgctcggctctaggacccaggctctcgaggcggctggagtggcggcgcgacgagagggtgaagcggatgcagacggaggcgagggtggggatggccgccgccacgatggacggcaccggcgccgcggcgtccgccgcccggaggtacacgacgcagcagcagcagcagcagcagcagctgcagcaccaccagccgcagctcgggaccgtgccccatctcctcgccggcggcgtcgctggcgcagtcagcaagacctgcaccgccccgctcgcacgcctcaccatcctctttcaggtacaaggaatgcactcagatgtggctacaatgcgcaatactagcatatggcgtgaagcatcccgcattgtctatggagaaggttttcgagctttctggaaagggaaccttgttaccattgctcaccggttgccttactcttcaattagtttctatgcctatgagagatacaagaatttgcttcagatgctaccgggtcttgagaagaatggtggatttggtgcagatgttggtgttagattgctaggtggtggtttatcaggaatcactgcagcttctgtgacgtatccactggacttggtgcggacacgtcttgctgcccagacaaatactgcctactacaggggcatatctcatgctctttatgcgatctgcagagatgagggtgtccgtggattgtacaagggtcttggtgccactttactgggagtgggccccagcattgcagtaagcttctctgtgtatgaaactttacgttcccattggcaaatagagaggccatgtgattcccctgttctgatcagtttggcttgtggaagtctttcaggaattgcatcgtctacttttacattcccattggatcttgtgagacgtcgcatgcaattggaaggagcagccgggagggctcgcgtctaccagacaggactttttggaaccttcggacatattgtccgtacggagggttttagaggcatgtatagaggaatcttgcctgagtactgcaaagtggttcctggtgtcggcatcgtatttatgacatatgagatgcttaaggccatcctcacaggactggaatctgatgattagatatctgcgaggtcatgctacacaattttgatacatggtgtcagaacaacatttgaggctgattagactgggagaaatatgagcatgtagcatacgttagggtttaggatgtgctaaggtttgcagtttgtgttatatggttacagatgtttatgtagtgcaccgtgaaagatgccacaggtcttccaaaatgaatatttttttggcatcaccaccattttgtgtatcttcaataacattgtaatggtacatgaagctgttgtctttagcctgatgatctttataacaaaaaaaaaaaaaaaacaattttaccagtgttatagcaaggttgatcaatggtggc

SEQ ID NO: 12406 - DNA, 1262 bp, Zea mays
acccacgcaacgaatacaatacaaacagagggaagggagcgagcgggaagccaaggtggggaaagcagggaagcgaggccaagtggagcggagcgaaagctggagctccccgcggtggcggccgctcgctacttccagtgttccatggtgtgggtgtgggcggctgtggcgatagccggagcctgaagcggcgggtggtgtgtggtgggcgcaaggagccacacggagcaggccgccacggcgaggaggaggaggaagaggaggagatggtcgtctgctccacgcgcaagtcgttcaaggactcgctcaaggtgctcgaggccgacatccagcacgccaacacccttgcagcggatttctcgagggactacgacggggcctgcctccagatgcgcatgtcctacagccccgccgcccacttcttcctcttcctcgtgcagtggacggactgcagcctagccggcgcgctcgggctgctcaggatcctaatctacaaggtttatgtagatgggagtaccaccatgtcgacgcacgagaggaaagcgagcatcagggagttttatgctgttatctttccctccctgatgcaactgcccaaggggatcagcgacgtggacgaccggaggcagaaggcggcgtgcacggagaggtaccggaggagggacgaggacgagggcaagaggccggtttcggaggccgacatcgaaagggaggaagagtgcggcatctgcatggagatgaacggcaaggtggtgctgcccagctgcagccatgccatgtgcatcaagtgctaccgccaatggcgatcaagatcgcaatcctgccccttctgtcgggacagcctgaaacgagtgaactccggggacctgtggatgctcaccgactgccgggacgtggtcgacatggcgacggtgacgagggagaacatcaggcgtctgttcatgtacgtcgagaagctgcccctcgtcgccccggacaacatcttctacgcctacgattctcatgtaaaatagctggagctagctgtgctgtgttctgagagtgatgacgcatggcttatcgattcttcatgcagaggagtagagggtgttcctcgtcctagctaggacgtggctaaacgcttggaccggggtgcggactctgacgacagaccttttcagtctatctaactgggtgtgggtgtacagtctgctcaggtcctgtaaatataatgtctgtgcatatttatggcttcaaatgccccgttgtttttcagcgtggat

SEQ ID NO: 12407 - DNA, 821 bp, Zea mays
atacaatacaaacagagggaagggagcgagcggaaagccaaggtggggaaagcagggaagcgaggccaagtggagcggagcggggcttcggctgggttccgcgcgcggccgctcgctacttccagtgttccatggtgtgggtgtgggcggctgtggcgatagccggagcctgaagcggcgggtggtgtgtggtgggcgcaaggagccacacggagcaggccgccacggcgaggaggaggaggaagaggaggagatggtcgtctgctccacgcgcaagtcgttcaaggactcgctcaaggtgctcgaggccgacatccagcacgccaacacccttgcagcggatttctcgagggactacgacggggcctgcctccagatgcgcatgtcctacagccccgccgcccacttcttcctcttcctcgtgcagtggaccgactgcagcctagccggcgcgctcgggctgctcaggatcctaatctacaaggtttatgtagatgggagtaccaccatgtcgacgcacgagaggaagggagcattaggggagttttatgctgttatctttcctccctgatgcaatgccccaggggatcagggatgtgcacgaccgtaggaagaaagcggggtgcacggataggtaccggaaggaggatctaaggaccaggccaatagtccggttttcgaaggccgactctgaaagggagcaaaatgcggtcttctggagggagaagaagctcatgggttgtttgcccttgtgcgagccttgcctcggcgatttatgtctaccggccaagggcggattaaaattagaatcttcgctcttg

SEQ ID NO: 12408 - DNA, 2070 bp, Zea mays
agaggatccccctgcagccgcgggacccgcaccgcaggtcactccaaccctctcaccaccctcgctgacaaaccgccccgcgctgagagtatccctcctgtcagttactgaagggtagacggacagaggccgtggctgcgctggccccgtatgggccccgcgcgtcagtcgcggctttctcgcgtcgcccccggacccggggatgggagggacgcgtgcccgtgctcctccagtcctccgtccgcactcccactcccactcccacagccggtctccctctacccacgaaacgaatacaatacaaacagagggaagggagcgagcgggaagccaaggtggggaaagcagggaagcgaggccaagtggagcggagcggggcttcggctgggttccgcgcgcggccgctcgctacttccagtgttccatggtgtgggtgtgggcggctgtggcgatagccggagcctgaagcggcgggtggtgtgtggtgggcgcaaggagccacacggagcaggccgccacggcgaggaggaggaggaagaggaggagatggtcgtctgctccacgcgcaagtcgttcaaggactcgcctcaaggtgctcgaaggccgacatccagcacgccaacaccctgtgagtgcccccggccccgtttccatcccggccgccccgaattcacgctcgccgcagctgccgcctgccgcagatcgatctccgcgggctccgcccgccccgattccatcctgaccgaaaccggggcggcgaaataaagttgctccagtgggtgggtggggtgggtatgcagtatgctacagtggcggttgagctctcatgtcatgtcatgtcatgtcgtgtcacgccgcgcgcatgagcgagcggtgggcgccgacgatcgggctggcacaccacctgccttcctgacgcgtgccttccctcgtgctgactgctcgctcgctcaaacaactcgacagtgcagcggatttctcgagggactacgacggggcctgcctccagatgcgcatgtcctacagccccgccgcccacttcttcctcttcctcgtgcagtggaccgactgcagcctagccggcgcgctcgggctgctcaggatcctaatctacaaggtggtttctcttctcctgcgatgtggtgtgaggattcgaattcgatgccgttccccggctgacggctgtgcttccgctcctgtgcatgctcaagtagcttcgttgtgcaggtttatgtagatgggagtaccaccatgtcgacgcacgagaggaaagcgagcatcagggagttttatggcaagtgctctgctctgcaacgacgacgcgtgtttgcaattttggccttgtgatagtactgatgtgtgcactgcattgttgcagctgttatctttccctccctgatgcaactgcccaaggggatcagcgacgtggacgaccggaggcagaaggcggcgtgcacggagaggtaccggaggagggacgaggacgagggcaagaggccggtttcggaggccgacatcgaaagggaggaagagtgcggcatctgcatggagatgaacggcaaggtggtgctgcccagctgcagccatgccatgtgcatcaagtgctaccgccaatggcgatcaagatcgcaatcctgccccttctgtcgggacagcctgaaacgagtgaactccggggacctgtggatgctcaccgactgccgggacgtggtcgacatggcgacggtgacgagggagaacatcaggcgtctgttcatgtacgtcgagaagctgcccctcgtcgccccggacaacatcttctacgcctacgattctcatgtaaaatagctggagctagctgtagtgtagcagcacaccatctgtgctgtgctgtgctctgagagtgatgacgcatggcttatcgattcttcatgcagaggagtagagggtgttcctcgtcctaggacgtggctaaacgcttggaccgggggtgcggactctgacgacagaccttttttcagtctatctaactgggcgtgtacagcctgctccgggcctgtaaatatagtggctgggcatatttatggcttc

SEQ ID NO: 12409 - DNA, 1594 bp, Zea mays
gctcgaattccgttgctgtcgcagggaagcgaggccaagtggagcggagcggggcttcggctgggttccgcgcgcggccgctcgctacttccagtgttccatggtgtgggtgtgggcggctgtggcgatagccggagcctgaagcggcgggtggtgtgtggtgggcgcaaggagccacacggagcaggccgccacggcgaggaggaggaggaagaggaggagatggtcgtctgctccacgcgcaagtcgttcaaggactcgctcaaggtgctcgaggccgacatccagcacgccaacaccctgtgagtgcccccggccccgtttccatcccggccgccccgaattcacgctcgccgcagctgccgcctgccgcagatcgatctccgcgggctccgcccgccccgattccatcctgaccgaaaccggggcggcgaaataaagttgctccagtgggtgggtggggtgggtatgctacagtggcggttgagctctcatgtcatgtcatgtcgtgtcacgccgcgcgcatgagcgagcggtgggcgccgacgatcgggctggcacaccacctgccttcctgacgcgtgccttccctcgtgctgactgctcgctcgctcaaacaactcgacagtgcagcggatttctcgagggactacgacggggcctgcctccagatgcgcatgtcctacagccccgccgcccacttcttcctcttcctcgtgcagtggacggactgcagcctagccggcgcgctcgggctgctcaggatcctaatctacaaggtttatgtagatgggagtaccaccatgtcgacgcacgagaggaaagcgagcatcagggagttttatgctgttatctttccctccctgatgcaactgcccaaggggatcagcgacgtggacgaccggaggcagaaggcggcgtgcacggagaggtaccggaggagggacgaggacgagggcaagaggccggtttcggaggccgacatcgaaagggaggaagagtgcggcatctgcatggagatgaacggcaaggtggtgctgcccagctgcagccatgccatgtgcatcaagtgctaccgccaatggcgatcaagatcgcaatcctgccccttctgtcgggacagcctgaaacgagtgaactccggggacctgtggatgctcaccgactgccgggacgtggtcgacatggcgacggtgacgagggagaacatcaggcgtctgttcatgtacgtcgagaagctgcccctcgtcgccccggacaacatcttctacgcctacgattctcatgtaaaatagctggagctagctgtagtgtagcagcacaccatctgtgctgtgctgtgctgtgctgtgttgtgttctgagagtgatgacgcatgatttatcgattattcatgcagaggggtagagggtgttcctcgtcctagctaggacgtggctaaacgcttggaccggggtgcggactctgacgacagacctttttcagtctatctaactgggtgtacagtctgctcaggtcctgtaaatataatgtctgtgcatatttatggcttcgaaaaaaaaaaaaaaaatcagctggatatatttgtgtctcc

SEQ ID NO: 12410 - DNA, 3455 bp, Zea mays
tggccgtgttgcatcagacatattgtatgaagtaaataataacatcagttagccaaatcaaaaaatattatacggagggcgaagacaatcaataaaaaatcttgaaatttttttggtggatagtttacatgggtattgttgtaagctgtcgcaacgcacgggcaatcgactagtttttttatatatatgagttatatgtgtgtacttacgctcttattaaaattgggcatgacatggaaaaatccaataaaataatagaattatatcaactcataagctgatggaaggacaaaataaatagaaatatatagatacctcgtatatttattatatactaaaaacagtaattgcatttagtagtgatgatatggatgacttggattaagagattgaaagtcagtggaaggatatggtatttagtgaagatggtatatttggcttgtatgctacgatataactagcagtgggctttcaaaatataagatgtagatatagaaataagtcaaagatgttgtaagtggcttgtatgtttagatagtacttatacaaattttagaaatataagacatagatatagatatagatataaatatagattgagatatagatctagattggatagaaattaatcaaaatcatgtcgccaagataagatgcgtgcaaaaaaaaagtcttagaagagaacatgacaaatatgatggcaatttgaacctgcaaacccgaaacttaataggcacccgacccgatggatgcgagtatgggtgaagattttgaccaagggtgcacccacacttgatctagagttttgcgggtgtgggtttctatttcaatccacgggtgacccgcacccgacctgaatttagttcattctttgttttgcgcaaaaataattaagatacaaaattagttattttgaacaagtaactcggctaataatttatgaaatgatttgttgttccgatttaaaaaaatattattttttaaaataactcttccacctttatttttgtgccttagttgtttcgattgagccaggtagtttggtggcaccatatacattcccttcatcatgctcttatgatctgttttaattctgacttttctgatttggtcccggcttctcctccttccccctcggatcggcggcagttcccgtgccctcacagtcacaggggacgcggctcgcctttccttccccgccaatccatccgctcttctcagcggcgagaagaagagatggggagcaacgccgccggcaagcctcctcctcctcctgctgctgctgtgtcgtgggagttccacgcgacggggcctcgcaacttgaccagccccggctggagggacctcatccgctccagctggtatgcccctctcgctccccatttccattccctcggtgaattaatgctacccagctggtctttcattctcttcttcgatcgcgcgtgtctattcgttgatcgatctgcggaataccggcgaattgaccgattttcattttacaagtgaaattagttcattttcacttgtaaaaatataaatcctttagaaaaaatgaagtttctaaactagaacttgtactttataaattggttccgtctcatgtttactccccctgtagtaccgtaccgtacctccgtacctaccaatctaccatagggagtaaccccgaaaccatctaccaattctcgtggtcgttaagagttgagtggagcaaatcagcaatcaagtctccttttgtttcttgcgggaaaaaaaacatgagaaacaaaattataatatattcatgcccacatataatatattcatgtatagctgtaattttgtttctgaatatattcatgcccacataattgtgctgcattgtagcaggcatgtatagctgtaattcgtcccagaatttcgtcccgagagcatgtgacaatgacattgctacttcttttctgtctcttgtgctcacattcatccttttctcaaccacagggttttcttttttttaaaaaaaacttttgtagaggtcatgttttgcagtagcatttggtattcttgagaacaaaaaggcagtgatgtctgtaacactgacgccgcgacgcacaaccattactacgcaggagagatccaagctacagaaggatcgcagtgtcgtgcttcgtgcaggccgcgtatctgctggagctggacaggcaggagggcagagccggtgaagccgcgctcgctcccaactggtggaagcccttcaagtacaagctggtgcgcccgctcatcgactccagagacgggtccatctacggggcgcttctagaatgggaccagctcgccgccctcgctgacctgatagtggccaagcctcagggcgctcccaaggtggtcctcgcgctcaggggcaccgtgctgaggcagctgaccgtggtgagggacctggaagacgaccttcggctgtttgccctggagagcctgagggggtccgtcaggttcacaggcgcgctggaggtgctcaagtcggcgatccacaggcacggcagcgccaacgtgtgcgttgccggccactcccttggcgccggctttgcgctgcaggtcggcagggccttggccaaggatggaaccttcgtggagtgccatctgttcaacccgccgtcggtgtcactcggcacgggcctcaggaaaatccaggagaaggccagcagtgtcctcaagcggtatatcagtagaagcggcggcggtggcagcagctcctcgtcaaatgtttccccaggaccaggagaggagctacaagccgccgccgctcgagatggagttggagaagaagtgatgagcagggaggtcaaaagatgggtgccaaacctgtacgtgaacagctgcgactacatctgctgcttctacgctgaccgtagcggcgtcgctaccgtcaccgaggagaagcgttccggagtgcattccaagctgtacgtgatcgccaaaggaccgagcaagttcctggaggctcacgggctgcagcagtggtggtccgatgattctgagctccacttggccgtgcacgacagcaaactcatgtataggcaccttaagtccctctatgtccaacagtagtagagaaggcattagtacttgtttctcagaatgcctagttcttcttctctagtccagccagacaagaaaacatgtaaaccgtcagctgattaagagctccaactcttgcaactcgtctaagcatatcttcttctcttctcgcgtacgcatagcatttgttttctttattatgtggacgttaaactctttttttccttgcaagcgtaccgtaccttacctaagcgtgctaatggattaggatccaaatatttctttacaataagttagagctcttagttaattttagtttaaaaataaataaaaatatatctcgatactaatttgattttatctttaaattttatagtgtaaaatctagagcatatacc

SEQ ID NO: 12411 - DNA, 1602 bp, Zea mays
  misc_feature (1464)..(1467): n is a, c, g, or t
  misc_feature (1483)..(1484): n is a, c, g, or t
gtggcaccatatacattcccttcatcatgctcttatatgatctgttttttctctgacttttctgatttggtcctggcttctcctccttccccctcggatcggcggcagttcccgtgccctcacagtcacaggggacgcggctcgcctttccttccccgccaatccatccgctcttctcagcggcgagaagaagagatggggagcaacgccgccggcaagcctcctcctcctgctgctgctgctgtgtcgtgggagttccacgcgacggggcctcgcaacttgaccagccccggctggagggacctcatccgctccagctggagagatccaagctacagaaggatcgcagtgtcgtgcttcgtgcaggccgcgtatctgctggagctggacaggcaggagggcagagccggtgaagccgcgctcgctcccaactggtggaagcccttcaagtacaagctggtgcgcccgctcatcgactccagagacgggtccatctacggggcgcttctagaatgggaccagctcgccgccctcgctgacctgatagtggccaagcctcagggcgctcccaaggtggtcctcgcgctcaggggcaccgtgctgaggcagctgaccgtggtgagggacctggaagacgaccttcggttgtttgccctggagagcctgagggggtccgtcaggttcacaggcgcgctggaggtgctcaagtcggcgatccacaggcacggcagcgccaacgtgtgcgttgccggccactccctgggcgccggctttgcgctgcaggtcggcagggccttggccaaggatggaaccttcgtggagtgccatctgttcaacccgccgtcggtgtcacttggcacgggcctcaggaaaatccaggaaaaggccagcagtgtcctcaagcggtatatcagtagaagccgcggcggcggcggcagcggcagcagctcctcgtcgaatgtttccccaggaccaggagaggagctacaagccgccgctcgagatggagttggagaagaagagatgagcagggaggtcaaaagatgggtgccaaacctgtacgtgaacagctgcgactacatctgctgcttctacgctgaccgtagcggcgtcgctaccgtcaccgaggagaagcgttccggagtgcattccaagctgtacgtgatcgccaaaggaccgagcaagttcctggaggctcacgggctgcagcagtggtggtccgatgattctgagctccacttggccgtgcacgacagcaaactcatgtataggcaccttaagtccctctatgttgaacagtagtagagaaggcattggtacttgtttctcagaatgcctagtttttcttctctagtccagacaagaaaacatgtaaaccgtcagctgattaagagctccaactcttgcaactcctctaagcatatttcttctcttctcgcgcaaaaaaaaaaaaaaaaaaaaaannnnaaggaaaaaaaaaaannaacacccgagggggggcccggtacccattccccccaatagggagccgattaaagttcctgggccggcgttttcaaaggtcgggagggaaaaaccctggggtacccaatttaatccccg

SEQ ID NO: 12412 - DNA, 5346 bp, Zea mays
  misc_feature (426)..(426): n is a, c, g, or t
ttggccgattctgttggtgcgtcgtgctgtattcaccagcatcatctataaccttgtgcacttaacttcatttgtagctctgcaaacttattttgacttttgcacactggtcatattttattggccggcataaaatgtctgagtttctgaactcaggtaataaacaagacagacctagcacctgctgttggagctgatctgtctgtaatggagcgagacgcacttcgcatgcgcgaaggagggccctttgtgtttgcacaggttcaagatcaaactatgcacatctttagtttttttttcctcgtgactttgtgctagttgagaggagaacaaggtttacatgttcaaggacattttacttccactgaaatcagtgatgatggcatctttatataattatgcaggtgaaacatggagtgggcgtgnaggggatcgtgaaccatattctgcaggcgtgggagatcgcgactggtaataagcggcgataagatctcacgacttggggccatatgttggatgcagatttgattcagtcggcacttccacatgcatgtgtcatctgttcgtttctcaataaattctgcgtcatttgctgctgattgtacttgacaagtagagacatggatggactcttaaaattccatccatgtgttaaatgacatattcgagacatccttttctcaataaactctgcatcatttggtgaattgcacttgagaagtaaagacatggagccttaaaattccatacttgagtttaatggcacatttgagatatcctttttctccttaaaattccatagcttcgtggattcggtattaacgctctggactacgagtgggaggttaatagtctgcaagcccgctcagtgaatgcatgaacgctggcatgttgtgaagccgttcagtgaaagttctgaatatggaaaagaaaaaaaaaatactgcaaggtcgcgcactgaaagatacgaatgctgcaaggctgcgcagtgaaaacggatgtgaatgctgcaaggacattcagtgagaatgatgcaagggcgtttagtgaaagttctgaagataaaaacaaaggccattcagtgaaaacaaatatgaatgctgcaaggacattcagtgagatatctgaagagaaatgaaaagtgatcagtgaaaactctgaaattgaaaaaggaatattcgtaatcagttaaaatatcttatatgcaaatatatgaaactagaaaaaaaaacaaatgcgactccgctggggatcgaacccagaatctctggttccgtagaccagcgccttatccattgggccacggagtctttgttgttttaatgaacttgtagttaaatatgagggtatcttgcaacattttttatgaaagaacacgacgaatagtagtggtaggtggtttttatcaaggaaactgtcgaatatagcactgcatatttgaaaatttccataaaaaacattaagtacttgagaaaaaaatactcctttcaccctaaattataagatattttaacattttggtaagtcaaaacattcgatgttgatcaaatttgtataataaagtaatagtatttatgatactattagattcttttctaataatattttaaaaataattctaatcgaacttaagacgttttgactctccaacaaaaataagatattttataatttgaaacggatcgagtatttcacttgagagtttattgaaggattcgaaaaacaaatatatgagaagagatattttttcatagaatattttagatttatctccatgtccaagaacaaagatactaactatacttaatgataaagtatgaatattctagagataaatacggtatctaaaagcttggtggtggtaaaaatgtgcaacagaccactatatagcgtgtaaattgtcgatgtttgataccatcacttagtaaatttgcatatatacattgtttcaactaaggaggtgttagaatccacttcggtaattgttagatactaaaaattagcttagctaggatggattataatatgtgcagataatatatcaattaattattagctaagtagccaaataacaagaacctcactaattgtaccaacctacccaatagatctgatattttggccttttcacttacctctattcacatggtttaccagtagcatataaaaggcgaaatacatgatagataaaaccatcaatatatctaccttttagcttttggttccaaacagaattaagctaatattagctgtgaactagtaaccagtacattcaaacaagaatgtgggattgcccctccccttggaatcatatagatagggtgtcttcttttttattccaactcttggtagggaaaatatgtttaacaggctctcagactaaaaaatacccttaggccaaatggcctaggcacatatggggttaaccattttctatttctctaacacatacaaaagatgaattgttttttctacaaagcattgaaatctctgtgaacttttctatgcagaatttttttctcggcacaactgtaaagaaagggtcagatttgcaagtgcaagatctcatttgtattacagaaacgaggttcccacaaaccctctgctgaagattttggctgtgaaggggaaagagataaagatgacactactccccctgcctccggcggtcctcagccgtctttcgtggtgtctacagtcctcgcgagtcgcgagctagcccagccgtcagatgattacgttggcttcagttgaggcgctttgattttgctgtggcgttatttcacaattcacacgttgaaagcaaagttttatttaggggcgaaattacaaacgcaaatcaagctcgaaacagtgttttgaatacaaaaaacaagtccatgtcacaagctcaggcgtcttcgggtccagtgttgcattccggcgaacacctttcctgcagtctccatcaacaaaaaagcagcaccttgcctgctgcagccttcgctactttgcaatgccgttcaggcgctcgataacggtgatcagtccctgcaagctcaggtccccgtcgccattggccaccatggccgagaacatctgccggtacagcgccgctccaggcagcacgttgacctcctcctccccgccgtctccgacctccagcgccatgccgaggtccttgacgatgtaccgtacgctgcccccggacgcgaactcgcggcggagcaagcggccgccgaagacgtccatgacgcgcgaccaggccgcgcccctggacaccgcgccgaggaacagcggcgcgtcgagccccgccgcgcgggcgaaggacacggcctcgccgaggcccaccaccgcgccggccaccgcgacctggttggcgatcttgctgctctggccgctgcccggcgcgcccatgcgggtcgccctgccgaggctggcgaagagcggcgcgagccaggcgacgacggcctcgtcgccgccggcgaagacggccagcgtgccgtcccgcgcgcccacgtcgcctccggagaccggcgcgtcgacggcgtggcagcccgccgcggccgcggccgcggcgacctcgcgcgcgagggacggggaggagctcgtgcagtccaccagcacgccgccgcggcggaggcccgcgagggccccggcggccgggtccaggaccaccgcgcggacgtcgccggggttcccgaccatggtgaacaccacgtcggacgcggcggccacggcggccggcgagtccgcgaggctcgcgcccgccgcgacgaggctctccgccctggacggcgtgcgagcgtacgcggtgaccgcgtaccctgccgcgaggaggcgcttggccatggcgccgcccatgacgccgatgccgatccaccccacgcgcgtggcccccggctgcaccggcgccggaaaaccgaacgccgccgcttccagttgccgcccctcctccatgatcccctccgtaccggagctactcgcaagctgccgattgtccacagccgcagccacgattttggttggttggttggattgcaagatatcccgccgttgctttcttttttttttcaacgggacagcgacagtgatgtgcataaacaaacaagaaactcgctgggtcccactctccgtgatcgcaatttcttgcatgaatccaaaaacacgcaaattaaaatattcaccacccgatagggcaccgcaagttttcatattgctttgttccagaagcaggagatgtacagcaagaacatcgaaaggggaaaacaaaacgatgggcatttggtacacgccaaggccgaccggtgaagtgaagtgaagagacgggagaaataaaagcgggcagctcaattagaggtggcagccgcagcagaggaagaagcaggagagcgcgaggcccagcacgacggcctcgacgacgtacatgacgcggaacgcgacggcgtcgaccacggcggccgcggagccgctgcgcagggtgagggaggggagacccgggagccggcgcttccacctgagggagcgcgagagcgacgacgcgagcctggacgcgccggcggcggatgggacggccagcctccagcgccggccgctccggggcaggttgtagtccctggagacgagcttcctcagccacccgcgcgagcgcgccggacccgcaggcgccaccgcatcggtcggggatatgggcgccgtctccgaaaccgagcccgccctcgccgccgccgtgtccgcctcgatggccattggccgccgctccgctgccgctgccctggtgcgggagagggcgtccgtgcgttggtttggctggaaacgttgcgatcgggtggtggactggtggttggtaagacgggggagagagacagggaggacgtgggggtggtgggcgacgcgacgtgcagtgctgcagggactggagcggacgacgagaagactcgaagatatatgggggaggcgacgggagaggggggttctggcactttggcccctgtgagtttctgctttgttccggcgcgctcctcggctttgctttgtgcgcaagcaaggcaacagcgatgcaacggagagcgagcgagcgagcgagcgagcagtctggcaccagcaacacagcgactagaaataaagcactcgtttccggcacagcacagcttccagttggcgagtttttggttaacgaaaggcgagttccatcgaagccagttcatgcgctttctttgctatgctacgcaggaaggcagaggagtgcaagggacaggtatagacaggggcgaagccaggatccaaagacagaggagataggcttagcctccaagcaaccaaaccagcaaaaacataatataaaaatggtaagggaaccaaccacaa

SEQ ID NO: 12413 - DNA, 1320 bp, Zea mays
  misc_feature (1267)..(1275): n is a, c, g, or t
  misc_feature (1303)..(1303): n is a, c, g, or t
gggtacctcgaggccggccgggccggggcatcttcagactagtctagcccgcccggtccggacggaacctgcgctccgatccgccacctctcttatctgaaaacctccagagtccagcctcccttccgattccacctccaagctcccagtcccagccatggcgtctcatgatcatcaccactcccactcccacgacgaccaccaccaccattcccacggggacggcggtggccatgcggctgggggatcgtgggtaggggaggacggacgcgtgtggcactcccacgacggcctcgcgccccactcccacgagcccatctactcccccggcgacttcaccaagcgcgcgccgccgctcgcctcgcgcgacttcgctgaccgcgccttcaccgtcggcattggcggccccgtaggcaccgggaaaactgccctcatgctagcattgtgcagatttctacgcgacaagtatagtcttgcagctgtcacaaatgatatattcacaaaagaagatggagaattcttaattaaacatggagcgctccctgaagaacgtatacgtgcagtggaaactggaggctgccctcatgcggctattcgcgaagacatcagcataaatcttggtcctctggaggagctatcgaacttgtacaaagctgatttgctactctgtgaatctggaggagataacttggcagctaacttcagcagagaattagcagactacataatctacattatcgatgtctctggtggggacaagataccaagaaaaggtggccctgggataacccaggccgatctgttggtaataaacaagacagacctagcacctgctgttggagctgatctgtctgtaatggagcgagacgcacttcgcatgcgcgaaggagggccctttgtgtttgcacaggtgaaacatggagtgggcgtggaggggatcgtgaaccatattctgcaggcgtgggagatcgcgactggtaataagcggcgataagatctcacgacttggggccatatgttggatgcagatttgattcagtcggcacttccacatgcatgtgtcatctgttcgtttctcaataaattctgcgtcatttgctgctgattgtacttgacaagtagagacatggatggactcttaaaattccatccatgtgttaaatgacatattcgagacatccttttctcaataaactctgcatcatttggtgaattgcacttgagaagtaaagacatggagccttaaaattccaaaaaaaaaaaaaannnnnnnnnaagaaaaaaaaaaaaaaaaaagcggccngaaaaaaaaaaaaaaaa

SEQ ID NO: 12414 - DNA, 919 bp, Zea mays
gaaggactgccgctagcggttgtattcgtcggaacatcgctcgaggccggccgggccggcgcgctcctggcgctgctctgagaactggatatgctgggcctagcacccctccgctctgcgcctcttcctatccgcgcctccgccaccgcctgcggccgaaataactcgcagcggctcgccaatggctgccaactctctcttctcgcgccagaggcggccgaaggtgacacggcgctgccggagaacatgcacaagtggaggatggtcatcgcctacgatggaacaaagttcaaaagttggcagtatcaaccatcaattccaacaatacaatattttctagaggatgcgctgatatgcatcactaagctggatcggaagaaactatgcttagtcggtgcaggcaggactgatacaggtgttcatgcatggggtcaggtggcacattttactacacccttcagttaccgttgcctcagtagtattcattctgcaatgaatggactccttcctcctgagattcgagtcagggaaattagtgcagcacgtcctgaattccatgctcgctcatccacaaagagcaaagtctatcgctacaagatctataatgaagcaatcatggatccctttcataatcactatgcttatcatagtgcttataaacttaatccccatgccatgcaggaggctgcaaattattttgttggaatccatgacttcacgtcttttgctaatgctgcacataatgaccgtgagcgcaggcccacaaagaagataacacgttttgatgttactgaaatgggcgctgctgtcttacagctcgaggttgaaggcaccggttttctgtacagacaagtgaggaacatggttgctttgctgcttcagtcggaaagaagcacttccttctgatatcgtcagcgat

SEQ ID NO: 12415 - DNA, 2446 bp, Zea mays
gtaattattaaaccatgcgtatagagttgccacgtttgacatttgtctatctctcctctgctttgttgcaaatgtattgattactaaatagaaagggtgaaaactaatggatctccactaacccaacaacacaccaatccaagtccatctgtacatgtacaatcatacttgacactgctgacgttggattcagaatttctgatcaatacccccaaacaaattatgggatataatatttttttagtgcttttggcttcttctatgcggctatgccttgaccggcaatggttagtcattaacactttaattacgggatatgatttatttttgtgtttttggcttcttccatgcctatgcattggacggcaatggtcagtcactacacgcttcattggtaacatcgactggttatagattgtccatggagacatacttgtcttcattattagaacaacaacaaggtgagcgagaagcattcttgtgttcttccggtaagtgccataagctaaaggggatgcagagaggttggtttattttacttctcttgcacatacctttctacttgatctttcaagctttgagctcctcaaaatttatcaacaggatacgaagcgttgctaggatgcctctgtgctggggtgataattggggccctagcggctgcctgcagtgttaggagaagaagagccagcaagtcccaaccatcaagaaacgatattggtaatttcactaattaattgcacatccatatgcatatagaagttactgagatagatgttttttttacccactaatagcaatacgaagttgcacatgttgttttttcttgcagaggtcgcgttggcatcccttgagtatgaggagactacctgcaagccgatgtcgatcaaagaaatatacacagcaactgaaaacttgagtccatcaaacgtcattggacagggtattgcaggtacgtgttcacaatacctgattcacagttatggtatctataccataaatcaagagaaagtatatttttcatccaagaacacgagacttagaaacctaactgttcaagtatatgttgtcctttatggtgtgcaactggttcatcttgtggttccaggcaaggtatacagaggagtgctgacaaatggctggcctgttgcagtgaagcacatcgttaagaatgagcatgcagaaaccttcctaagggaagttaaaagcctgtcacatgtcaggcacccgaaccttgtgtcattaagaggttactgtgacgggcaggaggagtgttttcttgtgtatgagctgtgcatcaacggtaacctatcagaatggctatttggtgagtaacatgatagcctaaacatttaaagtgacgactagaactctatacgttgttgcataattgaagaaaaaaaattttgattctaggaaaagacaagaaccttccatggattcagaggcttcagatagcacttggaagtgcttgtggcctttggttcctgcacatataccctgaaggctgcatcgttcaccgtgacatcaaggtttgttgcatgatctgaaagtcttcagtgcatctatagattcatgtttagtcaaactcacactttctatgacagccaaccaatatacttcttggggttgatatggaacccaagctgtcagattttggactctctagagtcatcgacttaggtgtgtcgcacgtaagctctgaagtcagaggaacatttggctatgttgatccagaataccgccacaaccacagggtgaatgctgcagggcgtgtgtacagcttcggcatggtgccccccctactcctctcaggaagacgagcaatcaacatcatgaatactgctatgccaatgtcactggacaaaatggtaagatcataagcagttaaagtaagatactacgttctgggaagaacaattgaatgagccgaatatgtgtaccttttgttcccaggcttctacacttatccaagatggcaatgtatcagagtttgctgatcctaggttgaatggagagtattcaacggaggcatttgacctcagtttgaagcttgctctgttatgcactggccacaagaagcaacggccatccatggagcaagttgtgtcaagacttgagaaggctcttgagatatccatgagagatgatgcaaaacacaacaacattagcattgtcgaatcccttgcatagctattatgtgtaatccttaagacccttgatgtttacatgaccatgcttaagcatttttgtgcgctaagtgaacgaaaaaccattcgagtgatgagaaatttacatcagaaaagttaagacaaaccaatagaattagttcacacctataaccagagatactgaaagaccaaatctagggacagtactacgatctagacttctattagagcacaggcttggatatttcagcaccttttctgtcacacatacagag

SEQ ID NO: 12416 - DNA, 3499 bp, Zea mays
gagcccaaaagatgttaaattgaaatagatgctcgtcatttaatatacgtaccatgtgcatagcttgtttggttcgattagtttgtctaactttttttttctaatgataactttttttaattggatcgaaatcttatacaagctgtgggttaaccaagaatcaaacaaaccctaaggtcttgttcgtttgtgtcggattggtgggtcggaacgattcctaactaaattgcttctctaatttatataaattttgattagctggaacgattccggttgcaatccaacgcaaacgaacaaggactaaatatattttatttccgggaggccatgacagaacagacacacatagtgaagatgcagggccacagaatgtgcctatggtcaaggttcaaccctggagctggaggagtgactgagtgaggtgcgagataatttggctctcacacacaaactactaaccaacctctggctctggctctcttccttctgcctctcctccacagaagagtcagtcatcacaactcacacgagccacttgaccagcgagtcacagtcagcgcaggccgctcccctcccgcctttcggcgattccgctcccccgcgcccgccggcactcaccgggccagggccagagaagcggcaaagcagagagtcggcgaggacgagactacgagaggaggaggagcgcgtgtcctttggtttggagcgagcgatggtgttcgcgtccgggtccgccgccggcgggccgcaggtgctgacggcgcggttcgtgcggcaggtggtgcagggccggtggttcatggtgttcgcgtgcctgctcatcttgtcggcgtcgggcgccacctacatcttcagcatctactccaaggtgctcaagtcgacgctggggtacgaccagcgcacgctcaacacgctctccttcttcaaggacctgggcgccaacgtgggcgtcatttcgggcctcatcaacgaggtcacgccgccgtgggtggtgctcgccatgggcgccgccatgaacctggcgggctacctcatgatctacctcgccatcgacgggcgcaccgccaggccccccgtctggctcatgtgcatctacatctgcgtgggcgccaactcccagtccttcgccaacaccggcgcgctcgtcacctgcgtcaagaacttcccggagagccgcggcgtcgtgctcggcctcctcaagggcttcgtcggcctcagcggcgccatcttcacgcagctctacctcgccatctacggcgacgacgccaagtcgctcgtgctgctcatcgcctggctccccgccgccgtcaccatcctcttcgtccacaccgtccgcatcatgccgtacccgcgcgccagccgacgccggggcccgtcagcggcagccaccagcaacgacgccttcttctgcttcctctacatctccatcgcgctcgcgacctacctcctcgtcatgatcgtggtgcagaagcaggtcaacttctcgcacgccgccttcgcggtctcggccgcggcgctgctcctcatcctcttcctgccgctcgccgtcgtcgtcaagcaggagtacaagatccagaaggagctggaggagtccctccgcgaggaccccacggtgaccgtggagaaaccggccaccgcagcttcgctgcagctggtggcagcagcagcagcagcacctgaaccagcggtggctcagagcatgactacgggaacagaggccaagcggtccagctgcctggggtcttgccttcggcacatgttcagcccgccggcgcagggggaggactacaccatcctgcaggcgctggtgagcgtggacatgctggtgctgttcctggccaccatctgcggcgtgggcggcacgctgacggcgatcgacaacatggggcagatcgggcagtccctgggatacccggccaagagcatcaacacgttcgtctccctcatcagcatctggaactacgccgggcgcgtcaccgccgggttcgcgtcggaggtgttcctggcgcggtacaagttcccgcggccgctcatgctcacgctggtgctcctgctctcgtgcgtcggccacctcctcatcgccttcggcgtgccgcagtcgctgtacgtggcctccgtggtgatcggcttctgcttcggcgcgcagtggccactgctgttcgccatcatctccgaggtgtttgggctcaagtactactccacgctctacaacttcgggtccgtggccagccccatcggcgcctacgtgctcaacgtccgcgtcgcgggggcgctctacgacgtggaggccgccaagcagcacggcggctccctggcgggcggcgcagacaagacctgcatcggcgtgcagtgcttccgcaaggcgttcctcattatcacggccgccacggtcgccggcgcgctcgtgtcgctggtgctggtgtggcggaccaggaacttctacaggggcgacatctacgccaagttcagggacagcgccgacgcggacgccgccgaggaaagggcggaggcggagatcgggtcaacggaggttaacgggaggaagcagtagggtagtatagtacagatatagagcccggctcgcactaatgtccatggcggccgccggccggggcccggcggttgcgttgactcggtctaggtcgaagcagccacacacccacaccgtcagtccgtcacacagtgctagctaacgcttcttctgactttggcatacgtgtcatcatctgtcatctcccaatcctagctgttcttgttctggagcccaaattggatggcaactggctgtggaaggcctcagcaggagcagtctaatgggtctctgaaagtagctgtcactgctaactgaaggcgattaggtgcacgtttactgtgtaatcctttatcataaaaaaactgttttttaaaaaaaaaaaaaaaatttgtgttttatactctatatttaaatataaatgaaaatcattacaatgtacaggtactttgttaataatattcaactaaggtgatgagaaaagtttcatagttatgacactctccggcgcttcactctcacccttcctctagccgccttctccagtctccacgtccctccactcgtccaacggtgccccctcacgagttcaagaccgagctcgcctacgcacccttcggacagaggagtttcaatctcctccttccgtgaattagtagttttaactacaaaaccaatctttttaaagttttaatatctgataaaaatgtatagtatgttactataaatattgcataattttttaaaacttcaaaaactaatgtataaaagtcactagtgacgtgttcgtacatctctatggtttttatttatgcttggatatagagtataacatactctatttgttttctatcttaagatcacgaaggtatgtcttaaatcaaatattttcaactttgaccgataataacaaagatatgtataaatattgactaaataaaaatgaaactattagatttattattaaaa

SEQ ID NO: 12417 - DNA, 801 bp, Zea mays
gatatcgattgggccatttcggcatttcctgttttcacgctttgctttcggtttcggggtcgtcgtgtcgaattgggggctgaggccgaattggatcgtcagaagctgggggtgagggagggatggaggcgactgtggaccacctgagcgcggcgtacgacgacttcatggcggcggcggcggctgtggtggaggcccgcgtacagtcgggcggcgagaagaagacggcggccacggacgccgcgctcgaggccttcaagcagcgctgggagatcttccgcgtcgcctgcgaccacgccgaagagctcgtcgagtccatccgccagcgcatcggctccgagtgcctcgtcgacgaggccacggggtccgcctccgccggatccgttgccgcccccggcatcaagcccatcagcgccgtccgcctcgagcagatgagcaaggccgtccgatggctcgtcatcgagctccagcacggcgcctctgctcaagggaccggcggcagtggcggtgccgctaccccaaatgccggcgctggagggcaacacccggaggagggtgcccagtagaaaaaaaagatttgactatgctacatgacagtatgctgataaactattggaagtaagcagaaatgtggagatgtcataatctgtttgtatcgatattataggatctgtagacaaagtacaatttcacaatttgatggctgcactcaagagaattggctgaggactatgaactactccctccatttctaattataagattttttggcttttctaaaaaataaaaaaaaaaaaaaaa

SEQ ID NO: 12418 - DNA, 2427 bp, Zea mays
ggaatggttccaggtaatcaaagcttacacaaattagataaacattcctggttcgattggttctaggtcatgattccggaacaaacgaacacacccttatctaaacttttgaagatgaaccaagtaagattttccccgctaggtctcttttctaattctatccatggctagctccatgacatactctggcaaacagaaacaaatactatggatgcaagcgattataagagcatcgctaaccaataaaccataacaaagataacaataaattctgcaaaattcaggtaaaaaaacaaattctgcaaaattcattttacaagcttaaacacattttgtggtttataaacatcattaagtgtttagcaaatttctaaataaaaacaagtttgttcgtttggctttaatccgtaccggtttctactaattttacaatgtttttgtctctatagattacagttgcaacaaacaaacaactttagtataaagccaacaacctcaacaaaactacttctatccagaagtaggaaacagaggtagtttgtctggtgtttgaagttcaagaaggaatacttgatcatggccatagtttagagcatttccaaaagctctctaaaacagttccctcattcattcttttgaaaaaataaaataaaaatatcattcacaagaatttgaactttttgaagataagtgcttgataaatctcttcctcaacttataaattgttcatgcgttctgcttttgccttttgctgtagtgtatgtgccccttttccacgggtttccttccctactacctggtttttgagtcttaggaagctaaccattgcaagttatcataaaaaactaaaatggcttcctattcattttgtatgcttggtataatcatttttatacgaagtaattctgtagattttggagatgcttgtagagcaaaaatgatttcccccaaacaaattcctcactcggtccaactacctcaccttccgtctcggcccaggcccaactacctcgcaccctcttgagccgaacaaacacctcggtagtctgcacggcccaatacctgccctcctcgggtccttccaacctccgcctctcccctccccaccccaccctactcgagcaatcgccgccgcatccacccacgggcccaccaaacgacctcgctgcgcccacccgtccgcccccatctagctcagcggtcccgcacaaccgaccactcggcagaatgccgccgcttcggcctccgccgccgcggctcctgctcaacaacgtctcgtgcatgcggaacgcgcagacggtgctccgcgacatcaacctcagcgtccacgacggcacagccctcgtcctgaccggtgcgaacggctccggcaagaccaccctcctccgcatgctggcgggcttttcgcgtccctcggcgggggagatcctctggaatggtcacgacatcacctccccgggcgttttccagcagtacaagctgcagctcaactggatgtcgctcaaggacgccgtcaaagagaagctcacggtgctcgagaacgtccagtggttcgagctcctcgaggggaaggacggcagcaggtcgggcccagccatcgagctcatgggcctcggcaggctcatgaacgagaaggccaggatgctctccatggggcagaggaagcggctgcagctcgccaggctgctcgctatcgaccgacccatctggctgctggacgagccctcagtcgcgctggacgcagagggtaccaggctgcttgaatacattatcgcagagcatcggaagaagggtggcatcgtgtttgtggccacacatctgcccattcagattgaggattctatgtcgcttcggcttccgcagaggtttccccggaggaagacgctggttgatcttgtccgctgatgtcaatgtgagattgtgagcacaggaatttagctgtatctctctaattcctctccagctatctgtctgattgctgttggagcaattactctggtgctgcatttgtcatcctatttttgacaacatggcaacacattgtcgatgttgataatctgtaggggtctttgtgatcaccgattcgatgcattggcccatgtatttggggacactagaaagcatttgccatggctgatatatgtatggctgttctttgtgatcatggttttgatgcattgacccacttatatatatggcacttgcttgcagaaactctgttagctgttcaatgtcttgcaggttttctcatgccttgcatatccatgtgaagcttcaagtgttggagactgggaaacttgaccaaatatggggagacctctggacaggatcagaattagatgtctgagtagagtgtctgttttctcacattattgtgcattgactaaggttgatttcttctctaacaatcttgttgtagtctgaata

SEQ ID NO: 12419 - DNA, 952 bp, Zea mays
ctgttgcgcgatggtggcacacaacaaaactcgatgggtccatcccgccgccacacgcccggtttccttcccttttcccgcagtccggatccagtccacggcccacgggttgctggctgcctggcttgcgggccccaccaccaccacagcgaccgcgggtgccgcgtgctcgctttcacgagcacgacgagctcggcttcggcgtgagccagcgtcgtacggctcatccgccccgtcctcggtcgctatttctctccatttcccttgccccctaccgtcgcggaggaagacaagacgcgcgcgcagaagcacacctgctcgggctggattaggaggacagcttcttcggccggcgacatggcggaggagaagggcgcgttgcagtcggcgagggagtgggtggtcgaccacaagctccgggccgtcgggacgctgtggctcagcggcatcgtcggctccatcgcctacaactggtccaggccgggcatgaagaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagctagtgtccttgcgaagtgcaagcagcggagtgggcgttatttcctgatcaaataattttgcctatggcacattctgtggaaactttgacggatctttgcctgcttttctatgtgatgtaagctgctgaaacctgcactcatcaaatgttgtgtatgcagatggtaccatgcatttgtttccctgaatggcttcaaatgaaatgaatgttttttttttaagaaaaaaaaaaaaaaaaaaaaaaaaaaaaaaaggccaaaaaaaaaaggcccctagggcc

SEQ ID NO: 12420 - DNA, 2753 bp, Zea mays
gttaccgctgcggcgttctgcgagctgtaaatatttgaggtcttcggtttacagtcgtgggtgtggacagccttatacgcaccaaacgtggctgtccttgctcatttgtgcacagtataataatttgacatgtgcatgctcacaagagatttataaaattaaactgagaactctcaaccttgtgcttccgacgaacgaaattgatgtatgcattcactggaagctaaagaatttctccgccgccgactgctggtccaggccgggcatgaagaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttccattcatctgatggcaatagcggccaacaaaaggagtagctagctagtgtccttgcgaagtgcaagcagcggagtgggcgttatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttccctgaatggcttcaaatgaaatgaatgtttttttttatcggtatgcatcaaaggaagtcaaaacgaaaaaagctgtttgtctaagtcgagttcagcagaatgttctctgtttacacaacatctgagtgcaggctttgatggccaaaaagtcacttcccactgacaacgacaacgagatctaatatccagtcacaggacatcggctggagaaaacctccaaagaacataggcgacaatactttaccataaaatagtgttggagatgccaaacaaaccttcaaaggacacagacttgtaataatttattatataacagtgtgttgaagatgccaggcattattgtagaacatactaaaagaagaggtcaaaattaaatcgccaggtcgaatgtcaaccccctgctccatgtgataatcacaccaaagagacaacagtgggcgaaaggggctcgagcccctaccgctcccgaccttatagggctctattagagcctctctaaaatttaaatatatttacatactattgttgattatataaggagacatatttatatgttacattttaattataaaagagcgagataaagagcgtgttataagttgcagagtaaaaatatagactagtgatgcataaaatcaatttttaccccttcatttatatctacactatgaaaggtggtggaatgtcttcaaaccaaataacctactctgtaaacggtcccttattgaatgttcatcgagaaggccatttacacatttaaatcaatccgttaaacgcagtcgaacccaaaaagaacgcatctaaaaagcccagccaaacacgagtgttccattcctcctactgggcccgacgtccaagttccaacaaaccggcccaccaacccgctgcgctcaaatggcaaaccacatatcctatataaatatcgccagctgcatcgtcgactggataccctagccgccacacctaacgacccacacgagcaccaagccgaggggaggggcgatggcgagaggtgtggtgtcagcgaagggcggcacggccgcgggcaagaagaaggggtcggtcgccttcacgatcgactgcaccaagcccgtggaggacaagatcatggagatcgcctcgctcgagaagttcctgcaggagcgcatcaaggtcgccggcggcaaggccggcaacctcggcgactccgtcaccatctcccgcgagaagaccaaggtcaccgtcacctgcgacgggcccttctccaagaggtataccacgctgaactgcttactgttactctctgcccctaaaggtcatgaatgtacttgtgcagatatgtgcagtttctggctttctgctgtgtgtgtgtaaatggtatttctgggtctgtgctatgtactagaaactgtgcatgatattgataggtcaatgatatgaatgtagaaactcggattggtccattttccagttcaattatgtggttcacttgattttcgtagtgacgattagtttcgcttattacacaattacgtgtagttttgtcaatgcaaaagtccaaaggtttagtgcattctatctttaaccttgtgtaattgcaaatggaatttgtagttctttttcaccttccaagaatccaacctatttcaagcttgattaagtttataggaatagcattgatatttatgttttcgaataggtgttttctatgaaaatgcatttcacaatgaatctaacagtacttgttcggtttcatagatgtgtgtgcgttttatagatttggtcaaacttgaaattgattatgaagtgagaattgcactattttgggacggagggatcagcagatatttgatatgattatatgacatcactatttagcaagaacgacattacggttagcaaatgtatggacttgaaatattttttctgtgtagtgtgtacccttaactaaagcatacacctgatgaaacaatcaaaagatacctgctgtttcttaccgtctaatataacatactgaatctgttcggtttagtctgatagtagtatccttatctgttgtcaccaggtatctgaagtacttgaccaagaagtacttgaagaagcacaaggtgcgagattggctccgtgtgattgcagccaac

SEQ ID NO: 12421 - DNA, 824 bp, Zea mays
ccacgggttgctggctgcctggcttccgggccccaccaccaccacagcgaccgcgggacgcgggtgccgcgtgctcgctttcacgagcacgacgagctcggcttcggcgtgagccagcgtcgtacggctcatccgccccgtcctcggtcgctatttctctgattctctccatttcccttgctccctaccgtcgcggaggaagacaagacgcgcgcgcagaagcacacctgctcgggctacattaggaggacagcttcttcggccggcgacatggcggagaagggcgcgttgcagtcggcgagggagtgggtggtcgaccacaagctccgggccgtcgggacgctgtggctcagcggcatcgtcggctccatcgcctacaactggtccaggccgggcatgaagaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagccagtgtccttgcgaagtgcaagcagcggagtgggcgttatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttccctgaatggcttcaaatgaaatgaatgtttttttttaaaaaaaaaaaaaaaaaactcgag

SEQ ID NO: 12422 - DNA, 2010 bp, Zea mays
  misc_feature (255)..(255): n is a, c, g, or t
ctagaacagtgcaaggcttgtagacatcctctcaggcagttggtcaatatatatttacattgttggcagtcctatgcaagggtgtaacatagctatacaaataaattgaccttctttttcaaacatttgcagtgtattgatcatagacctggatgcccaccaaggaaatggacacgaaaaagattttgctaatgatggtacatattttaattttctttggattttggttctttatatttgtcaatttgataccantttatcgctcacaggaagggtttacattttagacatgtacaatgctggaatttatccctttgtaagagtctacatcatcaccctcactccttagatatatgtagtatatgaagctatttttcttttgtgatctgttgctcttatatattgtcattatgaaatgcatattgatggagatattacttatgcggaactttcttatctcacttcttgaacaagttttattgttaaaccctaaatgtacaatcatctttttgaacaagctcttttgtgcagcatttagatgatgtaattgttcacagatcgaaattgaaaaacagcagtttttgtctcgaacgaagtaggagagatacgtgttatttcatatagaagagaaaaaaatagtacaaggagagatcaaaagacctctccaagagaaaaacagcagttccatccaactgttatactgcaatgaattccgacggtatcatgctatcagttttgtaacagtccacgttaatatgatgtagacaccaaaataaaggacgagttttgtatttatggtttcagtttcattggtaccagatatattcctgattcttgttctttgtaaacttacattggtttgtttcaggatttcactgctaagcaatacattgatcaaaaagttgaattagttgtaagttttatcttgcaaccttttagttatgcattctctccactgcacgtacttcatgtttttagttaaaattcttgttatgtgattgtgcattatagagtgggtcaaaaacagatgaatacttggagcaacttgacaaggctctcgaggtacatttacatacctgcagaattttctgtgacaataaatatttacactgggtactaggttaatgttttgaaatgtcatcttttgcatgatatttatccaaaaaaattcaaatcagtataatatggcaatgtattatttcaacttgtggtttcaagtgcatgtatcaatgattgaatatcctctttgtatatgtataaatccaaatgtgcatgaggtttgaaagggtaaaagtctggttctttctgcataggctgcatgactaaatcctcttaaattaccttatgaggaaatgggtaaatgctaattcattggtgctgcttatttgcttgttttaacaaacttttgatccacattttctcttggaacatattattgcagatctgcaatagtagatttgagccccagttgattgtttacaatgctggaacagacatcctcgatggcgatccgttgggcagattgaaggtaagtcctgagggtgtggttaccagagatgagaaggtatttaggttcgcaaaagatcggaacattcctttgctcatgctgacatcaggaggctacatgaagtcaagtgctcgagtaatagctgattcgatcatcaatctgtccaataaaaacttgataggattaggcagccagctgggttgagcaagaacttgtgacagtatgcttcttatcgggaagcaatatctcgtaagagcttattcgaatatgagtggattaaagaggattaaattccttgatggtcaaaattgaatagaaagatatttaatcctactcaatccacatgcaatcgaacaaggtttaaaggtgtcgttttttttttttgtgaaggataacatgtatgccacaaaaatgttctgtacataacacgggatgtttgtgaatctatacaacgtcaattgttcagtgcgaaaaaaaaaaaaaaaaaaaaaaaaaaaaaaaag

SEQ ID NO: 12423 - DNA, 1055 bp, Zea mays
  misc_feature (35)..(37): n is a, c, g, or t
acccggcaccgcaaccgctgttcctctgcgcggcnnnggccgccacagccgatcagccaccgcagattcctcgtccaccgcaaccattcggcttctcccaaatcccggcacgcggcacgggacctctccctctctctcccgctggcgggcgatggcctcctcctcctcttcctcacctgcgcccgccttggccggggaggcgctacgccagaaacgcatcctctccagcaagctctacctcgaggtcccgtcctccaaggcgccggtggtttactcgccggcatacgacatctccttcctcgggcttgagaagctgcacccgtttgaatccgccaaatggggccgcatctgtaggtacctcaccagggaagggtacctcgacaagaaacggatggtggagccattggaagcctgcaaggaggatttgctagtggtgcacacggaggcgtatttgaacagtctcaaatgcagcttcagagtttcctccattgtagaggtccctcctgtgtcgcttgtccctaattggattgtgcacagaaagctactacaccccttccggaagcaggtgggtgggtccattttatcagccaaacttgcatttgagagaggttgggctattaatgttggtggaggatttcaccattgttcggcagatgaagggggtggattttgtgcatacgctgacatctccctctgcatccattttgcttttgtccgtctaaatatctcaagtgtattgatcatagacctggatgcccaccaaggaaatggacacgaaaaagattttgctaatgatgcatttagatgatgtaattgttcacagatcgaaattgaaaaacagcagtttttttctcgaacgaagctggagagatacgtgtctttgcatatagaagagaaaaaatagtacaaggagagatcaaaagacctctccaagagaaaaacagcagttccatccaactgttatactgcaatgaattccgacggtctcatgctatcagttttgtaacagtccacattaatatgatgtagacaccaaaataaaggacgggttttgt

SEQ ID NO: 12424 - DNA, 1757 bp, Zea mays
ccggccggggtggaaagaacaacggacgaggcgacgtacgcgcgcgcggccggcgcgcacctcgccgtcccagccacctgccgttgtgcatgcgctctcaatctctgatctagtcatctgatctgtgcgggagtgtggccgccaccaccacgaccaccaccataactgctcatctatatataaaacacccccaccacaccgttctccccccctgtcctgccgccgtccgatcctgtggttgcgccgactctctggccgggctagtccattccttcatccgacgaatctaccctcgatcggatcctctggccggcggcatgggcgacgacgacgaccacaatgaggggctgagggcggggccgacggcgtcgtggcggctcaacgtcagcgacttccacatgccggagcggcccaaggagccgcccttcgtcgccagggtcttcctccgcagccacgggaagcagaggaagatcgcgaagtactacaagaaacaagagaatctactcaaggatttcagcgaaatggagaccatgaacgaaatgggtggcctagatcagaatgctcctaccgaggaagagcagaagcagttggcgaagagcgagaggtttgccatcaacctgtcgaatgcagtcaacctggtcctcttcgtaacaaaagtcgttgcttcagtcgaaagcgcgtccatggcggttatagcgtcgacgctggactctctgttggacttgctgtcagggttcatactttggttcactgcgtacaagatgaaaaagccgaacaagtacaactatccaattgggaagaggcgcatgcagccagtgggaataatagttttcgcatcagtgatgggcacacttggcttccaagtgctgatcgaatcagggcgccagctcataactcaggagcacgcggatttcaagttcaagcaagagctctggatggtcattagcatgtcctctgttgcggtcgtgaagttcttcctcatgctctactgccgaacgttcaagaatgagatcgtgagggcctacgcccaggaccatttcttcgatgtaatcacaaactctgtcggcctggtctcggcgctgctcgctgtccggtacaaatggtggatggaccctgttggcgccatactgatcgcgttgtacacgatcacgacgtgggcgcgaacagtgctggagaacgtaggcacactgataggcaagtcggcgccggcagagtacctgacgaagctcacgtacttgatctggaaccaccatgaggagatccagcacatcgacacggtgcgagcctacaccttcggcacgcactacttcgtcgaggtggacatcgttctctcgggcgacatgccgctgagtcaggcacatgacatcggcgagtcgctgcaggagaagctggagcagctgcccgaggtcgagcgcgccttcgtccatgtggacttcgagttcacgcaccggcccgagcacaaggccgaggtctgagtgcgtggttagtggttactgcagagttcagaccagctgtagcgctactgcagatttgacttcatatgctattagttcgtaagacgaatgctatattcatttcccacaactcttcaaaaagaatctagatatttttttgtcatgtacgtgcagactggaatacaattttgtatagtcgttcatgaaccggtgaaaaatatattttttaatacatttggctaataaagaattattcacacgacgcgcccgttattttctataaaacaaacataatagatattt

SEQ ID NO: 12425 - DNA, 3271 bp, Zea mays
gggcgagattttctatgatttttctaaaacacctaatccgtgagatatccataaaaggctacaaaacgacaaacttaagatcggtcaagctggagtcaaccggacctctattagctatttcattaaaaccctggccgagcataatccagtcaggcctccatcggctgggttccagtcggttaggtttcagtcagcatgacttcgatcggtcatattttagtcgaccaaatttcagcctgatgaatcacgacaaaccaaaacctttcaaaagcaagactgtgaagacctttgagttgattgatactcaaatcaatttaaagcactagggctacacccattgggtgcacctgatataacaacagatcaaagccacactcagaagcaagaccaagaagacctttgaactgattgatactcaaatcaactcaaagcttaggggctacacccattgggtgcacctcacctagtggatacaaagacgaaacaaagttgcactcaaaagcttaaaaaagtcaaacaagatgattttttctttgagtctcgagccaattactctcaaaagttggcttgactctcgggggtttgtggggaatggatatcccccgggtcttcacaaacacacaaaaatctcatgggtcgcttgatgggcctcgcgacatttgctaacaagaacaacaaagttgttggcttaatggatgcacgtcgcagatctatctgtttaatggtgatcggttgcgtcccaatactacacgagagataaagacatctgtttgggttttatattggtgaaaccaaaagatttagtactatttcggcgaagtctaacattgtggttgctatagccgcaaatttctcgtttttcgggtggctgacgatgaatttgcatcttttaggctcaggtctcctttggaacaaagaaacgtgaaggggttttgaaggattgaaatcctttaaaaaatcctatgttgtcctttggtacaatggattaaattcatacaaatcctataaaattcctatggaatagactattacagtgaaatttatgagaatttttaatatgagatccaatctcttaaaaaattactataaaattacaagtgtcacatagaactctaaggctcctttggaatggaggattagtaaaatatagggatgtgaaaaatataggaagagagttgcatgtcacctttaattccataggaaaatctatatgaagttagaccttatgttaaaaattctctaaaatgtcacaacaatacttaatttcaaagaaattttatacaatttgtagcaattcatttttttgttccaaaggaacacataggaaaacttttatggggtattaatattttacaattccattactttttctttgttgtaaagaaggcctaaagctttgggttccccggggccggccggccggccgtcaagggatttgtctctatcaccagcgcacggccgagaatacttcctcttcctccttcccacgatggccgccaccgccatggccgccgccgccgccgcctcgcgggccttcctgcgcccgcaccgttgcctcctcctcccacacacccatccgcttcgccgccgtctctccaccaacgctactgcttccgctcccgccgccaccgccgcgtcgcccggcgtcgtggacgtgctcatgaagcgaggactcgtcgaggccatcacctcggaggcgctcgccgcagcgcgtccaggggagctcaaggtttactgcggcttcgaccctaccgccgagagcctgcatctcggtaacctcctcggcctggtcgcgctctcctggttccgccgatgcggccacaccgccgtcgcgctcatcggtggcgccactggccgcgttggcgatccctcgggaaagagttccgagcgcccggagctcggcatagctgccgtcgagggcaactccgacgccattaagtccctcgtcgcccagattctcggccgcgtcccggagcctgcccaccgttcccactccggtcaaaaagagttgtctttggacaattcagcgaattcgtcacagacaatgggttcttttttgatcctcgacaactacgactggtggaaggacatcacgctgctggatttcctgagagaggtgggccgttttgcacgcgtgggtacaatgatcgccaaggagagcgtcaagaagcgtcttgcgtcggaagacgggatgagctacaccgagtttacctaccagctgctgcagggctacgacttcctttacatgttcaagaatatgggtgtcaatgtgcagatcgggggcagcgatcagtgggggaacatcacagcgggaactgagttgatcagaaaaatcttgcaggttgaaggggcgcatggactcacattcccacttctgctgaagagcgacggtaccaaatttggaaagacggaggatggggcaatctggctctcttcgaagatgctttctccttacaagttctatcagtacttctttgcggtgccagacatcgatgtcatcaggtttatgaagatcctgacgttcctgagcttggatgagattctggagctagaagactcgatgaagaagcctggctatgtgccaaacactgttcagaagaggcttgcagaagaggtgacgcgatttgttcatggcgaggagggattggaggaggcattgaaggcaaccgaggccttgagacctggtgctcagacacaattggatgcacaaacaattgaggggatagcagatgatgtgccttcatgctctttagcttatgatcaagtgttcaagtctccacttattgatttggctgtttccacaggtttgctcactagtaagtcagcagttaagcggcttattaagcaaggtggtctgtacttgaataacgtgaggattgatagtgaggataagctggttgaggaaggtgatatagttgatgggaaggtgctcttgttgtctgctggaaagaagaacaagatggttgtgaggatatcttgactactcttatttgttctttataacttattttagccattgaggagaaaagtaacggtgttgtgtcttcaaaactcaaatgagctgtctatgagcatacagattgttatattggagaggttgaacacacattttttttagctctactaattttgttcatgagaactttttgtgtgctatctattggctttgagaatgacagctgttttctcatatcatgttatagtatcaatccttttagggctagtttggaagcaagggaaggcaaacccagggaggaaaaacctctcatgt

SEQ ID NO: 12426 - DNA, 4235 bp, Zea mays
  misc_feature (2996)..(2996): n is a, c, g, or t
cgcgatcttcaattcttagattcacaatcttttttaaccatgtctttacttttttccttaccttatttagttggtcatttatactgcggtttcatgttagtatatatatttctacagtaatttttggcccttctcatgaaaaaattaaaaatgttgttttcgccttaaatcatctccaacaatacctcaaattggtgtctcaaattgaaatatgagactctacgcagaaaaaactactccaacagtgtcttatttcataaactttagtaaaaaatttatagagcaccacctcaaatatactacatcgtagtggactgtcctataatctagatttaaagatttactattggagcggaatgttttgttgataccctaaattctataaaatatacccatttttaaattatagggtatttttataggtcacattgttagagattctcttaagatcttcttcttggaccgtcaacaatgtattcttttaaaaactgtttttattactttcgtttgattttttacacaccgcttactaaggccctatttgtttcattccagattatacaatccaactttattggttatataagcacctattaacctatctaggtatctaaattacataattcatctaataatttatgttgtttgtttaccccttaatttatttgagttggattatataatctataggctaaacaaataggcttttagtttccatctattctgattatgttgggcgggagcaaactgacctcgcagtcagactgactgcaacacttatctctaaatttttccttttatatcatactatgcagctatgtcatctagattctatctcctacttctcttcttctcacatcagtttcctctaagttttccctctatatctcactccaaccataaaatattattttataaacccattcatcatttaatatcattttttttcttctaacaactactgcagagcatgggtgagcagtgagctgctgccgtaactccaaagctgacaagttttctgtgctgtccaccaagattgtagcatgtagatgagatgtagaggagctagtagcggctaccattacggcaataaagagcccgtaggaaaagcggagggggcagcgagcgggtgctgcataacctgcattcagtctcagggtaccattgcatcccactcggctccacctcgcggcccatatttgatatttcggctatggcaggtacagtatatactatatagatattgaaaacccaactttgtgatcctatgatcctattagtattcgttctacgttggaatttgaaaactggggcaaaaggtcattgcgctgtcgtcgtcgttcgcaagcagcaagcaggcagctccgggctccggccatggcatcagcaccaaggaatgtcggtaccaggactaccagcaacccggagatcccagagttcctggtgggcccggctggccggccggtgccggccgtggggctcggcacggcatcgttcccgttcgtggaggaaaacgtcagggccgccgtcctcgcggcactggagctcggataccgccacctcgataccgcttcgctctaccgctctgaacgtgccgtcggcgacgccgtggccgaggcagcgcggcgcgggatcgtggcgtccagggaggaggtgttcgtgacgaccaagatgtggtgctcgcagtgccacccggatctcgtgctaccttccctcaaggagagcttgcagtaagcgcttgttgagcttaacttttttgctgcttctttttatttgctttcaaataggatggtaacgctctgcggttcaaatttcggttcttgaaaggactagcaacaacaattagatctgaatcttagaaactaaatgcttcgatttcagtctgccagttttgcatttgcagtagctccaagtaccaaatacactaaaatcagtgtttttttgtggcaatcaaggttcttatctcttcatctgtaggaaccttcaaatggattatgttgatttgtacctggttcattggccgatagctgcaaagcccggcaagccacagttcccgtttaaaagggaggacatcatgcccatggacctaataggtgtatggcgggcaatggaggaatgccaccggcttggccttgctaggatgattggtgtcagcaatttcacaacaaagaagctccaagagctactggccattgctaaaatccccccgtcagtaaatcaggtctgtgcagatcatatgagttaggtggtggcaatggcagtaagccagtaacctcagttagttgtgggtctttcaggttcttgtagtccttttcttaatgattgataagcatgatatactctatataaggccccctttggacattttcacgtttcatgcgtttttgttgtaaaaaacaaactgattcgtataaaatttctatacaaattaccgtgaaatttctactgcgcaaaagaccacaaaaggaagaacaggatgttttactgtatttatttttatcgaacatgcagaatagctgtgtgcctttcttttcatcaaagaagaaagagtgtcacatggatattaatattccatatgaatatagaacattagaacttgaaggttttttaatatgtaaatagtcatcattgaacgaaaagtgggtgttttaggggataattgtttcaaattaaaaataactttgtatattgtatatcctcaagtatacctacaccatacactgacatgtgagataaccttggcttgagcaggttgaaatgaatccaatttggcagcagaaaaggttagctgagttctgcaaagacaaaggtattcatttgactgcctattctccgctagcaggccaaagcacgtctaaggtcaatccagtaatgcagtctgaggttctgcaagaggttgcaaaggctagaggaaagtcagtggctcaggtattaccaactgatccctcaatgtgtctaccttaaagtgtagcagttgttcaaaattctggccacanttcaatttttttaaggctttcaaaggtaataactaccggatttatattagcacctttagcttaatgtattgactaagtatgtgcagtttgtattcttcagaatggttttctaaactctttgtatgatgttaacactaatcagcataactacttttcgttctctcctagatttcgctgaggtggatctacgagcaaggcgctcgcgtggttgtcaagagtttcggaagggataggctcaaggagaacgtggaaatcttcgattgggaactgaccaatgaagacaggcgtaagattagtccgatacctcagcacaagagggtcacagtgttggggatcctcagcccagacggcgtctccagcgtggatcttgctgagcttgatattgttgaaatgtagcagaaatctccatctatcaggttgcaaggacaaaaaatggtgattggagtagctttcatacggctacgttgaatcagttgcttagatacggccatattgaatcaagaattagaagtagaggacgatctctctacttgtcgtccggacctcattttcttaaaatgtattttcaggcgtctgaccttgtcctgaaatgccatccaggccattactttttagaatgccatttttagatctgtttgatctagcttaaataagttactaggcaaacaaacaatacacattattagatagattatataatatagatacctatattataataatccataatcaacttattaaatgcttatataatttacatgctagattatatctatactacttattaagacagtaaaggtagtctgtcgttctgccgttctgccattttacgatctcaatcatccgttctaccattctgtaatctcagtcgtccgatcctacgtttgagtctcgctccccgatcccgcacaccggtcccgctcctagatcgcgccccgaaaccctctcgcctcgcctggaaaccgtcgcccccgacctcccctctcctcccccgattctggctgccgccccaggctcgcccgccccgaaatcctccaccgtgccgcgccgaaaacctcgcccaccaccaccacgccgcgcacgccccggtcttcgtcgccctaaccacgcccttccaacgatgatgtcgctaccgaagcgccgcgcatcctccttgcatcttcgtcgccgctgcgccacgccgaaatcctcccccaccgtgcccttccatcgacgaccatggcggactacccacgcgtc

SEQ ID NO: 12427 - DNA, 1957 bp, Zea mays
agccatccaatcctctccgattctgtggcttctaaactaggcttatggctttatcctgcaaagttggggtgtatacggacacaggatatttggtcgctggagacagacacacgacacgacacagacatgcgtcgaggtcacgaggtccagagcagtaggaaagtagttttctcgaggccacgaggtcccctgtacctgtagctgtagcatgggcggtacagcagcaccaatgcaagctgcaaggcgatcgaatgatactaccccaccggcgtcggacatgcaggtacggtagcgttctgtttttgtttataaataaaaaaaaactgctccacgctttgcacacggccgatccaggcagcagcagcagcatgttcccacaggcagatgcgcatccagcccacgagcctctcgccggccgggtggccatcgtgacaggaggcgccgggggcatcggctcggcggtggccgcgcacctggcgtccctgggcgcccgcgtcgtggtcggcttcatcggcgacccggcccccgcggaccagctcgtggcggccctcaacaactcctcgccggcaggcaacagcgacccgcgcgccgtggcggtggcagcggacgtgtcggacccggcgcaggtggcgcggctgttcgacgcggcggaggcggcgttcgggccggagctgcacgtgctggtggccgcggcgggggtgcaggacgcgacgtacccgcggatcgcggacacgtcgcccgagcagtgggacctcgcgttcggcgtgaacacgcgcggcacgttcctgtgctgccgggaggcggcgcggcggctggcgcgcggcggcgcgggccgcatcgtcaccctctcgtcctccaacgtggggtcgctgcggcccgggtacggcgcgtacgctgccagcaaggcggccgtggaggccatgacaaaggtgctggccaaggagctgggcgggacggggatcacggtcaacgccgtggcgccgggccccgtggccacgcccatgttctacgcgggcaagtcggaggagcgcgtggccgccgccgcgcgcgagtgccccatggggaggctcgccgagccggcggacgtggcgcccgtggtggggttcctgtgcaccgacgccgccggctggatcaacgggcaggtcatccgagtcaacggcggctacgtgtgagtgtactgtgatgagagggaggaggcatagctagctagcttagcttggagtgtcagcgtgtcaccaaccgacaattacacgtgctccttcccttaataataataataataataataataataataataataataataataataataataataataataataaggtctgagaaaaaaaaaacttgtacgtgcatttccatttgaccatttcattgtgtgattgagccaggtagagggaaaaaggacagatgagatccctcaaagtagagctcctgacagaatggtgactgcaccaaagggtacgatcaatacagtaaaatacatagccgaagctaaaagatgaccgagaattaataggagcttcccatcagcctaaacagttcacaatggtgtcctgaggcctaaaccagccagtctcattctaccgcataaaatataacataaatggtaatggttcactctctgagtaccggcggtaacaaatttgaataggtcagtattggatgactgttgtctactctgaagtgtcggttagaagattctggtcgccccctttgcttagatttgaaaccagcaatgatagtgagtaacctgttaactggagcctctagttctaaggagatggcggatctaagaaagatacatctaaaggcattacacttaaggacacataactgctaaggtttacagcttacaacaaagctttcagtttttgggcgcattgcattggtctaggatgcaataaaagaccacactggcacctttgtcatggaaatccagatttcg

SEQ ID NO: 12428 - DNA, 1936 bp, Zea mays
  misc_feature (16)..(16): n is a, c, g, or t
gcacgagaccattacntagaacatcctaatcgaaaactacttccaattcagcgagcgattcaccaccccaccaccaaaccgtctccgtcgcgcctcccgaatccccgtcgaatccgagctcccggaggcacccgaggcgcgggctccccaaccgcctcccgaccccgcgggcctgcgctgcgcaccgcgacgaaaacaaagaactactgatcgatataaaatggctgtaagcttcaaatactgggacgattgcttggatccagaggatatgagattgatgtggcaggatcctgttgtaagtaaagagtggaatgatgctggggaagagcaaggacagaaagttcacctgtcacgggaccctgatggtgaagcatatctcacacaaactgaaatgatggcagtggcggcaattaccgtccatagacatttcaaatcgcagctagacccgtatatgataggagcacttgctgaaattgcaagtggaaggagactctttgtagatacctatgatcgcaagactaaagaaaccaaggttggcatactgcaggtggcacctgaagttgctcaatggcttggaaggttacaagagttatgacattgaagataatactaatttgctgtactggcctcttgtgaatgtctattttggtgctgcttatgcaaaatggctcttctcttgtgatgacagacaaagaactgaagaatttgttgttagagcatataaaggcggcaaaaagaaggctgctcacaaatcaacttcccccatcttccagcgttatctttatgtgaaagagaacctgttgtctataagacaaccagaaatttgccatgacctcgctcctgaccaagaaaaactgtcaagcacagaatcacagttgatatattgggattccaaggtatcagaggctgatatggatgcaatgtggaaacatcctgatgtgtataaggagtggataaaatctggtgagagacgtggaaatgtacgattctcccatgatgcaaagaacaggccttacctttctcgcgttgaggtgaaggctgttgccgaaataatcatatcacgccatttgagcacaagaggagtaaaaccagaagctctcgcagcacttgcagaggtttgcagtatgcgctttgttcatggagtaagtacccggactggattgatgggaatagactaccctactgctgtatggctttccagggattgtggctacagggcatatacactgatctctgtggatgatctctacaatccttttgcatcaatgtactttggtgcatcgtacttggcatggttgtctcagtacgaaggaaggttagctgtatgactgaatcttctgaaaatctacattcggggaccagagaatgttagtcttcaggagactggaccgttttggaaccaattcctggagtcattaacacaatatcaagatccaaagaaggccaataataatagctgctgtatcttgtgaagttatctgatacctcttccaactttggttactgaagtttctgctgaggatcatttatgaatgctcatcgacattcttgccaaatttcaaatccccttccgaagggttcgggtactggcaaacaattttgcttgctggacaacacgaggtacaggataaaaggggctgtcagttcgtacatacattttggtcgctggcgccttgctcatgtttaaatcatgattgatcccatctcggttcatagagctgccccccagttccatatgtttcttcttctacttttaccatcagaatgttaacgcccttcccgttctttccgcttattggtgtatggcatactgtacctctgttgtataataataggacccttagaagaaaatggcctttgtaaaattatcgacgcttcatagtacatgtgctaccgttatacatgtaccaactgatactctcactagcagaaccgt

SEQ ID NO: 12429 - DNA, 1182 bp, Zea mays
ccggccggggacagtagtataggtcaggctgcatttgatcaagcacaggcatttaaacaaagtgtttctgttggtgctgtgattattacaaaaatggatggtcacgcaaaaggtggcggcgcccttagcgcggtcgcaccaacaaaaagtcctgttatattcattggaactggagagcacattgatgattttgaagtttttgatgtgaagccatttgttagtcgcctgttaggtatgggagattggtcaggctttatggacaagattcatgaagtgatacctacagatcaacagcctgaccttctgcagaaactgtctgaaggaagctttagtctcaggcttatgtatgagcagttccagaaccttcttaaaatgggtcctattggccaggtcttctctatgttgccagggtttagcgctgaactaatgccaaaaggacatgagaaggaaagccaggctaagattaagcgctacatgacaatgatggattccatgactgatgcagagcttgacagcacaaatcctaagttgatgactgaatcacggatcattcggattgcacgggggtctgggcggcctgtcagggatgtcatggacatgctggaagagtacaagcgacttgctaaaatctggggcaagatgaagggtctcaagctccaaaagaaaggggacatgagtgcactgacccgcaacatgaatgttcagcagatgagcaaggcccttcctccgcagatgcttaaacagattggtggcatgggcggtctgcagtctctgatgaaacagatgggatcgaaggagatgagcggaatgtttggaggcatgggtggttgacttgtttttggtggatcgtcgctgtgatgctaaattgagagcgtttaatgctgcggtctgatcaccatcagagcattccctgaagatcagcctgcgctatgttttggatcaggcttagcgtagctccccatgcctgcaaatttaacctatatgaacagtacgtttgtcctcttaaaaaacggtaaggtatatattacaaagcgaatatgcttatgtagatggttactccacacattagtcttccagtggtggtgtcgttgggttggcaaaggatgccccatggaacgggcggcccaaaaaaaaaaaaaaaaaaaaaaaaaaaaaaaaaactcgagggggggcccggtaccc

SEQ ID NO: 12430 - DNA, 2019 bp, Zea mays
cccgccggcctttttctcacccttcaccttgattcatccatcattcacgccagtacgccacgcctccgcgttccacgttccttctcggctctacgtcaccgtaacctcctccacccatccggccatcccccttctcacgcggctcgctcagggctcgagcgtctccccatcggaaccctaatcctctctttccctactcgcggaagccaactccaccggcaggggaagcggaagggaagcacctcggccccggcaagatggtgctcgcacagctgggcgggagcatctcccgcgccctggcgcagatgagcaacgccacggtgatcgatgagaaggtgctcaacgagtgcctcaacgagatctcgcgcgcgctcctacaggccgatgtccagttcaagatggtccgcgacatgcaggctaacatcaagcgcatcgtcaacctcgaggcgcttgccgcaggcaccaacaagcgccgcatcatgcagcaggctgtcttcacggaactctgcaccatgttagatcccgggaagccttctttcactcccaaaaagggcaagccaagcgtagtcatgttcgttggtctgcaaggttctggtaaaactactacttgtacaaaatatgcttattatcatcagaagaaaggattcaaaccagcactggtttgtgctgatacatttagggctggtgcttttgatcagttaaagcaaaatgcaacgaaggccaagattcccttttatggaagctacatggaatctgatccagtgaaaattgctgttgagggtgtggagaggttcaagaaagaaaactgtgatctcatcattgtggacacaagtggaaggcacaaacaagaagcagcactctttgaagaaatgcggcaagtttcggaagcaacaaaaccagacctggtgatttttgtgatggacagtagtattggtcaggctgcatttgatcaagcacaggcatttaaacaaagtgtttctgttggtgctgtgattattacaaaaatggatggtcacgcaaaaggcggtggtgcccttagcgcggtcgcagcaacaaaaagtcctgttatattcattggaactggcgagcacattgacgagtttgaagtttttgatgtgaagccatttgttagtcgcctgttaggaatgggagattgggcaggctttatggacaagattcatgaagtcgtacctacggatcaacaacctgagcttctgcagaaactgtctgaaggaagctttactctcaggcttatgtatgagcagttccaaaacattctgaaaatgggtcctattggacaggtcttctctatgttgcctgggtttagcgccgaactaatgccaaaaggacatgagaaggaaagccaggctaagattaagcgctacatgacaatgatggattccatgactgatgcagagcttgacagcacaaatcctaagctgatgactgaatcacggatcattcggattgcacgggggtctggtcgtcctgtcagggatgtcatcgacatgctggaagagtataagcggcttgctaaaatctggggcaagatgaagggtctcaagatcccaaagaaaggggagatgagtgcactgtcccgcaacatgaatgttcagcacatgagcaaggtccttcctccgcagatgcttaaacagattggtggcatgggcggtctgcagtctctgatgaaacagatgggatcgaaggagatgagcggaatgtttggaggcatgggtggcgagcggtaattttacgtcctgtttttggtggatcgtcgctgtgaacttgtgatgctaaattgagagggtttagtgctgcggtctgatcatcgtcagaggtttccatgaagatcagcctgcgccatgttatggaacaggcttactgtagctccccatgcctgaaaatttaatttatatgattatgaacagtacatttgtcctcgaaaaaatgtataagatataatatttgacaaatggaatatgcttatgtagtcttccagactaaaaaaaaaactcaaaa

SEQ ID NO: 12431 - DNA, 2032 bp, Zea mays
  misc_feature (2001)..(2001): n is a, c, g, or t
tcgaggccggccgccgcctcgccctctctcagttctcacctcaacgtcaccgcaactccgcaagtccgcaacctcctccttcccaccccttctcacgcgattcaagcgtttcccattcggagccctaatcctctctttccatactcgcggaagccaccaccaccggcaggggaagcggaaggggagcacctcgggccaggcaagatggtgcttgcgcagctgggcgggagcatctcccgcgccctggcgcagatgagcaacgccacggtgatcgatgagaaggtgctcaacgactgcctcaacgagatctcgcgcgctctcctacaggccgatgtccagttcaagatggtccgcgacatgcaggccaacatcaagcgcatcgtcaacctcgaggcgcttgccgcaggcaccaacaagcgccgtatcatgcagcaggctgtcttcacggaactctgcaacatgttagatcccgggaagccttctttcactcccaaaaagggcaagccaagcgtagtcatgtttgttggtctgcaaggttcgggtaaaactaccacttgttcaaaatatgcttattatcatcagaagaaaggattcaaaccagcgctggtttgtgccgatacatttagagctggtgcttttgatcagttaaagcaaaatgcaacgaaggccaagattcccttttacggaagttacatggaatctgatccagtgaaaattgctgttgagggtgtggagaggttcaagaaagaaaactgtgatctcatcattgtggatacaagtggaaggcacaaacaagaagcagcactctttgaagaaatgcggcaagtttcggaagcaacaaaaccagacttggtgatttttgtgatggacagtagtataggtcaggctgcatttgatcaagcacaggcatttaaacaaagtgtttctgttggtgctgtgattattacaaaaatggatggtcacgcaaaaggtggcggcgcccttagcgcggtcgcagcaacaaaaagtcctgttatattcattggaactggagagcacattgatgattttgaagtttttgatgtgaagccatttgttagtcgcctgttaggtatgggagattggtcaggctttatggacaagattcatgaagtgatacctacagatcaacagcctgaccttctgcagaaactgtctgaaggaagctttagtctcaggcttatgtatgagcagttccagaaccttcttaaaatgggtcctattggccaggtcttctctatgttgccagggtttagcgccgaactaatgccaaaaggacatgagaaggaaagccaggctaagattaagcgctacatgacaatgatggattccatgactgatgcagagctggaccgcacaaatcctaagttgatgactgaatcacggatcattcggatttgcacgggggtctgggcggcctgggcagggatgtcatgcacatgctggaagagtacaagcgccttgctaaaatctggggcacagatgaagggtctcaagctccaaaagaaaggggacatgagtgcactgacccgcaacatgaatgttcagcagatgagcaagccccctcctccgcagatgattaaacagattggtggcatggccggtctgcagtctctgatgaaacagatgggatcgaaggagatcaccggaatgtttggaggcatgggtggttgacttgtttttggtggatcgtcgctgtgatgctaaattgagagcgtttaatgctgcggtctgatccccatcagagcattccctgaagctcagcctgcgctatgttttggatcaggcttagggtagccccccccccccgcaaatttaacctatatgaacagtaggtttgtcctccttaaaacacggtaaggtatatattacaaagcgaatatgcttatgtagatggttaccccccaaaaaaaaaaaaaaaaaaaaataaaaaaaaaataaataacaccccccaaccccagcggcgggcggtgtagaggcatnccaagcctagcgtcacggcgtgcatgcgacg

SEQ ID NO: 12432 - DNA, 751 bp, Zea mays
gacccttcaccttgattcatcattcacgccagtacgccacgcctccgcgttccacgtttcttctcggctctacgtcaccgtaacctcctccacccatcccccttctcacgcggctcgctcagggctcgagcgtctccccatcggaaccctaatcctctctttccctactcgcggaagccaactccaccggcaggggaagcggaagggaagcacctcggccccggcaagatggtgctcgcacagctgggcgggagcatctcccgcgccctggcgcagatgagcaacgccacggtgatcgatgagaaggtgctcaacgagtgcctcaacgagatctcgcgtgcgctcctacaggccgatgtccagttcaagatggtccgcgacatgcaggctaacatcaagcgcatcgtcaacctcgaggcgcttgccgcaggcaccaacaagcgccgcatcatgcagcaggctgtcttcacggaactctgcaccatgttagatcccgggaagccttctttcactcccaaaaagggcaagccaagcgtagtcatgttcgttggtctgcaaggttctggtaaaactactacttgtacaaaatatgcttattatcatcagaagaaaggattcaaaccagcactggtttgtgctgatacatttagggctggtgcttttgatcagttaaagcataatgcaacgaacgccaagattcccttttatgggagctacatggaatctgatccagtgaaaattgctgttgagg

SEQ ID NO: 12433 - DNA, 1224 bp, Zea mays
atgtgatttgaagaatgattatttatttctatagatgctactagaattatttcaaaatgattggttttatcagttttgggtaaatctggtaaaactcgaccccgaatccgaattattggatatccaaaatttcggataatattttgtcgaaacagaattaggttaggaatttttaatacccggttttttatttatccaaattacgcgacccgattatttcagctaaccagaatgggaggcctctccggttgcctcggtctttctcagttctcacctcaacgtcaccgcaactccgcaagtccgcaacctcctccttcccaccccttctcacgcgattcaagcgtttcccattcggagccctaatcctctctttccatactcgcggaagccaccaccaccggcaggggaagcggaaggggagcacctcgggccaggcaagatggtgctcgcgcagctgggcgggagcatctcccgcgccctggcgcagatgagcaacgccacggtgatcgatgagaaggtgctcaacgactgcctcaacgagatctcgcgcgctctcctacaggccgatgtccagttcaagatggtccgcgacatgcaggccaacatcaagcgcatcgtcaacctcgaggcgcttgccgcaggcaccaacaagcgccgtatcatgcagcaggctgtcttcacggaactctgcaacatgttagatcccgggaagccttctttcactcccaaaaagggcaagccaagcgtagtcatgtttgttggtctgcaaggttcgggtaaaactaccacttgttcaaaatatgcttattatcatcagaagaaaggattcaaaccagcgctggtttgtgccgatacatttagagctggtgcttttgatcagttaaagcaaaatgcaacgaaggcctagattccctgtttacgttggtctgcaaggtcagtcttcctgtcgctacatatgtctcatgctattgtagctgcacatttgctcgagtgacgtttggcagatggttttatttgttcaaaaagaccatcaattattagaatttgatttattacgatctagcctaattagattgttttggactttgtctgttctttttttttacaataaacgggccactgccctgcccttgatataatttaaatgagaccgttttattcattttactgcttataatgatgtccagagtgagatttgttaccaccagtaatccaactcataaa

SEQ ID NO: 12434 - DNA, 1945 bp, Zea mays
ggttcatccacacggcccaaacccgattgcttccatccatgcagaacttgggaagccattgttccatgcgactatgcctttggcggtttggcctctgcctcagctggtcagtccagcccctctcggtcccctgagcagagaggccgatggcgtggagcccggccagcggccaggccggcagtaataaaaggaaacgaaaagcacgcgcaggttttgcatcagcgcacgcccgttgccgcgtgatttgcacggacaagcaccaaataggtgcatgcgcaacaagcctacgagacgggcacagatatttatcatgtgaggcgcgaacttttgcaaggcccaccataaagtgacccggaaccgaccctccgctccaaccgccgccgagcggcgctgcgcctgagtctgagctccccgagatcttgcctccccgctataaaatctccatctccggacgcttgcgcagggggaggggagctttccacttcacggctgatgagtgatgaccctaccagaaatcgacccgatacggctcctgcgccagatcgtccatcaatagcccgaatcacactcatcacaagcctcaaacttttccaaaccaatttagatgcggcgtgagtgctaaagcgctctctggactctgtttcgcagtggccgcagctgcagcgtcctcttccctttttgccatccagcatcacctgtgccgccggcgcgtaattgcaccgcggtcactggttagtaggaagaagggaaggaggaggggggagcggtgtgccggggtatcgtcgtgcccatgggcgtgcacgccaggtcgatgagctggtacatggggtcgccggcgccggggagcgccgccgagggcgaggggcagcgcgcgctgagaagcagctccggtggcagcgacggcagcttcgacaccaacatggtcatcatcctcgccgcgctgctgttcgcgctcctcttcgcgatgggcctcaactcgctcgcgcgctgcctcatccgctgggcacgccgcgcgccggccggggaggacggcggcgccggcgggctaaagaagcgcgcgctccggagcatccccgtcgaggtgtacggcgcgtgcggcgccgacggggcggcggctgtcgccgccgacgtctgcgccatctgcctcggcgagttcgcggacggcgagaaggtgcgcgtgctgccgcgctgcgcccacggcttccacgtccgctgcgtcgacacctggctcctgtcgcacgactcctgccccacgtgccggggctccgtgctcgacggcgcaaaggccgccgcctctgctcccgccgccgggggcaaccggcggcagggaagcgaggctgctgccatcgcaattgtcattggatgacgtggacgtgtgggggcccgcgtgcccactggtggtggagccacacggtatgcgagactagcttcgttccgtggtagtgagatattttgctgtgatgagaagccgacgagtcgcggcggcccatctctcagtcaagacacagcatggccttcaggatattatcccttcggtctgtacttgtgcatggtcgtcgcagctgatcctgtttgtgtatactaggagtggatgatgaggtatgccgctataggcttgcaataatacagttttgtttgtacatgttcgatttgacacaattttagagcactgagcagagcacaaaaaaaaaaaaaaaataagatgtacggtggacgtctattttgcactgacaaatttagaattattctaccattttaagttttgctactctaccatcgttttgagaggcttcacctaaatgaacataacgcccaccctacaatatcatttggtcatttacaagttgtttggtttgaggaatgatctagtccatcgtcttctcactcctcacttttttgtttggtttgtggaatggattgagttgatcaatatcacctcattcct

SEQ ID NO: 12435 - DNA, 2092 bp, Zea mays
  misc_feature (1405)..(1405): n is a, c, g, or t
atacgttgttacacataaattagcagattatcattcttactattatcaaaaaataattaatattatgaaaaatttaaggtgcgaacataatattttaattttaaggtgagactcacatatggaccaagctgcaccgttacacacaaattagctattatcattcttactcgtttaaaaaaaaaatcaaatagttttgtaaaaaaaattaaagtccaaacacaatagtgaatccactctagtaaacatgaatcttccatgggtttaggtaatgggtttaacccaccagttatgacgggttgggattgtttatttagttaaattattgagatgggtggggtgaagaagactactcatttgctgggttgggatgggtttcaacctattagcagtgctggatcatgatcttgatcaaagggtcaaaaggaatcgagtgtcgaagagaaaaaaaaatgtttagagtatggcgtgaaaattgcagacaagtaattcaggaatatttgtagttttacagaaagccacgccgcttgccatcatcgtctttttgaaccacatgttgctgtcctatccaacttccaaaggagtggtgacttccaaaagagctcgaggaggcacctcgatcagctcagaaactggatgagaccatccgatcctgattccatggtcatccacacgcaccccaaatgttcgcttgcaggacatggaatccatttgctatgtaggctgttgtggctccgcctcatcaggacagctgagctgaggccgacggcgtggagcgcggctgggccgccagccccatcaaaagcaaacgaaaagcacgcgctggttttgtttgcataatcgcacgcgcgtggccgcctgatttgcattgcacgcccagcacggacaagacaaagccgaacaagcatcaagtgcatgcgaaacaaacaagcgtgcgacacgcacacagatatttctcaagcgaggcgcgaacttttggaaggccagggcccagcgtaaagtgacccggaaccgaccctccgctccaaccgccgccgaggagcagcgctgcgtctcaagagctccccggcgagatcgtccatcaccatcaaaaaggccgcaccacactgatcacaagcatcaaacttcctaaagcgctctggtcgcagcctcgcagtggccgcagctgcagcgtcccctcccctttcgccatcgagcatcacctgtgctgaccgccggcgcgtaactgcaccagggtcactgcttacgaggaagaggaggcgcaacgcaacagtgttgttgggttgtctcgtcgtgcggtgccggtgcccatgggcgtgcacgccagggcgatgagctggtacacgagcccgccggggtcgccggcgccggggagcgccgccgaggcgcagcacgcgctgagcagcangcccccggggcggcgacaccagcttcgacaccaacatggtcgtcgtccttgccgcgctgctgttcgcgctcctcttcgcgctgggcatcaactcgctcgcgcgctgcctcatccgctgggcgcgccgcgcgccggcagcggagggcggcggcggcggcgggctcgagaagcgcgtgctccggagcatgcccgtcgaggtgtacggcgccgcggccgtcaccgtcgccgacgtctgcgccatctgcctcggcgagttcgcggacggcgagaaggtgcgcgtgctgccgcgctgcgcccacggcttccatgtccgctgcgtcgacacctggctcctgtcgcacgactcctgccccacgtgccggggctccgtgctcgacggcgcaaaggccgccactcccgccggtgggggcagccggtggcagggcagcgaggctgctgccatcgccgttgtcattggatgacgtggacaggaagggcccgcgtgcccattggtggtggtggtggagccacacggcaggtatgccagagcttcgttccgtggtcgggagatattttgctgtgagagaccgaccagtgggcccagaccctttgtagcttcctaggtcgcaggcaagtcaaggttgcagcagcatcccttcggcctttcggcctggtacttgtgcttggcttgctcgtcttacgtcgcag

SEQ ID NO: 12436 - DNA, 1006 bp, Zea mays
atcgtagccctcgactaaactaaactaaaccaaaaccaagccagtgagcgccctttttcttccgttgctccatgtccatggcttcccgtccgcctcttcgtcgtcgacgtcgtcttcccctcgtcccgctcctcgttctgctctgcctctccccggcatgcgccgccgggagagtcccggtttcggtctactacgaagcgctgtgcccgttctgctccgcgtttgtcgtgaacgacctctccagggtcttccgcgacgggatctcctccatcgctgagctgcggctcgtccctttcggcaatgggcgtgtctcggccgacggaaccgtcacttgccagcatggagaggacgagtgccaactcaacgctatagaagcttgcgtgatcagaatatggcctgacgcggagcagcattttcctttcattcaatgcgttgagcatttagcactgactcggaaatgggacgcctggcagtcttgctttcatgaaactggtctcgcttatcaacctgctattgactgctacatctcagggtatggaaggcagctcgtactccagtatgctgccgagacaaatgctctgcagcctcctcatcggtttgtaccttgggtggtcgtcaacggcaaaccgctcggtgatgattacatgaactttgaggcatacatctgcagcgcttatgacggcaatcttccaaaggcatgcaaggggaagcacctagcaattgctcaggagacgaaagccagccgaggagacaaggtgtgcccagctagcaaaactatcagctaactcgcgtgcgaaaatttattttttttggaatttggataaaactgagtactactttgagtttggttctaagaggttctgcgtttctgctgtcttgttgggtctccgtctattttgaagttagttgaaataacagtgctgtcaaacctttgacagaaaaacatcaaatgcaaacatttcatgttgatattcactagcattttcaggcaaaaaaaaaaaaaaaa

SEQ ID NO: 12437 - DNA, 922 bp, Zea mays
cattggggcctcccgcccgccaaacgtccagattgggaattccatcacgcctcgtcctctccgtcccgaccagaatcatcgcttcttcctgctccggcgatatccgccgccgcctgcggtccggcagagatgggaagcacttcctctatgctcacccaatacgatatcgaggaggtccaggaccattgtaaccacgcattctcgcagcaggagatcgtatcgctgtaccaccgcttctgccagctcgaccgtaacggtggtggcttcgtctccgctgacgagttcatgtcggtccctgagttcgccgtaaatcccctctcccagaggctcctgaggatgctggatgggctcaacttcaaggagtttgtagcatttttgtcagcttttagcccccgcacaagcctgcagcaaaagattgaatttattttcagggtttatgatactgactgcaacgggaaggttgcttttgatgacatcttgagcatcttgcgagatctgacaggttcatttatgacagagcaacagagacagaaagtcttgattcatgtgttagaagaagctggatacacaaaagattcacattttacactcccagactttatgaagattattggcaattctgagctcaagatggaggttgaagttcctattgactaaaaacctaacaagcatcatctagttgcttcaggcctgtatcttcatttgtgttaaattaagtagatggtatatttatatccttgcaactcaaatcatgatcagagatgtaattaaggaaacatatgtacctgctatttggaggtttagttggctcgcacttatactcaacgcttgttatacgccgtgatatcttccagatacccttacggatgtaaggttcactacaaatgtgctcaaaaaaaattaaatgatcaaggcattactg

SEQ ID NO: 12438 - DNA, 872 bp, Zea mays
aatggttccatttcttatgtcacgtccaaattggaaattccatcacgcctcgccctcgccctcgccctcgccgtccccgaccagaatcgtcacttcgtccggctccggcgatctcctccaccgccgttgtcagcggtccggccgagatggggagcacttcctctatgctcacccaatacgatatcgaggaggtccaggaccattgtaaccacgcattctcgcagcaggagatcgtgtcgctgtaccaccgcttctgccagctcgaccgcaacggaggtggcttcgtctccgctgacgagttcatgtcggtacctgagttcgccgtaaatcccctctcccagaggctcctgaggatgctggatggtctcaacttcaaggagtttgtagcatttttgtcggcttttagcccccgcacaagcctacaggaaaagattgaatttattttcagggtttatgatactgactgcaacgggaaggttgcttttgatgacatcttaagcatcttgcgagatctgacaggttcatttatgacagagcaacagagacagaaagtcttgactcatgtgttagaagaagctgggtacacaaaaaattcacatttcacactcccagactttatgaagattattggcaattctgagctcaagatggaggttgaagttcctattgactaaaaaccaaataagtatcatctagttgtatcgtgatgtgttgccgagagccccagacctgtatgttcatttgtgttgaattaagtctatggtgtatttatatccttgtaaatcaaatcatgatcatagatgtaattaaggaaacaaatgtacctgttatttggaggattagttgacttgcgctgaaaaaaaaaaaaaaaa

SEQ ID NO: 12439 - DNA, 983 bp, Zea mays
ttttttttttttttttaacctgaaaccattctccagaacatcacagctcgagccgatgaaagctaaacacactgagttgtgcagtcacaaactatcaactccctaatccttgcctcccctatgaactgatatctattctccaataacatattatccacatagatctcaaactagaaaccatttggtgagagcatcttcagtcatcatcttgaccagactgatcatcagggtcaccactcagaaatgagccaatggacttgcgaaggatgtggattgatttatcatcctgcttcatcttcttcagagattcttcagcatttgctatcttctctgaaaatgttttctcaagttcagatagagtagccttctccttcttcctttgcagttcatactgcacaagcaatttctctttatcatcttcaaactttgagaacaggtctttgaaattctgtatgtgtgcaactttatctttgcagaacttgtcatgtgttgctagaaatttggtgtactcattcttcaacaaactttcgcactcttttgaagtctttgacaatgctttcagaaaactctgcctttctttctcaagcctattcttggtgtcctgtaccatagtctgaatctctgttgccacgctggaaatggcctgctcggtcttcttctggccgtccttgtgggccttgtccttgatgtgcttcagcagcgtgacgatctccttcatgtcactgtcgaactcgtggtcggagtcgtccatgccgccgcgctcccgccgcctcttgtcggaaacgaccgcctcggcggggtccttcgccgccgcagcccgcttgccgccgctcgccttggccttggccttcgccgacgacgacatcgcctctggtgcccgggcccgagagagaccgccttgccgcctctggggatgctgcggtcgtgccccgtgctttggtttcgcgggtttttgaaatggacggcgaaggccgacaagggga

SEQ ID NO: 12440 - DNA, 3525 bp, Zea mays
ttgggtacctcgaggccggccggggatcctagtcaccagatcaaacctgaatggctccagatcgaccctcgagcctgtcgccccgtccccggcccccatcgggtcccgagggccggccgggagtgttgaggccaaggccaccgacccacctctctcatagcactagcagcaatggaggtggagatcctcgagtcctgcatggtgaaacccagcgacgacatagggacgccgccgccgcccatgcacgtggtctggctctccaacctcgatctactcgtggccaggagccacacgcccaccgtatacgtgtaccggcccagccctgacccggacttcttctcgccgggcgtcctcagtgctgccctgtccaaggcgctcgtccgcttctaccccctcgccggccggctcgcgcaggacggcgccggccgcccgcagatccactgcaccggagaaggcgcgctcctcgtcaccgcgcgcgccgacgctaccctccaggacatccccggcgggttcgccccgtcggatgagctgcggcagatgcttgtcccctcggctgccgacggcgaagaccgcgccggcatcttggccatgttccaggtgacgtccttcaagtgcggcggggtgtgcgtgggcgcggcgatccaccacacggcggcggacggcctagcggcgctcgacttcgtcaacacgtgggccgccatcgcgagcaagggcgtcgacgaggccgcgccggcgccgcgcccgtggctggaccgcacgctgctccgcgcgcgctcccctcccgacgtgcgcttcgaccacagcgagtactccccgcggggcggcggcggtccaaagacggcgagggtcccgttcgactccgccatcctacccatgtccaagacccaggtggacgcgctcagggccggcaagaaggtgtccacgttcaaggccgtggtcgcccacgtgtggcggtgcgcgtgcatagcgcgcgggctcgcgggagacgaggacacccgtctgtacatgaccgccgacgcgcgctcccgcgtccgcccgccgctcccggaaggctacctcggcaacgccatcttccgcgcgtcagcggtggccacggcgggcgacgtcgtctccgagcagctcgacgccgttgcgggtagggtgtccggcgccaccgcccggctggacgacgagtacgtccgatcgctggtggactacctggagcaggtggtgggcgatgtggcggggctccgcaagggggagtgggtgatgccggagaccgacctgtgggtgataagctggcaggggctgcccatctacgacgccgacttcggctggggacggccggcgttcatgggccgcgcgtgcctccagttcagcggcctcgtgtacctcgtcccgggcccggacggcgacggccgcctcgacgtcgtcgtggccatggagcccaagagcctggccagattcaaggagctgttgtacgagctcaaaggtgcaggtgttccgtgcacggcagactgagctgctgcattccgtgcaggttccttggcttgctaccggctggcaaaacgaaaacctgtttgccggattgttccttgcattgcgtatctacttcgacctttactgcagtactcctagttttctactcgttgcttgtgatcgcaatctggtgagtactgtactctatatgcatttacatggctatctatattcggcgcagctaaataaaaaaaaaatcctgtaactcggcaccggccgttacttttttcttttccaaaagggaagtgatttcttactattaaccgcgggagcaaagagatcaccgtattgctccacgtcatcagaaaaaaaattcaccgtccgatcacagctcagcggctatgcctctgcgcgtggagctgccgtcgctctctcttctagacgcttcgcgttagggataaaagcaaaaggaagaacagaaaaagaaaataatcaggaaggggagcggcggccaccagagcccggagttcggagttcacgatatgacgctctggtacggtgcttcttcgtcgcttggaagaagacgacacgaagaagaaaaaaaaggtaattttcccctgacagcacagtcgtccgagtctcgcgtctaggctgcttctccgtggcacggtttagcctcgtccttgcctctccactttggtcgtctttgtcattgtctcctaccccgttgtccagcgttcctacagccgcattgctgtcgaatgcgcgatcgcttcgaccgacgcatgcgctcgcgcggaggcgccgcaacgcaccctatgctgttgcgcttctctccttccctcgccaggacagcacttcggataaaatgccatcagtaactgattcgctaggctttcgggggagcaacggcgagctcccaagctatccacgtcaggtttttttcacgattggtgtttaacggacaggaggtttccctttcttcgactacacaacaccgaagcgttccagattttttcacgattggtgtttaacggacgggaggtttccctttcttcgactacacaacaccgaagcgttccagaaactcatttgagatccctaggcagcaacgccttcagatgtcctagcggccttgacatcgttccgagtgctgggcgccatgcaggtgtttgacaaaatgtccatgtcgtctatcatggtcatgtcatgcccccgttcgaagatcgtgctcacctactgcagctaatcgtataaagcgactttagctttcgtttgggaacaatttgttttttaggttctcagtgtcaaatggtaggatgttggcgggctagaggatgtgaaaaggattcttctagatactattctggtaaattggacttggttttgcagtaaatatcagcaacaccaatacgacgcgcaattataggtaaaacaagtgttttccctacaatagttttgggcttttgtgggatgaccttttcttttgcttgatatttcagctccctttgacgtataatcgcatgatttcttctaaattgcgcaagcgattaggtgtctgggtatatggacctccgggaacagggaaggtaggtttgaaaaagtttcacacgaattaaattaggtgtctgactagatttaggaaagtctcttagatggtttatataaattgaggtggttataaatatacgagtttacagtttatagatattagattattaatttcttaaaaaccaaaaaactattcttttctaactaaaagataaaaactggtttaaaaaaaactatattgcttcgcttccgtgcgtaagttccacgggacacatacgtttttatgaaacgaatgatcctagcctctatagcatacacacagttaacccttacgaagcttttttttaggataattgttgattatcaaatgaagggcacaatactcttgatcttatgtttctcgacgtgtacaggaaaggactgtttgttcctgtacgatagtaacatggcacaatgccagacaccagaacaacaacgacaaaatcacaaaaagataatgctgagcaacacaccaac

SEQ ID NO: 12441 - DNA, 1527 bp, Zea mays
gcacgagaccattacctagaacatcctaatcgaaaaattgtaagttaatgggccgaagttgtacagtgaactatctcccacctttggcacttcgcgctccccaaccaaacggtactgatcagccggccgccgttctccatttcaaattgcaaacccgttctccttttccgtctcctcgacgcaactcgtcgccgtcttctccaactcgcacctcgttcctcgccccaccatttgccgctcccgcctacgatgccgacgagtgaggtgtggagcttgtccgatttcgaaatcagcaagtacatcggtgagggcaggttcggcaaggtctacctcgcccgcgagaagcagagcgggtacgtggtggcgctcaaggtgatatttaaggcgaaactgaagaagcaccgcttccacgcgcacctgcggcgggagatcgagatccagcagagtctcgaccaccctaacgtgctccgcctcttcacctggttccacgacgaagagcgagtcgtcctcgtcctcgagtacgcggcccgtggcgagctctacaaggtccttcgcgctgctggccgcttcaccgagcgcacgtccgccacgtatgtagcgagtcttgctggtgcactggcatactgtcacaaaaagcaagtcattcatagggacatcaagcctgagaatttgctaatcgacatcgagggccggcttaaaattgcagattttggatgggcggctcgttcaaatgctaaacgccacacactctgtggcacaatcgattatctggcaccagagatggtagagaaaagagctcatgaccatgctgtggacaactggacattaggaatcctgtgctatgagttcttatatggttcacctccttttgaagctgatgaacaggatgataccttgagaaggatagttagggtggatttggcattcccttcatctccttgtgtatcttcagaggctaaggatctcatttccaagcttctagttaaggattcaagcaagaggctttgccttgaagacatcatgaagcatccatggataaagaagaatgcagacccttcaggcagttgcattaagcaaaaagatgtcacaagatcaaagcttctgtaatatcagtacaacctgcttgccagtgggcaagaatcttctgatgtggtgccaaactcgtcactactggaggacaaatatgatgacatgtagttttaagttccgatagttctggagtggattggtgtgtgtccctgcaagctttctcctacaggctggagttctagttctgatgcagcgtttgtgtttcccttttgaactgtgtcgtgaaaccaatgttcactcgagaggaatgtagttttcaactgagttgttgaaccttcgcaaattggagggtcaatggtctgtggagattggagaggaacgtggctttcgctgtggcgatcgtattttgtaattgtcgaatctgcagtattttggtctttagcaatgaaatatggagatgcccgtagtttttctaaaaaaaaaaaaaaaaaagcggcc

SEQ ID NO: 12442 - DNA, 1267 bp, Zea mays
aaccaaacggtactgatcagccggccgccgttctccatttcaaattgcaaacccgttctccttttccgtctcctcgacgcaactcgtcgccgtcttctccaactcgcacctcgttcctcgccccaccatttgccgctcccgcctacgatgtcgacgagtgaggtgtggagcttgtccgatttcgaaatcagcaagtacatcggtgagggcaggttcggcaaggtctacctcgcccgcgagaagcagagcgggtacgtggtggcgctcaaggtgatatttaaggcgaaactgcagaagtaccacttccacgcgcacctgcggcgggagatcgagatccagcagagtctcgaccaccctaacgtgctccgcctcttcacctggttccacgacgaagagcgagtcgtcctcgtcctcgagtacgcggcccgtggcgagctctacaaggtccttcgcgctgctggccgcttcaccgagcgcacgtccgccacatatgtagcgagtcttgctggtgcactggcatactgtcacaaaaagcaagtcattcatagggacatcaagcctgagaatttgctaatcgacatcgagggccggcttaaaattgcagattttggatgggcggctcgttcaaatgctaaacgccacacactctgtggcacaatcgattatctggcaccagagatggtagagaaaaaagctcatgaccatgctgtggacaactggacattaggaatcctgtgctatgagttcttatatggttcacctccttttgaagctgatgaacaggatgataccttgagaaggatagttagggtggatttggcattcccttcatctccttgtgtatcttcagaggctaaggatctcatttccaagcttctagttaaggattcaagcaagaggctttgccttgaagacatcatgaagcatccatggataaagaagaatgcagacccttcaggcagttgcattaagcaaaaagatgtcacaagatcaaaggtaaaacgataagtgaatatgcaagatatcttctgagccatggtgtttagtgttcttgttccttggagataaccatggtgtttagtgtaagtagaagccagcctatgtactgtgatcttagttatggaccatgtgtcgaagttgctaaacttctgttgcctgcctcatctggggaggcaattaatcttagcttttgtgtggatacagtagttccataaaaaaaaaaaaaaaaaagcttatcgataccgtcgacctcgagggggggcccggt

SEQ ID NO: 12443 - DNA, 1819 bp, Zea mays
cggacgcgtggcgcgacgcgtgggggccgaagttgtacaggccgcccgcgcccgccttttgaacttcgcgctccccatccaaaccgtactgatccgccggccgccgttctccatttcaaattgcaaacctatactccttttccgcctcctcgacgcaactcgtcgccgtcttctccaactcgcacttcgtccctcgccccacccaggggcggatctccacccggggctgcctgggctgcagcccctgtcggcagtcgcggcccagtccatcatcgcgcgacatgacctagcagtagcagcagacgtcctacgtccagccccagccgccgccgtttggctcctgcgttcgatctcgctgcgtcctggtcctgcgccctgcggtccagcctcctctccaagactccacttctccagcgcgctcgcccgcgccagccgccaggccgccaccggccaccgccattggccccaccatttgccgctcccgcctacgatgccgacgagtgaggtgtggagcttgtccgattttgaaatcagcaagtacatcgctgagggcaggttcggcaaggtctacctcgcccgcgagaagcagagcgggtacgtggtggcgctcaaggtgatatttaaggcgaaactgaagaagcaccgcttccacgcgcacctacggcgggagatcgagatccagcagagtctcgaccaccctaacgtgctccgcctcttcacctggttccacgacgaagagcgagtcgtcctcgtcctcgagtacgcggcccgtggcgagctctacaaggtccttcgcgctgctggccgcttcaccgagcgcacgtccgccacatatgtagcgagtcttgctggtgcactggcatactgtcacaaaaagcaagtcattcatagggacatcaagcctgagaatttgctaatcgacatcgagggccggcttaaaattgcagattttggatgggcggctcgttcaaatgctaaacgccacacactctgtggcacaatcgattatctggcaccagagatggtagagaaaaaagctcatgaccatgctgtggacaactggacattaggaatcctgtgctatgagttcttatatggttcacctccttttgaagctgatgaacaggatgataccttgagaaggatagttagggtggatttggcattcccttcatctccttgtgtatcttcagaggctaaggatctcatttccaagcttctagttaaggattcaagcaagaggctttgccttgaagacatcatgaagcatccatggataaagaagaatgcagacccttcaggcagttgcattaagcaaaaagatgtcacaagatcaaagcttctgtaatatcagtacaacgtgcttgccagtgggcaagaaccttctgatgtggtgccaaactcgtcactactggaggacaaatatgatgacctgttgtagttttaagttccgatagttctggagtggattggtgtgtgtgtgtatccctgcaagctttctcctacaggctggagttctagttctgatgcagcgtttgtgtttcccttttgaactgagtggtgaaaccaatgttcactggagaggaatgtagttttcaactgagttgttgaaccttcgcgaattggagggtcaatggtctgtggagattggagaggaacgtggctttcgctgtggcgatcgtattttgtaattgtcgaatctacagtattttggtctttagcaatgaaatatggagatgcccgtagtttttctaaaaaaaaaaaaaaaaaaaaaaaaaaaaaaaaaaaaaactcgagactagttctctctctctcgtgc

SEQ ID NO: 12444 - DNA, 1368 bp, Zea mays
  misc_feature (31)..(31): n is a, c, g, or t
aggatatttcttttctatctatctatctatncattaaagctgggagcaacggcgagctcccaagctatccacgtcagtttttttcacgattggtgtttaacggacggaaggtttccctttctttgactagtacacaacaccgaagcattccagaaactcacttgagatcctcctttgccatcccaccggaagccaaacctttccccctccatgccgcactagggtagctactgccaaggcgcgtcggtccaaggaagctcgtgttcctgcgtgccacgttcatggagttgcccgacacgtcccgcttcttcgtgctatcgttcatcgtcgcaccgctgcccaccaactcctcctagagtacatccacccaaactctgttcgctccccaggcggcagcgcgctcggaggtcctagcctagcggcctcagcctcgacattccatctgctccccaggcggagcgtgctcggtggttctactcctagcaggctcggactcggcactccgtccgctccctaggcagcaatgccttcagatgtcctagcggccttgacatcgttccgagtgctgggcgccatgcaggtgtttgacaaaatgtccatgtcgtctatcatggtcgtgtcatgcccagcgttgggagatcgtgctcacctactgcagctaatcgtataaagcgactttagctttcgtctgggaacaatttattttttaggttctcagtgccaaatagcttggcgggctagaggatgtgaaaaggattcaagcaagaggctttgccttgaagacatcatgaagcatccatggataaagaagaatgcagacccttcaggcagttgcattaagcaaaaagatgtcacaagatcaaagcttctgtaatatcagtacaacgtgcttgccagtgggcaagaaccttctgatgtggtgccaaactcgtcactactggaggacaaatataatgacctgttgtagttttaagttccgatagttctggagtggattggtgtgtgtgtgtatccctgcaagctttctcctacaggctggagttctagttctgatacagcgtttgtgttacccttttgaactgagtggtgaaaccaatgttcactggagaggaatgtagttttcaactgagttgttgaaccttcgcgaattggagggtcaatggtctgtggagattggagaggaacgtggctttcgctgtggcgatcgtattttgtaattgtcgaatctacagtattttggtctttagcaatgaaatatggagatgcccgtagtttttctatgacgcgaaaagggagggaaaaactggtaatttcaaatggccatatatctattattctgagtttaaaaaaaaaaaaaaaaaaaaaaaa

SEQ ID NO: 12445 - DNA, 2527 bp, Zea mays
cgtcgcaaccacggctgatagtttgtacgttgccgtcacgtttgctccagtttcgccatttattttcttatcatataaaaaaagagaacagatgattcccatggagaatatgctctccaaagttacaaccctattttttaaaggatttctatattactgaagaaaattagtttatttatttatggaaaaaatagaaattattaagcaaaatgggtcccaaactatacctggtcactagtgtagctggtaatccgccattccgcgcgagatcagtagggtgcgcgtgctggtgctggctacggccatggcgacgcccaccagcaccgtcacccgcggcggcaacaggcattggcattgtacccaagtgcttccactgctgttgctagtaccactatgcttcgcgcttctggttgagagcggcggcatccccacgacgctggacgggccgtttccgccggccacgcgcgcgttcgaccgcgcgctgcggcagggcagcaacgacgtcccgctcacggatccgcgccttgcgccccgcgtgcagcccccggcgcccgagcagatcgcgctcgccgcctccgccgacgccgactcgctctgggtctcttgggtcacgggccgcgcgcgcgtgggctcctccaacctcgcgccgctcgaccccgccgccgccggcagcgaagtctggtacggcgagcgcagcgccgccgacgccgcatcctatccgcacgtggtcacggggtccgccgaggtgtacagccagctgtacccgtacccgggcctgctcaactacacctctggcgccatccatcacgtccgtctccgcggcctgcgccctgccacgcgctactactaccgctgcggcgacagcagcctccccggcggcctcagcgacgagcactccttcaccaccctgcccgccaccggcgccggatgctacccgcgccgcgtcgctgtggtaggtgaccttggcctcacggggaactccaccgccaccgtcgaccacctcgcccgcaacgacccatccctggtcctcatggttggggacatgacctacgcgaaccagtacctcaccaccggcggcaagggagtcccctgcttctcctgctccttccccaaagctccgattcgggagtcctaccagccaagatgggatggatggggaagattcatggagccgattacatcgaagattccgctgatggtgatagaggggaaccatgagattgaaccgcagggtcacggtggagaggtgaccttcgcgtcttacttggcacggttcgctgttccatccaaggagtctggatccaacaccaaattctactactccttcaacgccggtggcatccattttatcatgctcggtgcctacatcgactacaaccgcacaggagttcagtactcgtggttggaaaaggatttgcagagggttgatcgacgagccaccccttgggtcgtggctgcttggcacccaccttggtataacagctattcctcgcactaccaagaattcgagtgcatgaggcaagaaatggaagaacttttatatgaatatcaggttgacattgttttctcaggacatgtacatgcatacgaaaggatgaaccgagtatttaactacacattggacccctgtggcccgatttacatcggcattggagacggcgggaacattgaaaaaattgacatggatcatgctgatgaccctggaaagtgtccctcaccaagtgataaccaccctgaatttggtgggctctgccatctgaacttcacttctggccctgccaagggcaaattatgctgggaccgacagccagaatggagtgcatacagagagagcagttttggtcatgggattctagaggtcctgaattcaacatatgccttatggacatggcaccgtaaccaggacgcatatgcagagaacagtgtgggagaccagatctacattgtacgacagcctgacaagtgccttctgcagccagctagtgcgtcgtctctcaattggtgatttgatttgatgacaaaatttctgctattatgtattaattaatatatattcatatccattagattctaagttgttcactatcttggttatttgttttagatagccccattggaggatgcccttctctagtgagtagtaacagctccggtgggtccattacaaatggccagctctcctacaaaatgtttgtaattatgtgtgtagctttaatgtgaaagagttaggtggtctgagcagtactcatctcctttttaatataatactttagggttgttttactctcggcgggtcgaattttttttgtgtagctttaatctgcacagttgaaggaacatttcataccaccattacttttcttgattttataattgtagagcggcagaatgcaagatgcaccttactgaatattatactgcaaggtttgttgagtctttttttgtgtttattatcgatttattgtaaggaggcaccaatctttgttttattgttgtataaagaaatgtgaaacaatagcatttggtt

SEQ ID NO: 12446 - DNA, 2101 bp, Zea mays
ctgcccttttcaggcatatataacattccccggccggcactacatccatccccgcttgattagcggcagccactctctccctctccactcttggtgtccgagtcccttggccgtacgctctgcctcactcctccgtttcttgcttctcctgccgccggcgtcggagagcgagcttctcggcgggcggcggcggcgcgcggcgccgggtgcggatcggccgcgggtgcatggtggaagccgccgccgggcgccggtcaggcaccagccgtcggcggcctagcggcagcggaggggagcaacagcgcctggttgcgctcgccgtcgccgcgcgcgtcgccatggtcagcacccggtctgcgggtccagcagtggcgggaggagatggagcgggagctgctggaacaggcgccggccccgctgccggtagaggacgatgcatggaggacttcttcgactgcctcctcggcttgctcggcgcgttaggcatgacatgggctacggcgcggccccagcggcagccgctcccgccgctgcctcgcggggttggggcggggcctgagccaaccgacgcccggcgtttcgcagcggcgctcagggccacccccggccggatcgctggcaatggcgcctgcgccgtcgcgtcactgtacacgctgcagggcaagaagggcgtcaaccaggatgctatgatcttctgggagaacttctgttctagagatgataccatcttttgtggtgtatttgatggtcatggaccttatggccatttggttgccaagagagtaagagatctcctgcctctaaagttaggagcagatttggggatggaagatggtagagtagcatccactggcaacattaagctcaatacaaatgatgtagcttcatctgaacacatagtcagaggaggtactgccgtttcctctgaagctcagcagaatggagattatccagaggtcttcccagcattgagaacttcattcttgaaggcattccatgtaatggatagggatctcaaattacataaaaatattgattgctttttcagtgggactacagcagtggcagtgatcaagcagggacacaatcttataattggcaatttgggggattcaagagctgtcttaggcaccagagatgaaaataaccagcttgttgctgttcaattgacagttgatctcaaacctgacattccaagtgaatcacagagaatcaggcaacgcaggggcagaatatttgcacttcctgaggagccggaggttgctcgtgtttggcttccaaggtataactcgcctggattggccatggctagggcatttggagacttttgtctgaaggatcatggtgtaatttctgtgcctgatgtttcctatcaccacataacggaaaaggatgaatttgttgtgctggctaccgatggggtttgggacgtgctatcaaatgatgaagttgttaatactgtcagccgagtcacatctcgggcctctgcagcacgatttttagtcgaatcagctcaccgtgcttggcgaactcggttccccacttctaaagtcgatgattgtgctgctgtctgcctattcctgaacacaaatgaagcaagtgaatcttcgagttccttggccaacaatttggcagatgctgtacaagttagcactgctcagtgctccaaaactatccaggtgagcgcacctatagacggaaacgaggtgtctgttgttgaaacgaggtgatttgcacaatgatggttgaggcgcaaagtgagcttgcatgctgtgcctgtgactgagatctgctgaacgatagtagttgaggcagagagagcgggggcatgaacatgctgtgctgtgcctgtgattggcatttgtggagccaagatatagcacgtcggtgggtttctgcttgctatttttttctggacgcaagtgtggttattatatgcgacattagatttttataggagaaacataaattgtagggtacttgaagttttggctttaaacatttatgttaacaagatatctgtatcattctttagcctcgttgctactcacagaaaaggttctagagcttgttgatcaaaaaaaaaaaaaaaaatggtcat

SEQ ID NO: 12447 - DNA, 3466 bp, Zea mays
atatttaaggctaatttggaaacactatttttctaagggattcttatttttccaatgaaaaatgaactaattttctttgaaaatagaaatctcttgaaaaaattgggttcccaaactagcccttagggatagtttaaaaactccatttttctaaaaggtttttattttactaagagaaattagttcattttccttaggaaattgaaaatcgcataggaaaatgtgagtgccaaactagaccttagaggtacgtggtatttttttttgttatgtcagtgacccaacgtaaatgagtgctacaataaagtggcaaaaaaaatcgaatgtcctcacaatttggggtctcaaacagaacgcgaagtctcgccgactccgacaaccttgcgttcctgtctctgcgtctcgtcgcctcagattcacccccaccacttcctccctccccttggatggaggcaggcagattcccgttccattccagactcgcagtacagtacacacagcaaaagcaccacccgggccggcttcctctagactagattagtgttgctaagagcctttttaactacgggattacgcaagtctcgtatactcatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcggggctgcgggggcggggcctgcgccaactgactcccggcgtttcgcggcggagctcagggccacccccggccggatcgccggcaatggcgcctgcgccgtcgcgtcactgtacacgctgcagggcaagaagggcgtcaaccaggatgctatgatcttctgggaggtaaaaggaaaattaaaaggagaaaataaagaaccatattttccctgctttcttgtctgcgcttttcctcagacatctagtgttgtgagattcttgatgtatttttttcccactgttcttgatcagatctaagcaactttattcttattctggattagtttacctgacatatgctgtgttccagatttttattccacggagaagctcaggtttagatttgacttttctgtacaagctaatttgatcttgatgctagcctcaggaagttgtttgtttttattcttgcggccacagcttatgcgtgttgttatgagttacgcaacatgagcacacagcatcaaactattcaagaattgaactttgactcaaatcctatatatatttcgcactggttgctgtgggatgttgctggtggagaattcctagttggtagtcttattcaagcgcaataattgatggagttggaatacttcatggcggttggaagggctccacacgattctcctccttatccaatactagttttttttttccttctccatgtccttgctggatgatcttatctgcttcaagccccatcctgcccttttctaatgcttcacttgattaccaatttggctgcatgcccattgagtgacacatgtacggatactatcttattttttcggactcatatttgccttccttaagttatgataactttcatgatttgactgctatagtagtaatttctaaaaaactgcacacgggtctcagtgaaaacataagcataactcacaataagaaaccatgtacctatccagttttactgggcacgtgtaaaatttgctactcctgttatttctgtgcagcgtatgtttgattttgacaactatttttactggtggacagaacttctgttcaagagatgataccatcttttgtggtgtgtttgacggccatggaccttatggccatttggttgccaagagagtaagagatctgctgcctctaaagttaggagaaggtttgacgacggaagatggtagagtaacatccactggcaacattaagctcaacacacatgatgtagcttcaccagaacacatagacaaaggaagtactgccatttcctctgaagctcagcagaatggagagtatccagagaccttcccagcattgagaacttcattcttgaaggcattccgtgtaatggatagggatctcaaattacataaaagcattgactgctttttcagtgggactacagcggtggcagtgatcaagcaggaacacaatcttataattggcaatttgggggattcaagagctgtcttaggcaccagagatgaaaataaccagcttattgctgttcaattgacagttgatctcaaacctaacattccaagcgaagcacagagaatcaggcaacgcaggggcagaatattcgcgcttcccgaggagccggaggttgctcgtgtttggcttccaaagtacaactctcctggactggccatggctagggcatttggagacttctgtctgaaggaccatggtgtaatttctacgcctgacgtctcctatcaccacatcacggagaaagacgaatttgtggtgctggctactgacggggtctgggacgtgctatcaaacgatgaggttgttagcactgtctgccgagccacatctcaggcctctgcagcccggtttctcgtcgagtcggctcaccgcgcttggcggactcggttccccacttctaagatcgatgactgcgctgttgtctgcctgttcctgaacacagacaaagcgagcgaatcgtcgagttctttggccaagaacttggcagatgctgtagaagttagcagtgccgggcgcgccacaactgtccaggtgagcgctggtgcatctacagatgttgccgccctggtaccagtaccagatgggaacgaggtgtctattgctgaaaccatcacaaagctggtcacgctcatggatttgcccaaggatggttgaggctcctgtgattgggacctgaacgaagatataccacatcggggggtgctgcttgcagttttttttttctgaacgcaagtgtggctagaatttgcagttttgcttcgtgtaaagtgccgcgtcagtttagcgtcgacgcgg

SEQ ID NO: 12448 - DNA, 743 bp, Zea mays
attaccgggccgacccacgcgtccgccccacactacaccacaccacacacacccgacgacgatcacacacacgtagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcgccgacgtgctgatcgtcgtcccgaggagggcgggcgccgggcgcgtcgtctggttccccgcggcggcgcgccgcggcggcggcagcgggcggttggtcgccgtgcggtccagcgggccggccacgccgccggagatctccgacaaggtgtctgagagcatcaagcaggcggaggagacgtgcgcggacgaccagaagggcgacgccgagtgcgcggcggcgtgggacgaggtggaggagctcagcgccacggtcagccacgcccgcgacagcctcaaggagaccaacgccaacgacccgctcgagatgtactgcaaggagaaccccgactccgaggagtgccgcatctacgacaactagctatagtcgtagctatatagggcgtggaatgatactctcgatcggcgcgtcatacgtggaatgaacttgtatgaagctatacctcaatgcttctctacctgccgccgccgccgcagcagcaccccgtatgatatgatacacagctgggatggtatactgatattttgggtt

SEQ ID NO: 12449 - DNA, 1675 bp, Zea mays
  misc_feature (1494)..(1494): n is a, c, g, or t
acgcttgcgcaccgaacgagagcaaaatatcccatgcaaatgcaagccacgtacgctttgcccttccacagcgagcgagtggccagcgcagccgataagaaacgagtgcacggaaacgccccgcccgtcgacgaaccaagctatatatcaacctcgtcctccccagcgcaccccgccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctatctatacctcaatgcttctctacctgccgccgccgcaccccgtatgatatgtgatacacagctgggatggtatactgatattttgggttaaaaaaaaaaaaaaaaaaaaaaaaaaaaaaaaaaaaatggactgacggatactttgcatttcgcaaggaatccgacaccgtcgagtaatctcaagccagtttgccgccagctgacattttctttggacaatgcacagtgcgcacatgaacatatgtttctgcaaactccgttcctctattcaacaaatcatgtacagaaaataaaaaaaaacaaagactgtagttaggtttacagttttgagatttaccagaagtagaggatattacagcaataatggctgactatctaggactaggagggatgagggcgtaggtaggtcagtaggtggtccttttgaacctaagcatgactagaagccaacacatggacaattacagaggtccatgtcgcagtatgcataatgccctacgttgtcttactactcatcgattaatgaacacaaaggtgaaaaatattacgagctcaaacacaactgagcaccaagacctcatcactctatctcacctcctagttccgatggtacttctaacctgatattcctaatgcgcctttatgtatgncctctatgtagaatgaattcaatctcgggaaagtttagaacttctgaaccccgtgggaggaagtgtgtatgtccaacctgaacatatagatctaaccctatggattgacgtcaaaaatggctcgactggatgtaagaaaaatggaccaggttccatttgatatttgagttttgatgtttga

SEQ ID NO: 12450 - DNA, 813 bp, Zea mays
cccacgcgtccgcccccgcgcccgccctctcccaggccaacccgcgaagcactacactactccacaccacacacacccgacgacgatcacacacacgtagaagatcgagttcgttcgatcgtgaccgtgacgcaggaagctataagctagccaagacaggaataataatggcggcgtcgacggtggcgagcctctctgtcccggtgacgacggcgaccttcgcggcggcggcggcggcgggcggcgccgacgtgctgatcgtcgtcccgaggagggcgggcgccgggcgcgtcgtctggttccccgcggcggcgcgccgcggcggcgggcggttggtcgccgtgcggtccagcgggccggccacgccgtcggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctatctatacctcaatgcttctctacctgccgccgccgcaccccgtatgatatgtgatacacagctgggatggtatactgatattttgggttaatttcc

SEQ ID NO: 12451 - DNA, 705 bp, Zea mays
  misc_feature (5)..(5): n is a, c, g, or t
cggtncaacccgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctggttccccgcggcggcgcgccgcggcggcggcagcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggacaacccggactccgaggagtgccgcatctacgacaactagctagtcgtatagctatataggccatcgacatgaaggacgaaggttgtagcacactacgaaagaatgatactctcgatcggcgcgtcatacgtggaatgaacttgtttgtatcaagctatctatacctcaatgcttctct

SEQ ID NO: 12452 - DNA, 797 bp, Zea mays
gtgcggcgctcgagccggccggctctcggccaaccgcgaagcactacactacaccacaccacacacacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcggcgacgtgctgatcgtcgtcccgaggagggcgggcgctgggcgcgtctggttccccgcggcggcgcgccgcggcggcggcagcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggagaacccggactccgaggagtgccgcatctacgacaactagctagtcgtagctatatagggcgtggaatgatactctcgatcggcgcgtcatacgtggaatgaacttgtatgaagctatacctcaatgcttctctacctgccgccgccgccgcagcagcaccccgtatgatatgatacacagctgggatggtatactgatattttgggttaatttcatgtaccaaagcgtgtttgaagtcgcggcc

SEQ ID NO: 12453 - DNA, 2865 bp, Zea mays
  misc_feature (124)..(124): n is a, c, g, or t
gtttcgtctcctgttgaacatctcacacttcattatcaggttaggcaccttgatacttctgagaagagtgaattgcacaagctacagcaactgaaagatgaacaaggtgaattgtccagcagtngatgagaagaagtacaaggcactaaagcgtgccactgaaagagagatactgcagagtgctgatgtcatttgttgcacctgtgtcggtgctggagatcctcgtctttcaaacttccgtttccgacaagttcttattgatgagtccacacaggcaacagagcctgaatgtcttattcctttcgtgcttggtgtcaagcaggttgtccttgtcggagatcattgccaattgggtcctgtcatcacgtgcaaaaaagcagcccgtgcaggattagcacaatctctctttgaacgccttgttatccttggagtgaagccattcaggctacaggtccagtatagaatgcatccatgcctctcagagtttccatccaactgcttttatgaaggcacactgcaaaatggagtgactgttaatgagaggcattcgtctggaattgattttccttggcctgttccaaatcgcccaatgttcttctatgtgcagatgggccaagaagaaatcagtgctagtgggacatcgtatctcaatagaactgaagctgcaaatgttgaaaaaattgtaacaacttttttaagaagtggtgttgtaccaagccagatcgggctcactagtccccccccccccccccccccatacattgtaaattacatgtcaaggaatggctctcttcgccaacaactttacaaggaaatcgaggtcgctagtgtagactcatttcagggtagagagaaagactacattattctatcttgtgttagaagcaatgagcaccagggaattgggtttctcaatgacccgcgcaggttaaacgttgcgttaactcgtgcacgttatggcatagttattcttggtaatccaaaagtactaagcaagcagccactttggaatagcttgttgacacattacaaggagcatgagtgcttggtagaaggacctctgaacaacttaaagcagagcatggtgcagtttcagaagcccaaaaagatatataatgatcggagattgttactgggcggtgctcaaggcatgcatggagctaacttcggggctggggcctcaagccaagcagcagataagagaagtggcagggggaaaggagggcaatcatttgtttcttatggccctccaaatggggtgcacaagcctggtgtgcacccagcaggttatgctgtacctcgtatgccttttcctccatttcctggggctccacattctcaaccatatgcaattccgactcggggtttgcatgggcccattggagctgttccaccggtgcatcaacctggaagtagaagttttggggcacctcgttcaaatactggtgggcctattggtggccaccttgctcatcaacagaattcccagcatgcgttccgcggcccggccgcgaattttaactacgctggcatggagaattcgagtagtcagccttctggtgtagcccaaatgtcccaatcgggattaatgacacagatgcctgttcaaggactaagtcaaacattccgtgatggtttttccattggtggggtgtctcaggacttcattgtagatgattttaagagccaaggatcacatgtgccatacaacattgcagaattttctacccaggcttctcaaggtggttatggtgttgagtttactcaagcgccccaatctggatactctgggaattatatgaaccaaaacacacatcctggatactcccatattggtacaacaaatgacattgtatctcaggatcacatggcccatggatctcacggaatgtttacgcaagtggggtataatgatccgtcgcaagatgagtcatctcagattcattatggaatggctgctgctggtcccctacattcgcagagcatgatgaaccccttatactctcaatcctatgctcactacaacacccagccacattctcttcaacctcctccccagtgataattaaggcttgtgatatggtgaagccacattttggaagtttggtgggttgcatcttttggcccacatgttgtgcccttctctgctatttcagaatcgatggtgcatagacatcagatgcaagcaatgtgaacaagcatatgacacactttgtattggatgtttatcggggcaggcttgtacaagatggctatggctactgaccaacagccagcgccgaggagcacaaggattgcaatgtatcatgttcttgatcgttgtggttcactacccgtttagaccacaagaggggtcatattgtgcatcggaagaggttggcggcactatcctcatccctcacctgtatataaaggcaatctgggcctatagtggtacaatgtgaacatattccaggatttgctgccactcaagtcaagttgcagcaattgcatgcctccatggtgtagagtggctttgtataaaggtgctataggttgggtggccacaacccttttggatatcacacatgacaagatatttacctttacattttgtatgcatctgatatggttttgatatttatgccagagatgatttaggtgatggtaaaattagttagtgacgactggaaatttgggagtgttctgtgaaagtaaatttgaccctgaatcctgcgaggaatggctgatcatgaagtttattgtataatttggatagtccgttcagagatattcatgcataggtgcatcacatatttgttctttatctttctgcaagtggcacttttctgagtggtcaattctgcaatgaaatgtgcgtgtctg

SEQ ID NO: 12454 - DNA, 2137 bp, Zea mays
  misc_feature (71)..(71): n is a, c, g, or t
tgacggcctatgttcttctatgtgctagagggacaagaagagatcagtgctagtgggacatcctatctcanatagaactgaagctgcaaatgttgaaaaaattgtaacaacatttttaagaagtggtgttgtaccaagccagattggagttatcacaccttatgaaggacagagggcttacatcgtaaattacatggcaaggaatggctctcttcgccaacaactttacaaagaaatcgaggttgctagtgtagactcatttcagggtagagagaaagactacattattctatcttgtgttagaagcaatgagcaccagggaatcgggtttctcaatgatccgcgcaggttaaatgttgcgctaactcgtgcacgttatggcatagttattcttggtaatccaaaagtactaagcaagcagccactttggaatagcttgttgacacattacaaggagcatgagtgcttggtagaaggacctttgaacaacttaaagcagagtatggtgcaatttcagaagccaaaaaagatatataatgaccggagattgttcctgggcggtggtcaaggtgttatgcatggaactaactttggggctggggcctcaagccaagcagcagataagagaagtggcagagggaaagaaggacaatcgtttgctccttatggccctccaaatggggtgcataagcctggtgtgcacccggttggctatgctgtaccacgtatgccttttcctccatttcctggggctccacattctcaaccatacgcaattccaacccggggtttgcatgggccccttggagctgttccaccggtgcatcaacctggaagtagaaactttggggcagctcgttcaaatactggtgggcctattggtggccaccttgctcatcaacagaactcccagcaagctatggggagcattgggtcaaattttaactacactggaatggagaatccaagtagtcagccttctggtggagcacaaatgtcccaaactggattaatgacccaggtgcctgtccaaggactaagtcaaacattccgtgatggtttttctattggtgggatgtcacaggacttctttgtagacgattttaagagccaagggtcacatgtgccatacaatattgctgaattttctacccaggcttctcaaggtggttatggtgttgagtttactcaagcgccccaatctggatactctgggaattatatgaaccaaaattcacatcctggatactcccatattggtacaacaaatgacattgtatctcaggatcacatggcccatggatctcatgggatgtttacacaagcgggatataatgatccctcacaagatgagtcgtctcagattcattatggaatggctgccgctggccctctacagtcgcagggcatgatgaaccccttgtactctcaatcctatgctcactacaacacccaaccacagtctcttcaacctccgccccagtgataatgaaagcttgtgataggatgaagccaaattttggaagtttggtgggttgcatcttttggcccacatgtgcacttctccgctgtttcagactcgatggtgcatagacatcagatgcaagcaatgaaggcacactatgtattggctatttatcggggcaggcttgactgaggggcacaaggattgcaacgtatcattgatcgttgtagttcactgcccactttggccacaggagaggtcatatcatcgagaggttgacggcactaccctcatccctcacctgtatagaaaggcaatcggggccaatagtggtacgatgtgaatattccaggatttgctgccattcagaaagtcaagttgcagcaactgcatgcctccatggtaccatgaagacacgcccgtagagtggctttgtatagaggtgctataggcgaggtggacaaccctttcggatatcgcacatggcaagatatttacattgacattttgtatgcacccgatatggttttgatatttatgccacaaatcatttaggtggtgatgcaagtagtttgttgtgattggaaaaaaaaaaaaaaacaccaatgctagtttgatcctgaaatcttatgggggaatggttgagtgggggttattttgttgtgaaacaga

SEQ ID NO: 12455 - DNA, 3784 bp, Zea mays
  misc_feature (1160)..(1160): n is a, c, g, or t
ggttaaaccatgagccagcttataggtacagcaaattgatccaagctgacaaaaaatcagtttcagctaggttcgttttgagtgtgagccgtccggctcgagattttttttagccctacttttcacaaagctgctgcactcgtttagattctctgaccctgctcccgagaactcatcgacgccgtccatgctgtcctcctctccggcgccgtcacaagagggcgccgccgttccctcctcctgggcggaagctgcgtcctcggcggcgctccggcactaccgctcactggccaagaaagggaagccgcaggggcgcgagtccacggtcctcgccgccatcctcctctctgccccgcaggactcgcacagcctcactgtgctctccatgggcaccggcaccaagtgcctcggtgcctcgatgctcagcgcacgtggggacctcgttcacgacgcgcacgctgaggtcatcgctcgccgcgcgctgctccgcctcgtctactccgagatcggccgtggcgccccgcctgattggctggttgcttccggggatgctgggagatggaggctgagggatgggcactgccttcatctttacatcacacaactcccatgtatgtgccatggtagtgagtagacactggtgttcttttgtttggattccgattgtttgtcctagagcatgctatgtagaatacaatgctaagttaggaatagctaaatttttaactgctcggactaattgttcaacaaccctgcatctttgtatgtaaactgatacaagtgatacttgtgctgctgcactttcgcagacctattccatcatttttttcttgtcggttgtggcaatatcctgataacatagtttgatggttccagttgatttggtgactttgtgtaggtggagtcatgccagtaccaccatcgcagtctgatttgccaagaaaacagctgaacagtatgaatgtcggtatgcttatactgtcttgatgttggtgttctacataacagtaccttcaaagttttgagctcgtaattttcatgtaccctaacttttaagtatggtagtgtcttccatggtccttgtcccggtaacaattagtttgagaattgtttagtttacaaaccagatgtattttagttatgatggtttcttgattttntctgctgcccttatatattgataaaacagtagcatggaagtgtggtgctcctagctagttgacttaagtaacctctgtgcaactgtccagctaaactggaacagtggaactggactgcttacattgtttttttatgcttaatggagggtccattttacaccccggtaggtgtttgatacgatccacaagattggtacatgctgacatttgtctctattggttctgccaacagaaattgaattcattgtattgcccacattttaacaaaactatatttcatcctattacatatgtcatatattttctaatataagtatactactctgtatatcagaaattggctttgttcaaaggaaaccagggcgtggtgatacaacatcgtccatgagctgctttgacaaaatcacccgctggagcgttgtaggaattcaaggtaaccatttccacttctgttgataagaccagaaacattttaacatgtgctattcatcttgtaacagtagttaagatatatatgtgtggaacttctgcctctatgtcaacatggaattttctatgcatccaattcagcattgctattttcttgcatcctattactgttttttttatattgtgccctttagtggttacaaagtgtccaagtgggataaatcctctttctgtgcattcctcaacaggtgcattgctgtcacatatactggaacccttgtatttgtccaccattactattggacaattacctgatggtactcctgaacggttctctattaaaaataatatcaagaaggccctggatgctcgtctgtcctctctacccaccgaattgccgcctcctttcaaaatgcagaaggttggtgttccttttcttatgttccagtaacttctccacgataacaaatcatttctatcttcagccaaaggtttttgaggcgcctgtcccaccaacagagtttcaacagattcctggagacgtacgcctcttgacatgcgggtagtatatatggtttgttccatgagctggatccttttccccccattttgtctctttctttatgcatccgtttattgtgccattcttttttactgaagcgttagctttgtcgtttttcttttactaggtactcgatttgttggaataaatccggtttgcatgaagttgtcttaggcacaactggtaggaaacaaggaacctcatcaaaggcagcgcacttaccctccaccgagtcactgctctgcaagtaagcgggtcttttccttgtgtggatttcttccatcgcgattctgacgcaaaaccgttgagaggaccgtgtgttgactgttgtcctaggagaagactactagaagcatttgtgtcccttgagcatcctttggtggggcaactaaaatgcgaggagctatcttaccgggcacttaaggtatttcgtgatctctgggataaactgatgtttagtactaagacatagcgttttttattccgccaggttcttcctattgatttcacctgctaccatccaagaaccgattacaaacgtgtctgattttctgttcctgttgcaggatacggctcatgaataccatcacgcgcttgagctcctcaggaaggccccattttttggctgctggcgagctaagcctacatttgttgattcgtttgcagtttcacggtgatgtctcgtgaactggtgaatgccatctccctgtttctttttgtctgttgaaaaaacatactatctccgtcccaaaatatagttctttctagcctatttttttccgatccatattaataaacgtataaatagtgtagaatgaattatattttaggaccgagggagtaggtctgatccagctttgttccgtgtgaaattgtatatgttggtggtccatgaatgaatcaaactgaacttatgcgcgcgtgctgctgtcacttgattccaagcactccctcccggcctccccgcgccaggtatctatattttaatatttgatctgcttaacttccctcctctgcctctgagcacacgttaatggcagagagttcaagttctgaataatggtaggatttcaagttcttttactcaagaatcgagatgtgaaatttatcgcgcgcgtgactgcgtgagcaccgaacaactaatgcctttctgctcgctcgcttcaatttcctggacgagcctcaccgaggttatcaagttccgttccaaacccaaggagacaaacgcgcgcacactgagcactgacacagcacatgctccgcacttccgcaggtccaggtcgtttttgaggttcatcggcgtcaagccgtcagccgctgccggtccatttgttctcgacggatggatcctggaatcccgcccgactcccgagactggaggacaagagactccggagaccggatcacaagcaagcaacatgttcgtttggtttggctttaatttgtaacgaattttattgtttttacaggattttgtatctatagtttacagctgactttaatctgaagcaaacagcataatacatagaggtcgaatggccaggcgaaagagaaagagagataaagttagacactaaaaaaatgaaataaaattattgatataatagaaagataattgttatataaatagacg

SEQ ID NO: 12456 - DNA, 2081 bp, Zea mays
cacaaagctgctgcactcgtttagattctctgaccctgctcccgagcactcatcgacgccgtccatgctgtcctcctctccggcgccgtcacaagagggcgccgccgttccctcctcctgggcggaagctgcgtcctcggcggcgctccggcactaccgctcactggccaagaaagggaagccgcagggcgcgagtccacggtcctcgccgccatcctcctctctgccccgcagactcgcacagcctcactgtgctctccatgggcaccggcaccaagtgctcggtgcctcgatgctcagcgcacgtggggacctcgttcacgacgcgcacgctgaggtcatcgctcgccgcgcgctgctccgcctcgtctactccgagatcggccgtggcgccccgcctgattggctggttgcttccggggatgctgggagatggaggctgagggatgggcactgccttcatctttacatcacacaactcccatgtggagtcatgccagtaccaccatcgcagtctgatttgccaagaaaacagctgaacagtatgaatgtcgaaattggctttgttcaaaggaaaccagggcgtggtgatacaacatcgtccatgagctgctttgacaaaatcacccgctggagcgttgtaggaattcaaggtgcattgctgtcacatatactggaacccttgtatttgtccaccattactattggacaattacctgatggtactcctgaacggttctctattaaaaataatatcaagaaggccctggatgctcgtctgtcctctctacccaccgaattgccgcctcctttcaaattgcagaagccaaaggtttttgaggcgcctgtcccaccaacagagtttcaacagattcctggagacgtacgcctcttgacatgcgggtagtatatggtactcgatttgttggaataaatccggtttgcatgaagttgtcttaggcacaactggtaggaaacaaggaacctcatcaaaggcagcacacttaccctccaccgagtcactggtctgcaagagaagactactagaagcatttttgtcccttgagcatcctttggtgaggcaactaaaatgcgaggagctatcttaccgggcacttaaggatacggctcatgaataccatcacgcgcttgagctcctcaggaaggccccattttttggctgctggcgagctaagcctacatttgttgattcgtttgcagtttcacggtgatgtctcgtgaactggtgaatgccatctccctgtttctttttgtctgttgaaaaaacatactatctccgtcccaaaatatagttctttctagcctatttttttccgatccatattaataaacgtataaatagtgtagaatgaattatattttaggaccgagggagtaggtctgatccagctttgttctgtgtgaaattgtatatgttggtggtccatgaatgaatcaaactgaacttatgcgcccaaaaaaaaaaaaaaagattccaagcactccctcccggcctccccgcgccaggtatctatattttaatatttgatctgcttaacttccctcctctgcctctgagcacacgttaatggcagagagttcaagttctgaataatggtaggatttcaagttcttttactcaagaatcgagatgtgaaatttatcgcgcgcgtgactgcgtgagcaccgaacaactaatgcctttctgctcgctcgcttcaatttcctggacgagcctcaccgaggttatcaagttccgttccaaacccaaggagacaaacgcgcgcacactgagcactgacacagcacatgctccgcacttccgcaggtccaggtcgtttttgaggttcatcggcgtcaagccgtcagccgctgccggtccatttgttctcgacggatggatcctggaatcccgcccgactcccgagactggaggacaagagactccggagaccggatcacaagcaagcaacatgttcgtttggtttggctttaatttgtaacgaattttattgtttttacaggattttgtatctatagtttacagctgactttaatctgaagcaaacagcataatacat

SEQ ID NO: 12457 - DNA, 1969 bp, Zea mays
catcggggggctcctcgcggccgggcgggaacacacaaaatagggcgtctggatgatccttgtgttctttgtttcccgtcccgcggtgtgcgcgcgcacgtctgccgtctgccaagaggagtaggcagagatggcttgccctgcgcagtccatgctctccgccagcggctgcatcctcctgaggagcaagcctcgggcttcctcctcccacgtgcgagggggcatcatcggcggtggctgcagcagcaggccgttccagctaacctgcaacgcttcctcttccccgtctcctccctcgccggcgccggcgcaggaagaccccgactgcaacgacgaggagtgcgccccggagaaggaggtcgggagcttgagggccgagtggctggccgaggagaggacccaggtcgtcggcactttccctcccaggaagagagggtggaccggcttagtggagaaggacaccgccggccagaccaacatctattctgtcgagccggtggtgtacgtggccgagagcgccatcagctccggcgcggcgggcatgtcggcggagggtgccgagaacacggccgccatcgccgcggggctcgtcctcatcaccgtcgccgcggcctcgtccatcctcatccaggtgaacaagagccagccgcaggtgccggaagccgcctacaacggcccgccgctcagctattacgtggccaagttccagccggcgcagacccttgaggcccccgccccggcggaggcggtagaggcgcaggatggcgccgccactgtccaggactcggcggctccggaggcgcaggaagctgtcctcatcagctgattcggttttgtggcagcttacagatgaggttgtagtgatgtgcatgatgatggaagagacacatgtataatacattcattgtatgcatgagagagaaagggagaaaggagcatttcggagtcgtattacgtttcgtgtatatttacatatacatgcattcaggtcgcctatgcttattggaattcagacatcacggcactcccacaaaccattcattcagttgtaacaacggggcatgagcagagctatatatatatatatatcgcggtagcagagccattcacaataactgcgtgtaccatgggccatggacctgctctgacaccattgctgctttgataagcacttcagctgccttcaccagccgcgcagtgagttttgttgccccgacgcgcctcagggatgcatcggcgagcatccggcccttctccccactgccgcccagggtgactgcacggaatgcacagtatacggactgagagaccttcttgaagacggtgtcatcggtctggaggcttctaaggaagaccctagtcaatatctcttttctggcgttcatcctttcatgatctgacaagctccttgaggttgacgagtacatcatggcctcaatgattttctcagtgccaacatctggaaagttgtctagcagccttgtgaggacgttgaacagttccgaagtggcattctccagctcagaagaagtcatctctgggttctcactcgctaacacctgatgcaaaacaagcatgctgctcgctagcgcaacctaacacgattgggttcaatcattccattctatcagattacaaacacaacaacatgataaagaaacatggaactaccagatgatggctcaccttgtcgctatcacaatcacttgttgaaacttactctgaacagaccgcagcctcaaccaattcaacataaaggtctcaggaaccgattccctttctacaccctccatgctgctgatgagctgtaatagcccaatccttattagcttgccaagtatttctcccctacactctggtaatcctgtattgtctgcttcacgatatgcaacatcagccatgaatatgagtcaatagcaacctgtggagatagaccggaaacaaaaaaattacctgctgcaggcatgca

SEQ ID NO: 12458 - DNA, 1222 bp, Zea mays
tgccgcggatgactgctcggagagtttcagttctgctgcgattttcaggcaatgccaaggcccgaaaggtcgccgcttggtttgctggacgggccacgcccacgcccaaggccctccgccgtccgccgttctcttcggtcggcagcctgcgcggcaacgtgtacgtgctggcgaccacagacccaagcaccggaaagatatttctttccgctcactcccggcgccccccgggcacacaaaagagagggtctggtgtgtggatgattccagtcctcctcctgttctttgtttcccgtcccatcgtgtgtgagcgcgtctgctggtctgccaagaggaggaaaggaaggaggagcaagtagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtcgggagcctgagcgccgagtggctggccgaggagaggacccaggtcgtcggcactttccctcccaagaagaaagggtggaccggcttagtggagaaggacaccgccggccagaccaacatctactccgtcgagccgatggtgtacgtggccgagagtgccatcagctccggcacggcgggtacgtcggcggagggcgccgagaacacggccgccatcgccgcggggctcgtcctcatcaccgtagccgcggcctcgtccatcctcatccaggtgaacaagagccaggtgccgcaggtgccggaagccgcctacagcggcccgccgctcagctattacgtcaccaagttccagccggcggtggctgcgccggcgcagaccctcgaggcccccgcccccgacgaggcacaagacggcgccgccgccaccgtcgaggctccggaggtaccggcaccgcagctgtcgtcgtgagctgattcggttttgtggcatgcagctttatactacggatgagccagtagcgcatgatgatggaagatatgatccatgatacaagcatttcggaattgtattaaagtttgtataaaaaaaaaaaaaaaaaaaaaaaaaaaaaagggcggccgccaccgcggtgga

SEQ ID NO: 12459 - DNA, 1125 bp, Zea mays
  misc_feature (9)..(9): n is a, c, g, or t
ttcccgtgngtcgtcccacactcccacccctaccaacgctctgcgccaacgaacgcgtccgcaagtcaaaccaggcccggtgcctcccgcgaccccccccgcacacacaaaagagagggtctggtgtgtggatgattccagtcctcctcctgttctttgtttcccgtcccatcgtgtgtgagcgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtcgggagcctgagcgctgagtggctggccgaggagaggacccaggtcgtcggcactttccctcccaagaagagagggtggaccggcttagtggagaaggacaccgccggccagaccaacatctactccgtcgagccgatggtgtacgtggccgagagcgccatcagctccggcacggcgggtacgtcggcggagggcgccgagaacacggccgccatcgccgcggggctcgtcctcatcaccgtagccgcggcctcgtccatcctcatccaggtgaacaagagccaggtgccgcaggtgccggaagccgcctacagcggcccgccgctcagctactacgtcaccaagttccagccggcggtggctgcgccggcgcagaccctcgaggcccccgcccccaacgagacacaagacggcgccgccgccaccgtcgcggctccggaggtaccggcaccgcagctgtcgtcgtgagctgattcggttttgtggcagctttatactacggatgagccagtagcgcatgatgatggaagatatgtatccatgatacaagcatttcggagttgtattaaagtttgtatatacacatgcattcagctcgcgcattctgtatgcttatttgaattcagacatcacggcactcccaccgcccccgcggtggaaaaaaaaagcggcc

SEQ ID NO: 12460 - DNA, 1195 bp, Zea mays
tcccatcgtgtgtgagcgcgtctgctggtctgccaagaggaggaaaggaaggaggagcaagtagagatggctcgccctgcgcggtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtaccgctctcctcctcttcccttcgccagctgtcttggaactctgcgtgcctcgttgcggcagcagtagtagatagatgcttacgccggcacagcagagagcggaattgaagcagcaacgagaacgagatgccattgccatttctgtggtgcgcatgcatgcaggtcgggagcctgagcgccgagtggctggccgaggagaggacccaggtcgtcggcactttccctcccaagaagaaagggtggaccggcttagtggagaaggacaccgccggccagaccaacatctactccgtcgagccgatggtgtacgtggccgagagtgccatcagctccggcacggcgggtacgtcggcggagggcgccgagaacacggccgccatcgccgcggggctcgtcctcatcaccgtagccgcggcctcgtccatcctcatccaggtgaacaagagccaggtgccgcaggtgccggaagccgcctacagcggcccgccgctcagctattacgtcaccaagttccagccggcggtggctgcgccggcgcagaccctcgaggcccccgcccccgacgaggcacaagacggcgccgccgccaccgtcgaggctccggaggtaccggcaccgcagctgtcgtcgtgagctgattcggttttgtggcatgcagctttatactacggatgagccagtagcgcatgatgatggaagatatgaatccatgatacaagcatttcggaattgtattaaagtttgtatatacacatgcattcagctcgcgcattctgtatgcttatttgaattcagacatcacggcactcccacaaaccattcagttgtaacaaggtgaacataccattttcacgcgtagtatttgaacataatttttatttttttggggctcaaagcgtat

SEQ ID NO: 12461 - DNA, 1307 bp, Zea mays
cgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatcggcggtggccgcaacagcaggccgttcctgctcacctgcaacgcttcctcttctccgtcaccttcctcgccggcgccggcgcatgaagaccccgactgcaacgaggatgagtgcgccccggagaaggaggtaccgctctcctcctcctcccttcgccagctgtcttggaactctgcgtgcctcgttgcggcagcagtagtagatagatgcttacgccggcacagcagagagcggaattgaagcatcaacgagaacgagatgccaatatgccattgccatttctgtggtgcgcatgcatgcaggtcgggagcctgagcgccgagtggctggccgaggagaggacccaggtcgtcggcactttccctcccaagaagaaagggtggaccggcttagtggagaaggacaccgccggccagaccaacatctactccgtcgaggtaacccttcgatacaaatctaattctgcggccacttcactcactgtggtgtaacctcaatctttctgttcctggatacaagatagctttattatacgatacatcacctcctgccatgccaactgatttgcacagccgatggtgtacgtggccgagagcgccatcagctccggcacggcgggtacgtcggcggagggcgccgagaacacggccgccatcgccgcggggctcgtcctcatcaccgtagccgcggcctcgtccatcctcatccaggtgaacaagagccaggtgccgcaggtgccggaagccgcctacagcggcccgccgctcagctactacgtcaccaagttccagccggcggtggctgcgccggcgcagaccctcgaggcccccgcccccaacgagacacaagacggcgccgccgccaccgtcgcggctccggaggtaccggcaccgcagctgtcgtcgtgagctgattcggttttgtggcagctttatactacggatgagccagtagcgcatgatgatggaagatatgtatccatgatacaagcatttcggagttgtattaaagtttgtatatacacatgcattcagctcgcgcattctgtatgcttatttgaattcagacatcacggcactcccacaaaccattcagttgtaacaaggtgaacataccattttcacgcgtagtaattgaacacaatttttttttacaccaacaaaacacac

SEQ ID NO: 12462 - DNA, 1067 bp, Zea mays
cccacttgccacttgggatacgctgacctctgagcagcctcgatccggctcgttcaaacttgaccgaacgcccgccattagctggtggcgcctcctccttgccggagccgcctcgccggcgggtggcgacgctgccgccgctgtcacagggctgctcgcaccacgcgctgcacgtacgctacccagtacccacactccgctccagtacacccaccgagacatctaacccaagcttgatctcatctcgtgcactcctctcccttcccctcctctcctagggttagcaagcttgatcccgtgcgcctgcttgggtgtctgaccgcaccggcgccgagatggtagccgctgcggcggcggtgcggccggtgtccttccgccacctcggcgttctcctccgcgctcctttgccctgcggcctgacaacctcccgcgtcgccgcacctttcccccgccgcacagattccatgaagatttctcaactcccattaacagctacacgattttcaaaacagaataattctggcgaggatgacgagctcctttctgaactaaaagataagtgggatgcaatggagaacaagtcctctcttgccttgtatggtgctggagcaatcctcgctgtctggatatccttggttgtagtgagatctctcgactctgtcccgttgctcccaggcatattggagctagtcgggctcagctactctggatggtttgtgtaccgatacctgctttttcaggaaaaccggaaagaattggccggtgttatcgatgatataaagagaaggattgttggcgatgatgaatagctgtttcctggtttgtaattctatttatctcgccctgtttggttctgaggaattgaaaaataatccaatggtgaagtgagaaagcactttctagttattggttttaattcatggggtccaaacaggctcctgatagaatcttgtaggcttctattcttactagctgagtgcccgtgcattgcaacgggaatatataatatcaatatactacgataatttatattctcttatattgtcataagaaaatgtttcataatc

SEQ ID NO: 12463 - DNA, 935 bp, Zea mays
  misc_feature (914)..(914): n is a, c, g, or t
cgaggccggccgggctggctcgttcaaacttgaccgaacggcagccattacctggtggcgcctcctccttgccggtcggagccggctcgccggcgggtggcgacgctcccgccgctgtcacagggctgctcgcaccacgtgcactcctctccagtacacccaccgagacgcgagacctctaaggctctaacccaagcagattccatgaagatttgtcaactccaattaacagctacacgattttcaaaacagaataattctggcgaggatgacgagctcctttctgaactaaaagataagtgggatgcaatggagaacaagtcctctcttgccttgtatggtgctggagcaatcctcgctgtctggatatccttggtcgtagtgagatctctcgactctgtcccattgctcccaggcatattggagctagtcgggctcagctactctggatggtttgtgtaccgatacctgctttttcaggaaaaccggaaagaattggcgggtgttatcgatgatataaagagaaggattgttggcgatgatgaatagctgtttcctggtttgtaattctatttatctcgccctgtttggttctgaggaattgaaaaataatccaatggtgaagtgagaaagcactttctagctattggttttaattcatggggtccaaacaggctcttgatagaatcttgtaggtttctgttcttaattaatgccagtcagagctacgaggtattggcctttccacaaaaaaaaaaaaaaaagcagctcgacctgttatttgcagaatctttttatttagcatggtctagaaaaattcttgtatcatccgtataaaaaaaaaaaaaaaaaagaaaaaaaaaaaaaaaaaaacctccgaggggggggcccggtacccaattcgccctaatagngagtcgtattacaatttcact

SEQ ID NO: 12464 - DNA, 1300 bp, Zea mays
  misc_feature (682)..(682): n is a, c, g, or t
cattgggtacctcgaggccggccgggctgtctctacactatacagccgggccgcgtccatacggcacgtggtggtgcgcctcctccacacgtacgtactggtttctatctgattccagagcaggcggagttgcggattggctgctggtccgatccagaagctcctagacgatgatggacgtggagtaccacgaggagtacgtgaggaacgcgaggggcgtgcagctcttcacctgcgtctggctgccggcgccgtcctccgcgcccaccaaagcgctcgtcttcctctgccatggctacgggatggagtgcagcgacttcatgagagcatgtgggatgaagctggccacagcagggtatggcgtgtttggtatcgattatgagggccacggcaagtccatgggtgccaggtgctacatccacaagtttgagagcctcgtggccgactgcgacatgttcttcaagtccatctgtgacatggagggatacaggaacaagagccggtttctatacggcgagtccatgggcggagccgtggctctactgctgcacaggaaggatccgaccttctgggacggtgcagttcttgtggcgccaatgtgcaagatatcggagaaagtgaagccgcacccggtggtggtcaccctgctgaactcaggtggaggagatcatcccccagtggnaagatcgtccccaccaaggacgtcatcgactccccattcaaggaccccgccaagcgcgcacaagatcaggaagaacacgctcatctaccaggacacgccccggctgaagacggcgctggagcttctcaggaccagcatggatgtggaagacagtctgtcagaggtgaggatgccgttcctcgtcctgcacggcgaggccgacgcggtgaccgaccccgaggtcagccgcgccctctacgagcgcgcggccagcgccgacaagaccatgaagctctacccggggatgtggcacggcctcaccgccggcgagcctgacgacaacgtggagctggtgttctccgacatcgtctcgtggctcgacaagcgcagtcgccactgggaacccgacgagcgggtgagaagggctccgccggagcctgagaacaagcgccgcgtcaccagcagcagcagtcaacggcccggcagcttcctctgcggactaggctgccgctgccggcaacaccagcaacagtgtagtaggatgtagatatggaaaacgcttgctttttcctcctcctttaagttgttgacaaagaactgagaaaagtcatggtctcaacaaagatcttgttccatcct

SEQ ID NO: 12465 - DNA, 1243 bp, Zea mays
ccacgcttccgtatcaatctaccatacaagggggatgcatctggaatgggctttgaagtaagagcaattgagaataaagaaatcattagtctggccggcagcaaaatacagattgatcaagtcagacttcttgaggagcctaacaaaactgcatactctagaactgtccaacagcttataaaggagcaaccagatggaaccaagtatcctcctgctttagatgcaatacaagatctaaaaatgaaagacatgtatcttgctgaaagttaccgtgcatatcacatactactgcaaaaaatgtctgaaaacaagtgccatggttgtctgctacggaggccccctcccccattgatgagggagcaaaagatgtacaaggatcagttgaatgaattgaaattccaaatgtccgacgaggcacttcaacaaatgccagagtttcaaggcagaattgatgtactaaaggtaatccactacattgattctgatctagttgtgcaacttaagggtcgggtagcatgtgaaatgaactccggtgaggagttaatatcaacagaatgtctgtttgaaaatcaattggatgacctagaacccgaagaagctgtggctattatgtctgcattcgtcttccaacaacgcaatgcttcagaaccatctcttactccaaaactggctgaagcgaagaagaggctctatgatacagccataaaattagggaagctccaatccgagttcaaggtgcctgtggaccctgaagagtatgcacgtgataatctcaagtttggccttgttgaggtcgtctacgagtgggcaaaggggacgcctttcgcagacatatgcgagctgactgatgtatccgaagggatcattgtaagaacaatcgtccgtctggacgaaacatgtagggaattcaggaatgcagcttccatcatggggaactctgcgctgttcaagaagatggaggtcgcgtctaacgctattaagcgtgacattgtgtttgcagcaagtttgtatgtcacaggaatctgatgcatgtaacctcgtagtctcccttgcttcttttgttagagaaatcgttgtgctggtggaatgctactaacctaaccttagctagaacaattgttgtggtatttttttttccaagctcgagaaaaaaaaatttgctagttttgcgaagtttctgaagcggcgaccagcagagtaaaggaaaatcgaaagcaggtgggattctcgttttttcactgag

SEQ ID NO: 12466 - DNA, 1414 bp, Zea mays
gacgtgggcattggcaaatcgcgggggccctcgtggttgggacccgcacgcccggcccgcccattccataccccaccttgcgtacgcgagccgaacgctcgtgggtactgcagcctccgtccctacctagggttccggcgatggcgcacggcggctacccgcgccgcggcgctgccgtacgcaggcccaagtcctcggcctctgccgctgttgccgaccgcaagcggaagcggaccgccgccgccgccaagaccacctcccttaagaaccagatccgctccaccgagcgcttcctccgcaaggaccttccggatgagattagggttgctcaagagaagaaactggaagaactgaagaggcaacaagagcttcagaatcaacttgttgtccagcggacattacagtttagagatagaaagataaaattctttgagagacggaagattgagaggatgataaggcgactcgagaagcaacaacgttcaaatggtgacggtgtcaacaataatctgtcaaaattgcgagaagatcttgaatatgttagattcttccctaagaatgagaaatatgtctcgctgttcactggagggaacagtcaagatattgttcaagagaggaataaatggcgcaaacagatcaaggagaatctcatggctgctgcagcaaacggaaaagatttagaagagacagcaagcgacgacgataccttggatgtgagtgatgatgacttctttatgtctggaagttcaagtgatgaagaggctgatgatgagtggactgacaaaagtgctaaggaaccagcatccagtgcttcaggtagggcagcatctggcatgtcaagtgatgaaaagaaccagcgtcagagagatgctcgagttcttatgccgccaccacgctcattagccccaaatagaggcagacatgcagataaacgtgcgatatccagctcgagcagtacttcaaacagcacaagcggcgaatcatttaaaaatagaagagtaccaaatcgtcccggggataataacagtaatctgagctcaaattctgatgttcataaaccacggcgcaaaaggaggcataagaagaaaagaaagctgcaggcatgatgaatattcccaaagcgcgtgaactgtgggggtccggtggaaattcagattcccagcgaagtttggactttgagcatggccaatttggagaagttgaaaaaaaaatagacacagcatgtgcgatgtgtctgagcaagttgattgattctgtatcctcactcctaaaacgactgtacatccatctgttcatggatatcacttgcggtaccgaatgcttgtccatcatttccgccgtgaaattatgtatgtttttttctctcccccgatggtctccgatgattctgtggtacttgggaagcgcggaacag

SEQ ID NO: 12467 - DNA, 1438 bp, Zea mays
ccacgcgtccgaaacacgcatgaaggcccaacccctcgcgcccgcccacgggcaaatggcgattgcatttttggtgctaaaccgcacgacccactcggcccattccatgccccaccttgcgtacgcgagccgaacgctcgtgggtcctgcagcctccgtccccacctagggttccggcgatggcgcacggcggctacccgcgccgcggcgccgccgtacgcaggcccaagtcctcggcctctgccgctgttgccgaccgcaagcggaagcggaccgccgccgccgccaagaccacctcccttaagaaccagatccgctccaccgagcgcttcctccgcaaggaccttccggatgagattagggttgctcaagagaagaaactggaagaactgaagaggcaacaagagcttcagaatcaacttgttgtccagcggacattacagtttagagatagaaagataaaattctttgagagacggaagattgagaggatgataaggcgactcgagaagcaacaacgttcaaatggtgacggtgtcaacaataatctgtcaaaattgcgagaagatcttgaatatgttagattcttccctaagaatgagaaatatgtctcgctgttcactggagggaacagtcaagatattgttcaagagaggaataaatggcgcaaacagatcaaggagaatctcatggctgctgcagcaaacggaaaagatttagaagagacagcaagcgacgacgataccttggatgtgagtgatgatgacttctttatgtctggaagttcaagtgatgaagaggctgatgatgagtggactgacaaaagtgctaaggaaccagcatccagtgcttcaggtagggcagcatctggcatgtcaagtgatgaaaagaaccagcgtcagagagatgctcgagttcttatgccgccaccacgctcattagccccaaatagaggcagacatgcagataaacgtgcgatatccagctcgagcagtacttcaaacagcacaagcggcgaatcatttaaaaatagaagagtaccaaatcgccccgcggataataacagtaatctgagctcaaattctgatgttcataaaccacggcgcaaaaggaggcataagaagaaaagaaagctggtataactttgcatccacaccataaacccttcttttgtgccactttttatggacatgtttcagaaaacataggatgaaccgtgtctgaaacttccgtgtatcctttttttttcaatcttcactatgggttccgagctcattcatcaccttatatggctacttctgcctaaactgtgaattgtttatccaattgtggtgccttggacactgctgtgaaatctatattttggtaaccatcaaaaaaaaaagctatcgaagtttatccattgggttttatagagatcataagttcaccgccaccc

SEQ ID NO: 12468 - DNA, 690 bp, Zea mays
tcccgggcggcccagcctcctgatgagtggactgacaaaagtgctaaggaaccagcatccagtgcttcaggtagggcagcatctggcatgtcaagtgatgaaaagaaccagcgtcagagagatgctcgagttcttatgccgccaccacgctcattagccccaaatagaggcagacatgcagataaacgtgcgatatccagctcgagcagtacttcaaacagcacaagcggcgaatcatttaaaaatagaagagtaccaaatcgccccgcggataataacagtaatctgagctcaaattctgatgttcataaaccacggcgcaaaaggaggcataagaagaaaagaaagctgcaggcatgatgaatattcccaaagcgcgtgaactgtggggggtacggtggaaattcagattcccagcgaagtttggactttcagcatggccaatttggagaagttgaaaaaaaagaagacacagcatgtgcgatgtgtctgagcaagttgattgattctgtatcctcactcctaaatcctgatgtaaaacgactgtacatccatctgttcatggatatcacttgcggtggtcagatcttgccagtgtaccgaatgcgtgtccgtcatttccgccgtgaaattatgtatgcttttttcccaaaaaaaaaaaaaaaaaagggcgctcgagaccctcgtgaa

SEQ ID NO: 12469 - DNA, 1833 bp, Zea mays
gtgcctcaatccacgtgtggtcagcatcttcaatggtgagagactaatatacatctgacgcaatgtgaagtaatgattaatctatggggcacggggaagtcactgtgtttgtcgttggcggtgagataaactgtcgtaacaccgcccagttaaggaacatttcactggaagagagatcaaacgaggtcggataccaaaagaccaaaccggaaggtgttttaatactacaatcccaattgccatattcaggatactaaattttagaagcccggtcattggaggagcttttggttaaaaaaaaactctctttcgacgtcctctttgcagtcgatctgaaaaattacagtctacagtttacagccatgttactctccggccgccaccactgccaccacaaattcaccccttcctcaccgccggccgccttccgctccacccatctccgcggtctccggccgcttcggcccctagcccttgcatccgccaaccctcctccgccaccgtcgccactaccttccctattcccgtcgccaaggcgtccatggcggtggcggcacagcgccagcgacgttatcgaagaccttcctcctgtcgaggccgatggaaacgacgccgtcaaggtcaagaagagcttctgggcagcggtgagcctcatcatcggcacggcggtcgggccgggcatgctgggcctgccgtccgccaccatccgctccggccaggcgccctccgcggtctgcatcctgctctcgtgggcctacgtcgtgtcctccatcgtcctcgtcgcagagctcagcttcgccgccatggcgcgtgacggcgtcgacgaggtcagcttcacgggacttgcgtcgagcaccctgggggcgggccctggcgcggtcgtcgctgtcgtgtacgccgcgctcagcttctccctgctcgtcgcttgcgtcgccggcatcggctcgctcgtctcccagctgttccccggggtgagtccggtcctggccaacgccctgttcccctgcttcgccggcgtcctcatcgccttcttccctttcaaggccgtcgacggcgccaaccgagccctctgtggcctgatgcttgtttccattaccgctctcgttgtgactggcgtgtccgtcggtcggaccagcttgctgggatctctcagctacgcgtgctggagcccaggcgcgatcctgccggccataccggtgaccgtgctcacgctcgggttccatgtcatcacacccttcatctgcaagatcgtgggagactcggtgtacgacgctcggaaggcgatactgattgggggcgctgtgccattggccatggtgctgtcatggaatgccgtcattctcgggctggctagtgctggcggcaatgctgggtttgatgaccctatcaaactcctcctctcagtgaatccagccgcgctgcctgctgttcgaggcttcgcttttgctgcactggcgacgagcctgatagggtacgcagtgagctttccgaagcagttggcggacacagtggagctgattcttcagaggttttctcagaagcaaggaagcatgcaccaagctaatggtagcggtggatatggcagaaatggggcgattcttacatggatggtgctgatcattcccatctttattgcgtcgttcttctcagcagtcttctccaaggcactggattttgctggggtttatgcaaactgcttcctgtttgggatcctgcctcctgttatggcctggatccatcggtcacagaagaaaaggaggtaagctatggcatacagtttatagctgccaacattagtagtacaattgtaaaaagttaaacgaaacatttgca

SEQ ID NO: 12470 - DNA, 1754 bp, Zea mays
gaaaaattacagtctacagtttacagccatgttactctccggccgccaccactgccaccacaaattcaccccttcctcaccgccggcctccttccgctccccccatctccgcggtctccggccgcttcggcccctagcccctgcatccgccaactctcctccgccaccgtcgccactaccttccctattcccgtcgccaaggcgtccatggcggtggcggcacagcgccagcgacgttgtcgaagaacttcctccggtcgaggccgatggaaacgccgccgtcaaggtcaagaagagcttctgggcagcggtgagcctcatcatcggcacggcggtcgggccgggcatgctgggcctgccgtccgccaccatccgctccggccaggcgccctccgcggtctgcatcctgctctcgtgggcctacgtcgtgtcctccatcgtcctcgtcgcagagctcagcttcgccgccatggcgcgtgacggcgtcgacgaggtcagcttcacgggacttgcgtcgagcaccctgggggcgggccctggcgcggtcgtcgctgtcgtgtacgccacgctcagcttctccctgctcgtcgcttgcgtcgccggcatcggctcgctcgtctcccagatgttccccggggtgagtccggtcctggccaacgccctgttcccctgcttcgccggcgtcctcgtcgccttcttccctttcaaggccgtcgacggcgccaaccgagccctctgtggcctgatgcttgtttccattaccgctctcgtggtgactggtgtgtccgtcggtcggaccagcttgttgggatctctcagctacgcgtgctggagcccaggcgcgatcctgccggccataccggtgaccgtgctcacgctcgggttccatgtcatcacacccttcatctgcaagatcgtgggagactcggtgtacgacgctcggaaggcgatactgattgggggcgctgtgccattggccatggtgctgtcatggaatgccgtcattctcgggctggctagtgccggcggcaatgctgggtttgatgaccctatcaaactcctcctctcggtgaatccagctgcgctgcctgctgttcgaggcttcgcttttgccgcactggcgacgagcctgatagggtacgcagtgagctttccgaagcagttggcggacacagtggagctgattcttcagaggttttctgagaagcaaggaagcatgcaccaagctaatggtagcggtggatatggcagaaatggggcgattcttacatggatggtgctgatcattcccatctttattgcgtcgttcttctcagcagccttctccaaggcactggattttgctggggtttatgcaaactgcttcctgtttgggattctgcctcctgttatggcctggatccatcggtcacagaagaaaaggagatctcctgattcatgtgaagatgttctacctggcgggaatgctgctctgctgatacttttcgctgttgctgttgtcctagcaatctggcactagtagaaggtaagcacaccagggactcattctgtttgtttgccagactgttcgtcagtgaactgaaagcactgaggtggttagaactttgaggttttgaatgttcatggcatcaatgctttatagttcctctccccgtatcatgattttcttctttgtttgtcctaagttggacgctaactaactatttacccatttaaatgtctctttggtaagattctggtgaaaccgactgtct

SEQ ID NO: 12471 - DNA, 1329 bp, Zea mays
  misc_feature (1294)..(1294): n is a, c, g, or t
  misc_feature (1302)..(1302): n is a, c, g, or t
  misc_feature (1304)..(1306): n is a, c, g, or t
  misc_feature (1320)..(1321): n is a, c, g, or t
ccggcgtgacagaggcatagagcaaaagccaaactggcagccagcacagcagagcgccactcgactcatcctttcggttcccctcccccctccgcgttccacaaccctcgagaagcttccaccctcccctcctgcgacgccgccagagccgcggaaaccctacccaccccggccgctcacgcaccgggcgcccgcagccgccggtcgcgtgcctgccgccgacaccgcccaaagcgattggatctcgagatcgtcgaagccacgatggaggactgggattctgaagaattccagccagttgtgcctgttgtgaaagccgagccacttaaaaatcagtgggctgatgaagatgttgaagaagatgatgtaaaagaatcatgggaagaagaggaggaggaggagaaacctaagccagcgccagtggaaaaggtcgctgcaaaacctagcactaaggctcctgctaaaaagggaaaacagcaagcattgacaagtgctgaagaaccagatgagcctcctcttagtcccacttcacagaaaattcgccaacaaagacttgtggaagaagctgacttcaagtcgaccaccgagctttttgcaaagaagggcagtgagcaaaagtcactagatacttttattccaaagtccgagagtgactttgcggaatacgcggagcttattgcaaacaaactacgcccctatgagaaaagctttcactacatggctctgcttaagaatgtcatgagactttccatgacatcgttgaaaggtgcggacgccaaagatatatcttcttccgtgacggcaattgctaacgagaagatcaaggctgagaaggaggctgcagcaggcaaaaagaaacaaggagcgaaaaagaagcaactccacatcgagaaaggagacgacgacttcatccccggccggggtggtggctacgatgaccccgatgagtacgacttcatgtgatctggctgggagggatagtaggtttctgttatgtatacctttggcgggcagagaatatatcactagagtttgcggcatactattgcatggaacatgcgttatctattcgagaatgatttttgactctgcaggataagaagagcacttgtgatctggatgcatgggtgttttcttatttatccttgaatctttgtgttatttttttttcaacattgcattttttgccaaatgtactatagtaccttccacgctctggttactccgtgagtcatgaaagcaattaaaccccaaaaaaaaaaaaaacttgtgtttgcaaaaaaaaaaaaaaaanaaaaaaanannnaaaaaaaaaaaaanntttcttag

SEQ ID NO: 12472 - DNA, 929 bp, Zea mays
ggatggtttctctcgtacagcgagagccacacacacactgcgacctcctaggcagtgagtgcagacgtgcagtatgactcctctcgctccttccattcacgcaagcgcaagtgcgcaacttgctgctctcgctgtctcagattccctgctacgccgcctcctccgcggctccgccaccagtctcccctgcaaccgggaatccgggataagaggaagagaaaccgcgcggcaaaaggaaaggagtacaggagcgagaaaagaatctctgaccggagtcctgccaggctgatagaatcctggcagccatggatatactgctaggttctgggagattcttggcgcgacggactcccctcatgctcgtccctcgctgctctcgaggctcccgggacagaagcggcagcgacaaaggtgaaacctctgctgactgggacaaggcatgggctaagttcaagaagaaagggaagaggaccctcttttctgatttctcaccagacaagtatgtgacctggaacccacggcgcagcgagtatccgttgtcagaagaggttgatccaatcaagagaactgaaagatctaacttgatgctttggacgagtccccagttcacgttggtgggggcgattatcatcgtcttgacattactaatctacacactagtcgttcctcccaagtaactgcacaagtgacagctaggaggtgagttgtaaatcaatattatttcaaatgggaagtctggattgtacaatttttacgtgcattacaccaactacagtagtattgcctccattgcaacctagttgtatattaagttactcttcattccatcgaagaaatatttgggggccaggtacaataatatgttggtcggtattcaataaatcataatacatgctgatgctcctgattcaaaaaaaaaaaaaaaaaaa

SEQ ID NO: 12473 - DNA, 2402 bp, Zea mays
  misc_feature (2283)..(2285): n is a, c, g, or t
  misc_feature (2287)..(2287): n is a, c, g, or t
  misc_feature (2290)..(2292): n is a, c, g, or t
ctggccggacttgacctcgaacctcttgggctcgggcgccttgaaccccggcggaggcttgaactcgggcgtcggctcaggcgcggaggtggagacggttgcggcggtggtgtccggctgggccctgacggcgagagaagcggccctggcggcacgcgcggtggcggtggcacccaaggcgacggtgcgacgggggaggaggaggggcgtgcggtggtgcagcgcggtgggtgcggcgggcggagccatggattggattcggcggcgacggcgactcgggccggacggcggggagcggcgtgcgagtttctgtggcgcctacgcggcgagacgcggggacgaagcgattggtgtacctgctgctagtgcaagtggagtgggtgggcccggtctgttaaatggagtaacgaccaccggtgataggttagccagccactgacatgtgggacaacagacggcccacaaactcccgctcgactggggatctttgggtcggcgcaaatccctttcaacattcgtgggcggggcggatgacctggagctggaggttcgtggtagcggccgccgccggccatggagaagataaatcggattctcgacctgcaggacctcctctctgacgcggacttcggcccactactcgcccgacagctactgtctccgttcgtgcggcggccacctacctacctcgtagcaagacaccgtatcctaagtgctgccatggatttgcacctagagctctacattggtcgccggcgccgcggcggaggcaagactcagaagtaccctccccctcccatgggaggcaccgtgttccagctgctccacttctgtcggcttgatggagctcctgatggatggagaggagaggagctcgcccaacaggtactctcaccctaccaggctatttttcttttatggaatttataattgataatctattttatacattcagaagcatcagatagcatgcattatatgccaatgaaatttccttcgtggagagtttgagtagcttgtctctgatgcttatcaatgtccctttcttattttttttctccttttttaattagatagacgtcgccgtgggttaaatatcttgtgtagtcatttgttaaggcgagaatattgttacttctcagacatgtattagtagcttgtctctgatctggtagtaacatgataacaattattaattctgagaaaaaaaatcgtacgtacattataacattcggagtgaagtcaatattatgcatcagtaatattgtataaaaaatttagccaccttactttgatgtatgttacatgatttaatcatgaacaaataaataaaaaacggggaatgggaggtaattatggtggttgaaagaaaaaaacgatattttatggtggcggtgaggttaagatagagggaatggttgacgaagatattgaaatactgattgcttccgttcttttataaaaaaatagaatatatggtgagaaatttagaagatagccttagcttccgttgttttatccgcagccacaagttttgctctgcgtctcccaagttcccgatctcggccgcgcgagtcagtgcaccccgtgcgtgatcaacaggtccttcctgctgccgcggccgcctcccacttcgactgctcccgcacctttcgttcacgcaagcgcaacctgcttctcccgctggctgtctcggacaccccctccctcctgccacgcatcctccccgcccacgagtctcccccgcaaccggataataaggaagaggaagagaaaccgtgcggtgcggcgaaaggaacagtgaaaaaggaagaatctctctgatcgaggttcctgtccggcttgcagaatcttggcggccagccatatatggatgtactgctaggttccgggaggttcttggcgcgacggcctcccctcgcgctcgtccctcgctgctctcgaggctccccggacaaaagcggcagcgacaaaggtgaaacctctgctgactgggacaaggcatggtctgccttcaagaagaaagggaagaggaccctgttttctgatttctcaccggacaagtacgtgacctggaacccacggcgcagcgagtatccattgtcagaagaggtcgatccaatcaagagaactgaaagatctaacttgatgctgtggacaagcccccagttcaccttggtcggggcgattatcatcgtcttgacattgctaatctatacactagttgttcctcctcccaagtaactgcagaggtgacaactactagggggggggggggggggnnnanctnnnaactagtactatttcaactggggaagtctgtattgtacattttttacgtgcactatggcaactcactatagcagtattgattcaattgcaatcatgtagatacaacaccg

SEQ ID NO: 12474 - DNA, 1996 bp, Zea mays
cgactaataaaaagaaacggagggagtatatagagactaaactttagttgggtgtaatcaaccacctatatctgacttcacctatctacgtgagggctgaggtggagtcctttcaactcttagattcacccaacacttgtatccacggttgatttgtgtatttcttgtggttcttttatagtccctttccctttatagtgagcagttgcagaaagtttatacataaggattttctagttgcacacggtccaaactgttttaaaaccagcgcgcaccagacaagaagaccagtacgtggtacagtgcgtgcgtcgcacacggtccgctcgcgcgccacgcccacttggcccgccgcccctgtgcccgtggcccggccacgtcccctcctccgtcgtttccgcggcccgatcggcgacctcaccacgtccgctgctctgcaccccacccccacccagcggcagcgtgtaggataagccgcttgtggccgcctcgccttccccatcacgaccaccacccaatcaccacgccagcttatatgccccacccggcgccactcgggccgggacggagaaaaagaaagaggagctcggacaaggcagagcgccatcgttcggtttccttgctgaattcccgatcgctcgctcgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaaggaccaactggtggagacggacccgctcctcaacaaggtcggcgccgcgccggccgccgcctcccgcgccaagacgaccgccggcaagaaggctgccggcggcgacgacagcggcagcggcggggggttcaacctcggcggcctcggcgggctcttcgccaagaaaagcagctgaacgtgccaagtgtggcgtggtttatggattgtcgaactcaaagctggatttggcttttgagggggaaatggttgcgcatatatatttgtggacgtgtggtggtgtgaccagtgatctttgatgtcataatgtgatatactctacttccagctgcaaaaaaagaaatttaaacaggactaaattatgctctcaatccatatggattggatgagattgagttagtttaattttcaaacagcggccaatctttcatatttttttctaatctcgtccaattcaataggaataaccgaaccaaacctaattatgacaggcctaagtatgacagatgggttattaaaatggttaagctacttagctgatcatgtttgatttatgtctgatcttactttactcttgggtgcaaataatagcttgggaaccactgaatctagatattgattgcctttgctgtgccagtttacagtttaggaattatggacactacttaatccagacatgtgtatatatcagtctcagataaatagatttatctctctttgagagagacaataaacccaacaacccaacagaagtattggtataaaccgaatcaatcggtgatgtgttttttttaccatgaattcctgaagtgggcccggttggcaaccatgtcggaaacacaaatccttcctttattgtgtactataataatcgttctgctcaatttcttgatcagagtagtggagtactggagttccagttgctgattgaccttgcagagttcctcctgccttggcatcgtcatgttacaaaactgagggcacacaacacatgttgtaccctttgaatggagggaagggatgtaaaatttatgaactctggacatatctctgtacagttgataggaacaatggtgatatctctgtacagttgataggcagagcttgcgcagtagctcttcatgctacagcttacaaccacacaggg

SEQ ID NO: 12475 - DNA, 839 bp, Zea mays
tgggaccctcgaggcccgcttgggtcccccgggcccggcccggacggagaaaaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacccgctcctcaacaaggtcggcgccgcgccggccgccgcctcccgcgccaagacgaccgccggcaagaaggctgccggcggcgacgacagcggcagcggcggggggttcaacctcggcggcctcggcgggctcttcgccaagaaaagcagctgaacgtggcgttgtttatggattgtcgaactcaaagctggatttggcttttgagggggaaatggttgcgcatatatatttgtggacgtgtggtggtgtgaccagtgatctttgatgtcataatgtgatatactctacttccagctacaaaaaaaaaaaaaaaacaagcccctagcgcgctccccaccgcaccgagctcactccccctttcgccttcgtcccagatctcaagcccgccgcagagaacgacaggacccaaaccccaactccacaatgaggccgtcgctgatgagatccacctcccagctcctccgccgccggaactactccctccgcat

SEQ ID NO: 12476 - DNA, 757 bp, Zea mays
cctcgaggccggccggggcaacgtcttcccccccgtgtcaggacggagaagaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacccgctcctcaacaaggtcggcgccgcgccggccgccgcctcccgcgccaagacgaccgccggcaagaaggctgccggcggcgacgacagcggcagcggcggggggttcaacctcggcggcctcggcgggctcttcgccaagaaaagcagctgaacgtggcgttgtttatggattgtcgaactcaaagctggatttggcttttgagggggaaatggttgcgcatatatatttgtggacgtgtggtggtgtgaccagtgatctttgatgtcataatgtgatatactctacttccagctgcacctgtgatttttttttcacggacttcgttttgatctcaatccacgtggattggacgagattgagttagtttaattttctaaccagtcaaaatctttcatatttttttc

SEQ ID NO: 12477 - DNA, 2554 bp, Zea mays
  misc_feature (2529)..(2529): n is a, c, g, or t
cgggcaccacccgttgaagtcgaagagaggcatgcgctcgggaggtggttggctgcttcatcatagtccgtagccgcctgcgaggcccttcatatcttagaagaggaggaggaggagaagaagagcagggagaggagccaggcgcgcctctgcagcgatggaagtggcggacgaggtggtgcgggtgctcggcgccgggttcgacctcacgtccgacttccgcctgcggttcgccaaggccagcgaggggcggcgcctggtggagctcggcgaggacacaagggacgtgccgctccccggcggcggcggggccacgctccgcggggtgccgcgcgacgtcggcgtcgacaagggcgaccgcatccgcttccgctccgacgtcctcgagttcaatcagatgtcagaattgcttaatcagaaatcttcagtccaagggaaagttccttcaggctattttaacgctctctttgaattaagtggagcttggttgactgatgccaaagacaccaagcatctagcattcgacggatatttcatttctttgtacaacatgcacctaaaggcttctccattagttcttcgagatgaagtaaaaaaggctgttccatccaagtgggatcctgttgcattatcatggtttatcaagacttatgggacacacatcattgttgaaatgggaattggaggtcaggatgtcatatgtgttaaacaaagtcattcttcaacagtttcaactgctgatcttaagttgcacctggaggatcttggcgatttcttattttctgatgggaagaaccactccccaatacatcgtaagacaaaggatggcaagagcacggtgcctgatgtttttgtcaggatagtgcagcattctaataacctgcacctttctagctactctgaaacatcaaccaaggatggactgacagttaccggttcctcgaggccggccggggcatacctacccaaccactccaaatggctgcaaacagtgccaaagaaacctgatgccattatgtttaaatttgtccccatcacctctcttctaactggtattcctggcagtggttacctcagccatgccatcaatttatatcttcgctataaacctgatcttcaagacttgcaatatttcttggagtttcaagttcctctacaatgggcacctatgttcaatgagcttgtccttggacctcaaaggagaaaaggctcgtacccttcaatgcagttcagatttctcggccccaaactccacgtcagcacttctcaggtatctagctctcagaaaccggttgttggcctacggctatacctggagggcaggaagtgcaaccggttggccatccatgtccagcacctctccagtgttccaagcatgatcgcagactccgtggcgtcttcaatgtcagaatggcgcgagtcccaggacagcgacccagggtacatcgaggcaatccagtggaagaactactcgtgcgtctgcacctccgccgtcaagtacaacccggagtggcacaagagagcccccggcggagtgttcatcgtcactggcgcccagctcgtctcgaagggggcctgggccaagaaggtcctccatctgcgcctcctctacacccacatccccaactgcaccatccagaggaccgagtggaggaacgctccggcggcgtctcagaaggggagcttcctgacgacgatcagcacgacactgagctcccctttcacgcagcgtgctgacacccaccaggcgaaacatgagccggcggtgcagctgaactcaggtgtctaccccgacggaccgccggtcccgctccggtccaggaagctcctcaagttcgtcgacatctcggaggtggtaaaagggccacacgacgtcccgggccactggctggtgatcgcggcgaagcttgtgaaggagggagggaagatcgggatccatgtgaagtttgcactgctgggctatgaagggcagtcgcagggtaacagtttcatgagctgaagcctttgtacataacaacggctggttctgatctttgtagatttcaggattttggaagaagcacaggattaggatttttaatactgggattttttttttttttgtggggagtcgacaggaactgtgtggagggcagtcggaaaatagaccaatcaccgctttgttaggaatgcctgtggaattcccgtggcagtataattagagcacgtagttgtaaattgctcctttgttgtacaaggtgtgttttatttcagtaggaaacacctcagttaagaattactgtgccgatattttcatttatatttatatgttgcaaaattacgaccctttgaataaaaatctaatgacatcaattttgtataaaaaaactatatagagaggatgtgaccataatgcacatgtgcacgcatacgccgaccatacgcacacccacggtctgtcgtttacaagcagatgctaggtgtaaataaggctgcaagaacattaaccattttaccctatattttgttacatgtttgattccaatagcnccaatctcctaaccgaccaaaggat

SEQ ID NO: 12478 - DNA, 3430 bp, Zea mays
  misc_feature (773)..(773): n is a, c, g, or t
  misc_feature (1016)..(1016): n is a, c, g, or t
  misc_feature (1773)..(1773): n is a, c, g, or t
  misc_feature (2903)..(2903): n is a, c, g, or t
tattctctgcatattgcagttcttgacactgagaactatagaccaaggatttttttcgtcagaactttataattttctcttacatttaacctattatggtttaaaaaaatgatgaacttacctagcaaatcgattttacaaaccacataaatacaacaaaatgttgttttgatataaaacctgctaaccttgtgaatatcaggtttatcaagacttatgggacacacatcattgttgaaatgggaattggaggtcaggatgtcatatgtgttaaacaaagtcattcttcaacagtttcaactgctgatcttaagttgcacctggaggatcttggcgatttcttattttctgatgggaagaaccactccccaatacatcgtaagacaaaggatggcaagagcacggtacaactatttctgtcttcagtttgcattatcatatattggaccaaaatttagctaatctgatccatttcgttacaggtgcctgatgtttttgtcaggatagtgcagcattctaataacttgcacctttctagctactctgaaacatcaaccaaggatgtatgtattttcttatatgacttagtatcaattcgttgtctcttggtatggtgaaaaaaattatatgtccgctattccaaacagggactgacagttacctgttcgaagaggggaggagaagcatacctacccaaccactccaaatggctgcaaacagtgccaaagaaacctgatgccatttatgtttaaatttgtccccatcacctctcntctaactggtattcctggcagtggttacctcagccatgccatcaatttatatcttcgctgtaagtcatgagaacatgtctttttaaaaccgttatcgtattgctctttttagaacaactgcattttacttaccaataaaatatttgcttagaatgttattcactgagaacaatcttacaaggtttgttttcccagataaacctgatcttcaagacttgcaatatttcttggagtttcaagttnctctacaatgggcacctatgttcaatgagcttgtccttggacctcaaaggagaaaaggctcgtacccttcaatgcagttcagatttctcggccccaaactccacgtcagcacttctcaggtaccagaatgttaattgacatttttagatttaagcgcattgttttgttcgttcattcaccttttattttattatttatgttcccaaatggtaagtttagtctctgtctctgtgaggactgaaataaaatggcaagttgttgacaatttggacgtacagtattttcatttaattgtcattctcctctgggagaatcacttcatttaagtaaagtaacagtttgtaccaatttatgcacatgtttttgctctcctttgttgtttcaaggtatctagctctcagaaaccggttgttggcctacggctatacctggagggcaggaagtgcaaccggttggccatccatgtccagcacctctccagtgttccaagcatgatcgcagactccgtggcgtcttcaatgtcagaatggcgcgagtcccaggacaacgacccagggtacatcgaggcaatccagtggaagaactactcgtgcgtctgcacctccgccatcaagtacaacccggagtggcacaagagagcccccggcggagtgtttatcgtcactggcgcccagctcgtctcgaagggggcctgggccaagaaggtcctccatctgcgcctcctctacacccacatccccaactgcaccatccagangaccgagtggaggaacgctccggcggcgtctcagaaggggagcttcctgacgacgatcagcacgacactgagctcccctttcacgcagcgtgctgacacccaccaggcgaaacatgagccggcggtgcagctgaactcaggtgtctaccccgacggaccgccggtcccgctccggtccaggaagctcctcaagttcgtcgacatctcggaggtggtaaaagggccacacgacgtcccgggccactggctggtgatcgcggcgaagcttgtgaaggagggagggaagatcgggatccatgtgaagtttgcactgctgggctatgaagggcagtcgcagggtaacagtttcatgagctgaagtctctgtacataacaacggctggctctgatctttgtagatttcaggattttggaagaagcacatgattaggatttttaatactggattttttttgtgtgtggagtcgacaggaactgtgtggagggcagtcggaaaatagaccaatcacctctttgttaggaatgcctgtggaattcccgtggcagtataattagagcacgtagttgtaaattgctcctttacaaggtgtgttttatttcagtaggaaacacctcagttaagaattactgtaccgatattttcatttatatttatatgatgcaaaattacgaccacaactaagtatctttaaataaaaaactgcgtcgcccagcagcaggcacgccaggtcaatttgatatcaagttgtagtcaagataacaacatcaactgcaaggaggatggtggtggggaggcgtccgcgctttgtatttatagcggttcatgtcccccgccctcgatgtggtgcgggcgccgaggatttaggtcgctgtcgatggaaggtggcgtcgacgatggaatgggattcggccatttccttgaatggagtgagggctccgatggtagaggtagcaatggcccgtgggattgcgtgaatagcgggggcgaggctcacgcgcgcccgtagcaggccacgcccgcgagaggatgacagagctttgtgtttccatggaaggtcgcaattctggtaggcggcgctcggtgtttccatggaaggtcgcggggttgcgagcgcagaggatggaaggancggggacgcggcggcgtgaatggcgtcgcgtcgaccgagatttgcatggcgcggaggatgacagagccgggggcacgggcgcgtgagagtttattggagctgaggtatcccgaacggctggcttcggaagttaggtacccctaaccttgcaattagaatcttagtattataactaggtgagtgtccgtgcgttgcaacggaatcatataataacacgataacttatgtacatatgtgtgttataggtgtatgcccgtgcgttgtcacgaaagtcaaaatttagtactctatctgttctaaaatagtaatcattttagaaaattagtgaattcaaacaatactgatgtatatgttttatagttagatacccgtgcgttgctacgatttctatatatatcacacaggtagacattatagcctttgatgattcattcacgcactccatatacatgcacaagttttagtaaaatatataaagactatcttaaacttttgatgcaatagctcaaagcataataacttggatc

SEQ ID NO: 12479 - DNA, 2010 bp, Zea mays
  misc_feature (1845)..(1845): n is a, c, g, or t
  misc_feature (1864)..(1864): n is a, c, g, or t
  misc_feature (1950)..(1950): n is a, c, g, or t
  misc_feature (1966)..(1966): n is a, c, g, or t
tttattcggcacgaggacgcgccaccccgacggggcactgctcacgggaaagagagaggattcctccgccgcgtccgcgttggactggacagctcacgccgctgcgaaagcaaccagccagagccagatccgtcggttccaacgaaacatccattcacgcccgccaccggcatccccatctccgatccgccgcagccgcagtcgcaggcacgtcctcctctccggccacccggcgcgcggcagccagcgagcgagccactgtggtcgccgtgcaggtacctaatttttgcagcccccacaaagtcagagggtgggggcaaaaaagaaagggggaagacacaagacagtcacagagaggtgcgcggccaacttgcctggtgcgggtggtttcgggcacgggcgagcgccatccgctcgctgccgatcccaatccggccagcagcggccgccccgccaccgggcctccctccgaccgttccccccgcccgccatggcgggttccatggtggaccgcgccaccagagacatgctcatcggcccggactgggctaagaacatggagatctgcgacatctgcaaccgcgaccccgggcaatcgaaagatgtcgtcaaggcactgaagaaacggattggccacaagaatccaaaagttcaacttcttgcgctaactctgttggaaactgttataaaaaattgtggggatatacttcacatgcatgttgcagagagagatatattgcatgatatggtgaagatagtgaagaaaaagtctgatcctcgtgttaaagagaaggtattggtgctgatagatacatggcaagatgcgtttgggggaccacgtgcaagatatccacaatactatgcagcataccatgagttggtgcgtgctggagctcaattccccaagagaccagagaaacctgcacctttgtttaatggccagtctcaggcagcaaggaatatgcgtagtcctgaccaacaggaagcggaatcttctgctgccaatgattttcctgctttgagcatgtcggagattcataacgctcgtggtattatggatgtacttgctgagatgctgaatgctttagacccaggaaacagagaggggctaaggcaggaggtaattgtggaacttgtggatcaatgccgcacttacaagcagagagtagtgcagctagttaattctaccacggacgaggaacttatgtcgcaggggctcacactgaatgatgatttgcagcgtgttctagcaaaacatgatgcaatagcagcaggcattgcagtccgagtggagaaaaaatcgaagtctttgcaagcacttgtagagaccgaggattcgacaaaccaggattccaaaaaggagcaaggactcatagatattgaggatcccacaagtcaagatgctgcaaaagatccaaatcaaagtacaagtgaccaatctccttttgagcaattagctcttccagcaccaccagtgtcaaatggcgcagcaacctcagcaccacaatctgatcttggcattgatcttctgagctgggatgatacccctgctacaacacaaaatccacttgctcttgttcctgtcacagatcctcttgctgactctacttcatcaaatcaaaatgcgctagcaattgttgacacattttcagaaaacagcaccacgaaccacaacgctcaaccagctgacccctttggtctcaatccgagttctgctattccaggatctcagctatacaacacgccaactcagcagcctttccagtcacaacagcctccgcagcaggcggcgctctatgcgatggggggtgctgtggaccctggaacgtcttacgatcacgcatnccagtttaaaatgttagtnctgggtggaatggtcaagctgccaaccctgttgtgccctgccagagcagcactgaatacgatgatcaaagtggaacctttcaccgnctcttgggaggctagnccagcgtcaacaaatgattgccaatggccattggggagcttgca

SEQ ID NO: 12480 - DNA, 4580 bp, Zea mays
ctgcacaccgtcctcccggtcgtagggggccgccgccatggctggggaactggggaggcaggggggttcaaggtccggtggcgcgcggtgggatgaagccctattgttttgcttgcctggctcttggctgggtgttgtgtcagtgtgtgtgtgtgagagagatgggagctttgcggctgcttgctacgtgggccgtagggtgaggcgtgggcctacttactggcgccttttgcaggttgggccggcctgcgaggtgcatttggtgggtttgggttggcgcaagccgcgagggaagggagggccgggcggctgccgggtcgccgtcgaggcgtcctccctcccgagtcccacgagcacggagcaccggcctccggttcagattcggtgacacgcacggcacggacgaacccaacggggcactgctcacgggaaagagagaggattcctccgccgcgtccgcgttggactggacagctcacgccgctgccggcccggcccgccagagccagatccgtcggttccaacgaaacatccattcacgcccgccaccggcatccccatctccgatccgccgcagccgcagtcgcaggcacgtcctcctctccggccacccggcgcgcggcagccagcgagcgagccactgtggtcgccgtgcaggtacctaatttttgcagcccccacaaagtcagagggtggggccttgggtacctcggggccggccgcgaggcagtcacagagaggtgcgcggccaacttgcctggtgcgggtggtttcgggcacgggcgagcgccatccgctcgctgccgatcccaatccggccagcagcggccgccccgccaccgggcctccctccgaccgttccccccgcccgccatggcgggttccatggtggaccgcgccaccagagacatgctcatcggcccggactgggctaagaacatggagatctgcgacatctgcaaccgcgaccccgggcaatcaaaagatgtcgtcaaggcactaaagaaacggattggccacaagaatccaaaagttcaacttcttgcactaactctgttggaaactgttataaaaaattgtggggatatacttcacatgcatgttgcagagagagatatattgcatgatatggtgaagatagtgaagaaaaagtctgatcctcgtgttaaagagaaggtattggtgctgatagatacatggcaagatgtgtttgggggatcacatgcaagatatccacaatactatgcagcataccatgagttggtgcgtgctggagctgaattcccgaagagacccgagaaacctgcacctttgtttaatggccagtctcaggcagcaaggaatatgcgtagtcctgaccaacaggaagcggaatcttctgctgccaatgattttcctgctttgagcatgtcggagattcataacgctcgtggtattatggatgtacttgctgagatgctgaatgctttagacccaggaaacagagaggggctaaggcaggaggtaattgtggaacttgtggatcaatgccgcacttacaagcagagagtagtgcagctagttaattctaccacggacgaggaacttatgtcgcaggggctcacactgaatgatgatttgcagcgtgttctagcaaaacatgatgcaatagcagcaggcattgcagtccgagtggagaaaaaaccgaagtctttgcaagcacttgtagagcctgaggattcggcaaaccaggactccaaaaaggagcagggactcatagatattgaggatcccgcaagccaagatgctgcaaaagagccaaatcaaaggtttgcttccatcactgttgcatatgctcttaataactctcataatgtctacaaatatgttaatacattcatatgtaatttaattgttttccagatgacttctctaattactttcttttatgcatgttatctttgtaacagtacaagtgaccaatctccttttgagcaattagctcttccagcaccaccagtgtcaaatggcgcagcaacaaaatctgaccttggcattgatcttctgagctgggatgatacccctgctacagcacaaaatccactagctcttgttcctgtcacagatcctcttgctgactcgacttcatcgaatcaaaatgcactagcaattgtggacacattttcacagaacagcaccgttaacagcaacactcaagctgctgacccctttggtctcaatccaagttctgctattccaggatctcaggcatacaacactccaactcagcagcatttccagtcgcaacaggcgacactgtatccgaacgggggtgctggaacgtcctatgatcaggcatcccagtttaataatgttaattcagggtggaatgatcaagctgccaaccttccagcagagcaagcactgaattacggtatggcaagaattgtaatctctgatctgctgttatatctttctggaatactacttaattattactttattagtgtgtgcacttttctgtatcacttctgtccttcaaccagaactctctgtattcatatgaatctttctttttctatccgaagaagaagaagaaaaaaaaaagtgacgctagtatccatactctgacgatgatcaaagtggaaaccttccgccacctccttgggaggctcagccagcggcaagcaacgaaatgccaaatggtgaattgggaggcgtgcaacctctccctgggacagctgggcagttcggcggcatgcagcaggcactgcaaccacaagttaaccacatgggagttccacaaaggcagccaatgtacagcaaccagtcagggattggggtggcgccaacactgatgcaggcaggcttggggaaccagcagttgggttcgacatccatgatgggcatgcctccacagatgtatggcggcggatcgcaggcagccatgatgtacccgcaacaaatgccagtggcgccgcagcagccgatgtatggtggtggtggtcgtctggcagggtacatgcagcatcctgctgtggccgctgcacactactacagcaacctggggacggcgggaatgtatgggtaccccggcgcgaacgggctgtcccagagcatgtatggcctctcggtgcaggataactcgtcgtaccagactaagacggcgccaccctctgcggcgacgaagcccgaagacaagcttttcggcgacctcctgagcattgccaagaccaagaaagcttcatgagacgagcaggagcaggagcaggagctttgtcgtttgatcttttacacttgtgtaacattcattgtctggctgtcgtataagctttttggggtcctctttttttttaaaaaaaattatttgttcccacgatcccattggattcgttataccgtacgtaaatgatgattcaataaaggctgtgcagtacgtactcaagatattgtaaaaaaaatgcagaaatgttttcagtattcatatatgtataaggaaccgatgacggcggagatccggcgagctgtgtacagacccaaaggctctcctcatctgaagcatccgtggctttccttggagatgtaacctgccttttctgtttttaatcaatcatctctgtactctgttctgcctgcgtcgctttcggctgcatcgctagcactagcagcggggtggggtgggggtcgtagtcgtgctaagcaagcagcgatccgcaccagaatccatccaatcgcgcggccatgggcgacggcgagacgcggctggtggccgccgcgacggcgaggaagtggctggaggacccgcgcgtggggtacgacggcggcgtcggcagccaggcgctgagctgcgtggcgatcgccggcgcgcgggtctccgtcgccgagcgcggccgcgtcgtctgctcgctccgcgtgcgcgcccccgtcgccgtgcgtgctggccgtccaactccaactactacagcagcagcggttgacttggtcccggagcttcccgagccctctgactgactgactcgccccgtgggccgtgggtgcaggacgcggaggggaggtggcacgccggagcgatcgcggcggcggtggactgcgtgtgctcggcggtggcgtacacggtggaggccgcgcccacggctaccgtccactacagcttgtcctacttctcgccggccgatcgcgacgtacgtccagattaaccttcctttttatttcccccgccaaactctggagctagaacaacgctcacggctagctccggccgcagacggaggtggaggtggaggggcgagtggtgggccggatggggaagctgacggccgcggtggtggtggtgcgcgataaggagtccggcgagctggtcgccgtagggaggcagtgggtgacccccgcctggccgaccaaggccaacaaaaccagcaagctctgaagaagaaatgcagtagaattttttgtataataattcgccggcacacttgtcatcttggaaattcgatctttcatttcatcttggtaggtattcctggtttcaggcacgagctcggactcggtctttggggccggccgggatcagaatcagacgcgggtacgagcggtgccgcggc

SEQ ID NO: 12481 - DNA, 2416 bp, Zea mays
gccggccggatcagaaaagagggaacgaaaagaaagggttggacagaggtgcaggccagcctgcgtggtgcgggtggtttcgagcacggggcaagcgccaccctgctcgctgccgatcccaatccggctacagcagcggccgccccgcctgcggggcctccctccgaccgttccccccgccctccatggcaggctccatggtggaccgcgccaccagcgacatgctcatcagcccggactgggctaagaacatggagatctgcgacatctgcaaccgcgaccccgggcaatcgaaagatgtcgtcaaggcactgaagaaacggattggccacaagaatctttaagttcaacttcctccgcttccgttgttggaaactgttattaaaaactgtggggatatacttcacatgcatgtcgcagagagagatatattgcatgagatggtgaagatagtgaagaaaaagtctgatcctcgtgttaaagagaaggtattggtgctgatagatacatggcaagaagcatttgggggaccacgtgcaagatatccacaatactatgcagcataccatgagttggtgcgtgctggagctcaattccccaagagaccagagaaacctgcacctttgtttaatggtcagtctcaagcagcaaggaatatgcgtagtcctgaccaacaggatgatgcagaatcttctactgccaatgatttccctgctttgagcatgtcagagattcagaatgctcgtggtattatggatgtacttgccgagatgctgaatgctttaggccctggaaacagagagggattaaggcaggaggtaattgtggaactcgtggaccaatgccgcacttacaagcagagagtagtgcagctagttaattctaccacggatgaggaacttatgtcgcaggggctcgcactgaatgatgatttgcagagtgttctagcaaaacatgatgcaatagcagcaggcattgcagttcgagtggagaaaaaaccaaagtctttgcaagcacttgtagagaccgaggattcggcaaaccaggactccaaaaaggagcagggactcatagatattgaggatcccacaagccaagatgctgcaaaagagccaaatcaaagtactagtgaccaatctccttttgagcaattagctcttccagcaccaccagtgtcaaatggcgcagcaacaaaatctgaccttggcattgatcttctgagctgggatgatacccctgctacagcacaaaatccactagctcttgttcctgtcacagatcctcttgctgactcgacttcatcgaatcaaaatgcactagcaattgtggacacattttcacagaacagcaccgttaacagcaacactcaagcagctgacccctttggtctcaatccaagttctgctattccaggatctcaggcatacaacactccaactcagcagcctttccagtcgcaacaggcgacgctgtatccgaacgggggtgctggaacgtcctatgatcaggcatcccagtttaataatgttaattcagggtggaatgatcaagctgccaaccttccagcagagcaagcactgaattacgatgatcaaagtggaaaccttccgccacctccttgggaggctcagccagcggcaagcaacgaaatgccaaatggtgaattgggaggcgtgcaacctctccctgggacagctgggcagttcggcggcatgcagcaggcactgcaaccacaagttaaccacatgggagttccacaaaggcagccaatgtacagcaaccagtcagggattggggtggcgccaacacagatgcaggcaggcttggggaaccagcagttgggttcgacatccatgatgggcatgcctccacagatgtatggcggcggatcgcaggcagccatgatgtacccgcaacaaatgccagtggcgccgcagcagccgatgtatggtggtggtggtcgtctggcagggtacatgcagcatcctgctgtggccgctgcacactactacagcaacctggggacagcgggaatgtatgggtaccccggcgcgaacgggctgtcccagagcatgtatggcctctcggtgcaggttaactcgtcgtaccagactaagacggcgccaccctctgcggcgacgaagcccgaagacaagcttttcggcgacctcctgagcattgccaagaccaagaaagcttcatgagacgagcacgagcaggagctttgtcgtttgatctcttacacttgtgtaacattcattgtatggatgtcgtataagctttttggggtcctctttttttttaaaaaaaatatatatatatatttgttcccacgatcccattggattcgttataccgtacgtaaatgatgattcaataaagggtgtgcagtgcagtacgtacttacgatattgtg

SEQ ID NO: 12482 - DNA, 1930 bp, Zea mays
aatacttagatttttctcacagccagattctctttacagccagattttcagaaaagctgatcagaaaaagctgaaacaaacaggccctatatagtatcttgtggagccttagggtacgattaagatactatatataaattttaagatgtgtttaataggatcagtattattttaactaggatcgtagtatcctaacatattaggccatactaaagatttgacaaccttgcatggtaccatcaaaaacttaatctgaattcttattcagctattgcgagttttgatctcatcaacgcaagtcaagatatccatgtcaattttgctgctaccgtcgggcgatcgcgtccttggaattcttgcccctgtggaatttcttctagctactaataacttgccgtcactgttgattgaccaaatgggcagctactttttgcagtttaattatactctgtttcccccgatttgctacttactttgatcacaaatatatatttatttacatttgttctaagtcagtttttgataaactaagaatatgaaagtttttattgtgcgcaaacataagacttccattattagcttcatcgtaaaaaataacatataagtactctttttttaatatagcataattttatatcggtatactcttttattcaatataatatagtataataatgacacatgtataagtggcctactattacagactatatcgatcttctaaaagacttttaatttgaaactagttggttaaatttttcagagctgcttttgcttaaataaactaaggatctatttagtttgtggctaactatgccacattttgcctaaggttagtcattcgaattgaagaactatctttaggcacaaaagtgtaacaaaatgtgacaaattagccagcgaaccaaacagaccctaaaagcaaccaaaagagttgttttctacccaagtacttcaatggaagcagcttcttctctagagcatccttagatctgcttctctagagcatcctttgacatatcgattgacaagctagtcgccaaggtagccttttgctaccactatcaggcattgggtccctcgaggccggccgggacgcatccatctaccacacaaaaacttcatatttgttcatttgtctccagcaatacaatggagtactcgtctactagggtcgtgtgtttagctctggcgttggccatggtcgccgtgacgccgtgcgcggcccagaactcgccgcaggacttcgtgaacccgcacaacgcggcgcgcgcggccgtgggcgtcggcccggtgtcgtgggatgagaacgtggccgccttcgcgcggagctacgccgcgcagcgccagggcgactgcaagctggtgcactccggcggcgggcccaaccactacggggagaacatcttctggggcggcggcagcgcctggaaggcgtcggacgccgtcggcttgtgggtgggggagaagcagaactacgactacaacagcaacagctgtgcggcggggaaggtgtgcggccactacacgcaagtcgtctggcgcaaatccaccgccatcggctgcgcccgcgtcgtctgcaacaacggcggtggcgtcttcatcacctgcaactacaacccgccgggcaacttccgcggacagagaccctactagctacctagctagctagttccaatatcgattatacgcgtacatatactctacatgctaccgattgaataagccacaaactaagcttaggccaccagttgattaggtttcttgtgaacctactcacccaggtttaagtgaagtgtgcatacatgtatgtgtatgttctgtgtggggtgtgacagttcgtttagtgtttcataaaataaataaatctctactactacttaagtccaaaaaaaaaaagcgcacaacgcccccggtgcacggttctgcc

SEQ ID NO: 12483 - DNA, 1519 bp, Zea mays
  misc_feature (8)..(8): n is a, c, g, or t
tcgtgtangccgagcaaaacaaatactaaatgccgccaccccccaccgccgtatcatcctgctggcgcggcacaagacgccaccgagccaagaatttgcatcctcatcctgcggctgtcagtgtcaagcagccaggctcaggggtaaggtttcagcaattcagctccctcgcctccgccgcggcaccggcactacgagtgcttcgctaccagccagccagcacactctacgagtcgccatcttccactccaccgaggcagctccaagccatggccatggagaaggccgcctccttcctctcctccctcttaggcggcggcggcggggagccggcggcgactgtgaaatctatcttcatataccctatcaagtcctgcaggggtcttgccgtgtcacaggcgcccatcacctccactgggttccggtgggatcggcagtgggtggtggtgaacgccaaagggcgagcatacacccagagggtggagcccaagcttgctctggtccaggtggagttgccgccggaggccttcgctgagaactggcagcccacgcccgacgaccacctggttatcagagcacccggaatggacacactgaagatacctctaataacggaacacgccacaatcgatgatgtctctgtctgggagtggtctggctctgcgtatgatgaaggggctgaagcgtctgaatggttctccacttactttgggaagccaagtcgactagtgcgcttcaaagaagcatcggaaactaggccaaccgatccagattatgcccaaggttataagatcatgttcaccgattgcttcccatttctgatagcttctcagggttcactggatgcactaaatgagattcttaaagaacctgtaccaatgaaccgcttcagaccaaatattttagtggatggatgccacccatactcagaggacctgtggaaaaccataaagataaacaacctaacattcctaggtgtgaagttatgcaaccgctgcaaggtgccaaccattaatcaagaggatggagtacctggtactgaaccaactgaaactctacagacttttcggtccgaccaagtgcttcgtccaagccacaaaaataaacgacaggtgtactttgggcagaatttagtctgcaaggaatctctatcaggtgaaggaaaggtcatcaaggttggcgatccagtttatgttgtgcaggcattcgcttcttctaatgaagccccagcctgattcagggttaaaagtagtgacagggtgttcaaaataagtgagtttgtcatgcacactggataaacaaaaaactgtgggctgttgaaactgttaatgagacaataaaacactggccgctggacagtaattatgaattaactgtaccttcatcaggggcttatttacttctatgatattacataccttgtacatcagaataatacaaaacaataagaagtgccaaaaaaggaggtgagttagaagagctgtccaaaaaaaaaaaaaaaaaaaaaaaagtcgacgcg

SEQ ID NO: 12484 - DNA, 1122 bp, Zea mays
agctaataggtcgagtgcttcgctaccagccagccagtacattctacggttactactcacgccatcttgcactcctccgacaccgagtacattctacggttactactcacgccatcttgcactcctccctcttaggccggaggcggcggggagccggcagcgactgtgaaatctatcttcatataccctatcaagtcctgcaggggtctcgccgtgtcacaggcgcccatcatctctaccgggttccggtgggatcggcagtgggtggtggtgaacgggcaaagggcgagcatacacccagagggtggaacccaagctcgctctggtccaggtggagttgccaccggaggccttcgccgaggactggcagcccacgccctacgaccacctggttatcagagcacccggaatggacacgctgaagatacctctagcagcggaacacaccacaatcgatgatgtctctgtgtgggagtggtctggctctgcgtacgatgaaggggctgaagtgtctgagtggttctccacttactttgggaagccaagtcgactagtgcgcttcaaagaagcatccgaaactaggccaactgatccatattacgcccaaggttacaagatcatgttcaccgatcgcttcccatttctgatagcctctcagggttcattggacgcactaaatgagattcttaaagaacctgtaccaatgaaccgcttcagaccaaagtgccaagcattaatcaagaggatgaaatacctggcactgaaccaaatgaaactctacagacatttcggtccgaccaagtgcttcgtccaagccacaaaaataaacgacaggtgtactttggggtgaatttagtctgcaaggaatctctatcaggaaaggacgaaggaaagatcatcaaggttggcgatccagtttatgttgtgcaggcattcgattcttctaatgaagccctagtctgattcagggttaaaaatagtgacagtgtgttcaaaaatcaaaataagtgagtttgttatgcgcactggagaaacaaaaatcagcgggctgttaaaactgttaatgagataataaaactcctgctgctggacagtaattatgagtcaaaaaaaaaaaaaaaa

SEQ ID NO: 12485 - DNA, 1118 bp, Zea mays
ggccggccgggaatccgctttggggcgcctatgcgcccgcagcaaccaacgaggcaacggatcgagttcctctccgaactccaactctgcgccgcaatccactcaagaaggttagccctcgtggtctcggatttggataatcctccgccgaggtatgaaacaggaggcggccaccagcatagtggtgacccaggaggacgtcctgcaccactacaaggagcctccaccccgccgcgaggacgatccgccagcactggctgcgtcgctgtcgttgccgtcgtcactgtcggaggacgatggcgacgccatgccgcagccatcttcatacgcggtcttgccgcgccgggaaggcgagctggtgtctgcggaggagctgctgctggtgccgccgctcaacttcgccatggtggaccacggcgtgtaccgctccggattcccggacgcctccaacttgccgtttcttgagacgctccgactccgctccgtcctgtgcctgtgcccggagccatacccggaggctaatctggagttcctccgtgcccacgggatcaagctcttccagttcggaatcgacggctccaaggaaccatttgtgaacataccagaagatagaatccgtgaagctctagaagtcatcctagatgcaagcaaccatccggttcttattcactgcaagcgaggaaagcatcgaaccggctgtgtggttggatgctttaggaaattgcaacgctggtgtctaacttcaatatttgacgaataccagcgttttgctgctgccaaaacaagagtttctgacctacggttcatggagctatttgatgtatcgagcataaagcatttagcatttgagtcgtctgtatgatagtaacattggtgcatgataacaactcaatactggttccattacggtgtcatctttttcatttaagaaaaaaaatcatttctaaaaatgcaaaaaaaaaaaaaaaaaaaaaaaaaaaaaaaaaaaaaaaaaaaaaaaaaataaaaaaaaagcaaaaaaaaaaaaaaagaaaaaaaaatacttagagaaaaacaacataaaagtacattaatgtgtagttattgggggggcccacacattttggacatgaaaaccc

SEQ ID NO: 12486 - DNA, 5669 bp, Zea mays
ccgcctctcacctctccagtccccacccccgcccccgtccgctccctatcctgttcgttcccctcctctccacacgatcccctcccttgtcggcttccgcgcgggcgggagtggccgcggccacgactccaccgcctcctgctcgcgccaccacccctcggcccctcgcggcgccgcgcgaccggcgcgtggtgcgcgtttgcctgcccgtcgtcggccccttcttattagttattattaggcggaggagaggctagctctgcggggggtcgccgcgcgccgccgaatcggatcacacgcctccccttcccgccaggccagggggccatggccacgctcccgcgcgccgcgccgcccacgcccgccgcgctgctcccgctgccccgcgccgcgccgccgctgctgctcgccgggagggccgccgccgcgcgccgctctcggctgcgcgcgcggggcccgtccgcggcggcgcgccggagctgggtcgtcgcctccgccgcttcctcctcctcacgggccgtggtcggcggcgtcgcccgccgggaggcccctcccgcgccgcagaagcccacgcagcaggctgcggacttgaaccatatcttgtctgaacgtggagcttgtggtgttggatttgtcgcaaacttgaaaaatatgtcttcatttgacattgttcgtgatgctcttatggctcttgggtgcatggagcatcgtggtggttgtggagcggacagtgactcaggtgatggtgcaggactgatgagtgccgttccatgggacttgtttgatgactgggccagcaagcaagggcttgctctctttgacagaagaaatacaggtgtaggcatggtcttccttccacaagatgagaagtcaatggaagaagccaaagctgcaactgaaaaggtttttgtggatgaaggccttgaggttcttggttggagacccgttccttttaatgtatcagttgtaggtcgcaatgcaaaagaaaccatgcctaatatacaacaaatatttgtgaaagttgcaaaagaagataatgctgatgacatagagagagaattatacatcagccgaaagctgatagagcgggctgcaaaatcttttagttgggcagatgaactttatttctgctctttatcaagcagaacgattgtctacaagggaatgctacgatctgaggttcttgggcaattctatttagaccttcagaatgaactgtataaatcaccttttgccatatatcatcgaagattcagtacaaatacaagtcctcgatggcctcttgctcaacctatgaggttacttggacacaacggagaaattaacacaatacaggggaacttgaactggatgcgatcaagggaaaccacactaaagtctcctgtatggcgaggtcgtgagcatgaaatttgcccgtttggtgaccctaaagcatctgattcagcgaatcttgacagtacagctgaattgctgctaagaagtggtaggagtcctgcagaagctcttatgattctcgtccctgaggcatataagaaccatccaacattatctataaaataccccgaggtaactgacttttatgactactacaaaggacaaatggaagcttgggatggacctgctttacttctatttagtgatgggaggactgtaggagcaactcttgataggaatggtctccgtccagcacgctattggagaacgtcagatgacttcgtttatgtcgcatctgaagttggtgttataccaatggatgagtcaaaagtagtaatgaaaggacgattaggtcctggaatgatgataactgttgatctacagactggacaggtgcttgaaaacacagaagtaaagaaaactgtggcttcagcgagcccctatgggacttggttgcaagaatgcacacgtttgataaagcctgtcaacttcctctcttcaactatcatggacaatgagactgttttgagacatcaacaggcatttggctattcaagtgaagatgtgcaaatggtgattgaatcaatggcttcacaaggaaaggaaccaacattttgtatgggcgatgacattccattagctgtattatcacaaagaccacatttgttatatgattatttcaagcagcggtttgcgcaggttacaaatcctgcaattgatccccttagagaaggtttagttatgtctcttgaggttaatattgggaaaagaggcaacatcttggaggttggccctgaaaatgctgatcaggttgcactatcaagccctgtgctgaatgaaggtgaactggaaactctattgaacgactcaaaacttaagcccaaagtactgtcaacatacttcgatattcgtaaaggtctagatggttcacttgataagacaattcaggctctttgtgaagaagctgatgctgctgtgcggagtggctctcaacttcttgttctttctgatcgttctgaagcacctgaacctactcgtcctgccataccaatacttctagctgttggcgccatccaccagcatttgattcagaatggtctccgtatgtctgcttctattgttgctgatactgctcagtgttttagcacacatcattttgcctgtctgatcggatatggtgccagtgctgtgtgtccttatctggcactagaaacatgccggcaatggaggctgagcaacaaaactcttaatttgatgcggaatgggaagatgcccacagtgaccatcgagcaggcacaaaggaactttatcaaggcagtaaaatcaggtctgctcaaaattctttcaaaaatgggtatctcactgctctcaagctattgtggagctcagatctttgaaatttatggtcttggtcaagaagttgttgatcttgccttctgtggaagtgtatcgaaaattggaggtctcacacttgatgagctgggtagggagaccttatcattctgggtgaaggcgttctctgaagatactgcaaagaggctagaaaactttggatttatccaatccagacctggaggtgaataccatgcaaataatcctgagatgtccaagctgttgcacaaagcaattcgcgagaaacgtgataatgcgtacactgtctaccaacaacatcttgcaagccgtcctgtcaatgttcttcgagatcttcttgaattgaaaagtgatcgtgcacctattcctattggcaaagtggagtctgcaacctccattgttgaacgtttttgtactggtggaatgtccctaggagccatttcaagggaaacgcatgaagctattgcaattgcaatgaatagaataggtgggaaatctaattcaggagaaggtggtgaggatccaatccgttggaatcccctcactgatgttgtagatggttattctccaacacttcctcatctcaagggtcttcagaatggtgacacagccacaagtgccattaagcaggttgcatctggacgttttggagttacaccgacattcttagtaaatgctgaccaaattgagataaagattgcgcaaggtgcaaagcctggtgaaggaggtcaacttcctgggaaaaaagtcagtgcatacattgctcgtctgaggaactccaaacctggagttcctctaatctccccgcctccacaccatgacatttattctatcgaggatcttgcacagttgatttatgacctccatcagataaatcctaaagctaaagtatctgtaaagcttgtgtctgaagctggaattggaactgtagcttctggagtttcaaaggcgaatgcagacataattcagatatcaggtcatgatggtggtactggagctagcccaatcagctccatcaaacatgctgggggtccgtgggaacttggtcttacagaaacaaatcagacacttatacaaaatggattgagagagagggtagtacttagggtggacggtggattcaggagtggtcaagatgttcttattgctgctgctatgggagctgatgaatatggctttggttctgtagccatgatagctactggatgtgtcatggcacggatttgtcacacaaataattgtccagttggagtggctagtcagagagaagagcttcgtgcaaggtttcctggtgttcctggtgatcttgttaactacttcctctttgttgccgaggaggttcgagctgcattagcccagttgggttatgagaagttggatgacatcattgggcgaacagatttgcttaaaccaaagcacatctcattggtgaaaacgcagcacattgatcttggatacctcctatcaaatgctggattgcctgaatggagcagctcccaaattaggagccaggacgtccacactaatggccctgttcttgatgagacaatccttgcagatcctgagatagctgatgctattgagaatgagaaggaagtttccaaggcatttcaaatctataatgttgacagagctgtctgtggtcgggtagcaggtgtgattgccaagaagtatggagacacaggttttgctggccagctcaacatcacgttcaatggaagtgcagggcagtcctttggttgtttcctgactcctggaatgaacattcggctagttggggaggccaatgattatgttggaaagggtatggctggtggagaactggtggtagttcctgtagacaaaacaggatttgttcctgaggatgctactatagttggaaacacttgtctgtatggagctacaggtggtcaggtatttgtgagaggcaaggcaggagaaagatttgctgttagaaactctctatgtcaggcagtggttgagggcaccggagatcattgctgtgagtacatgactggtggctgcgtagtcgtacttggcaaagctgggaggaatgttgcagctggaatgactggtggtcttgcctacattctagatgaggatgatacacttgtcccaaaggtcaacaaggaaatcgtcaaaatgcagagagtgaatgctccagctgggcagatgcagctaaagggcttgattgaggcctatgttgaaaaaacgggcagcgagaaaggtattgcgattttgagggaatgggaggcctatttgccgctcttctggcaactggtaccgcccagtgaagaagactcgcctgaggcttgtgcagagtttgagagagtacttgccaagcaagcaaccacccaattgtctgcgaagtgatcgaatcagactacaggaaggtggtaggtgttttctatttgacacaaagtgatctcatcttatcacttcaagaaaatcgaagaccataaccggcactctgaggcaccgaagtgcccgtctgaagactgcaactttgtggaggctctgcccaggccatctttttgagttgagctaacagaaccgagggttcttctcgacgctcgtgcacctaggtaacccctgtaaattggtttgctgacgctaggctgcaaggggcctgccctgtttgaactgctgtactgtacatgattcttggccgttgccctgtgtaattatgttttggttagctcgtaaatttatacgcatccaatggaggcatacaatgcaagtcgcaagcgcaatagtacggtgcatgataaactgtacggccaggttggattggaatgtttgcttcgtgaatgaacgaaaccggcgtcatgcctgtggtgtgaccgctcctctggttggcatcc

SEQ ID NO: 12487 - DNA, 1432 bp, Zea mays
aaaaaacagtgcactgactgagtgagtgtcatccagtgcaagctcccagtcccagtcccagtcccagtcccagggtagtagaggactagaggcaggctagagcaaagcacgcggattgcgtggctagcgcaacaatggcgatggccacggccaagctcgtccttctcatggtcctcgtggccggcagctccagcggcggcagcgcgtgggggccgctgatgagccgcctccggatgccgacggcgcggtcgcccgtcgaggtggcgaaggagcgcctccaggaggactacgtcgtatcggcggctgcgccgctgatccacgcgctgcggccgctgctgggctccgcgggggacctgggccggcgcgccggcgtgccgtgcgacagctggcgcctggccgtggagacgtacaacaagcgcgattggacgacggtgccggccagctgcgagcgctacgtcggccactacatgctcggcggccactaccgccgggactcccgcgtcgtcatcgacgaggccatcgcctacgccgagggcctcaagctgggcggcaacggcaaggaggtctgggtcttcgatatcgacgagacgtccctctccaatctcccctactatgccacccacggcttcggcactaagctatacaacgcgacgagcttcaacgagtacgtgctggaggggagcgcgccggtgctcccggagacgcagcggctgttcaagaagctcgtctcgctgggcatcaagccggtgttcctgacgggccgcaccgaggaccagagggccatcaccgtcaccaacctccgccgccaggggtactccggctggatgacgctgctgctcaagcccgtcggcctcaaggccaccgccatcgcctacaagtccggcgagcgccagaagctccaggacgccgggtacgtcatcgtcggcaacatcggcgaccagtggagcgacatcctcggcgcgccggagggcgcgcgcaccttcaagctgcctgaccccctctactacattggctaagcagcgatgccaacggcgcggcgcggctctccatcagcccatccatcaacccgtcacccggctccagtgcctgtgctcaactactctttgtttgttacccctcacttcttatcatcattaattcctaaggttaattccctgagctgagtggaaataaggccgactcggtggagagctgtcgacttctcaataaataattgctcatgaaaaccacgatggtttatgttattcaaagtcttatatatatataatggattagtaccgggaaaaaaaaaaaaaaaaaaggccccgtgggccactgttgaattttgcagcgtacatttggaataaatccattgcaacagactaaaaaaatacatgaaaaaaaaacaaataaaaagccatggtctcagagggacggaggctccgtcatgaac

SEQ ID NO: 12488 - DNA, 1354 bp, Zea mays
ttttttttttttttttttatctaataatctatttgtatgttcaactcaacttaaagggcagccaacatattagagccaacaatttggagcaattgaccaaactattgaaaaataattgtttttgtgtgtgtggctagaagtagtagctggtcaaatccttggatgccaagaagaagaagaagaatagccttgtctagcaagaagaagatagagggatgatgtgattatacgcaaaatactaaaacctagggtggtagtacaagcagtagttatgagcaggcctcttctctttctttcctgttccgttctttttctttttccctgcggaattccccttcttccctagtgcctcgattcgatatttcgattggattggattaccaagggacagagggagggaatcccacacacacctctggccctcgcgaggccaagggaagggaagcactcagcacccagcagcagaaggaccgccgtaaatggcgctgccggtggcgaagctggggaccctggcgctgcggacgctgtccaagcccatcgccagccgcctcaagagccaggccgccgtccaccccaagttccgcaacttcatcatcgccatcgcccaggcaaaccaccagatcaccacaaagatacagaggcgcatttatgggcatgccacagatgtggcgatcaggcctttggatgagcagaaagctgttcaagctgctacagatctcatcggggaagcctttatcttctcggtcgctgttgctgctctaatttttgaggttcagagaaacgcaaggtctgaggctaggaaggaggaagctcgtagacaggaacttgaggaattgaaacgaagggaagagagtatagctaaagaattggaagatcttaaattgaagcttagtgaaattgagcagcttgctaaagggcgaggcctgacaggaatcttgaacttgaaacgggtccatggcacagaggtcggcaaggcagcagcacctctgcgtgagtaagcaatccggctttggcgcaggaaagtatgattccttgtcgcccccattatttggtaagacttgtgttgtcgtgctcaacctattctttggtgctcatattggatccacatttgtagtggttgatccatggacaccctgagacagtggtaataatacagcgtaacaaagaaatcaaattaaagcgcaatatgtatgtgctacttggtggcggtgaccacaaaatcagatgttaagatggattagggcttgtttggttgtatacttaaggtgtaaaaaatgccacgtttcagattaaagctggttgtttggactgttgcaactaaaaaaaaaaaaaaaaaaaagccaaaaaaaaaaaa

SEQ ID NO: 12489 - DNA, 875 bp, Zea mays
ctcgaggccggccggggcgacaatataacattataacccacgcaactccggggtccgggttctggctcgccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaaccctcgtaaggttaagtggacaaaagcatacaggcatttgcatggcaaggacatgacccaggatacaacctttgagtttgagaggaagaggaacaggcccgagcgctacgaccgcaatttgacggagcagactctgaaggctatcccgcttattgcaaagattaggcatgaccgtatgggaaaacacatctcaaacagacataaacctggtaaacgcaaggagatggaaaaggattccaaggagctggagcaggacatcggcatgctcccgaagaagcttattatcaaccatctcgcggctgagaaaacgaaggtcaaggttgaagttgttcagcagcagacagaagataacgcgatggaagagtagtgcgtggcattttgtgtgcttgtgttttcatgtctgatgcagatccttttgtatttgcgtaagaagctatgtagttgatgaaagatgtttatttaatatatatattaatggatggattcgtggactgagtatcagcaagtttgttgttctggaatgtaagcttgctctgcttatgctataattgtcttgtcaggaaagtctcaatcctaaaaaaaaaaaaaaaaa

SEQ ID NO: 12490 - DNA, 1306 bp, Zea mays
  misc_feature (98)..(98): n is a, c, g, or t
cacttttagctaagtttagcacttaaagattcaaacataaatgctacaagatgttaaaagtaaagtgctaaactacacattagcatcttagctccttnaaaatgtgctaaattgagctaaaagtgatcctgagtcacagaaagacttctacatcaccccactctctatatccggccagtattaattaactatctttctatatccatatactaaactttagcgcttgcatacaaacattacccatgtgctaaacatttgagaggactaaattgtagcacctggctaaagtttagctcattagatctaaacatacggttatactctttggagctccccagatgtgagctgttcgtcttggtgttcaccccactggcccctccacgtggacaaaatcaaaacaatattacatgagtaggtttatggctagcttatgagtagagtggcaatggattagcatccacgacgattgccgtttgttcgccatccgtgtacatgatacagctttaaaaaaattgcaagggcaaaatcggaaagtgccagtggctttaaccattcggcgccctacccaccttcctttttgccttctttatttacaacacagcctaaaaagccggccgggctagttggtctttctggcttgctcgcatttcatgccatcacggcatcgccattgcagcgctcactttaatttactcagccagcggatgccgaccctcacctccgatgccatcatcgcgtccccgaggtggggcgtcctccccttatgcggcggcggccgctcgggcggaccgcgcactcgccgcccgtcgtcgtccggcggccacggctgcgggtggccgccgctggaccgcgtggccgtctgggtcggcggcggcatcgccgcggtgttcttcgcgtccctggagcggtgctcgtgcgtcaacgtgcgcacgcacgacgacctcctcgacgacgagcggagggactcggaggcgccgctgatgatgttcgacgacggcgacggtaactcctgcgtgcagaggcgcggagccaggtggtgcggcaagggcaagggtactggtagtggagattgttagtgtacgatattaatatgtatatttgttcagaaaacgtcgttcgcccggtttaattttggctgtcgtcgtcgtcttaaggcttaagctcctgcgttggtcctatttcgagtaagttttgcccttgtaatgctatttcctgctgcgtttctgtttaaattatcagtgtatggatgtttcactgtatctaagttaattcagagttacatacctccaaaattgaaactaaaatg

SEQ ID NO: 12491 - DNA, 1341 bp, Zea mays
gcacgccgttaaggttgctttgcattcaccccttgccgcacacatcaggaaggcgggcaggcgacgacaatgacgatgatggcgccgcatccgcagccactgccgctgccacagccgccggcgccgttcggggacaccacgctcaccaaggtgttcgtgggcgggctggcgtgggagacccacaaggacgccctccgcgagcacttcgagcgctacggcgacatcctcgaggccgtcatcatctccgacaagctcaccggccgctccaagggctacggcttcgtgacgttcaaggaggcggacgcggccaagaaggcgtgcgaggacgccacccccgtcatcaacggccgccgcgccaactgcaacctcgccgccctcggcgccaagccgcgccccccgccacacatcctccgcccttcgccgccggccaccccggcgccgcacgcgcccgcgctcccctcgcaacaccagcccacgccagccatcgccgtggggtccaggggcgtgtcgccggtgccgtggtactaccacccctccacgacgccgccgccaccggccgcgcaccactacgcccacggcgcgcaccagcagtaccacggcgtgctcccgttctaccccgccgccgccgccacctacgggtacgccccgaattacgtcgcggacctgagctacaatgcgaaggtaggccaggcggcagctggcggcacgggcgggtcctacctgcaggggcacttcgcgtacccggcggcggcggcagcgcagggcggcatggtggcggcggcgcccaacggcatggtgccggtgtacccgttctaccactaccaccagtaccacgcctcgcaggggggagtcgccgccgcgcacttcttccccccggtctccgccgccgccgtccccgccgtcgtctccaagcacaccgtcatggccgctcccaaagtggagcaggtgacaggctgcagctgaaggcacgaggcgatcgatgatggcgacgacgagcggcggaacgaaaggagcaggccaaacaggctgcgctgcacatgaagggtgtcgtccgtctgtcgggagggcccgaagcgacgcaaggcccgggcccccattaggccattgctacatcccccctctgacttcgtgcgtggctgcacggccaccgtgccgggcaagaacagtctgtaacaaatgattcgattcgtctctctctcgtttaccaaccgtatttttttccaatggtaaacccgttaccagtgtctgtagggggcagcggaccccaataaaatcgtcataatatttcgccgttcaaaaaaaaaaaaaaaaaaaacacgagggggggcccctacggcgtgc

SEQ ID NO: 12492 - DNA, 3222 bp, Zea mays
gcacgagggttgggtttctttttgcaccaatcgtatgcatttggcttctctgcataagtgcaataggcctctacaatatcatccgttgggaccaccacgtttatcgagccctctcgccatattacatgtatcaattcctcaggaagactcaaactggtggctggatgtcactgggtggaatccttctctgtgtaacaggctctgaagctatgtatgcagatcttggacatttttcgcaatcagcaatacagattgcattcatatatgtggtttatcctgcacttgtattggcttatatgggacaagcggcttttatttcacaacatcacaacttcgagagcagttatcatattggattttatgtgtcagtaccagaaacactcagatggcctgttctggtgattgctatactggcagctgtagttgggagtcaggcaattattactggaaccttttcaatcatcaagcagtgctcttcattaagttgtttccctggagtgaagattgtgcacacatcctcgacagtgcatggtcagatatacataccagaaatcaattggatgctgatgatactctgcctggctgttactattggcttcagagacacaaagcacttggcaaatgcacaagggttggcagtaataactgtcatgcttgttaccacttgcttaatgtcactcgttattgtgctttgctggaacaagagtatcttccttgcccttggtttcctgcttttctttggcgcgatcgaagtaatctacttctcagcttcccttgtcaagtttcatgaaggtgcttgggttcccattactctctccttcatatttatggtggtcatgtgtgtcggccactatggcacgataaagaagtacgagttcgatgtgcaaaacaaggtttcagtaaactggctcttaaaccttggtccttcgctgggcattgttcgtgttcgaggcattgggctaatacatacagaactgatgtctggaatcccagctatcttctcccacttcgtcaccaatctgcctgcgtttcaccaggtaccttatcacttcagagctcataaacatactcaagcaacagtttttctgaatgcacttcccagatatctggataaacagcatcagtgcatggggggcagtttatggatggtaacttttagagttctcacaactgttttccatcaggtactggtattcctctgtgtcaaatcagttcctgtgccgcatgtgcaacctgaggaacgatttctgctgggtcgcatcggtccgaaagagtataggctatacagggtcattgtcagatacggttatcgcgatgtccagaaggatgacctagagttcgagaaggagctagtcggcaacattgcagagttcatccgcagcagcgcggaatacgacaagaatggcttcgccgaggacacagataagccctccgggaagctgtccaccatcagcactggaattaacatgtgggaagaggatggagaacctgatgcatcctcatcccctcgcagggagacagacccacgcgacgcagcacccgagcgaaagaaagcgaggttcatgataccaaagagcgcccaggtggacagcgaggtgcggcgcgagctgcaggagctcatggacgccagggaggcgggcatgtccttcatcctggggcgctcgtacatgaaggcgaagagcgggtcgggtttcgtaaagcgggtcgtgataaacttgttgtacgagttcttgaggaagaacagccgtggccctgcgtacgccgcgagcataccccatgcctccacccttgaggtaggaatggtctaccaggtctgacaaacagttagcggggtgtgtaaaggtagaagaaactagaagagatgagacgacgcttgtatatacacccacttgttgctgccgataccgttaacataattacaggataacacagagtagagagacatttgaaaacagctgtggatagcccaaccagaagcatgtgtttagtttcgtgatatgtttgctgctgctgttgacttgctgagtctcagacagtacttgtgagctgtcattgtctgtgagctgtaattgtctgggcgactagcaaaatagcagttttgacgtgcagcgacctctgtagttctgctacttttctatagctgatgtttcaggtagcagcttaattgtatgtttggaaaccctaaagctaatagttagttagcttagttgagacacaactagctaatagttagcggctcttaattggtttcgggcttaagaacgtctgaaatttccagacaaaccataatgggaaacgtctcttaggccgtgtttggttcagcttttgggggcttctggccgccagaagctagaagctgaaccaaacgcctagcttctggggtggcttctgatggaagcgcttccccccgcagccgttataccgttgcccgcgagaagcgccaaaaaggccgtttatcctcgacgccgcgcgccacgacacagcacgcccaagaaaccccgtgtcctcacaaaacactgcctgccggagatggccagcggcgaccttctcctccgtgtcctcacaaaacactgcctgccggagatggccagcggcgaccttctcctccgcgcccacgccggcgccccggtcctagcgagggcctcgcctgcctcctcctctagtcccggcaaggcgccgcaacggactaatctcacctctggccgcttccaaggtcggcatcgccgacgtcgttgggcgggtcaggtcgaggtggagcaggacgaggaagatgaagctctcaagttgggagtggagaagaatggcgcgagacgggaggtgtgggctacgttcccaaacgctggcgctgcctggctcggtgcctcccctgagttccatctcctgacatgccgccgccgcagtagagctaacgaggcacgggtagcatgcgccgcggcctgcgtcgcgggttgggcatcctcctcgtcccactcccgcacgcacccagccgcccgccgccgatctctcgcgtggctcttctcctccgacgcctcaatggcttctcccgccactccttctgcagcttccccgtcggggagcgcaccgtcgagcagttctcagacgacgaatacgaccacgagtacgaggacctccgggttcgtgctacatctaggggtggtaacgggccatttaatttagcctagcaaatttaaggatagaatcaagttagggccggatcataaa

SEQ ID NO: 12493 - DNA, 1850 bp, Zea mays
tccgttgggaccaccacgtttatcgagccctctcgccatattacatgtatcaattcctcaggaagactcaaactggtggctggatgtcactgggtggaatccttctctgtgtaacaggctctgaagctatgtatgcagatcttggacatttttcgcaatcagcaatacagattgcattcatatatgtggtttatcctgcacttgtattggcttatatgggacaagcggcttttatttcacaacatcacaacttcgagagcagttatcatattggattttatgtgtcagtaccagaaacactcagatggcctgttctggtgattgctatactggcagctgtagttgggagtcaggcaattattactggaaccttttcaatcatcaagcagtgctcttcattaagttgtttccctggagtgaagattgtgcacacatcctcgacagtgcatggtcagatatacataccagaaatcaattggatgctgatgatactctgcctggctgttactattggcttcagagacacaaagcacttggcaaatgcacaagggttggcagtaataactgtcatgcttgttaccacttgcttaatgtcactcgttattgtgctttgctggaacaagagtatcttccttgcccttggtttcctgcttttctttggcgcgatcgaagtaatctacttctcagcttcccttgtcaagtttcatgaaggtgcttgggttcccattactctctccttcatatttatggtggtcatgtgtgtctggcactatggcacgataaagaagtacgagttcgatgtgcaaaacaaggtttcagtaaactggctcttaaaccttggtccttcgctgggcattgttcgtgttcgaggcattgggctaatacatacagaactgatgtctggaatcccagctatcttctcccacttcgtcaccaatctgcctgcgtttcaccaggtactggtattcctctgtgtcaaatcagttcctgtgccgcatgtgcaacctgaggaacgatttctggtgggtcgcattggtccgaaagagtataggctatacagggtcattgtcagatacggttatcgcgatgtccagaaggatgacctagagttcgagaaggagctagtcggcaacattgcagagttcatccgcagcagcgcggaatacgacaagaatggcttcgccgaggacacagataagccctccgggaagctgtccaccatcagcactggaattaacatgtgggaagaggatggagaacctgatgcatcctcatcccctcgcagggagacagacccacgcgacgcagcacccgagcgaaagaaagcgaggttcatgataccaaagagcgcccaggtggacagcgaggtgcggcgcgagctgcaggagctcatggacgccagggaggcgggcatgtccttcatcctggggcgctcgtacatgaaggcgaagagcgggtcgggtttcgtaaagcgggtcgtgataaacttgttgtacgagttcttgaggaagaacagccgtggccctgcgtacgccgcgagcataccccatgcctccacccttgaggtaggaatggtctaccaggtctgacaaacagttagcggggtgtgtaaaggtagaagaaactagaagagatgagacgacgcttgtatatacacccacttgttgctgccgataccgttaacataattacaggataacacagagtagagacatttgtgaaaacagctgtggatagcccaaccagaagcatgtgtttagtttggtgatatgtttgctgctgctgttgacttgctgagtttaaggcagtacttgtgagcggtcaaaaaaaaaaaaaaaaaaaaaaaaaaa

SEQ ID NO: 12494 - DNA, 9095 bp, Zea mays
  misc_feature (4060)..(4060): n is a, c, g, or t
  misc_feature (8123)..(8123): n is a, c, g, or t
  misc_feature (8388)..(8388): n is a, c, g, or t
  misc_feature (8745)..(8745): n is a, c, g, or t
  misc_feature (8835)..(8835): n is a, c, g, or t
gagcaaatttctaaccacgctgttcggtttttgacagcctcagaattttcttactaggggtcgacgaaagagacgggacgatggttgttgaagaacgcttgactgcagaatcgtattttcttttatcctaggtgactatagaattcatgtatctttgatatgttctttacttactaagtaaaagtaatgtatggtcgtatggacagttgcgtaattgttcaattgttgaatgtacagccatgatgttgatttaatgcatgttcagcgatttacttggacgtgtgttctcctaaaccatgtgcatgtattgaatatttgttcttgtaaaatttccttagtttatgttttaagggtttttatgtctcctataaaaccgcgcgctaagtaaaataacttatgctatatcatgatagatacactttctagtttgtgaaggagtttaatgtggaattttcttggtctcatattaaagcattccataatgacactggcataaatagacaatgacattcagggttgccttgcatcttagatatactatatacctctttcgttttagaaatatctacgtcattggttggttggccggctgcttccaggcccgtggcgtcccgttgaccttgcacaacgcctgtttggttaactagagaggagggtgacaacatagacattttttcacttaattgcctacatgcgcggaaacacacctatcttgcgtatccagcggtccggactagctggagaccggtgctcgatgcccagtcaatcaatcacgcaaatagtaatcgcatgacctcacggtcttgacaattatcctatttgtttggtatataaaggaacccaagccaaatgtaaggtgaacatatttcacaacgaacgttattgacgtctctgtagactgtagcttagtagttatttataaatactcgtcatgggttttatgttaattttctctagttattttaaccatatagttcaagtcctaagagtgttgttaatagcagatgtcttttactttcgtgtttagatttgacaaaaagcttagcgtctgtttagaagcacctcggtattaagaaactagtttatatatctagctttctagaaactagtttatgaaaaaaaaaactagatcaaagtatttggaactcgatttctaagaaaccagtttttagtttttgttaatacacgatgaatatcttagcctccctctattttaaaaatggttgactcaattaaacggtggcaaaatacatgtaaattccgcgaattaacaagggtatgccataaataaatagataaaactagttttagttttagttggagaaggctagcttcttgatttttaagaaaatatgaatcaagtttttataaaccgatggtataaactgatatgtttagaatcacctcagtttttataaaggaataggtgcacttacaaaggttagtctttttgtgcagcttttacatatgctcaatttagagaatgtagggtattacatatattagtatggttcggacatctctaatcacgtgttggtttcggctgtgcccatatttaacgtaccactcgtttatgccctcgctctctccactatttttttggtactttacgtatcccggtatctatccacgacgacactattgattggtagtttttttccctctcatataaattatccattaatcacttgtatctactcatgttttattcatgaaactagcattgtctacctaactcagtgaaagtaacattgtctgctcatttgtatttattcgtgctttattcaatgacgatggattgatgatggtgatgagatgaaactagcattgtcttgtgcttttcgttttaaaaagttggcattcatctgttttcccatcagatgcctatatataatttcacaagcttcctctgaacacaatgatggattcctatctaaccaggggcggacccagcacctaggcacctcaggcggtggcctgggctgcctcgcaggttctgatagatagaagcaagtataatgcgtagaaacaagcgagcaacgtagcatgtacacggcgaaagtataggcacaaaggatcacattgtaatctcgcctaggctgtctctaaatcctgggtccgccactgtatctaaccccgtataattcactgctggcagccttttaaaagtgcacccaaaaagaaaaaaaggtgtgggacaagaaaaggcacttcattagggcctaaaaggcactaaaacggaaaaaacgtacaagtacgtatcaagcctgttggacaagcaagtaagcaaccggctccacgcgtcccgttccgttcgatagccacacgcaagctttccagtcccctcgccggcgcgccccctcccgcgggccgcggctacaagaacggaagctgcgtgcttcgcttcacttcactccacttcatccagggaaataaaaaagcagggtggtttggaatccacatccgtagggcgagcggctcggctgcggaggggagcccacggcaaacggcatcccgcatccctatcttcctccctccctctctcgctcgcgtcgcgtggttgtctgcctggctggttgccctctcctccagagacctctcctgtctccacccctttggcctttgctcgtcgtggcgctctcgtacgcgcccaacgaggggagttaccgcccggtttcgcttcgtacggacggttgatacttgatagcgagttaatactctaagacttaaaggaggcgcggcgggcgtgggggcgagcgagcttgcttccgggggttggttcttgcgggaagctactagaaggaggggggacgaggaggagtgtggagtgtgtcttgctttgcctcgcctgtcctggtttgttagcctcccgctcgctcgaggccaagccgacggacaaatcttggtttgggacgcgccgccgcggtaggattcgggtgcccctattccctgtttctttccgaggattccgcgaggttcgctgccatggagccagcaggcgtggcgcattgaggcgtgcgtgcagggccggagagggacatggatctggagtccgcggacggagcggaggcggctgacgggaaggtgagtccttggatttgaagctatttcctgtgctggggcttgcccctccgttctcttgagtcctcactgcttgctgcatctcctgcagcggcgtggggagtcattgcgcgcgacgctgctgctcgcgtaccagagcctcggggtggtgtacggcgacgtggccacgtccccgctctacgtctacaagagcgccttcgctggcaacgacatccagcactcggagggcaacgaggagatctacggcgtgctctcgttcgtcttctggacgctgaccctcatcaccctcatcaagtacgtgctcatcgtgctccgtgccgacgacggcggagagggcggcaccttcgcgctctactccctcatctgccgccacgtccgcgccggcctcctgcctggcggcggcaccagagatgagctcatggaggaagagaaggtcaccgggcgtcgtggtgagcggcctgtgtccagggtcagggcggtgctggagaagtacagagtgctgcagcggctgctgctgctgttcgcactgctcggaacatgtatggtcatcggggatggcgtgctcacccctgcagtctcaggtatgccgtcttggttctggatggttggtctccatcgcattatatttgtttctgatgcgaatgatgttgctccatttgcagtgttttctgcggtatctgggcttgagttgtcgttggaaaaggaacagcacaaatgtaggttaaatcttctatttactgttggattgtgtttattttagtcagctttatgtattatgttcgattgtaccatgtttatgagatgtttactgcaacttgtttgtgtgcagatatagaacttccagtggcctgtgccatacttatatgcttgtttgcgctgcaacactacggcacacacaaagttgggtttctttttgcaccaatcgtatgcatttggcttgtctgcataagtgcgattggcctctacaatatcatccgtngggatccccatgtttatcgagccctctcgccatactacatgtatcaattcctcaggaagactcaaactggtggctggatgtcactgggtggaatccttctttgtgtaacaggtacatataagttaggctgctgttgcttaatgtttgactccagcaatgcctgaattctagtgacagaagtctgacacttcttttccctattgttgtaacaacttttaggctctgaagctatgtatgcagatcttggacatttttcgcaatcatcaatccaggtatagatgactctgttgcaacttacaacagcaaatcaacgactacgatacatgattactgttataattatggaattttactgattcccactgttcacccttttcttgtaataaaatcatatctagtttacctcagtttcttattctttgtacaagaaattaacagatactccagttgtttaaatggctctcactgaaactcctattttcattatatttgcatctccctgacatacttagacttctacaaaatgtagaaaaattgtaacacactaagaacccttggtatattttgtgattacccctaatgtttaaattatttttaatccatataattttttccttgggaatattgtgctaagtcagttcctggctcagtaaaatcattcctgaaagcatctgcctcttgactgaaatcttttaattatatggccggaaattttaatttttcatgcaaactgcactgccaatttactgatttctttgaaaggtcaaccgtgtatctgtactccatgtgtgtttatattttgtcattatttctgtagttctttatattcatactcagtatccttgacatccctacatttcatatgatattggacattctcatgatctccgaatcttgattgtgctactcatcacacttgaataaggaaaatgcaaatgttgaactgtcttcagattcttaatgttttttttctaaaaaatcctgacagattgcatttatatccgtggtttatcctgcacttgtattggcttatatgggacaagcggcttttatttcacaacatcacagctttgagagcagttatcatattggattttatgtgtcagtaccaggtagtttttttaatttcccttgcctttttcctttaggaaatgtggttatcattattggagtaattatgtgtcagttaccagaattccattaaaaaaagacctgaatattttgaagcactgatgtatgcaacttcgtctgtagaaacactcagatggcctgttctggtgattgctatactagcagctgtagttgggagtcaggcaattattactggaaccttttcaatcatcaaacagtgctcttcattaagttgtttccctggagtgaagattgtgcacacatcctcaacactgcatggtcagatatacataccagaaatcaattggatgctgatgatactctgcctggctgttactattggtttcagagacacaaaacacttggcaaatgcacaagggttggcagtaataactgtcatgcttgttaccacttgcttaatgtcactcgttattgttctttgctggaacaagagtatcttccttgcccttggtttcctacttttctttggcacgatcgaagtaatctacttctcagcttcccttgtcaagtttcatgaaggtgcttgggttcctattagtctctccttcatatttatggtgatcatgagtgtctggcactatggcacaataaagaagtacgagttcgatgtgcaaaacaaggtttcagtaaactggctcttaaaccttggcccttcactgggcattgtacgagttcgaggcattggactaatacatacagaactaatgtctggaatcccagctatcttctcccactttgtcaccaatctgcctgcgtttcaccaggtaacttaccacttcatagttcataaacatatcaagcagcagtttttttctgaatgcactgcccagtgatctgaataaacagcatcagtgcatggggcagtctatggatgtaacttgtagagttctgacaattgtttttcatcaggtactggtattcctatgtgtcaaatcagttcctgtgccacatgtgcaaccggaggaacgatttctggtgggtcgcattggtccaaaagagtataggctatacagggtcattgtcagatatggttatcgcgatgtgcagaaggatgacctggagttcgagaaggagctagtcagcaacattgcagagttcatccgcagcagtggggaatatgacaagaatggcttcgtggaggacacagataagcccttcgagaagctgtccaccatcagtactggaatcaatatgttggaagaggatggagaagttgatgcatatgtatcccctcataaggagatagacccacacaatgcagcacccaagcgaaagaaagccaggttcatgataccaaagagtgctcaggtggacagtgaggtgcgccgcgagctgcaggagctcatggacgctagggaggcaggcatgtccttcatcctggggcactcgtacatgaaggcgaagagcgggtcgagtttcataaagcggattgtgataaacttcttctacgagttcttgaggaagaacagccgtggccctgcatacgccgcaaacataccccatgcctccactctggaggtaggaatggtctaccaggtctgacaacagttagcagctgtgtaaaggtagagagatgagacgacgcctgtcagccccacctgtatatatatccacttgttgctgccgataccgttaacacaatcacaggatgacacgagtagtgagtgacccttgagcacagccaatgctgaggaagcagctgaagatgagatcatctgtggagagcccagccagaagtatgcattttttgtttgtagagccttttgttgtgccggtagttgttaagtttcgtatgtttgctgctgttgtttagtttcgtacttgtgagctgtaattgtctgtaagagtgactagcaaaatactgtagcatttttgacgttcagcggcctctgtagttctgtcacttgtctataattgaggttgaggactgtataggtagcagctaaacattctagtaggggctgatgtcgttgggccgcctgtattatagactgggccgtaaagcacagcttctttcgggcctaagaacgtctggaagacaaaccacaaaggaaaaaatgtctctcttgtaccttcttgaattgtcgccggcccagttcttctccgcgtcgtagccggacatctcactctccaggtctcaaaaccgatatatgtttacacatcagttagaatgctttaagattttagtgtttacctttccattttcttgagttaaatcgaattttttttaagacttttagaaatgctttcataagctttagataatatattttggtgcgtcatgtcatgtctcaacctatgtgtgaagttttcccccctaatttttagaaactcagggctggtttggaaacttattgagtgggaaaataaactaattttccactcaattcttcgaaattctggaagaaatttaagttttcaaactagctcttaaaggtattttttgtagtataaaacattatcagatatattgatcggatctttttttaactaaaaaatgaaccgccatgaataccatttgtaacgaggccgggagataatctaaccagtttagttcgagcaaaagaaaatcatactatgatgagagcgaaatgagccggtccacaacaaactggccgcgaacgaggccccaatcatctccgctcctcactttatcttccataggtagtgcatactatgtgcaatatagccttctgttcatttcggggcccggattcagcaagttgttcccctcgtgcacatgcgctcttcagctcttttcttcatcgaatcgaagagcgagaatcgaaaaggctggtgattgttagtttagccatcgcctgtagtgcaacttctgtctgtaccagtgctccaggaaaacgctagggtctgtcggtcgggacttgggacatatacgagtgtaacatgaagngtagagtgaggctgtgtccactgtccagtagatagtacatgtgaccgtgcaaattgcacagtatatatcactgtctgtaatgtaatgtgaagtttgagatgaggcaggagagccggtagagacagcggaacggaagagcgggaaacacaggatcacgagctgccctgtcacgccagtcctctttcgtacatctgctgccgcccccgagtccattcctgtctgccgaaaacctgaaacgacagtaacaggaagccatatgggcttncatagctgagattgccggacgaccctacttctacttagctggttcttgggatgcgtacaagcaggggtgaaaacggttttccggtccgattttcgcatactactttattttgatactctctgtttcgatgttttcgtttcttacgttcgattttgatccattatcgatttcttcagttcgctttggttcacatttccgatggttcgttttcgattttatttctaaaataaaatatgaaaatgagaatgggagagaggtttagctgcactcttccagaaacaaaggtttagcagcgtagagcgaggaatcagtgcccttttgaccctttgcgcagcacagacagtgctggaacctttncaggctcgccccccggccggggccgaccgtcacatgtctcgcacccgtgaatagtgctgagaattgggagcgtgcggtaggctggcttcnacgaggtcctctaaagggttctctactctaaatatagaggatcaaactgtcctctacgctctccagcaacgtcctctaaacggtcctctaaatttagaggtcactgctggattctctatatatagagtttctctaaacggtcctctatccatttgactactttaaataaccggtttagcaaaactaaaatatgttcaatacattttgagaagtatgataaatacgtgcgtaaaaaaataaaattttaaaatgtcttttat

SEQ ID NO: 12495 - DNA, 2135 bp, Zea mays
aataagtgtagttagcatagtggtgtaagtgctatattttaaacttggtggtcaaagttcgagtcttggtgatcattattttaaaaaaaaaaaaaaaaaaaaaaaaaaaaaaaaaaaaaaaaaaaaaaaaaaaaaaaaaaaaaattcgaacggaggtccttttcttctttctcgtctgcttcctccttccctcgtcgtcctcgcgtcgcctccttcggccctccctattaatacctgcctcctcacaaccaggtcctgtcctcggggagccgaatccacacggaccacaccagaggacgcgggggacgccccggattcttcggattccaggatggaactacacagaaatagcactaatggttcctgcctcagtgcatgtgggccactgacagactactacattcctgattacatactgaagccggcctatgaaccggtcactgttgataatgtgccatgttgtcctgtggtagtcttcatcaactctagaagtggtggccaactgggaagcagtctgataaaaacataccgtgaacttctcaatgaagcgcaggtttttgatctctcagaagagtctcctgataaggttctacatagattatacagcaactttgaaaggctcaagtctagtggtgaccatgttgctactcaaattcagaagagcttaaggctaattgttgctggtggtgacggtacagcaagttggctgcttggagtagttagtgacctgaaactatcacatccacctcctgttgctaccgtacctcttgggactggaaacaacctccctttttcatttggatgggggaaaaagaatcccgctactgaccaggcagcagtgaaatcattcctggatcaagtaaaaggagcaagagaaatgaatatcgatagctggcatatcatcatgaggatgcgaattccacaggaaggcccatgtgatcctattgctcccttagatcttccacattcgttgcatgctttccaccgcgtatcagcttgtgactctctcaatttggagggataccacacattccgtggaggattctggaattattttagcttgggaatggatgcacaagtatcctatgaattccactctgaaaggaagagaaatccagagaagttcagacaccagctaagaaatcagggtacatatgctaagcttggatttaagcattccctaaaccatctttcatcgaggaacatttctcaacttgcaaaggtgaagatcatgaaaagacctggttcccagtgggaagagctaaagattcctcgcagcattcaatcagttatctgcctgaacctgccaagcttctctggaggattgaatccatggggaacacctggcacaaggaaagcacaagacagagacctgactgcaccttacgttgacgatgggcttatcgaggttgtcggcttccgtgatgcctggcatgggctcatcttgctggctcctaatggccatggagtattttggtttcaggcccaccgaatccgtttcgagttccacaagggagcagcggagcacacgttcatgaggatcgacggggagccatggaagcagcctctccccaaggaggacgacaccgtggtggtggagatctccaacctccgtcaggtggccatgctggccagcgacccgtgcaggtccaagagcgtgaacgagccgtcctccccgtcgtgccacggccatgaggacgacgacagcaacagcctggaggacgaggacgagtgggaggacgggaggaagaagttcggtgcggcggccaccttcaagatccccgacgaggtggacatcgctcatctcagttagaatctagaaaccccgccggctgcttctgcgtcggttggtggtgctgagtctgtgcatttcagagcgttgcatttcagagcgtttgctgcttgctacagcctacagtgctactgctcccttttttgttttgttttttggttgcctccacgagctcagatttcagaagctaaccactgctgttggtgaaaaaaaaaaaaaaaaaaccgacgaccctgtaaattttcaagttttagcagccatgtgtatttcactggctgataatttttttgcgtgctacgtaatttgaaacgtggaaacgacttgtacaaaaaaaaaaaaaaaa

SEQ ID NO: 12496 - DNA, 3672 bp, Zea mays
cattcgattttaatctgactgcaggggaaaaagaatcccgctactgaccaggcagcagtgaaatcattcctggatcaagtaaaaggagcaagagaaatgaatatcgataggtactgtcttgcttacaaaggataaaagataatgttttgtcatgcactgcatgagcttgtccatccatctcatatgatgaagtgttttatgctcttttccaattattgttttacttatcttaacaacattagaacatatccttatgttcagggtacgaaagaaaacactcaattcagcttctagttgtatttttctgtgtcagctggcatatcatcatgaggatgcgaattccacaggaaggcccatgtgatcctattgctcccttagatcttccacattcgttgcatgctttccaccgcgtatcagcttgtgactctctcaatttggtaagaaacacctttcagatgtgctgtatataatatagagcagtgtcttattgattttattttttcaggagggataccacacattccgtggaggattctggaattattttagcttgggtaagagttctatgtaatctgtttattctaccactttgaaccataaacttttcctggggaatgtttgatggtgtatggataatgcagtagatgcaaacatctgtcatttctatagggaattatgatgtcagtttgtatgtcgggctgcaccctctttttgtgggggacaaagccggaacttgggttccattatcttaaaaaaatagggaattatgatgtcccagtgaattcttatgtattcctgctttatatatatgtaagaaaaggttagtaagaatgatagtcataatttgaacataccataggaatggatgcacaagtatcctatgaattccactctgaaaggaagagaaatccagagaagttcagacaccagctaagaaatcaggtatattttgtttttaggtttgtttcaaatactgctcttttttcacttacctcgctgtatcattaggatttgcaaaccccatcagcatggttagtataatgcatttctttgatgcagggtacatatgctaagcttggatttaagcattccctaaaccatctttcatcgaggtactttgtcactaatgcagtctataatgtttctgatattgatcgaattatagttcaattttctataccagcatgttcagtgtagcatgtatgacattaattatatctgtataaggaactccttcaccatcactttaagagtctctgtattccttgacctctgatatgcgttatgcgtatatgacctatacaacttccactttcaggaacatttctcaacttgcaaaggtgaagatcatgaaaagacctggttcccagtgggaagagctaaagattcctcgcaggtaatataccactgtcgcccaggcatgtccatgtacgattgaggtggactggttattggcaagaaataaaattacgaattattataaaatctgacaaacattacccctcttgtttcagcattcaatcagttatctgcctgaacctgccaagcttctctggaggattgaatccatggggaacacctggcacaaggaaagcacaagacgtgagttttccctgttgaaacctgttaggagactcgattgctttgttgatgacatactattggcacttggcagagactcattagttttcatggcaatatgcagagagacctgactgcaccttacgttgacgatgggcttatcgaggttgtcggcttccgtgatgcctggcatgggctcatcttgctggctcctaatggccatggaactcgtctagcgcaggtggaaggaactagtctgctctgtcagcactcagcggctcggcacacagtgcgcctaactaggaaaggaaactgaagatttggtgatgagtgtattttggtttcaggcccaccgaatccgtttcgagttccacaagggagcagccgagcacacgttcatgaggatcgacggggagccatggaagcagcctctccccaaggaggacgacaccgtggtggtggagatctccaacctccgtcaggtggccatgctggccaacgacccgtgcaggtccaagagcgtgaacgagccgtcctccccgtcgtgccacggccatgaggacgacgacagcaacagcctggaggacgaggacgaggacgagtgggaggacgggaggaagaagttcggtgcggcggccaccttcaagatccccgacgaggtggacatcgctcatctcagttagaacctagaaaccccgccggctgcttctgcgtcggttggtggtgctgactgctgagtctgtgcatttcagagtgtttgctgcttgctacagcctacagtgctactgctccctttttttttgttgttttttttttggttgcctccacgagctcagatttcagaagctaaccactgctgttggtgaaactgctcgttatgatcccccattgttctgtaaattttcaagttttagcagccatgtgtatttcactggctgataatttttttgtgtgctacgtaatttgaaacgtggaaacgacttgtaccaaaggtctgataccgtgtactatggagtatgtaggagagtagaaagcaacagattttggatcacgtaatctgtcagaggaggagtcgtcacggtaacaaatgacggctcggcttctggagttcgctgcgtccgtccgtccgcccgccgctgtttgataggagtactcccgcacccgcacccggttccaggccaaaccgcgttccccacgcgcccaccagaaagcagaggcggcagcataaaaggcccccgcgcgcctcgccgcccgccacgtcaatccaatccacgacacaaagttgcggtgagcaattgcaaggcgatgagcttgaggtacatgagccgtgtgggagcgcgggtggtgcgggagagcacgggcaggtcggtcaaggcgcaggcgcaggcggcgtccatggcgaggagcggcggcagcagggcgccggccgccgggtcggtggagtcggggagagcgagcgccgtggcggcggcggcggcggccaggaggaaggcggaggaggagaagcggcggcgcgccgagcaggcgctgcgcaccgtcatgttcctctccgtctggggccccaacacctaggcctagtaggaatcaaggagtgttagcatcatcgtgtgtagcgttctgtgcacgtttgtttgtttgtttgtttgtttgtttgaggttcagaaaacaaagtgtaaattacttacagtggtataatctttgaagacatcacatccccacgttgattctttggcgaaacaaagttaccgagggggcttccactttccacgacggcgttgaacgccagcctgagctacaacttccaggaggcaggaggcaggaggcactcaggctcatcgatgctgtgactccagagctcacgaagtgccgaagttgagcgaaaccaaatggcggttggttgcggtggtgcctgcacacaacttgcgggaggcagacgtgctgaacagcaaaccgcgacaggtttcacgcacacagggtgtagcgaattgggctctggggatgtgtcgtgtggtgggtggggcgaccggagctgactagatcgaggtggattagaacaaagtggtacactgccgtcactgtatgggttgggtc

SEQ ID NO: 12497 - DNA, 928 bp, Zea mays
catcgggtggctccacgccggccggggcaaaaccactttcacctgaactcctgaagcaaaagcaatggccatgagagcgcttccgctgaccccttccaggagctcctcgtttggagctcaccaaaccaggccgagcggtggcggccccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccagaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggttgacaagctaggaagatacgctcacgttgcgtgcttggagaaccccaaaccggcgaactttttcgccaaaatcttcgccagatgaactatgctgcgtccgtcgaaagcgttgtctcgctcgctcgtggttagatagtacaatatataggtaagtgttgttgtggcttcaaaggggacaagattgtgcgcaatttttcaaatggattggtatgtattgagcatcagcgcgttccatagttccgactccctcttcagtgtattcaagtcgaccatgaacccacgacccacaaagatcaagaacaaactactgaaaatgtttacgtagtagcataagactttcacgacaagttagtagtactctggaggtcatgtattattagctcgtgttccttgtcataatacaggagaagcttccaactttaggcttatttataagaaaaaaaaaaaaaaaaaagcggcc

SEQ ID NO: 12498 - DNA, 6879 bp, Zea mays
tcggtacccctgccattccagtgtaacagtgctccatcggatcggaggctgtttaattagcaacaaaatattcttagcctctcgccattaatctctaagaaacaccacaacttcacaaaaacagtatgcattgcttcacagtatcctctgagccctgacggtacggtgtccgtcctttcttgtgtcgaaattatatgggctttgcctcgtgtttctcctaataacccataaaacagaatttttaaaaaggtctacttatacatgagtttaattagcatttgttttaagaattacaaaaacagtgtgcacattgaagcaaagggtagggccaaaaatgaaccgagctcgggtcggtgtagctcggtcatatagcgagctgagaaattaggtttggcttagactcgttcaggctcgctatccgatcgcgagccatcaaactaagtctcatttagaacataaattgtatatttttattgtatataaaataaaaaatatatgtaccaaaaatttatcaacatattttaaactacgtatatagcattgggtccataaaaataaaaaaaacatagcactgtatgattagtctggcccaggtgagctcgagcgaacctccagctgtttttttcccctgccatctcttctcagcccccactccccacacagcagttcacgataagacagaaaaaggaccggcaactgttcgccggcggggcgttgtgtgacgttgattcgatcacaagggccctgcgggagaccaacgaaaggccatgattgtttcagcatcgatgctgctgaatgctacgacgatctctgatgggggatggagtcaatcaagcggagacattgctacgaggcaggccatcatggagattgtggcaactgaggcccacctgcccaaatgttttccgtgtgacccccctcgctcactcatcagcaagcttagcatatatgcacaactgttcattaatcaatacattgaaaaaggctgcacgcagcccgtgttcttttgatccggaaggtcagaggtattagcaatcagtgtccggcatccagacactacgtacgcacgagtaattggagatcctagattagaataaaccacctagagagcttgatgctttctagagctgaactcatccaggttaaaagcaaagccaggacttctcggggctctatgtcagattgtcagtgttgcaccttgtactgatcgggagacagccaggccaagcaaagtagataaacaaaccatgtctacgattgaggcattgatggtaccgcgcacggtgcacatggttactttcaagctagctaatgcaaggcgctatgcactaatgtccccttccagagaatcatgtgccctgttaattggcttggctcaatgctctctaggggcaacaaccgatgtttatatattgctgatatatgcagttatagagaagagagaaaatatggatatacatggataagatcgtaattcacaactaacccaccataaatcacagtagggagacagagctctctctaatatagaaatagacgtaacaaactgcattttcatctaataccctctcaatcacaatagagaaaccctaagcccaacacagctcaagtaccttctttttcccctcgtttatgcgttatcatgcagagtgtttctgtgatccacaaatatccctttctgtacagttcaggtaaaccagccacgcagcgcccagtcgtgagtcaccagatcgggcatgcaaccagcttccttctacttcctgggccacacgcagcggttattacagggaggcagacgcagcgccctcgtcacgtctgaactctgaagcctgagcacgcccacgtcgcactgggccagaatctccctctcgtttcagcaggcctgctttgcaccacgtagccttgttgccaccacacaacagctgacgcgccgccgctgcttgctggtcctccatatagaaaggccggatcgctgggcgaacctgtaagaaccactttcacctgaactcctgaagcaaaagcaatggccatgagagcgcttccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccagaggtggagggaggatgacgagggagcaggtgtgtatcatgcaaagcaactgcggctcgataatgttatgttatcatccgtaatctgatttatttgttgtttgatttgcaatgaagtacggagcacttaggcggaagattggtggcacctaccaggatttcttcaagtcatatgttgaaggtatcttatctacacctttcccgtgagaatatttaaacgccaagtgaacaggcccgtatattgcctactggtattcagattagcactgcatcactgaataatccgtgtagttttttttggaaacaagtgtagtatgatgaaagattgaaagtagtgtccactgaaaatatattatcgcacacatccttttttattcctaacaagagagaatatcaagttatcgacgattgacgaccaaccaggattggtcttcgagtcatatgtcgaagtcgacgggcaatacgtggaggagggttgggtcgacaagacctgcaagatctgcaagaaggacacaaggggggagccgaggcaggttgacaagctaggaagatacgctcacgttgcgtgcctggagaaccccaaaccgacgaactttttcgccaaaatcttcgccagatgaactatgctgcgtccgtcgaaagcgttgtctcgctcgctcgtggttagagagtacaatatataggtagtgttgttgtggcttcaaaggggacaagattgtgcacaattttccaaatggattggtatgtactgatgagcatcagcgcgttccatagttccgactccctcttcagtgtattcaagtcgaccatgaacccacgacccacaaagatcaagaacaaactactgaaaatgtttacgtagtagcataagactttcacgacaagcaaattagtagtactctggaggtcatggttttatatagccggctatagcggtcgatatatccagatatatccattttagcagcgaaaagttacgccgtttagcccaatatatcccgatatatccagctatatcgcgatatatcccgatatttgcactttttagaagtttggggataaactcgttttcccactatttagaacactgctctggaggtcatctattattagctcgtgttccttgtcataatacaagaggagcttccaactgcaggcttatttatagaactgtggagcacttacaaagctattgcgttttgcttacctaattatgtagttatttatataataatgtgtctagatgcctcttgcgttgagcatagacaggtacaccctgcacctgacgatagtgcatccgatcttaaagcccggcatcactgtaaacccaacaccgatctttgcttcctccgcggtcagcctagctggtacgctttccatgtgcttcctttggaaccgaacgccgctcttgacgaagaacatctcggcccttggtttcaagaggcgagcaaccgtgagcaatgcccagacagatctagccatcctcgcaaacccccgcgtccgctgcgtccttggatggccgcccgcctcgacaaatgctctgtggtccagagttcccaggaaggatacctccatagtacttggcacagcaaccagatacttctcccggcagaatctcccaaaggcggaatttggtgactccacaagagcgtcgaatgggtcctttgaactcataacacggtagaaggaatccatggagaaatactcctctttggtcgccgccagcatcgcccgagcaaagtaggcctcaacgcaatacttcctgtgagcccttttctcaaacacaagggatctatcggctggaaactttgagcagtcgaggtcccatccagctgaaaccttcatccagctgacgacgagctttgtgaaatcatgtatacacttcgacgagttctcaaacaactcgatgaacgtatcaaccgatcccactttgccaatgccgaaacttatttctttattcatctgcgacgctctctggtcagcctcctccttcagctccagatttctcctttccagttcttcgagctctgctcgcagcagaacaagctcagagtctttcttgcatatgtcggcctgcagctccagggcgagcctttgacgctcatggatccgtgagctgacacgagactggtgcattggattgctccacttatcggcaccgaagtagagatctttaagcccagccgtctcttcaagctccgacgcaaaacgctcaccggcgaccgcaaccctttcaggatcatacggcacatgtgcctgctgaaccttcacataggccagcttcagaccagagaccgcgccaagaagcctctcgacaaccgcttcctcgtagcgggcggtggaagttccggaacagctctcgtggtcagagacttggtgtggatatactttcaggtgcgcgccgtcttcgctgctgcccccgccggttgtgctgccggcgttgggcttctcgccgacgttctccgccacagcgacggaatgcaccttgcagatgtccgtgattcgcagaagcaggctggatgacgccctcctcggcttccccttcgccggctccatctcttaagattccgtagtcagccgcggcgtccgactccgagcgtctgtgatcttcagtctgcgtgcgtgagacagcaagtcaaacgagcataggttccaacttccaagaaaggaagatcgcggcttttgaagatgtctatttcgatcgaatcaacgccatgaacacggaatgtggatttaagattgcgtctactctagccgactggttggcgtccaggagaaggaaacaaaatagtacaaaaacaatcccagaatagaagaacaggccaatctgccttgcagactctgagtaatataccttttagccggcgggtcctgaaacttcaggaactgctggtattgcgcatctggacggacccaggaagcgcaaaagcctgccaagaataggacccagcgagagagatgatgagatggcgcagaatctccagggatccaacccgccccgcctcggggctcccgcttatttagtggcagaggacagaggtagagggttttgtgggggtgggggagggaggggggagggaggcaacgacctcgtgggggccagtggattcgaacagagaaatagtactgtggagtacgtagaaatggggagtggtagccaaacagacaggtggtggagttcagttccttcttttattgtcatcagtgcctctcgggagagacgtgggggttttcttttgtaatcccaagggctgagggatgctgccgaccgaaggaagcagaccttggaaaccctagcagccgcgctgccgccttgttcgtcgcctctgaccgggttctctgctgcctggaggcgtaaattaaaggcgctaaccgctcatctttttatttcaggctctgtaactgcagatctgacttctcagcttctattccagatcatgcaataggatagaaggggaatatccaggccttcaaagaaagggccagtgaaaggtgaaaactgatcttgacccggctttggcggttgaataagttcggtcttcactcttcacgccatcatggtagtttataaagaattccattcctatggtaggtattcagtgccattcagagcgccctcacctcagtattattgtaattaaatctcgaatcatgaatgcctgaatctgccctgctcacccggacaacgctggtcatggctcatggctcatggccctgcaccctgcagtagtagtagtatgggaataaacaagctcacacgaatcacgatctgaactgggcgaaggcacacacctacactaggctcaggtcaggtgtagtacatttcagaaatggacagcccagagtcgccctaccaaagcaacccggacaaagctgtttccctctttcctcgcgaatttaaaaactcaaagcaaaaaaaaatctatatatgatttcgcgctttaaagcgcaaaagcccctgctaatttgcggatcgtaaggcatttgagatggcaagtagtaatggcatccacgcaacgtccaactgtaaatctcgcaaagctcgtggtgtctcgttttcttaatgagagtagtaacaattaacaaacgctctcgtgcttgagacggcaccattagttaggttaggtcgccactaatatcatccatttagcccatgctttgcctgtcacggcgcctccgatccgtattgaatactatagcagtgctgattaatacgggtctcgcgtcggttgccaaaatacacgggatcacaaatttcgctttagagatacggagcttcttcttcggtgtagaaaagagaactacaaaaacaagtagaagaaacgcaaacaacagccatccatccacgacgtgtgtaataacaatgaggaggtattcagaatcctcccttgtgatacgaagcgagtggatgtcatctcggattgaatctagcagacgctagacatccctagtgttgtcgtcgaatactcgactgcataatcgctccttccataaattttatgaggttttgtttgagtactttagtattcgacccaatctacatgtattgtggtggattggggtttacgtgtggattggagcgattactagactacccaaacaaggcctgatgtgtatactatgatctgtgt

SEQ ID NO: 12499 - DNA, 569 bp, Zea mays
gagctcctcgtttggagctcaccaaaccaggccgagcggtggcgggcccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccaaaggtggacgagcgtggtcgcggccgaggtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggtcgacaagctaggaagatacgctcacgttgcgtgcttggagaaccccaaaccggcgaactttttcgccaaaatcttcgccagatgaactatgttgtctcgctcgctcgtggttagatagtacgcgcccgggcggccgctcgtgtggcttcaaaggggacaagattgtacacaattttctaaatggattggtatgtactaag

SEQ ID NO: 12500 - DNA, 723 bp, Zea mays
cctcggggcccctcgcggccggccggccgggaagaaccactttcacctgaactcctgaagcaatggccatgagagctctcccgctgaccccttccaggagctcctcgtttggagctcaccaaaccaggccgagcggcggcggccccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccaaaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggttgacaagctaggaagatacgctcacgttgcgtgcctggagaaccccaaaccgacgaactttttcgccaaaatcttcgccagatgaactatgctgcgtccgtcgaaagcgttgtctcgctcgctcgtggttagagagtacaatatataggtaagtgttgttgtggcttcaaaggggacaagattgtgcacaattttccaaatggattggtatgtactgatgagcaaaaaaaaaaaaaaaaaaggcccctcggaccgcc

SEQ ID NO: 12501 - DNA, 1372 bp, Zea mays
ccgggaaaaaaaaatggaattctgaaaaaaaaaagaaagatattgaaaagaaaaattgacttttgaaaccctttatttattatgtgtaacggaaaagagttgcgatttcttcttattcctatagaacgtctagtaacaagaatatgaaatcgtaaatagcgaaaaattcttgccttgcgcgggcacattggggcccccggggccggccgggaagaaccactttcacctgaactcctgaagcaatggccatgagagctctcccgctgaccccttccaggagctcctcgtttggagctcaccaaaccaggccgagcggcggcggccccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccaaaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggttgacaagctaggaagatacgctcacgttgcgtgcctggagaaccccaaaccgacgaactttttcgccaaaatcttcgccagatgaactatgctgcgtccgtcgaaagcgttgtctcgctcgctcgtggttagagagtacaatatataggtagtgttgttgtggcttcaaaggggacaagattgtgcacaattttccaaatggattggtatgtactgatgagcatcagcgcgttccatagttccgactccaacttcagtgtattcaagtcgaccatgaacccacgacccacaaagatcaagaacaaactactgaaaatatttagatagatcgactccttcacgacaagcaaattagtagtactctggagcaaggttttaaataaccggctatagcggtcgatatatccagatatatccattttagcagcgaaaagttacgccgtttagcccaatatatcccgatatatccagctatatcgcgatatatcccgatatttgcactttttagaagtttggggataaactcgttttcccactatttagaacactgctctggaggtcatctattattagctcgtgttccttgtcataatacaagaggagcttccaactgcaggcttatttatagaaaaaaaaaaaaaaaaaaaaaacaaaaaaaaaaaaaaaaaaaaaaaaaaaaaaaaaagaaaaaaaaaaaaaaattgagaaaaaaaaaaaaaaaaaagc

SEQ ID NO: 12502 - DNA, 947 bp, Zea mays
gcgttgggaccctcgaggccggcccggggtaagaaccactttcacctgaactcctgaagcaaaatggccatgagagctctcccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccagaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggttgacaagctaggaagatacgctcacgttgcgtgcttggataaccccaaacctgcgaactttttcgccaaaatcttcgccagatgagctatgctgcgtccgccgaaagcgttgtctcgctcgctcgtggttagagagtacaatatataggtagtgttgttgtggcttcaaagggggacaagattgtgcacaattttccaaatggattggtatgtactgatgagcatcagcgcgttccatagttccgactccctcttcagtgtattcaagtcgaccatgaacccacgacccacaacgatcaagaacaaactactgaaaatgtttagatagttcgactccttcacgacaagcaagttagtagtactctgggggtcatctattattagctcgtggtccttgtcataacacaggaggagcttccaactttaagcttatttatagaactgtggagcacttacgaaaaaaaaaaaaaaaaagcggcc

SEQ ID NO: 12503 - DNA, 3042 bp, Zea mays
cgcaccgtataaaaacaagtgtcagtgcgagccagcccatgcatgcgcagcgatcttggccatttgcggagccaagccaacccaagccgagcgagcagaaaatatgcgataccgtatgagggaaaacactagttattatacgaggtagctagcaataatacagatcggactcttcgcaaccggcttcacatgcacatcatatgatggccgcgccgggttcacatgaacgctcccgtgcctagttgcaccgatttcttaatcccgagcatggactataaaatcccctggcatcgcccccccccccgcatcgcaaacaagctagctaatcacttgtcaagaacaagagctctctacctgcattggctagcgtgatccgcgaggtagctggctgcttgttgtgatcgagcaatggcgtccaaggcattcgcgctgttcctggccgtgaacctggtggtgctgggcgtagccaacgcctgcacgcccaactgctcgaccccctcgacgccgacgccgacgcccacgccgtcgtcgttcggcaggtgcccccgcgacgcgctcaagttgggcgtgtgcgccaacgtgctgggcctcatcaaggctaaggtgggcgcgccgcccgcggagccatgctgcccgctgctggaggggctcgtcgacctggaggccgccgcctgcctctgcactgctatcaagggcaacatcctcggcatcaacctcaacctgccggtcgatctcagcctcatcctcaactactgcggcaggaccgtgcccaccggcttcaagtgctgagcgcctctccgtctcatcatcgccttgcgctgcctcccttccattccatgcatggttccgtttcagtgatgcatggttccgtttgattgctttcccacgtacgagaggtactgcatgcatgcaacgcatggccgtacgtgctctcgatttgtaatttcccagcctcttccgtccttgtgtgcatttgttgtaaagggctggcgatcacttctacgccggtgctaataagttccaatcaagtttcagtgttttgcatgaaaaaaaaaaaaaaaaatataactacatttttctagccgtacatagcgtatgaattagcgacgaatataggatttaaagttgggatatgttacctttaaagttagagtggtccaattcttataaaaatcaaaataaatagatgactttacatttaaatcctacgacatatgagaatcaaaagaattaaataaatcaaaatcatctatatacttaagtaggatcaaaaccacatagtggaccagggcccaccctatctaccctctagatccgccactggtatgaacacgtctgacccagtctagcaagagtccgttaaggcccggcacgagttgcgacaggcccgatctggtatgatatatggctcatgtcgtgtcggccaccagagcaccctaggcatggcccgtttggctataaattatgcggggcaggcctgtggtctaaccggtctaaggcaccctatcacatttaatagaaaaaaggttaaaaatatgctcaaataaatatttgagccatgtttgttggctttaaaagtctatctacacacttagccaaaagaacaaatataatcatgtgtaatatagatattttatgaaaaaatagaaaaataatattggggcataacgggcctaacccatcgtgccgcgtcttaggcccgaacacggcccagtgatcgggctaggctggtatgagcccagtaatcaataggtcatgtcatgtttgtgtcaggttaaaattgtatcgggctacaggtttattagacagctcgacccatttgacatctctagctaccaagtacttattagaagtgtgtgcatgagcaaccgatcaatatatattactattagtctataatagtacaatacctatacgttgtgacaatatatggtcatgagacggaggggcaagctgcaggtggctaaacggaagtggcgcttgtggagacgacgggcgaggtcagtggtgacaaagcttgctaacaaaaaaacgtacaagaaggtataatgcatgaggcacaagaaaaggctgcgtataccagcgtgggggtgggaacgaggtctgcgagccggagaactggcgatagccgccgtgctgccgcaaagtttagggctagtttaatatccgtaaaactggagaggattaaagggctaaatttcccttattatttaaaattgaataaaaataagaatctagcaccttcaatacctttcggttttctcgctcccactagtctttaagggcatatacaaacacttttaatatgatgtttcttgagatgtttttaggggggttaattaaaaaaatacaagagacgtgaagagcttgtctttacattactctctgtacataatatttcttaactatatttatgattcagaggctcagagttgtattatacagtctcttaattatctcttatacttaaaaatcgatccagggtttcagggttgtaggatgcaaactggctaactttctttcgcgccccgatggtcgacgagccccaccgtgcaacccggtaatgtgtcacgccacaactggttccccgcgcgccagaccggatgggcctagctagccctggcgcgtagagaggttgtccattgggaggagaagcaggatcacacggtccgtgggcagcattgcgggcggtggccgatccccacgctcgtggctgagggattcgtgatcagcagatcgatcgtgcatgtcgtgtgtaggatttgaggggaaggaggagcaaagccctaggaacggagaaggcgaggaacagttggcttggatcgtcggtgattacaaagaagtatgaggggttttgcaaaaatgttgacgcacgacgtacgacgatatagtggaaactattcttttagtagtagaaaaaagagattagttattagtctccgttaggaaaccttgatatatgtatctctatctttagtccaagaccagccttcttaaagggccacgacacgtgtttgtttaatagattcccgtgccgacaat

SEQ ID NO: 12504 - DNA, 1608 bp, Zea mays
cactgcacaagctattcctctggccttgattatcttgcgcgtgcatgcttttgtatggatatgatcgcagccacgcatccattctcaatcaccatttgcttgacatctaatgtccccctctggcctctgcaccacttgcgcacactacacaccgtctgatacgccaagatcccaagctaaaataacaccccaatgatcatatgaaaacaagtgacagtgcgagccagcccatttgcggatcggagccacccgaagccgcgcacaaaatattcgataccgtataagggaaaaacactatagtcgttatacgaggtaggcaaataatcctcttcctaaccggcggccgggttcacatgcatatatatgatggccgcggggttcatcacatgaacgctattgtgcctagtgcaccgatttattaatcacccgaggctgtactataaatacatcggtaatactgtgatcaaagcatcgctgtcgagatctctaaccactgcattattggctatagagagtgatcgcgatcgtggtagctcctggctttgtgatcgagacgagcaatggcgtgcaaggcatttgcgctgttcctggccgtgaacctggtggtgctgggcgtagccagcgcctgctcgccctactgcccgaccccgaccccgaccccctcgacgccgacgacgcccacgcccacgccgtcgtcgttcggcaggtgcccccgcgacgcgctcaagcttggcgtgtgcgccaacgtgctgggcctcatcaaggcgaaggtgggcgtgccgcccgcggagccgtgctgcccgctgctggagggtctcgtcgacctggaggccgccgtctgcctctgcaccgccatcaagggccaaatcctcggcatcaacctcaacctgcctatcgatctcagcctcatcctcaactactgcggcaggaccgtgcccaccggcttcaagtgctgagctgagcgcgttcgcctcccttgcatgcatatgcacgcacacgatgatgagtgaatgagtgatgcatattatggtttggttgcatttccacgtacgcgcgacgactagtccgcatcatgcatgtacgcatggccgtgatttgtattctccccgcctggctgctgcctctttatttgctccccgtgcatttgtcatgttgcaaagagttagccggctgtcacttgtatgccggtgatacataagttccaatcaagtttgtcttgcgctttaaaaaaaaaaaaaaaaaaaaaaaaaaaaaaattctggccgtacttgagcttatatggatactaccagtaacacgtatttagagcatattcagatataaaggctaattgccagttatctaaaaactaatcaaaatcagtttcagtatgcctaattagaagggttcatttttagctaagtctttatctaattaattgttagctaacaatttttagttattataatacaaatttggtataagtagctttataattaaatgtactaatcaaccatccactaccggaatccgggcctttgccgagtgctggcggctttgccgagtgccttttatcgggcactcggcaaacggcaaagaagactttgccgagcgccgcactcggcaaag

SEQ ID NO: 12505 - DNA, 928 bp, Zea mays
ggaccctcgaggccggccgggccggggcgggggcctcgggaagagtatcttttctgcttaacggcccgccaaccctggaatcggttcagccggaggtagggtccagcggccgggccggcgggcccccgagcccggcgggcccgggatcgcaaacaagctagctaatcacttgtcaagaacaagagctctctacctgcattggctagcgtgatccgcgaggtagctggctgcttgttgtgatcgagcaatggcgtccaaggcattcgcgctgttcctggccgtgaacctggtggtgctgggcgtagccaacgcctgcacgcccaactgttcgggcccctcgacgacgccgacgcccacgccgtcgtcgttcggtaggtgcccccgcgacgcgctcaagttgggcgtgtgcgccaacgtgctgggcctcatcaaggctaaggtgggcgcgccgcccgcggagccatgctgcccgctgctggaggggctcgtcgacctggaggccgccgcctgcctctgcactgctatcaagggcaacatcctcggcatcaacctcaacctgccggtcgatctcagcctcatcctcaactactgcggcaggaccgtgcccaccggcttcaagtgctgagcgcctctccgtctcatcgccttgcgctgcctcccttccattccatgcatattgcatggttccgtttcagtgacgcatggttccgtttgattgctttcccacgtacgagaggtactgcatgcatgcaacacatggccgtaccgtacgtgctctcgatttgtaatttcccagcctcttccgtccttgtgtgcatttgttgtaaagggctggcgatcacttctacgccggtgctaataagttccaatcaagtttcagtgttttgcatgcaggctctgcctacggccctaactacatttttctaac

SEQ ID NO: 12506 - DNA, 782 bp, Zea mays
tcagctacgtaggccccccccccatcgcaaacaagatctctaaccactgcattatttggctatagagagtgatcgcgatcgttgtagctgttggcttgtgatcgagacgagcaatggcgtccagggcgtttgcgctgttcctggccgtgaacctggtggtgctgggcgtagccagcgcctgctcgccctactgcccgaccccgaccccgaccccctcgacgccgacgacgcccacgcccacgccgtcgtcgttcggcaggtgcccccgcgacgcgctcaagcttggcgtgtgcgccaacgtgctgggcctcatcaaggcgaaggtgggcgtgccgcccgcggagccgtgctgcccgctgctggaggggctcgtcgacctggaggccgccgtctgcctctgcaccgccatcaagggccaaatcctcggcatcaacctcaacctgccaatcgatctcagcctcatcctcaactactgcggcaggaccgtgcccaccggcttcaagtgctgagctgagcgcgcctagagctcagcgccttgcgtgctcgacgtgctgcgttcgcctcccttgcatgcatattatggtttggttgcatttccacgtccgtgcggtcgtttggatctgatttgtattctccccgcctggctgctgcctctttatttgctccccgtgcatttgtcatgttgtaaagagttagccggctgtcacttgtatgccggtgatacataagttccaatcaagtttgtcttgccgctttatatttcgaaaaaaaaaaaaaaaaaa

SEQ ID NO: 12507 - DNA, 1857 bp, Zea mays
tattttaattggaaaacatgatacaacaacttaactgctagatgttatcttaccaccaaagaaaaacaagtgaacagtcttgcattggagatttaccgtgcacttctctgattcaggtatgtaaagagccgaaacgatgcacagctaagagatgctagtaaagctaaccagacatccgcttgtgaacctgagaagaccacagctaatgggcaaccaattgttccttgcggcctcattgcttggagcttgtttaatgatacatataatttcactcgtggtaatgagaacttgacagtggacaagaaagatatttcctggaagagcgatagggaacataaatttggtaaagatgtctatccgagcaacttccagaatggcgcacttaaaggtggagcaacacttgacccaaagatcccggtatgtgaatttttattctgtaccatcttattgtgtcatatgcttttatagggagactattgttcattgtagtatacatctgcaacatcataatttcagctaatatccattgatttcttgttcatgtggaaaaaaactgtatgggtaaggaatatttgtggcagttattcatgtcatttaagtgttatgtgacagttgagtgagcaagaggatctcatcgcttgcatgcggactgcagcacttcctacattcagaaagttatatgggagaatatacattgacctcaaggagaatgacacaataacagtgacattgaataacaactacaatacatatagcttcggtggcaagaaaaagctggtcctctccactgcaacttggcttggggggaagaacgattttcttggctttgcataccttatagttggcgggctctgcattttcctggcatttgcattcaccttgctgtacttcgtaaaaccaaggttagtgacttttgactgtatgttgcaattgcttggaaattagccttgtgctggatttagtccatgaacctgctatatatatgcgtattctatcaactgtgatagccgtactgtgaatgtgatgcttgctgtgaagtaatccgggtttagcctatcaagtttatagaaaacctgtagtaaagtattctgattatgcctggtgcaacccattttatctcagcatcttttatgtcaattaaaggttgaggcgtccctgtggctttaggttgtattgaacacatttcacagcacaccactttggcccttttgttgaaagtacttccataggagcactttctataaattttggactagaaccagacaaccagctgttctgttttactttgctgactttggtccttcacgctgttaatttgcttatcatggtatattgtgttgcctatgttatgcactgtgtcctggcatggtcaacgcttgtaccataagaatgattgttttagggcttctgtgcttgttaaaatgtctatcattatatttcattgacaccctacacgagtggaaatgttaatccagtctgtgccttatgcaggaaactgggagaccacaactacttatcctggaacagacgccatgcaggacgctaagatgttttggaaccccaagtgtcctaactacttaagtgcaacttgtatgaaatgaaatgccctgaaccagaaatctcgttgggcagactggatcagactagaacttcatgtacattttttttacaaagggtctaggtggctacgtgattttgtttcttgtgttctatagagctgcatgtagcagtgattatgagaatacatattgatgtctaatggcttgcttcgtggtacgtgcactctgagggcctgttccgtccagtggatttgagcattcggaacgactcctagctgggatgtttgtctaatttata

SEQ ID NO: 12508 - DNA, 1963 bp, Zea mays
gacacgaacccaacccagtcgaaccacctcgccagtgagcgcccccctcccgtcctctttccctgctggccagaactccgaatgaaatcgctgctccaccagctttctttaccttcaggaagcgagccggtagcatcaagctagatcgcggagaagctcctcgtttcccccatcggcgctgctctggcggggagaagcgtcctctcacggcggccgggaagaccaatccgcgccgccagtccctgcggcggcttccgtgaggtggtcttggctcctggggcggcgtgttcgtggtggccggcgagatgagcagccacgcggttggaacaagcaacggcggatccggggatgcggccgccgggggcgcggccaggaggaacaccaggatgcccaaatattccaagttcacacagcaggagctgcccgcttgcaagccgattcttactccaaaatgggttgtctctgttttcttaatcgttggggtcatctttgttcctattggtgttgtttcactgctagctgcaagagatgttgttgagattattgatcggtatgatgaggcatgtgtgccagtcaacatgactgagaacaagcttgcttacatccagaatgagaccatatccaaagagtgcataaggaatcttacggttacaaaggatatgaagcagcctatttttgtgtattatgaacttggtaacttctaccagaaccataggaggtatgtaaagagccgaaacgatgcacagctaagagatgctagtaaagctaaccagacatccgcttgtgaacctgagaagaccacagctaatgggcaaccaattgttccttgcggccttattgcttggagcttgtttaatgatacatataatttcactcgtggtaatgagaacttgacagtggacaagaaagatatctcctggaagagtgatagggagcataaatttggtaaagatgtctatccgagcaacttccagaatggtgcacttaaaggtggagcaacacttaacccaaagatcccgttgagtgagcaagaggacctcattgtttggatgcggaccgcagcacttccgacgttcagaaagttatatggcagactatactttgacctcaaggagaatgacacaataacagtgagattgaataacaactacaatacatatagctttggtggcaagaaaaagctggtcctctccactgcaacctggcttggggggaagaacgattttcttggctttgcataccttatagttggtgggctctgcattttcctggcatttgcattcaccttgctgtacttcgtaaaaccaaggaaactgggagaccacaactacttatcctggaacagacgctaggatgtttcggaacaccaagtgtccgtactactcgaaatgtagcttgtatgaaatgaaatgctctgaaccagaaatgtcgatgggcataagcaagcatggttcaggaaagaacttcatgtatattttttacgaaggggtctaggtggctacgttatttttgtttcttgtgttctttagtgtagcactgaacaggagaataccaattgatctctattagcttgcttcgtggtacaagcactctaaatggttgactgtggtgttgacgctttggctgccgaagaataccaattaatgatgttggttgactgtaatatcctcaagtgggaacagtaccaacttctgtacaaattgattaccgtgtgatgtttgtttctccactaccattatagtacacgggtgccgaaaaaaaaaaaaaaaagtcagaatgcctttctacgtgctataataattaaaaacataatctacaacactagagatgcatatgcgagattcgtttttattgctccacacagatggtagactggaaatcatgactagaaaacttgggattcactgcttcgtcctttattattgtgctcatgttcagattcatttccacttgctcctctact

SEQ ID NO: 12509 - DNA, 1872 bp, Zea mays
atgtccaccccccacccccccaaactgtcgacaccggctcgacacgaacccaaccggccaaccacctcccctgctggtcagaactctgcaagtccgcatcaattcgcactcccagcttcctttaccttcgcaacaagcaagccggtagcagcaagctagatcgcggggaagcgactcgcctccaccatcggcgctgctccggcgcggagaagcgtcctctcgcggcggctgggaagaccagtctccgccagtcccggcgactgcttccgtgaggtgcccttggctcctgggcgacgggctcgtggcggccggcgagatgaacagccatgcggccggaacaagcaacgggggacccggggatgcggccgctgggggcgcagccaggaggaacaccaggatgcccaagtattccaagttcacacagcaggagttgccagcttgcaagccgattcttactccaaaatgggttgtctctgttttcttcatcgtcggggtcatctttgttcccattggtgttgtttcactgctagctgcgagagatgttgttgagattattgatcggtatgatgaggcatgtgtgccaggcaacatgactgagaacaagcttgcttacatccagaatgacaccttatccaaagagtgcataaggaatcttacggttacaaaggatatgaagcagcctatttttgtgtattatgaacttggtaacttctaccagaaccataggaggtatgtaaagagccgaaacgatgcacagctaagagatgctagtaaagctaaccagacatccgcttgtgaacctgagaagaccacagctaatgggcaaccaattgttccttgcggcctcattgcttggagcttgtttaatgatacatataatttcactcgtggtaatgagaacttgacagtggacaagaaagatatttcctggaagagcgatagggaacataaatttggtaaagatgtctatccgagcaacttccagaatggcgcacttaaaggtggagcaacacttgacccaaagatcccgttgagtgagcaagaggatctcatcgtttggatgcggactgcagcacttcctacattcagaaagttatatgggagaatatacattgacctcaaggagaatgacacaataacagtgacattgaataacaactacaatacatatagcttcggtggcaagaaaaagctggtcctctccactgcaacttggcttggggggaagaacgattttcttggctttgcataccttatagttggcgggctctgcattttcctggcatttgcattcaccttgctgtacttcgtaaaaccaaggaaactgggagaccacaactacttatcctggaacagacgccatgcaggacgctaagatgttttggaaccccaagtgtcctaactacttaagtgcaacttgtatgaaatgaaatgccctgaaccagaaatctcgttgggcacagactggatcagactagaacttcatgtacatttttttacaaagggtctaggtggctacgtgattttgtttcttttgttctatagagctgcatgtagcagtgatcatgagaatacatattgatgtctaatggcttgcttcgtggtacgtgcactctgagggcctgttcggtccagtggatttgagcattcggaacgactcctagctggattgtttgtctaatttatataaggtttgatcggttggaacgatttttagtgaaatccggcgtaaacgaacatgccccaaacggtttcctctaatagtgttttgtgtaatgtccccaatgggggaatattacaaacttctgtataaattgaccactgtatgatgtttgtttgtatactacgatttctctactacttattaatgca

SEQ ID NO: 12510 - DNA, 1833 bp, Zea mays
gagacccagagccgcggtccagagcgggcggcggccggcaacaacgaaacgggccaacgccaccacctccacctcgtcctcctcggcacctcccccgtcgcgtccagcgttccaggtccagctccccccgcgatcccgacgaccccgtccgcctcggcctgcgcctccccgctacaactacaagggtccgcccgcgggcgctgcggtaccagcgagcccctcctcctccacactcagcggcgcggagatcctgtcctgtgccccggaccgagagaagccaggcgccggcgtctggaattcggacatggaggcggcggcggcggtcgtaggcttcggcctgaccaggtggcaggcggcggcgctgtcggcggtggccggctgggtgtgggcggcctccttctacgacctcacgcgccgggcgcgcgcgctcgtccagccgtgggtcacgcgccgggtgcacgccgagacggcggccatcctcaggttccagaggctggagcacaagttgctggacaatatcttctctgtgctgtcatgcgttgtctccgtgcccttctacacgggattcctccctctcctcttctggagtggacacggcaggctggctaggcagatgaccctcctcatggctttctgtgactacctcggcaactctgtcaaggatataatgtcagcccctcggccgtgctctcctcctgtaagaagagtgacggctacagaagacgagaaggaaaatgccatggaatatgggcttccatcatcgcatgccctcaataccgtttgtttgacgggatatttactacactacgtcctcacgtttggagaacatggtagtgttacagttgctgcgggtttatctctagctttcttgcttgttatgctagttggcatcgcgcggatatatctgggtatgcacagcttgaccgacgttgttgctggaattggttttggcatcgtcatccttgcattctggttgtctgttcatgaccgtgtcgatgccttcgttgtctccggggaaaatgttgcgaccttctgggcaggcctttctctgttgctgtgctttgcgtatccgaagccggagttccctactcctagcttcgaataccacacagcattcaacggggttgctttcggaatcgtgtacggcatccagcaaacatacttccacttccacacccctgacgccccggtcgtcttcagcgccgagctgcccctgctcacgttcgccgggcgcgtcctcgtcgggatcccgaccatcctggccgtgaaattctgcagcaaggcgctctccaagtggctgctgcccgttgtgtgcagcaccctgggcatccccaccgtgtcgtcctgctacgtcccggccctgagagccgacagcggcagcggcaaggacaggcagggcgccgggcacctgcagcggctgctgttctcccacttcccccggaaggcgtacgacgtggacacgggcatcaggttcgtccagtacgccagcctcgcgtggtccgtggttgacttggtgccggccatgttcgcccatctgaatctgtagccagctgcgtagaatttctgcttctttctcttttcgatgagctcccaatgcggcgcatcctgctcgtaagacatggatcagcttacgaggctgtaaatccgatggtctgtctgtttggcttgtccttctcgtatcgtatgtacctagctgttctcaccaggggtgttgtttctgtacaagtttgtgtgtagtaagtagcaaccagtagtattgattgatgatgggtagctatgagacattcttgacgtcaaagagatgccttttcttgccgaaaaaaaaaaaaaaaa

SEQ ID NO: 12511 - DNA, 1990 bp, Zea mays
acacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccccgtccgcctcggcctgcgcctccccgctacaagagtccgtccgcccgccagcgctgcggtgccagcgagcccctccctcctccactctctgcggcgcggagatcccgtcctttctctgtgcccccggtaccgcgaggagccactgcccaggcgccggcgtttttggaactgggcatggaggcggcggcggcggcttcggcggcggtccgggggttcgggcgctggactgaccagctggcaccctggcggcgctttggcggcgctgggccggctggggtgtgggccgcctccttctacgacctcacgcgccgggcgcgcgcgctcgtccagccgtgggtcacgcgccgggtgcacgccgagacgccggccatcctcaggttccagaagttggagcacaagttgctggacaatttcttctctgtgctgtcatgcgttgtctccgtgcccttctacacgggattcctccctctcctgttctggagtggacacggcaggctggctaggcagatgaccctcctcatggctttctgtgactacctcggcaactctgtcaaggatatggtgtcagcccctcggccatgctctccgcccattagaagagtgacggctacagaagatgagaaggaaaatgccatggaatatgggctaccgtcatcgcatgctctcaacactgtttgtttgacgggatatttgttacattatgttctcacatacggagaacatggcagtcttacagttgctgcgggtttatctctagctctcttacttgttatgctagttggcattgcgaggatatatctgggtatgcacagcttgaccgacgttgtcgctggaattggtttcggcatcgtcatcctcgcattctggctggctgttcatgaccatgtcgacgcctttgttgtctccgggcaaaacgttgcaaccttctgggcaggccttgcgctactgatgtgctttgcgtatcccaagccagaattccctaccccgagctttgaattccacacagcattcaacggggtcgctttcggaatcgtgtacggcatccagcaaacctacttccacttccacgccccggacgcgccgatcgtcttcagcgccgagctgcccttcctcgcgttcgcggggcgcgtcctcgtcgggatcccgaccatcctggccgtgaaatcgtgcagcaaggcgctctccaggtggctgctgcccgtgatgtgcagcaccctgggcatccccatcgtgtcgtcctgctacgtccccgccctgaaagtcgacggcggcggcagcaagagcaggcaggccgccggcgggcacctccagcgccttctctctcacttcccccagaaggcgtacgacgtggacaccggcatcaggttcgtccagtacgccagcctcgcgtggtccgtggttgacttggtgccggccatcttcgcccatttggatttgtagccagctacttaaaatttcagtttcctttttttttctggaggtctcaatgaggccctcctactcgtaagacatgggtcatcttatgaggctgtaaatccgatgatctggcccctttttttttgtattgtattgtatgtatgaatggttccctagctgttttcatccaaggtgttcagtaagtagaaatcagtggtgctcactccatcctaaatatataaagcgtaattattttatatttcagtcccatgatatagggcattttttaaggacatttatatatcaaaacagtaatatagtgtttaaaaggaaaattaaatatatttcttattcttaaaaaaaaaaaaaaa

SEQ ID NO: 12512 - DNA, 2694 bp, Zea mays
attttggtatatttgaactattactgtttgtcagaaattttgtcttttttgtaactgatagagtaagatgaatttgatcataaaatttttttatatatatgagataaggttagatgtacatccatgttttttcagaattttttgaaacttttttagtaggtttgcacgggatttacatgaaaacgtggtttgtattcgatacgttcgtatagcgttgtccgtccaacgcagggcaaacaatatttcgcgtcaagtaacgctttatgccaacctccagtaatttggcttgcgcccatccattgacggaaaaaaattctttacatcaggttaattagacagtcgtcctagttcacggttggtctcatggtctgcccccatccggcaccagtgcccagtggcatctgcgcgcgtaccggccgcgcgccgccggcctgaagccgagcacggctgtggacgggcacgtatcgtacgtggcaaagggatgaagggaaccagggacgcgcgactagccgagccgtgccatgccgagtaggccggcgcgccggcgcggcagcaggtgggagcggcaaagcgggcacgtcacctcgcccaggtcgatccagcggtcgatgcatcgcgtgtggaacgcgtgggtgcagttgcccagccgccgcacctcgtccttggcctcaagccactcgaggcacacccggcacgtcggctccgcccccacccccgacgacggtgacgacgacgaatccaccagctccaggaactcgacgagcgggaggcgccgcttcaccgcctctggcctggggcggccgccgttgatggctggtggcgcgtgatcctcggggtcgtaggagaactcgtagaggccgaggaaggagaggagcagcacgaacacgagcacggcggcgtggaggagcttgagcagcgcggccacggggcgcggcaccgcgtagcagtagcaaaccagcgggaaggtcatggcgaccggcaggacgaacgaaaagcacgtacgctgctgcagcaagctagctaatagcgcgaagctgggtccgcaggaggccgccgccgccgtgcgctccggccggcgcggcgtgcatgcgtctgtttaatatggctcggatcggattccggagggcacgcacaaaggcgcgggacatgcatattagggacgaggcaaccgaaagagagaaaaaaaagggtgtggcggcacgtccactcgtggtttgcacggtgcgcgaaagggctgctggaccacggtagcgggtacagcatggctgtcgttctagatacgtgtacgtagtggccggatggcatgatgcattgggattgcctattgctagtttgcggaggggccggtatcgtcatgcaacaaagcgcgagcgcaatggcgaaagtcgtcgtcatgacacgtatgaatattttagaagaaacgttgcatacttgcatcgcacggcagggacgcctaccattttcgcctttcccgacgggactctcgtacctaaaccgatcatgcaaatgctatctcacagccaacacgggtttggcgtgttcaggtttttggcttgatgccgtgttcggaaaatgttttattcagtttctctctcgcagctttcatatcacattccctatcacacatgttctattttaaacctcactatacaaataattatatatctatattatgttatgttgaagacaccctcgagagaagttggtagggtacatgccatgacacatcggacttgcttaaaatttaaggagaggatgctagcaggttggtcccgtacgtggctgccagtacacatgtccaaataggccgggccggcagtgggtccatgacccgccacgattgtggcccggcacgaacataactcaacccgactagaatcgtgcccgactgagcgactatttttaaaacggtcagtctatttttagctacaatactgatgaccctgttattatatgagatcattctgaattgtgatatgtgtttatatgtgtatctgaatttttttgtctaagtatgtatctaaaattataaatataattaattgaatctaaaataattttgaatattacctttaatttctgaattttagagtgttttttttgtttacgggtctgggtccgacccggcacgatgagcccatcgtgcctccagcccttgtaaaaataaccgtgccggacctaggtcgcgtcaggcgtcggccatcccgtgggctggcctggcccgacacgataatgaaccgtgttaggcttggactgatgtccttcataccgggcctagccgtgcccgggccggcccgacacgtcccgttggacatgtatagctgccagtgccatgtagccatgacacatggcatttgctaaaatttaggtttattttctcaacaaaatttattgcatatattttatattaaaattacagttctaatttgttgtagttttttaacacaatatataactttcggctatgataaaaaaatagacaaaaccataaactagataaagtgtgatttgtgttgtatcgtgggtctgtaaccatagtagtaattatgttgttaatgtactcacttcattcttttttattttaaaaataaatgcgatctataggtgatacatatttatagttgtacaaagaagcacaggtgttaatgagtaggcttaggccttaggctagtttgacatgaaaggcagggctat

SEQ ID NO: 12513 - DNA, 1381 bp, Zea mays
agtttcatacacgagtgcccatctaattgtctcttcctgctgtcgcaggacgcacctgcacgcgtccaccaagccccccgacttcccgacccgaggccccgacctgcgcaccgacgggatccctacctatccggccgtcacccctccccctgcccctcccgagttggattgttcgcggaattggcggaggggcagccggatatgtcgtcgtcggttgggggcggcagcgcgggcggcggcggagtggacatggtcagcctgctggagaaggccaaggatttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaaagaaaaagatagaagttggtgagcagaaaaagaagaggatcaagtctgatacagattctgcacgattttctgctgcatctatgaggaatcaacttgaccaagctgcaagccttaaaggagagcaggttgctgctagggtaaaatcagatgacgaaaaagatgagtggtttgtcgtgaaggtcatacatttcgataaggaaacaaaagagtatgaagtacttgatgaagaaccaggtgatgacgaagagagcactcaaaagaagtacaagttgcctatgtcttacattattccatttccgaagaaaggggatccttcgagtgccccggattttgggcagggtcgacaagttttagctgtttatcctggcacaacagcattatacagagctaccgtagcttctcatcgtaagaggaagtctgatgattatattctggagttcgatgacgatgaggaggacggtgctctgccgcagagagccgtgccgttctacagggtggttgccctgccggagggccacaggcagtagtgacatttgacgcagttctgcattcctagtgtaacatatagcgcaaggtagggtgtcttcagtgtgacaatgtggtggtcatatctacgcgaaacgagagagaaaacaaggacgtgcatgtagcacttacatgtggggtccttgtataaaagacgatgacgtttttttttcaatctgctagagcacgtctatgtaattgcaatccagttttaatctcttatattatactttagagagaaagggcatactgtaagggtctatttggcaacaatatttctcaaaattatagttttataatactaaaaatatcgtagtttttgtcccctcaaaaaaaaaaaacaac

SEQ ID NO: 12514 - DNA, 1435 bp, Zea mays
gtcgacccacgcgtccgcggacgcgtgggcggacgcgtgcctccccacccaccaccgcgccgggccaccaccacccactctaccctcccctccccaccaccactagcacccaccgtcccggcgcggagaccgcttccctccctccgcctccgcaaccctctcccgcctcgcccgcgcctccctccatttgtccgcggctcccctccctcccgatcttaaccacccgccacccggcttcctctcccccttcttcctccctcaaaccagacgctcgcccccctttcctccacctatcttcttcagacgaccagcaggaggtacgagcaagaccacctaggaggcctctctctctctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaattattctcgtagggacaaagcttgatcttcgagacgacaagcagttctttgtggaccatcctggtgctgtccctatcactactgctcagggagaggagctaagaaagcaaataggcgctccatactacatcgaatgcagctcgaagacccaactaaacgtgaagggcgtcttcgatgcggcgataaaggttgtgctgcagccgcctaaggcgaagaagaagaaaaaggtgcagaggggggcgtgctccattttgtgatctaatcatcggtagatgaagaaacaagggcgaaggtgccatggctttatcatcgtcgcgtcttgcttcagtggaacggcatggatggtccccaccccccctaggtttactggcggctcggctgcagcgagttctcatctctttgtcgaggcattaagcgatatgtttgtttcattttcctccttcctgccttgtgattatctggtgtgtgtgtgtgtgtgactgacgaagtcgcggcgattaggtaactcgcttagaaggtatttcccgtgtttgagcaaaagaaagtatccctgttatctctgttccataagttagacatgatgtaatcgtactaagtttatttttacttatttcacttgaatggaaaagtatgcttcccatttaaaaaaaaaaaaaaaaaaaaaaacacgaactagtctctacgagggggggcccggtaccca

SEQ ID NO: 12515 - DNA, 1472 bp, Zea mays
actccaccctccctccctctctctctctctctccacctccaccaccagcacccaccatcccggctcggagaccgcttccctccctccgctccacccccgcaaccctctcccgccgcgcacgcgccaccctccattcctccgctccccgcttcctcccgatcttaaccacccgccgcgccccctcccgccacccggcttcctctccccctcttcttcctccctcaaaccagacgctcgccccccatttccccatctctcttcttcttcttcttcttccccatccagaggaggaaggaagaagaataagcaggaggcctctcccccccagcccagccaccccgtagcgacgacggagggcggaagaggatgagcgcgtccaggttcataaagtgcgtcacggtcggggacggcgccgtcggcaagacctgcatgctcatttcctacacctccaacaccttccccaccgactatgttccgacggtgtttgacaacttcagtgctaacgttgtggttgatggtaacactgtcaacctcggcctctgggacactgcaggtcaagaggattacaacagactgagaccactgagctatcgtggagctgatgtttttcttctggctttctcactgatcagtaaagccagctatgagaatgtttcgaagaagtggatacctgaactgaagcattatgcacctggtgtgccaataattctcgtagggacaaagcttgatcttcgagatgacaagcagttctttgtggaccatcctggtgctgttcctatcactactgctcagggagaggagctaagaaagcaaataggcgcgccatactacatcgagtgcagctcaaagacccaactaaacgtgaagggtgtcttcgatgcggcgataaaggttgtgctgcagccgcctaaggcgaagaagaagaaaaaggcgcagaggggggcgtgctccattttgtgatctaataatgatcagtagacaaaagaaacaagggcgaaggtgccatggttctattatcgccgcgtcttgcttcagcgaaacagcaatggatgatcccaccccctcccccccctagattttactggcggctgcagcgagtcgaggcattcgagagcgatatgtttgtttcatttccctccttcccgccttgtgattatctggtgtgtgtgactgacgaggtcgtggcaatttaggtaactcgcttagaaggtatttcccccgtgtttgagcccccacccccaccaaaaaaaagaaggtatcatgctatctctgttccataagtagacatgatgtaatcgtactaagtgtttatttttattttttttacttatttcacttcaatcaatggaaaattatgcttcccaattaaaaaaaaaaaaatggcagtccccctccctccttgtttgcctgtcaagttctcagtgtctttgtggcaaatggagcatgcatattatttaaaaaaaaaaaaaaaa

SEQ ID NO: 12516 - DNA, 1549 bp, Zea mays
  misc_feature (113)..(113): n is a, c, g, or t
  misc_feature (610)..(610): n is a, c, g, or t
  misc_feature (1098)..(1098): n is a, c, g, or t
cacgccagtacttttcgcagccgtcgtgcaaagctctctccaagccctcgccctttcacgctcccttgagggctttgatgcgggtggagtccagcggcggcctcccactcccnagagctggaaagacagcaggcgggcgccaagagacgccgccggcgggcacgggcggcggcggcggcggcggcaccccgaacgatggccgcgcccgccaccgccgtgcagcggctcttcgaggcgtgccgcgaggtcttcaccggagctggtccaggcgcggttccaccgccggccggcgtcgagaggatcaagtccgttctctagatagtatcacagcagcagatgttcgtctaacatccagcatgccatatttccgacgtgttgacccctacggcactccaaaaatcacttacttgcacctatacaagtgcgaggctttctcgatcggcatcttttgtttgccatcgaggggtgtcattcctctccacaatcaccctggcatgactgtgttcagcaagcttttgtttggtgccatgcatataaaatcttatgactgggctgcttctcaacaagacacacctgatgttcagttgcaagcaggaccacgtttggcaanaggtgaaggttgatggcatcttgactgcacctcatgaaacggcggtactatatccagaagatggtggtaatatgcattgctttaccgcacagaatgcttgtgcagtgcttgatgtccttggccctccatatgatgatggcagcggaaggcactgccagtactacaatgtccgttcctctgcaatttctgttggctcaactatattgcctggaggtgacagatatgaatggctggaggagagcgagccatctcgagatttttatcttgttggatcaacatatatgggcccgaaaatttgggaccactgaacttatatgcctgtgagataggatgtgcctatagctgttcggctgctagaaaagttgctgcacccacagcgtttcctgagaggaaaaaaaaagcctactgctcacttcaacagttcaacagcatcgttacctgcctcttcagcagttcaacagcttttaacagatcagtatatgttggtntttggaggaagtgattaggaagaagaaacgatggaccacaatggtaagtgctcaccgttcgtaaatatatgacaccgttgattttttttaaaaattttaatcactcgtcttattaaaaaaataatgagttatcatttatttttatatgatttagtttgtgcttgacttaaaattttacattttagaataaatattttgaataagacgagtcgtcaaagttttcaaaaaaaatcaatagtgtcatatatttatgaacggaggtagtactcacttcggactgaattattgtggaaagaccatgaggatgtcccgaaagtcacagtcatgcttcagtatgaatacgacctggatcctcggacgattatcaagtgtattgtatcctgtaatagtgtcaattgtcaaacacgcattgccaccggagataaaaaaaagtctcctgataacttgccgt

SEQ ID NO: 12517 - DNA, 5228 bp, Zea mays
  misc_feature (3677)..(3677): n is a, c, g, or t
  misc_feature (3937)..(3937): n is a, c, g, or t
  misc_feature (5074)..(5074): n is a, c, g, or t
gttttgaaaggttgacgatgttattaatttgacagcctaatccacatatttagctccaattatattttcagttaatcggttgctgtgtttctctatctctgtttttctatgtttcagatagcactttgttgatggaatgaagatcaagatggaagcataaatgataaggcaggggtactggtttttttttcacatccttgcctttttcactatataaaaagattagacatcctccaatatcatattggttacacggtgcttttgcccgtagtgacggccagggttcgattcttaaatgctgtccgcatttattttttgattttttccacggcccgctggccagggagagcaggatggctcgctcgctggaagaagatgcacgaaggatttgttcacgcttaaatatagtagggattgtattccttcatggttgttcaatagagtgattgcatgaaacagtgcagtgcttaaatttgtagtgcccaagaaattagtgcctctatgtcagtgcttgctatagaactaagaatggcaatatatctatgctagtttttgaatcctgcaacttttatatgtttgttaccttctcatgttccatacggtttcatgatagtttatggaggatacaactgttcgcgcgtgtgcttttcccttttcttattggagtgcgccacaatccactctctattttagtcaacaatacattgttaatatgctatccagtgttcctgtcctgcagggcaaggtttctaacaccaggaaggccctgttgaacattgggcaaaaaccagctcctagcttagctctctctctctctcttttttgttagctcctgtctacacttgattttaatttgctctgtttgacaatggccaagaagttagaaatgctaattatgttacccatctattgttgattgcaggctgtagggagccgaaatgtcctgagtgattttctggtttgatatgatagcatgagggtttgtgcagattatatgacaccataaggatgtaaagtgctgtattgctgattttttaggctgtaatctttgtccacttactttcatagtgctaaccaatgtgagatatcagtgctttattcaatggtaccttgagcttgatcccatggtaatagagcctccactacccttttcaccgtattgcaaacattcaaacaaaactttgattgaggatgcagaggtagatagatgtcttcttgatgagatgaactctcttctgaacagaatatctaattagcagctgcaatggataccgtgtcttgaaaataggtgctgtgctgactctggtaatagggaatgggtggaaagagggaggtggcggcaaatgtgcaagggaagggatggctcggtgatcttggtgtcttccttatcttaagatgaacgtctgttgaaacatatttattatcttaagatgaacttctggtaatagggaactgactactactagcttttgttcatgatagaaaaaataaataaatgttaactccgatgtagcattttataaatttgattatttataaatagcagaaatgcatggaccgaccaaacagcaaccatccatgcacatggaatgaatcgatggaggtagctaggccacttaaaatttggagccatgaatctctcttggcctaccacaccatccgctatttatagtccatcttcttctttggaaccctattatatattgcctctctctttctcaacagcacccggactgcttgttagcacaaacagatcgatcgattacagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgcctccggggacacgcccaagagcaagctggggatcacggacgccgtgctcaagctgaggctcgccaccgacgccaacatcaacaaggcctacgcggagggggacaaggacaagatcgcaaaaatccttgctgcatacggccaggcggccgacgcggtcgctgcggccccgcctcccgagaagctcaaagtcatggagaagaccttctcggcggtcgccgccgccgctcatcaggaggcggcggcggctgctgctgctgctgcagtgattaaggtttaagggagagctcctgcatgaaattaaccacacgtccacacgtatacactacggaacaagtgtttccatcagacgaccatcagtgaaaaaaaaccatccttctctgtgtgtgtgccgtgtttttgtcatttcttctttccattgctagagaaacgggttatcttttttttcccacatttataagcggcaatacatgcgtgcacctgtagtagtgtgaccatatgtactgtgctctcggtttgtatatcgatagtagcatataaagctactactcccgatttgtaactatagatctcggtattaaagccattttatttttatttttaaaaaaaaaaaaaaaaatttttttggtgaagctaacctattttagaaaaattgtttggcaaaacagtttcatgtaaagtatagagagagatagaaatgagagggaaagttatgaaatgctacttttttagctcatctgtttcattcctttggtcagaggataaaaaaaagaggttcaactataaagctgtttgagaaataggtgtttagtaaaaaacagtttttataacattagcttgtaaacaggaccgtaatatatacaaacgagtttgcgttgctagtcatttggattatactttattgaggacaaatgtatgtatgctcataaaattctcaagtttgagcgtaaatagtgccagatatagcgtaaatattgttacaatcgttaaatcgttagcgcgatgtcacgtacaacccctccgtaacagacatgcgtgaatcatggtggttaacgtaaataccgagccaacatgaaagacgtggatatatgtgtgatgtggtattcatgatcataaaattctcaagtttgagtataaatagcataaatgcggttacaatggtcagctgatgtcacgtacaacccccacgtatcaggcgtgcgcgaatccaggtggttaccggaaaaaccgagccaacttgagatatgtggatatctctaggacatcatattcatgatcataaaatcctcacgtctaattgtaaatagtgtcagatatagcgtaaatgttgttataatggtcaacacgaactccaacgccagatctccgatggacacgacggagaagatgaagctcacaaattccaatggcaagcgcaccatngtctagctcttggccttgacgttgaacacccagagggcgtgccagccaccaccgccattgccgtcgagcgcgccggttaccaccatcttcttttcgtcgtcgacgcagaagatgctcattgtgccggtcttgaggctcggcgggtacaaccctcgatctcgcgccagccatggttggtaccaagtgcacaggcagaccaaagtactgactttgatgaagcaaagaggcatttctagcagatatataccacagatggcatnttctagatgggtcatccatccaggaacatgcaataagcctaactcaaatggaaattgtggtcatccatggtgcagtactccaatccttgtcacctcaccagttggccagaccatttcaaatctgatacagaatggattgttcggtgttgaggatgcaatgagatgctgccatgactctttatctgctcttgctgcagtagcatctccaggaatacatcatagtgatatccgaccagagaatgtgatctgtgttggtaatggttcaagccatccatattttgtactaattggatggggtcacgctagcgctatcctagaagatagggatcgacctataatgaatctgttcttctcatctacatttgtgctcgaggaaggcaagctatgtgcaggatctgatgcagaaagtttaatgtatcttctatatttctcttgcggtggagtttgcccagagcttgactcagttgaaagttcccttcagtggagagagacatcatggtcaaggagagttatacaacagaagctgggcgacgtctcagtagtgttaaaagcttttgcggattatgttgatagtctttgcggaaccccatacccaatggactataacatatggttaaaaagatcgagaagaacgataaatggagaccatgggaaggaagttgacacatcaagttaatagtatggaacattttcttgcaaaatctgaaatgtggaggatcaagagtgatgaatccattagtttttgtggttgtgtagataatttatttgtgaaaggtccgtagtagtagtgtccatcgtcttttctttgcccctttgataagggtgtttcaaaaattgcaatctgctgctactatactcaatgggatcattatcactgtttactattttgtgcaatatatagacccttgatgatatcagcaacatgttgtgctttgtaaatagtctttggtagattggtgagcctctcctctagtttccctctgaggttctggtctctttttatttgctgctatgctaggcttatggatgttaactagtaggtaaatgtggacatcgagtgtggtatagtcaattattttttagtatttcccgtttgcaactgctccagaatagatatgcaattagcggtggtgtggnaaagtagcatttatttaagttggctaagttatgtgttggatgcaacgttaattgttgaaggtcatgtaaatgatgttttgtgcactgatatatcctgccactgttgttcttagatctgtcggtatgtgtgtggtgtatagatttccccccatat

SEQ ID NO: 12518 - DNA, 1609 bp, Zea mays
aaggtagtttgtccaacatatttttgggtgaatagatagatggtttcaaataaaaaatgttatcaaggacaaagtttttaaaactttgtgagattatggacgtttcagcatccgatattgttccctaccacactacgcacatacttgtgtccctagagcatatgtatcactgaactactactagcttttgttcatgatagaaaaaataaataaatgttaactccgatgtagcattttataaaattgattatttataaatagcagaaatgcatggaccgaccaaacagcaaccatccatgcacatggaatgaatcgatggaggtagctaggccacttaaaatttggagccacgaatctctcttggcctaccacaccatccgctatttatagtccatcttcttctttggaaccctattatatattgccgcgcccggccccggcacgacccggactgcttgttagcacaaacaaacagatcgatcgattacagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgcctccggggacacgcccaagagcaagctggggatcacggacgccgtgctcaagctgaggctcgccaccgacgccaacatcaacaaggcctacgcggagggggacaaggacaagatcgcaaaaatccttgctgcatacggccaggcggccgacgcggtcgctgcggccccgcctcccgagaagctcaaagtcatggagaagaccttctcggcggctgctgctgctgctgcagtgattaaggtttaagggagagctcctgcatgaaattaaccacacgtccacacgtatacactacggaacaagtgtttccatcagacgaccatcagtgaaaaaaaaccatccttctctgtgtgtgtgccgtgtttttgtcatttcttctttccattgctagagaaacgggttatcttttttttccccacatttataagcggcaatacatgcgtgcacctgtagtagtgtgaccatatgtactgtgctctcggtttgtatatcgatagtagcatataaagctactactcccgatttgtaactatagatctcggtattaaagccattttatttttatttttaaaaaaaaaaaaaaagaaaaaaaaaaaaaaaaaagaaaaagaagggcggccgctctagagga

SEQ ID NO: 12519 - DNA, 2777 bp, Zea mays
tcgccagtccctgtacctccgtataaaccctagtacctcttatccgttcgtcactccccaagcgtcacaccgaatcaccacagtcgagctcgagcaggaacaagccgtgagcgcctgcccccggtgctcaatatctattccacacctcatggcgccggcgctgagcaggaccctggggccgtcgtcggtggccgcgctgcgcccgagcccgtcgtgccggggtctgttacgggccgcgctcgcgccgcagggcaggggcgcctccgcgaggtgcgcggtaggggtgagatgggaggcagccaggcggaggaggatggccggggtgaggtgcgacgccgccgtcgctgagaagcctgccggcgaggaggagacggccggcgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgatccttctgtgttggctgatggcggtgagttggagataaggattaaacccgacctagaggcggggacaatcactatcacagatactggcattggaatgactaaagatgagctcaaagactgtcttggaaccattgcacaaagtggcacctcaaagtttttgaaggctctaaaggagaacaaagaccttggtgcagataatggactcattggtcaattcggtgtcgggttctattccgctttccttgttgcagagagggttgtggtgtctactaaaagtccaaaggcagataagcagtatgtgtgggaagcagaggctgacagcagctcgtatgttatcaaggaagaaaatgatcctgagaaaatgctttcacgtggaacagagattactctttatttgagagatgatgacaaatatgagtttgctgaccctaccaggattcaaggcttagttaagaactactcgcagtttgtctcattccccatatatacatggcaggaaaaatcaagaacagttgaggttgaagaggaggaagaatcaaaaggtgaagaggctactgaagaatcaaaaagtgaagaggctactgagggtgaaaagcagaaaaagaagaaaaccataactgagaagtactgggactgggaattggctaatgaaacgaagcccatatggatgaggaatccaaaggaagttgagaaaactgagtacaatgaattctacaagaagacatttaatgagtttctggatccgcttgcttacactcacttcaccactgagggagaggtggaatttcggagtgttctctatgtcccagggatggcgcctcttagtaatgaggagataatgaatccaaagaccaaaaacatccgattgtatgtcaaaagagtgttcatatcagatgattttgatggcgagctgtttcccagatacttgagctttgtgaaaggtgtagttgactcaaatgatctccctctcaatgtttctcgtgagatccttcaagaaagtagaattgtcagaattatgcgtaagagacttgttaggaagacatttgacatgattcaagagattgccgagaaggatggcaaagaggactacaacaaattctgggagagctttggcaagttcatgaagcttggttgcatcgaggacacaggaaaccacaagcgtcttgcaccattgctgagattctactcttccaaaaacgagacagatttaataagtctggaccagtatgtagaaaacatgcctgaaaaccagaaggcgatctattatatcgctactgatagtctccagagcgcgaagactgctcctttcttggaaaagctggttcagaaagatattgaggttctttacctcattgagccaattgatgaggttgccattcagaatttacagacatacaaagagaagaagtttgtagatattagcaaagaggatttggaattgggtgatgaagatgaggacaaggagaaagaaagcaagcaggagtatactcttctatgcgactggataaagcagcagcttggcgataaagtcgccaaggtccagatctcgaagcgactcagctcttctccatgtgttcttgtttctggtaaatttggctggtcagccaacatggaaaggctcatgaaggcacagacccttggtgacacatcaagcctggagttcatgagaggtagacgaatttttgagatcaaccctgaccatcctatcatcaaggacctgaacgctgcttgcaaaaacgagcctgaaagtactgaagccaagagggcggcagagttgctatacgaggctgcgctgatctccagtgggtatactcctgacagtccagcggagctgggaggcaagatctacgagatgatgaccatggccctcggcgggagatgggggaggttggagacagaggaggctgaagtcatcgccagcatcgacgacgcggactcgtctgaaggtgccacgaccacgacagaggtagtcgagccctctgaggtcaggacagagagcgacccgtggaaggattagatagttctgtatgcaaggattatgccctggtgtggtgtatgagcactggatgtaacgaaagtacgaaccagagccaggatagaggaatacagcgtttgataagaacactggtgttaaaagtgtagatctctggtttgggttgtgctgataaatttttgtaggctatagccatccaatgaaaaatgccctctgcgctttcgtgcattctttctaaaataattataattataattta

SEQ ID NO: 12520 - DNA, 1412 bp, Zea mays
aaaaatcaagaaaacagtcgtctccagtttccatgcagagcagaaaagatcagctagcgagagaagcaatggcgtcggctcctgcgttctgcgtcgcgctgctgctggcttccgtcgctgccgtccaagtggtgccgccccaggccggcacgtcgtccacctgcagcactgacctcctccgcctcctcccctgcctgcccttcatcgagggcaccgccaccgtgccggcggtgccctcgatgaagggctggcaaagggaaggtgttggtggatccacggatgaagaaggacaagcgggccagtgggactgggaagaagggcagcaaaggcgcaaaggggaagggtggccaaaaggcatgagagggaaagctgggaagaaggcagggaaagccccacggtaaggaagccgaggagctaagcatggctggaatgctggatgcccgcctccctgcggaatttttgcctcaggctacagctactcagtaggcagatgttttgaaatcgtgtgatggtagaagtttgtgttgaaaagttttgtagcgtgagtagtggctataatgtttcaaaactagtggtcacttgagtgtcactaagcataatttacacacttcacaatcaatttatcaaaacttttatcccccttggggactctagagcacatacatctcttactaatatttgtgtgatgaagtgaggaaatgaagagttctccttttgggtgtccaggtgacagtggctttggttgctttggaccaaattggcgactttggctctggaatcggcttgcatttccttatcagatgaaaagaatgcagcactttgaatctcaagcaatgagatgcagagaccgcctggatgcgcaccgctcaacttgttgatcagagtagaatctgatccaagctcttttgcgttcaagatttggaatcaggctgatgcataggcggcccctgactccgagctacttggtgatagcatcaagcagctggccagataccaacttgatgatggctcagctctaagagaatataataagcagtgaggcgatggctcacagtccctgcaaaagccgttactgttgtagtgcttaaacaattgtttcaagtggcttgaagaacgtcagttgaatcgcaggaaccaatcgagacatctctgtacacggaaaggtacagaataatatattcttcttttacccaccaagggaatagtctactaatttcaacacaatattctcctttttccattcgaaaacaacacagaatactcaatccagaatctccaatttcgtagggcaagaggcgaacacaaatcaagattcaaagatttgaattttctcaaagtcacccaatctatctttggtaacagcccatataaagccgcaggcgcaaacactaccctaaaatattcagaaaaca

SEQ ID NO: 12521 - DNA, 2005 bp, Zea mays
ctgcaggatgctaatgtttttatatagttttctttgcgttcaaagtgaataggttgaagttttagaaatgaaattgcatattagtatcatgttttttgtttcccgtgtattgactgctcatgctcactattctatttaatacatagctaaccaagccctgcccaagatattatagtggtggcatagacgacgaggctacaagctgccctgattttttataaccggcctttcttggctctggaatctttatgatggttgatatacacacatttttacagattccgcgttgtccctataattctataaatcgtccggtgcctcatgtttctagtacgctgatctttacgatgttcctcaagccgagacgagagaatttgtgcccaaaccatacccagtgaggaatcagtcaccaagagcgagcccgcagtactgggtcggcaggccacgagcgagcggtcagcatccgcaggtacagccacacacccacgcacgagcactcccagccggcccgccgagaatccactcacccgctggttcatgggctccacggaaacgatagcccacacgtcagtcccttccacaagacccacaccggctccgcgggccgcccccgagatctatccccgtttccaacctcacacccccccttccattggagctccttcgtctgagttaaacctaaaccctaatcgcgacctgcgttcgtcaaaaccctacctggccatggacggcggaggaggaggcggtggaggaggaggtggagttggggcaggtgtcatggtgggtggcggagtcgtgccgggcggcgggggcggcgacgtggaactcgtcagcaagacgctgcagttcgagcacaagctgttctactttgatctgaaggagaacccgcgggggaggtacctcaagatctccgagaagacatcggccacgcgctccaccatcatcgtccccatcgacggcgtcgcctggttcctcgacctcttcgactactacatccgcaccgacgagcgcgacgtcttcagcaaggagctgcgactccagaccaaggtgttctatttcgatatcggggagaacaagaggggccgattcctcaaggtttctgaggcctctgtcaacagaaaccggagtaccataattgttccagctggcagctctggtgaagagggctgggaagcattcagaaatgtactgttggaaataaataacgaggcttccagattgtatgtcctaccaaatcatccaaatcagcaacacatggagccgccagagcgtcttcctggcttgtcagatgatgtgggtgccggatttatagctggacatggtagccagtccgcttctgggccagaggtagatgtcgaacgtttggttgatctgcctcctcaagaagaaattagtggcatgggtatgtctaaggtgattagggcagatcagaagaggttcttcttcgacctgggaagcaacaacaggggccattatttgaggatttctgaggtggctggagttgatcgttcgtctataatcttgccgctctcgggtttgaagcagttccatgaaatggttggtcactttgtagatataatgaaggacaggcttgaaggaatgacaggagctaacgtgcgcactgtcgaatccagtcagagatgattacccttactgtggcctgggcaagactgctgttatgcctcctgtaggtttgccatgtggtgtgtggtaatgtagatcacgcactattaattcatctggtggggataataatgtctcctttctcttcatttttttaaaattcagtggtgaggattgatttatttgggacgttttgctttttcggaggaataataagcagtgtattgttcgtggggtggtataattatagttgctgtagtgttagccctgttttcatgcttcgctgttcttgtttatgtaaaaaagatgtgtggtatgtttctggcattgagttctttctacacatgttaaaaaaaaaaaaaaaaaaaaaaaaaaagcggcc

SEQ ID NO: 12522 - DNA, 1774 bp, Zea mays
  misc_feature (1734)..(1734): n is a, c, g, or t
catcctcaaaccagccttaaatgaaactaccaaaacacttgatcctacattccaagtgacaggctgacctgatcataatactgaacatcgagtttcattgatgattcaaactggctctagtttctatgatgttcgtcaatcggacacgagagaaccagtcccaaaagaggaataaaaagtgcccaaaccttacacagtccaatcatgtcagtgagagtgagcccgccagtaccgggtcggcatgccacgagcgcgcggtcagcatccgcaggtacaacacgcacgcacgcacacacgagcactcccagcccatcccgcccaccaagaatctacccgacccaccggtttatgggctccgctgaaacagtagcccacacgtcagtcccttccacgacacccaaaccgggtcgcccaccgttttcggagtaagccccacctcgagatcgagccccgccgggaacctcacatcctcttccactcgagctccttcgtttaaacccaaaccctaattgcgacctccgttcccccaaaaccctacggccatggacggcggaggcggtggtgtagggggaggcggagttggggcaggtgtcatggtgggcggcggagtcgggccgggcggcggcgttggcggcggcgacgtggagctcgtcagcaagacgctgcagttcgagcacaagctgttctacttcgatctgaaggagaacccgcgggggaggtacctcaagatctccgagaagacctcggccacgcgctccaccatcatcgtccccgtcgacggcgtggcctggttcctcgacctcttcgactactacatccgcaccgacgagcgcgacgccttcagcaaggagctgcgactccagaccaaggtgttctatttcgatatcggggagaacaagaggggccgattcctcaaggtttccgaggcctctgtcaaccgaaaccggagtaccataattgttccagctggcagctctggtgaagagggctgggaagcattcaggagtgtactgctggagataaataacgaggctaccagattgtatgtcctaccaaatcatccaaatcagcaacacatggagccgccagagcgtcttcctggtctgtccgatgatgtgggtgctggatttatagcaggacatggtagccagtctgcttctgggccagaggtagatgtcgaacgcttggttgatctgcctcctcaagaagaaattagtggcatgggtatgtctaaggtgattagggcagatcagaaaaggttcttcttcgacctgggcagcaacaacaggggccattatttgaggatttctgaggtggctggagctgatcgttcgtctattatcttgccgctctcgggtttgaagcaattccatgaaatggttggtcactttgtagatataatgaaggacaggcttgaaggaatgacaggagctaacgtgcgcactgtcgagcccagccagagatgattacccttgactgtgggcctggcaagactgctgttatgcctcctgtaggtttgccatgtggtgtgtggtaatgtagatcacgccgtattaattcatctggtggggataataatgtctctttttctctttattttttgaattcagtggcgaggattgatttgtttgggactttttttctttctttcagtcggaggaataatatgcagtgtattgttcgtggggtggtataattgtggttgctgcagtgttagccccgatttaaggcgtngccgttcttatttaggtaaaagatctgctatgtttctggc

SEQ ID NO: 12523 - DNA, 886 bp, Zea mays
aaaaaatcaagaaaacagttgtctccagtttccatgcatagcagaaaagatcagctagcgagagaagcaatggcgtcggctcctgcgttctgcgtcgcgctgctgctgctgctggcttccgtcgctgccgtccaagcggtgccgccccaggccggcacgtcgtccacctgcagcactgacctcctccgcctcctcccctgcctgcccttcatcgagggcaccgccaccgtgccggcggacacttgctgcgccaaccttggcagcatggtgcacgacgagccgcagtgcctctgccaggccctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccgggggtccaagatgatagctgacggcttctctgtcactcttggtttcgtggcatttgtgtcagtcctagctttctgaagaattgggcggcattcgtcaggcagttagaattatggcttagagaaacttagttgcttttccgatgggcgcttgtttcctagagagacaacccgcccaggaaaaaatactgtatgtccatcccggttgttcttgttcggctacaagatttgtgttttcagttccaaaaaaaaaaaaaaaagggccgctcgcgttctagacggacgctggg

SEQ ID NO: 12524 - DNA, 1798 bp, Zea mays
acttgttatacaaagtaatttgtttcacatggcaataacatgttggaactggtttggaagagatggaagctgctggtgggataatgtagcctggcaatgttgggtaatttgcctgtgtaaaaaagaccgatggatcggaaagactagcaatgcaggcggcggcagtctttgatgtcatgtgatcatgccacccgctgcgctggcagcatcttgacgccactccctgcctacagtaacagcagcctgtgcactatgctgcctactactagcacgattcattgcggctgtgctgctgctttccctggtacgtgaaagttaaagcccgcatttagatggctggtcctgtccgcgtacggattctgaaactaattaacagctatgagaatcgtgttcccttttactgcttccttcatgtgaaggattagttgagttggttcttcttttgccatgtcaatctatctgttcaagaagtcccgtgacaggttccggtgcgtcgccgatgcaaggcaattccgtgcccgagacgagtttgtttgtgtgtgtgtgtagtacatgaacatggaggagtttccggtgcgtcaccgacgcaatacagttgccctctctctttcctgctgtcaagccaagccagtgtgtcctgtccacccatggcagcacatggagtttccactgccgcctgcgacagtcggcacggcgaggcgccatagccagagaatccgtgaacacgagggcgagttcgatttggcgtccagtggaacgtcgtgtggccggccggcgcttgcatcaacaacactggagcagtgaccacactccaggacggagaccggacagacagctgggccccctccagtcccgtcctcggcaggtcatgaaacagtgtgccatgccactgcgaacccgcctgtccataccagaccagcagcagcgctggcgcggccgggcacgccacgccgcgcttcctctcaacttctcttgtgtgacgtcgacctcgtccggatgctataataactgcccctcaccaaacctcccagccagctagctctcactcactcacaagtcacacagccacacttgaaccgctgcccgcagcggagggagcttgcacgggccaacgcacacataacacaagctcgtcgtcgatggcgcggtgggctgcggtgctggcgctggccgcggccacggccatcgccgtggcgtccgtggcgggcggcgacatgaacgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggacaaggacgaccccaacctgggcatcaagatcaacgccaccctcgcgctcgcgctccccaacgcctgcggcgccacccgcgccaacgtctcccactgcgctcgtacgtcctcgctttcttcttccttcagccggccagccagtgctagcgaagccacaaggccgccgcccgggcccggcgttgcttttcttactgcttcattcttttctccccaagccaaatcatgtctgtgtcattttattttattttattttatttttgctgcagagctcctgcatattcccccgggctccaaagacgccgccgtcttcagccccggcggcgacaagggctccactgccgctccaggtcagcctgcctctctacctccactgcctcctcgttgctcttcgttcatttgacgtttccttttcgatctgagacc

SEQ ID NO: 12525 - DNA, 1053 bp, Zea mays
acggatgctataataacttcgcctcccccgacctccccggcagctcgcactcactcactcacaagtcacacagccacacttgaaccgctgcccgcagcggagggagcttgcacgggccaacgcacacataacacaagctcgtcgtcgatggcgcggtgggctgcggtgctggcgctggccgcggccacggccatcgccgtggcgtccgtggcgggcggcgacatgaacgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggacaaggacgaccccaacctgggcatcaagatcaacgccaccctcgcgctcgcgctccccaacgcctgcggcgccacccgcgccaacgtctcccactgcgctcagctcctgcatattcccccgggctccaaagacgccgccgtcttcagtcccggcagcgacaagggctccactgccgctccagccaaggacaactcgacggcgacgaccgactcccgcgcgctgcaggcgaccaccggacgcggcgtctcctcctcggcggcgaccgccggtgctgcactcacggtgctgctcgccggctacctcctcctgctcgtgccagagctgtcgcctagctcgttctagaccctctgtcaagttgtgccaccagtaggatttgatgtgttgttgttctttctagtacgtgacgtgacagacaatttgctgctggtgtccttgttgttgtagtagttgcactgtgtgttcctgttatgctatgggtacgagatgttagggcatgggttaagctaagctaaggcgatggggtatcagtaccttacctctcatctggctgctgatcctttttgttcttggcactgctgttttatctgaacatttgatcagccaagaaaaaaaaaaaaagtgacacggttaatgggaaaaaaaaaaaaaaaaaaaaaaaaaaaaccgatt

SEQ ID NO: 12526 - DNA, 585 bp, Zea mays
aacacgcgaatcctccaatctgcccttgccgccgccgccgcccgatccaggtctgcagactgctcacttctccccacccaacgcggcggcactcctccctcccccagtgcctgttgtgcgcctgtacttcacaccggcgtcgccccctcctccagagctccccaccggagccaccctcacccgtcacgccctcctccgctgagtgcagcaagtgctgatcagttcggttagcacactcttctacaaatccacagtcacttcttcacagtgggtgggcgggagatggtgctgaggcgggcgataaccgaaagccccaagaaggttgcggggctgaaggatctggtgaacctgccgatccagctgcgagagttcgccggaggccagtcccaaatgtcacatatctccttcttcctccgtgtctggtcgtacatcaaggacaacaaacttcaggacccaacgaataagaacattgtgaagtgtgatgagaagctgaagaccgtattattgggtaggtccaaagtgcaagttgtcctttgctatttagaatggaagaagaaatgccttgttccaaaaaaaaaaaaaaaa

SEQ ID NO: 12527 - DNA, 1091 bp, Zea mays
  misc_feature (1000)..(1000): n is a, c, g, or t
ttaagtcagcagtcagcataaattccccagggtattcctacctacttgagatatccatcgcaattcatcattgcacagcttgagaaatcctcgacatccatatccccaaacagccatcatctcttacaaaattagaaccccaaaatttcttgctgctctggcagagctacataacacaacagcgagactaaagaaaacgataaagaataaaagaggctgcatagtttcaagttgcagctatacaagctaggtacatgtgagtgttctaccattacgtcgcatgacatgtcctagaaaagcacgacacagactcttccgctcgagtgcaacatcctgtgaagcatcacgttcttccttcacaatgttggaatctccccttcctccaagtcgtccctcggtaacccagacgttgcatctactggttcgtccctgttcaccattgcaaaatcgcagcttaagaagtcatcgacatccatgttctcgaagagctctgggtaggtatccaacatctcttgctcaaaggccaagtcgggtacctcggggaacaatccctcgtcaatgtccagcggataaactttcatgcaagatttccttttcagcgcttcaggagtcgagcttggcgtccgtttgttttgctgactgtgttccagctgaggacccgtcgcgccatcagatactacaatgctggtggaagatggtactaagggatatgttgccttggtgtctatcttcgatagagctgcacctcctgcctctgcagtgctgacaggatatgaaattccataccccttcagatctacaacgcgtccctctgaggacaacccgctttcccttgtcttctccatatccagaggacagacttccatgcgggatttagtttctgcaggcccagaggtaccatttggtgatatcttgctatattgattcagtcctttcggctgaccatgtaatgcttgagcttgacaaccggggtatgagagcacagaagaatcgacattgntaactatctttgattcacttgtaacatctgctggagaaattttgcaggcatttgaagttccatggtccttgagatctataatctcagtttc

SEQ ID NO: 12528 - DNA, 808 bp, Zea mays
gccggccggtccgggggaccgcccgccccccaaacgcgaatcctccaatctgtccttgccgccgccgcccgatccaggtctgcagactgctcacttctccccacccaacgcggcggcactccttctccctccccgagtgcctgctgtgcgcctgtacttcacaccggcgtcgccccctcctccagaactccccaccggagccaccctcacccgtcacgcactcctccgctgagtgcagcaagtgctgatcagtgggtggacgggagatggtgctgaggcgggcggcaaccgaatgccccaagaaggttgcggggctgaaggatctggtgaacctgccaacccagctgcgagagttcgccggaggccggtcccaaatgtcacatatctccttcttcctcagtgtctggtcgtacatcaaggacaacaaacttcaggacccaacgaataagaacattgtgaagtgtgatgagaagctgaagaccgtattattgggcaggtccaaagtgcaactgtctgaactcccaatgattgttaagctccatttcccaaaattgccaaagtagtgacaacatagtattgtatattgaagttctgtgggaccccctacagtaacttttacttcaaaaaaaaaagttctgtgggaacatgataggatagatagaacactatatgtattgttttgctgaaatttccatttactgtctgtatgtactggagcgatctatacatcgagcataccgattagattgcttgtcaaaaaaaaaaaatgaaaaactcccgagccaaccgcccgccggcgccgccgtcg

SEQ ID NO: 12529 - DNA, 1420 bp, Zea mays
gcacgagacccgcaactagctcgcccgcagcgccgcaggtacaccaatcgcttcgtccccgcgtctcgccgcgtagcggcgtaggcgccacagaaactcgcacgccgctccccgccgtccggcccgagtcgccgtcgctgccgaatccaatccatggctccgcccgccgcacccaccgcgctgcaccaccgcacgcccctcctcctcccccgccgcaccgtcgccttgggtgccaccgccaccgcgcgcgccgccagggccgcttctctcgccgtcagggcccagccggacaccaccgccgcagccgtctccacctccgcgcctgagccggcgcccgagttcaagcctccgccggggttcaaggcgcccgagcccaagaggtacgaggtcaagtccggccaggtgggcagcgtcctcggcgcctcgctcgccatcccccttcgcctcggcaccggcgtcttcgtcctcgggtactcgccatctcttgtttctccatcagagataccatcagaccagtatgcactggaatttggagcttggaaggtgaaagaggaatcaaaaataggacagtgcaaacgaccagaaaagcctatcgagatatatgaatttgaaggttgtccattttgtcggaaggtcagagagatggtaacagtcttggacctagatgtattattttacccctgtcctcaaaaaggcccaacattccgacctaaagtcctcgaaatgggtggaaagaaacaattcccttacatggtggatccaaacacaggggtcgccatgtatgaatccgatgacatcataaaatatctagctgatacatatggcgatggaactgttccaattatgctatcacttggtctgttgacagcaattacagcagggcttgctactcttggtcgtattggaaagggaaattcctacattgcttcaaaagtcccaccgcagcccatagagatatgggcatatgagggatctcccttctgtaaattagtacgagagacacttgtcgagttggaattgccacatctgctacacagctgcgcacgaggcagccccaaacgacaagaatttttcaagaaaaaggggcttttccaggcgccgtacatcgaagatcctaacacgggagtccagatgtttgaaagcgctgaaatcatagactacctgaaggcaacatatgccctgtacccaagctcgtagtgatgtatcagaaatggtcattgtaatgttgcgtgtagattcagttcttcccggtaataaaaggaaaagaaatagtgggccacgcattctgtatgatgcacagccgattttgtctatgcagatctaaactttgaagttactacaaattcctgttttcctggttaaaatagtgtttggttccaaatcgtagttggacaaaaaaaaaaaaaaaaaaaaaaaaaaa

SEQ ID NO: 12530 - DNA, 1455 bp, Zea mays
aaaccgttggataaagacgctgcaaactgaatagggagaaagacggttccggagtccggactcaagtcccccaaaaatcccaatcgaacccgtccgcctatcgccccaaaccctcgcccagctcgaggtcctcgccgccggccgccggccgccgtctccgtccgaccgccgccatggctcgcaacgaggagaaggcgcagtcaatgctgaaccgcttcatcacgatgaagcaggaggagaagcgcaagccccgagagcgccggccctacctcgcctccgagtgccgggacctcgccgacgccgagcgctggcgctctgagatcctccgcgagatcggcgccaaggtcgccgagatccagaacgagggtctcggcgagcaccgcctccgcgacctcaacgacgagatcaacaaactcctccgcgagcgcggccactgggagcgccgcatcgtcgagctcggcggccgcgactactcccgcagctccaacgcgccgctcatgaccgacctcgacggcaacatagtcgccgtccccaacccctcgggtcgcggaccggggtaccgctactttggcgcggccaggaagctccctggcgtgcgggagctcttcgacaagccgcctgagatgcggaagcgacgcacccgctacgagatccacaagcgcatcaacgccgggtactacggatactatgacgatgaggacggcgtgctagagcgccttgagggccctgccgagaagcgcatgcgggaggagattgtttcagagtggcaccgtgtggaacgggtgcggcgggaggccatgaagggggtgatgagcggtgaggtggctgcggctggagggcgcagcggggaggctgctagagaggttctgtttgagggggtggaggaggaggtcgaagaggagaggaagcgcgaggaagagaagagagagagggagaaaggcgaggaagttgggagggaattcgttgcacatgtgccgctacctgatgaaaaggagattgagcgcatggtattagagaggaagaagaaggagctgcttagcaagtatgccagcgattccctgctggttgagcaggaggaggccaaggagatgctcaatgtccgacgctagaagacgactggccaattgaagctttcattgtgagctcaagacgagcactgaggtacaagaaggaacatcttttgaagtgctggcaccggggggaccaaagacattgttatgtaaaagaaaacaggtttgcctgaaatcacattttatgtgtttaatcagacttgagcgagtgatactggtgcctgtgtgccctgaacgaaggctagacttgtggtattgatgtgcctgtgtgcactgtaacttaactcgtatcatgtacagccattggctgcaatgcactgatcattgatcccttaaaatttcagtgatatagcaaaatctgatcgtatcaaaaaaaaaaagaaaa

SEQ ID NO: 12531 - DNA, 1336 bp, Zea mays
  misc_feature (669)..(669): n is a, c, g, or t
gcaacgaggagaaggcgcattctatgatgaaccgcttcatcacgatgaagcacgaggagaagcgcaagccccgatagcaccggccctacctcgcctccgagtggcgggacctcgccgacaccgagggctggtgctctgagatcctccgcgagatcggagccacggtcgccgagatccataacgagggtctcggcgagcaccgcctccgcgacctcaacgacgagatcgacaaactcctccgcgagcgcggccactgggagctccgcatcgtagagctcggaggtcgcgactactcccgcagctccaacgcgccgctcatgaccgacctcgacggcaacatagtcgccgtccccaacccctcgggtcgcggaccggggtaccgctactttggcgcggccgggaagctccctggcgcgcgggagctcttcgacaagccgcctgagatgcggaagcgacgcacccgctacgagacccacaagcgcatcgacgccgggtactacggatactatgacgatgaggacggcgtgctagagcgccttgagggccctgccgagaagcgcgcgcggcgcggggttgtttcagagtggcaccgtgtggaacgggtgcggcgggaggccatgaagggggtgatgagcggtgaggtggctgcggctggagggcgcagcgggngaggctgctagagaggtgctgtttgagggggtggaggaggaggtcgaagaggagaggaagcgcgaggaagagaagagagagagggagaaaggcgaggaagttgggagggaattcgttgcacatgtgccgctacctgatgaaaaggagattgagcgcatggtattagagaggaagaagaaggagctgcttagcaagtatgccagcgattccctgctggttgagcaggaggaggccaaggagatgctcaatgtccgacgctagaagacggctggccaattgaagctttcattgtgagctcaagacgagcactgaggtacaagaaggaacatcttttgaagtgctggcaccgggggaaccaaagacattgttatgtaaaagaaaacaggtttgcctgaaatcacattttctgtgtttattcagacttgggcgagtgatactggtgcctgttgacaaattttgacgaatgctaagcttgtggtattattggtgtgcctgtgtgccctgaacgaaggctagacttgtggtattgatgtgcctgtgtgcactgtaacttaactcgtatcatgtacagccattggctgcaatgcactgatcattgatcccttaaaatttcagtgatatagcaaaatctgattgtatcatctcgtttgaaaaaaaaaaaaaaaaa

SEQ ID NO: 12532 - DNA, 2350 bp, Zea mays
tagaagaaaaaaaaggtattatgtaagcatcaatgtaagtaaaagaacaaaactatatagaaaaacatcgaaaacaccattaaaacggcaatcttgtggttgtggcagtttgcactctagtgcgaggccgtggccgagtggaggcgggccagccatgacgggctatcggctagacgataggctgacggcaatggcaggcgagccgcaagctagagacggtgtcctgacggcgctcggtcgatatcggtcgtggcctcaatagtagttagatccagcagcttactcatttttcatacctatatttaaactccactctacgaataatacagtctacaccgtgtaaaacaacataaaatagtgttttagacgatcatgtgttcatgtggctgaaccgacggacacggtagctcgatgttctacaaccatgtatcttgttagaaaaaaaaggcaaacgctactgcacacaacagttgcaggcagtgattcatcactcttacgtactagaggagacgagagggaggggcgcacgtgtcgctgcgcgcgcgtgagatgacaccggtcgggccgccggggaaggagtgtgaacgggtcgccgtcggcccggcggccttcactgccggacaaggacgccgcagcgagcactgtctggcgcgccacacagtacggctgcgggggcaccaacaagacaaccgcccagggaccagccatgtgtacggcccgggccacgtcgacgacgagtcggttgcacgtcccaaagcgtcgcggcaaaaaccgtacagcgatcgcacgtagggtgtggagccgggtggccttcgttcacacggctgacgcgaacgtgtcattaagcccgccgatggcgagccagcggcggatcgcacccgtcggtgcccgatcgatcggatgggaggacggcgacgtgggcagggcagctaaccgccgggctcctctctccatcagatcacgcatcagtccgcgacaagcaaatttaccaaatcggccccgttcacaccactatagtacagccgtgcacccgacgggacgggtccgtggatggagggcgcctagccgccgatcgagagcacccataaatagccgtgccaggacatcagccgcgcagcagcagcagctccaacaagacacaccaaaacacctagctagcttaccgcacctgctgcttggggctgccaagtaagtagtaagctagagaagcaaagcaaagcaaagctccgatccaatccaatccatcgcaaggattatgtctctggtaaggctcctggacacgctggccctggactcgtgggtgcggaaccccttcaccatcttcggcacggcggtggccgccgacgcgtggctggccagcgacacgtcggcgttcgccaacacgcacatcgagagccgggacacggcggccgcctacgtgttcagcgccgcgctcccgccgggcgtcaagaaggaggaggtcacggtggagctggacgagggcaacgtgctggtcatcgccggcgagcgcagcgtgtgccgccaggagcgcagcgacggctgccaccacatcgagcgcagccgcgccaccttcctcgccaggttccacctgcccgaggacgccgccgtcgacggcgtcagggccgccttggacgccggcaggctcaccgtcaccgtgcccaaggtcggggccgccgccgccgccatcgtgcccgagaagcccgccgccgacgcgccggcgctggcgcccgtgcccgtcgaggccggcccctgctgagcttctgacgatgccgacgccgacgccgaccgagacggccggccggctccctgttcctccacgtacacgcccccccgccggtgaacggatagtagcgtcccacgtcgtcgtgcgactgtgaggttgtcgctcgctcgcccgtgctgtctcaaagtttgtttccgtggtttggtcctggctttgcgtactacgtgatggactcagctgcctgtactgtactgcgtgcatgcatgtaaccatgaaaacaaaagggtggtattcctgcattgcacggctgcaacgtgtaattccgtctttaatcaatgttttttctgtgcttagtaaatgaaaaggcaagctaagctggaatcctatataaaaaaaaaaaaaaaaaaaaaaaaaaaaaaaaaaaaaaaaaaaaaaaaaaaaaaaaaaaaaaaaaaaaaaaaaaattcccccatcccccaggaatccacacaaggacttcgacgtcacacgggggctgggcacaaacacaccaagggtcggcaccaatggtttactaccaggagggggactactgctccgaggaggtgaggtcggtggccccggccggtttcggccgccacggggggg

SEQ ID NO: 12533 - DNA, 765 bp, Zea mays
  misc_feature (708)..(708): n is a, c, g, or t
gtggcggccgcctcgagggccggccgggccgcgagagcagcataacaagaagacacaccaaaacctagctagcttgccgcacctgcttggggctgccaagtaaaagtagtaagctagagaagcaaagcaaagctccgatccaatccaatccaccgcgaggattatgtctctggtaaggctcctggacacgctggccctggactcgtgggtgcggaacccgttcaccatcttcggcacggcggtggccgccgacgcgtggctggccagcgacacgtcggcgttcgccaacacgcacatcgagagccgggacacggcggccgcctacgtgttcagcgccgcgctcccgccgggcgtcaagaaggaggaggtgacggtggagctggacgagggcaacgtgctggtcatcgccggcgagcgcagcgtgtgccgccaggagcgcagcgacgggtgccaccacatcgagcgcagccgcgccaccttcctcgccaggttccacctgcccgaggacgccgccgtcgacggcgtcagggccgccttggacgccggcaggctcaccgtcaccgtgcccaaggtccggggccgccgccatcgtgcccgagaagcccgccgccgacgcgacgccggcgcccgtgcccgtcgaggccggcccctgctgagcttctgacgatgccgacgccgaccgagacggccggccggctccctgttccntcacgtacgcccccacgccggtgaacggatagtagcgtcccacgtcgtcgtgcgact

SEQ ID NO: 12534 - DNA, 4977 bp, Zea mays
  misc_feature (488)..(488): n is a, c, g, or t
  misc_feature (569)..(569): n is a, c, g, or t
  misc_feature (605)..(605): n is a, c, g, or t
  misc_feature (685)..(685): n is a, c, g, or t
ggccacttgatcacgatgtgattcctagagatattagaactccctgttgtgcttattcgagctccgacgtacatattagctgcccatttcaatggcccgctgtaatttagtgggttacctaatggtgccattgattatttaccatcaaacattcagtgaggtttttaggatgtgatatctgtatacgagaagattacacattccacctgtgcaagtggaactagtttgtactctctgttccaaattacacatccttatgccttctcaagatacatagcttttattatgtacctaaacataatgtagatcgagagcaaaagttatatctagaaaaactagaacagacttacaatttagaatggagtgagtatttcctagcaagggtgttgcctttccagagcagaacaaacatttgagcttatgtctagtgctctcatttttttatgatattctttattttggcataacacaactttaacaaaatatgngaagattgtcaatgaatcattgtgcttacatggtaaaaaaaaccaacccagtgggggggggggggcacagcggcaccgtancccatgtgagaacggatgagtgaggccgggccttanaactttgctttggtgtgggaccgatgagaggatttttgtaaccccggcctaaattccctacaacggggaatcgaacttanaacgtaaggagtgctactcaggtcacctaaccaatttagttagaggcccttttgcgtgcttagacagtatggctgaattaccgctagtaatactatgaagtgcctgtttacaactattgtgcagttccgctccatcctcactggcaaacatcaaacttttgccatggctgaagatgggtaggtaaagttgtcccaccggtgctaaacaggttcatgtcacaatttttgtggtaaattcactaatgtgggaagtctgagtaccatgagtgtgaagttctccagacacactgatcctattcatttttaaaataaaaataaggcttcaaaaagaatgctcagatttgtaatcttattgaatatacttgctgaaaacgcttgagttcacctgtttttcatatatttaaagaattccatctgacctggtgttgttggagcatgacaaatgtcctttgtctataatgttctttgttattttgttaacatgcaatctgaaataagattgtggaaaatatattcctgtatcagttgttttggagatattttcaaatgtatagttcatacttctcatctgaccaagttgccattgataagtctgggatgccaacttacaactattgggcaattttggtcctccatctttgtgttatggactttttctgttagactgacatatatggtgtgtgtatatacggtatgggtatgtttaaggtatagcagaccggcccatgtatatgttagattgtcatatatggtatgggtacatgccaggtatagcaggccagcccttgtatatgattggaaagatacgagaagatctcatctggttctgtttccataagccacaagatctctcccttatttatatggtctctccaataaatcaatccattattctacgctatttcggttgctttctggtatcattcgtctaggtttagcctttcgccttttgccaccactgctccttgtgtgcgcctcatccactgtactggctactatggctggtgatcctcctgcactgcctcctggcgctgctgcttttcgcacagccgtcggcgccggcacgatcactgccgatatggaggtgtggagattcttcatgcactcgttcctgtacgtggaatattttaatcagcggtgtagctcatgttcagatcatctttgcagttcatttttgtgtcttacacttagaatttgactgctccaatgtgctccattcaatttatgcgagcagtttgatttccgtgtatacgcttgggctgctctaacactgcatactttgtactggtcttgaatgagtctgacccccattggacctagaatggggaacagatgtccttttttattcttatatgttctttaatcattgaagcatgacttgaaataaaaaaatatggaaaattgtataagtatcactgtgtccggagagctttccaaatgtatgactgcaggtttcccacttgaccatcttaccactaataatattgtggaatgtgcctgtgaataactccatgtgtgatagactgatagttcatatacaggatagtgtcacagtttttgtggtaatttggcagcatgggaagcctgagtgctacaggtgcaaagctcttcacatacactggttcttggtcaattttttctgaaagaaactagaaagctttcaatggaaaccctcaacttgatggcttgatgctttgttctgttcttcgacgagtcttgctgaatacacctgagtttgcctgaggttctcaaattcagaaacactggctaacctagaaaggttggaacaagacagatgtccttttccatgcttttagcaaaggagagcctaatataatatatttcctggctggttcacctcttaaggtgtcatgtgccaaccttgggtggaacagtctccacattgggagtggtggccagtgcccttggatagaggctctgcagcccattacctgtgcacaggtgtagtttggttcgggactgactggacagaaagtagaggtagagttctgctagtggtaaaccagttatggtcacattttttgtgttatatatggcggcagtgtggataatcttaagtgctcggagtgcaaagctctcgcacactgagccatggtctatctgtgttagaaaactggagggctttagaggagtccttgacttggggctctgtactgttcttggaagagacttgccaaagtacctcagtttatgggttttgcaaaaataaacccaggctgtcctaatgatgggaacaacagaatgatctagtttggtgaccaatttcactatttggctacaagggaagtgaatacatggagggaacatgtaaatccgtcgagaaataattcaaaacttgaatttgtatactcatttcatgtaaatggcatcaaatcttccccaacgtcattaacagctgtgggtcacttccgcaagctgagaactgacaccatgcattgcatcttggtttccatcccactgcagctcaaaagatgttacttacatgctgctgctgcatgttgtcaaacataagtttcttgggccatctgtttatctttttgggacactcatgtttgaaccgtacggattcagcttttgtacaaggtatggtcaggaaaatatgtatgttttgcactaggcatgtaagtagtgcttgggcctaaattcagtcactgcttgatgtatatgatccatagttttaacaattaactataaattgtaactgaatttgatgagttctgtgctccacacttttaacagttaactgtgagttgtaactgaacctgatgggttctatgcttcaagcgttcgaccttgggggccaccagatcgcccgccgcgtctggaaggactactacgccaaggttgatgctgttgtgtacttggtggatgctgttgacaaggaacgttttgccgagtcgaagaaggagcttgatgcgcttcttgcagatgactcccttgcaaacgttcctttcctcatactgggcaacaagattgacatcccatacgcggcttcagaggaggagctgaggtactacctcggcctgagcaacttcacaaccgggaagggcaacgtgaacttggccgactccaatgtccggcccctggagatcttcatgtgcagtgtggtgcgcaagatgggctatggcgaaggcttcaaatggatgtctcagtacatcaagtgagtcgctgctgtcctcttttgtccatggcgctgctgctttcgcaggagggttgaaatcaagtctggtcgtgacatggcagctgcatggaaaggtttatggtagctagtgataggcaaagcttgtaagtcggtgttaatcctagatatgtgatgtggggtctactttctcttctgattgtttcttggggtggtctaaacggttcaaaaaaaaatgcgacttcttcgggtcagctagaagttatgtaatcacgttacatgaagcagcgcattgttcgccagctgctttggtgtggtggacttctgtcggtaatggtgagcttgcggtttctaaaagtatgcgtgtagactgtggtaattgtgtatctacagattccaaaccttgcatttgctgttgactgaggtagcccggaaatgataaaacatcctggtgaaagttgcattgctttcatgttgcgttttcgttggaacgaagcagcacaccaacccgaacgctgctattcatttcaatttgaacatttaaaagcaccttgggcttcgtttggctaaccgtgtattgtacacgcattgttagagcatctgagtcctaaacggagttgtaggacatcaaaaacttgctttaatagggttctattttacaaaaaaaaaatatataggaaatattaaataaatataggactcagtctatcagatcctaagtataagatctcgtatgttcgagcacttttttatgcttctaaacactttaaattagatcctactttaaattttaggacgccgatgtaggactactggttggagacgcttttaacaattacacccgtcactataaggaaaatggccaaaataacttttattcatatgccgtaaaaaataaccttatttttggtgaccgacaccaacccatagaaaaataaatttgttattatcagtggttaggtatcagccataaaaaataagcttattattttttgtggccaggcatcagccgataaaaataagcatttattttcaatagctgacatgtgcccaccagaaattagtgttgaggaaaagggtttcatttgagggttgatttggtgacaaagggatcccgagaggatgggagggg

SEQ ID NO: 12535 - DNA, 1275 bp, Zea mays
ctcgaggccggccgggaatgaccgcttgtgatctgatctgacggtagaggtaagttgttctagaacaagtagacgccaccgaagaatctagaatacggcccccggggctcgccgggaagaggaggggaagaaatattcttcccgtcgaaagacggagagaggaaaagggacaagggcaaggcaagagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccgacgcagtaccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagcttgatgcgcttcttgcagatgactcccttgcaaacgttcctttcctcatactgggcaacaagattgacatcccatacgcggcttcagaggaggagctgaggtactacctcggcctgagcaacttcacaaccgggaagggcaacgtgaacttggccgactccaacgtccggcccctggagatcttcatgtgcagtgtggtgcgcaagatgggctatggcgaaggcttcaaatggatgtctcagtacatcaagtgagtcgctgctgtcctcttttgtccatggcgctgctgctttcgcaggagggttgaaatcaagtctggtcgtgacatggcagctgcatggaaaggtttatggtagctagtgataggcaaagcttgtaagtcggtgttaatcctagatatgtgatgtggggtctactttctcttctgattgtttcttggggtggtctaaacggttcaaaaaaaaatgcgacttcttcgggtcagctagaagttatgtaatcacgttacatgaagcagcgcattgttcgccagctgctttggtgtggtggacttctgtcggtaatggtgagcttgcggtttctaaaaaaaaaaaaaaaaaaaaaaaaaaaaaaaaaaaaaaaattattttaatttttaaaaaaaaaaaaaaaaaaaaaaaaagcttgtacctgcccgggcggccgctcaa

SEQ ID NO: 12536 - DNA, 926 bp, Zea mays
cctcgaggccggccgggagaaaacgtgttgaagacgtttcgcggcccgcacagatcgcctttcaagttgaacgggctgccggcctaccgctgacagacgattcaaccgtccgccaaatccaaacgcaccgatccattccagaccatggcgacgaccaaggaccccgcgaccaccggcggcgagcccgccatcggcattccctaccacccggcggcggattcccaggggcactactactacgcgccgccgccgaacccctacgcggcggggatgccgccgcccaacgcgatctacgccggcgcgcccaagggggtgccgctccagcagaccatgttccgcgacacgcccgcgcccttccactgccaggcctgcggtgaagccgccgtctcctccgtccggtcaaagccaagccttgcatccgtcgtggcttgcatgatgccattcatgctgggggtctgcttcctatgcccttcgatggactgcctctggcacaagtaccattactgccccagctgtggggaaaaggtgggtgagttcaggaagtcggacccgtgcctcgtcgtggatgcgacccggtggtccgagccgagcttcgccgtgcctgcgtagcgcacatatgcaccacttgctatactgccttaaaaaaatgagagtgttcgtttctctcgtctagtctgtatataaaagatgctactggcttgttgcatgctgtatattactgaacctgaagaactgccgttgcgctctagtctctcctcccaacgttagaattgaatattttttgttttctttggaacagaataaatttgctgctcttacaagtgcataatcgaatctagtacacgtgtaaatgcgtaacaggaaatttatcagcaaggaaagaaaaaaaaaaaaaaaaaaaaaaaaaaacaaaaaaaaaaaaaaaa

SEQ ID NO: 12537 - DNA, 1513 bp, Zea mays
cttgttctcctcctcctccatatctccagccgcaaccggtcctcactcctaatttctctggctctgccctctccttcctctcctcaaaagtctctgtaaaaaaagtaggtagtgtctcttttcgaccgctgcagaggagcgagaggcagctcccactcgtgccgctgttcctcgcgccatggactccttcagcttcctcaagtacctgcgcggcggcgtggtcgccggcgcccatcgcgcgcccgcggccgccacgaccatcgccgcgtcggcgtgcgagtacggcgacgacgcctcctccttcttcgacctggagttcgcggtgcccggcgacgagagcgccgcgtccgacgccgaggaggagcgggtcgagctcagcttcgctgcggaggacgaaggcgtcgtggcgcccgtggccgccgtcgcgccggcggcagaggcggagcctgaggccgcgccgccgccgccgccgtcgctgccccgtccggccaccaggtttcgcgtgctgctgctcaagctacggaagcccaagggcggccccggcggcggcggacgcggccggcaccagcgccgcgccggtggcgagccggttcctggtaaagctccgggtggacgacgcgacgccgctggcgtcgctgttcacgcgcgacaacagctcgcgcgcctcggacgccggcgcggaccggccggctacggcagcggcggcggcggcggagccccagcagcaggagcaggaggtggcggcgtcgatcaccgcggaggagcggcggttcgccaaggaggtggtcctgcggtacctgagcaagatcaggccgctgtacgtgaaggtgtcccggcggtacggcgagcggctccgcttcggcggcgcggcgagcgagggagaggaggagacggacgcggaggcggacccgtccccgtcgcaggctcctccaccgtccgtgccggcgggggtggtggcgtgcggcgtgcgcgcgccacgcgccagcgtgcccgcggggctgaagcaggcgtgcaagcggctggggaagagccggtcggcgtcgtccgcggttgcggtggcgccctctcccgcggcggcggctctgagtggcccgcagcgcagcggcgggacgactcgctgctgcaggtgcaggacggcatccagagcgccatcgcgcactgcaagcgctcgttcaacgcctgcaatggtacgggcacgggcccacctcagcgatgcaacagcagcccctagtaaacaaagcacggcatgcatgcatgcaatccggctgcatgaccttgccgtctagttccttcgatgatgatcttttgtcttcctgtgtgatggtggttgcggttgcattgcattgcactgcactgcaccgcaccgtgtgttgtgcagttgtccagtggggtatgcgacggagagaggctagtagtaccaactccacttgtaaaaatcctggtacgagcactcgtggaaggtatgtgcacgacctgctctttcatggctaaaaaaaaaaaaaaaaaaaaaaaa

SEQ ID NO: 12538 - DNA, 2053 bp, Zea mays
gaagtcgaaagccgacgcccacccccaccccgcgctgctgctgttgctcatctcatctatctggcattgatgctgcaactgcaacgccaccttgggaccttgtcctcgtctcctccatccgcagccggtcctcactcctctgtcctctgctcccgctcctccagtcctcctcaaaaggctctctcaaaaaagagtcttttttcgaccgctgggagtagttggccttggaaccgagcgagcgaagcgagggagcaagatttgactgctggcgagaacaagtgagaggagctagctcccagcaaagctccgtgcccccgcgtgcgtcatggactccttcagcctcctcaagtacctgcacggcggcgtggccgccggcgcccagcgcgcgcccgcggcctccacgaccatcgccgcgtcggcgtgcgagaacggcgacggcgacggcgacgacgacgccgcctccttcttcgacctggagttcgcggtgcccggcgacgagagcgccgcgtccgacgccgaggaggagcgggtggagttcaacttcgccgtggcgcccggtgccgccgacacggtggccgtggccgtggacgcgccggccgcggaggcggaagccgagtccgaggccgacgccgaagccccgccgccggcgccgctgctccgcccggccaccaggttccgcgtcctgctgctcaagctgaggaagcccaaggccccgccggcggatggggccggggccgggtccgcgcaggcgccgccgaggcagccggccgtggcgagccggttcctggtgaagttccgcgtggaggacgcgccgcttgcgtcgctcttcacgcgcgacaacagctcgcgcacttcggacgccggcgtggaccggcgggctccggcggcggcggcggcggtggaggcccagcagcaggaggaagaggaggcgtcggcgtcggcgtcggtcacggcggaggagcggcggttcgccaaggaagtggtgctgcggtacctgagcagcaagatcaagccgctgtacgtgaaggtgtcccggcggtacggcgagcggctgcggctcggcggcgcggcgagcgagggcgaggagacggacgcggagcccgacccgtccccggcgccgccgtcccaggctccttcgtcgtcggccccggccccggcgccggcgccgcagccggtggtggttgcctgcggcgtgcgcgcgccccgcgccggcgtgcccgcggggctgaggcaggtgtgcaagcggctcgggaagagccggtcggcgtcgtccgcggtggccgcggcgccgtctcccgcggcggcggctgctctgacgggcccgcaggcgcagcggcgggacctcgcgcgcctgcaggtgcaggacggcatccagagcgccatcgcgcactgcaagcgctccttcaacgcgtccaaaggtacggttgtacggggccgggcttcggctcggctacgcaacagcagcctagcttcggctgctacgcccggtgctagtatgtagtactccgtaatggctaaccgtttgtttttctctctctctcttgcgtcggtggcgctgtagaacctcggtccatgacggcgacgacgggcggcgccggggaaggcgcgtgaggcggtcccgtacgtggcgccatgacgggaaaggcgtgacgcggactgtggtggtgacgtggtgttgtcagcgtacgtagatggtggtagtcggctatccgttaataaagataaaatattagtactagtaaggtttggaccggaagaaaggtttgtctttagcgccgcgctgtgggctgtctacttggatcatcatagtttttgtctgtctgtccgttccggtgccggttctgtggtgcttgtgtgctgtgctgtgtagcagtggccactgaggcactgactgactggccagtggtaaacgtgctcctcctatatattatattattattatatatgtaaaatattgctaagttggtgatttgagcgacgagagaaaaaggctgcggcgagctcggctttccgtcactggggaggggacgtcggcacgtcgcgcctgcagccc

SEQ ID NO: 12539 - DNA, 4472 bp, Zea mays
ctagcataatccatcgttaccagagatggaaatggcggcgacttctgcggagacaacaacccagatgacgctagactactttccactctcggatccctgactaccactcgtcaggcgtccccgcctgcagtgcgggtctaatctagccccgcgaattccccaattttcgccgctccaattcgctcatccgtccgcgcgcccctcgccgaccggccggcgcggcgccggccggcgtcctctctccggggtagtcagtcgcgcactgcgcatcgctgttgttccttccggttcctttcgcgtccccccttcggagcagggcaacgtccaagagatattatcgctgccgctgccccgcgcgggccgctcgctgtcccactcgtgcgccacgcctcggactcggaggtgtattccctcttctccccccgtgcttatccgcgacggaatccaatcccttcgctcaagtccttctcctaagcaaagccccctcgcttttggcgtatgcccccgctggcgcgcccatgattcccgccgattcctccgcccgttcagtccagcaacccttgctgctgcagtgctgcggctagttcggtggcggggaaggaggaggaggcgagatcttggagtggggcgaagcggagatgtcgttgccgtcgaacaaccggaggacgtgctcccggagcagctctgcgcggtccaagcacagcgcgcgggtggtggcacagacgcccgtggacgcgcagctgcacgccgagttcgagggctcccagcgccacttcgactactcctcgtcggtgggcgccgccaaccgcccgtcggcaagcaccagcaccgtctccacctacctccagaacatgcagcggggccgctacatccagcccttcggctgcctgctcgccgtccacccggacaccttcgcgctgctcgcctacagcgagaacgcgcccgagatgctcgacctcacgccacacgccgtccccaccatcgaccagcgggatgcgctcggcatcggcgtcgatgtgcgcacgctcttccgctcgcagagctccgtcgcgcttcacaaggccgccgccttcggggaggtcaacctactcaaccccatcctcgtgcacgccaggacgtcggggaagcccttctacgccatattgcaccggatcgacgtcggccttgtcatcgaccttgagccggtcaacccagccgacgtgccagtcaccgccgcgggcgcgctcaagtcgtacaagctcgctgccaaggccatctccaggctgcagtcgctgcccagcgggaacctgtcgttgctgtgcgatgtgcttgtccgtgaggtgagcgagctcacgggctatgaccgggtcatggcctacaagttccatgaggatgagcatggcgaggtcatttccgaatgcaggaggtccgatctggagccgtatcttggactgcactacccagccaccgacatcccgcaggcgtccaggttcctgtttatgaagaacaaagtgcggatgatatgtgattgctgtgccactccagtgaaggtcattcaggatgatagcctagcacaacctctcagcctctgtggttccacactcagggcttcccatggttgccatgcacagtacatggcaaacatgggttctgttgcatcacttgcgatgtcagtcactataaacgaggatgaggaggaagatggggataccgggagtgaccaacaaccgaaaggcaggaagctgtgggggcttgtcgtctgccatcatacaagcccgaggttcgtccctttcccactaaggtatgcttgtgagtttctcttgcaagtatttggcatacagctcaacaaggaggtggaattggctgctcaggcaaaggagaggcacatcctcagaacgcaaacccttctttgtgatatgctcctgcgggatgctcctgttgggatatttactcggtcacctaatgtgatggatctagtaaagtgcgatggagctgcattgtattaccagaaccagcttttggtgcttggatcaacaccctctgagtcagagataaagagcattgcaacatggctgcaggataatcatgatggttcaactgggctgagtactgacagcttagtggaagcgggttatcctggtgctgttgcacttcgtgaagttgtgtgtggcatggcggccataaagatctcttccaaagattttatcttctggttccgatcgcacacaacaaaggagatcaagtggggtggggctaagcatgaaccggttgatgcagatgacgatggcaggaggatgcatccacgatcttcattcaaggccttcttggaggtggttaaatggagaagtgttccctgggaagatgttgaaatggatgctatccattctttgcagttaatattacgtggctccctgccagatgaagatgccaacagaaacaatgtaaggtccattgtaaaagctccatctgatgatatgaagaagatacaggggctacttgaactgagaacagttacaaatgagatggtccgcttaattgagacagcaactgcccctgtcttggctgtcgacattgccggtaacataaatggatggaacaataaagctgcagaactaacaggtttacctgtaatggaagccatagggaggcccctgatagatcttgttgttactgattctatagaagtggttaagcagattttggactcagctttacaaggaattgaagagcaaaatatggaaatcaagcttaaaacattccatgaacatgaatgcaatggtccagtaatcttgaaggttaactcctgctgtagtcgggacctttcagagaaagtcattggagtttgctttgtagcacaagatttgaccaggcagaagatgattatggataagtatactaggatacaaggagactatgttgccatagtaaagaaccccactgagctcatccctcccatatttatgatcaatgatcttggttcctgcttagagtggaataaagctatgcagaagattaccggtataaagagggaagatgcgataaacaaattgttaattggggaggtcttcacgcttcatgattatggctgtagggtgaaagatcatgcaactctaacgaaacttagcatactgatgaatgcagtgatttctggtcaggatcctgagaagctcttttttggtttcttcgacacagatgggaagtatattgaatccttgctgacagtgaacaagaggacagatgctgagggtaagatcactggtgctctttgctttctgcatgtggccagtccagagcttcagcatgctctccaggtgcagaaaatgtcggaacaagctgcgacaaacagctttaaggaattaacttacattcgtcaagaattaaggaacccactcaatggtatgcaatttacttgtaacttattgaagccttctgaattgacagaggaacagcggcaacttctttcatctaatgttctctgtcaggaccagctgaaaaagattttacatgacactgatcttgaaagcattgaacagtgctatatggagatgaacacagtagagttcaaccttgagcaagctctgaatacggttctgatgcaaggcattcctttgggcaaggaaaaacagatttcaattgaacgtaattggcctgtggaagtatcatgcatgtacctttatggggacaatttaaggcttcagcagatcctagcagactatctagcatgcgcccttcaattcacacaaactgctgaaggacctatcgtgctccaggtcatgtctaagaaggaaaacattggatctggcatgcagattgctcatttggagttcaggattgtccatccagctccaggcgttccagaggccctgatacaggagatgttccagcacaacccaggggtgtccagggagggcctcggcctgtacataagccagaagctggtgaaaacgatgagcggcacggtacagtaccttcgagaagccgacacctcgtcgttcatcatcctgatggagttcccggtcgcccagctcagcagcaagcggtccaagccttcgacgagtaaattctgaccctcatgctcctggaactgcagcgagtgttcggccgtgtcgaagtctcggttgtagctagccaagtggctgctactgaaacatcggttggtcggttctggtatctagcacggcctgtgtagtgcggatagatttggttgtttggctttggagagataagctagctggctaggtgtaacgtaacgtcgaccgataactgtatgtgaatgatgatgagctgtgaggacgaataaaggcttcacttgtgttctctattgctcttcttagagtatgatggccaacagctgtacaggaaagcatccacctaaatctgggctcgctgaatgacggctaaaagttgtttggtggctttgtaatcccttacagtcgaatgttggtctttaaactgtcagttaaatgctagtacggcggtaggtctgttttctt

SEQ ID NO: 12540 - DNA, 1870 bp, Zea mays
cttgcatgcctgcagaactaacagggttacctgtaatggaagccatagggaggcctctgatagatcttgttgttgctgattctgttgaagtggttaagcagattttggactcagctttacaaggtttgtcactatgctttcagtcgatctttttgtggttcccagcttaatctgaacgtgtccatttttttctatgacagcttagtgtctccttgtgtttcaggaattgaagagcaaaatctggaaatcaagcttaaaacattccatgaacaggagtgttgtggtccagtaatcttgatgattaactcctgctgtagtcgggatcttccggccggggtcattggagtttgctttgtagcacaagatttgaccaggcagaagatgattatggataagtatactaggatacaaggagactatgttgccataataaagaaccccagtgagctcatccctcccatatttatgatcaatgatcttggttcctgcttagagtggaataaagctatgcagaagattactggtatgaagagggaagacgcgataaataagttgttaattggggaggtcttcacgctccatgattatggctgtagggtgaaagatcatgctactctaacgaaacttagcatactgatgaatgcagtgatttctggtcaggatccagagaagctcctgtttggtttcttcggcacaggtgggaagtatattgaatccttgctgacagtgaacaagagaacaaatgctgagggtaaaatcactggcgctctttgctttctgcatgtggctagcccagagcttcagcatgctcttgaggtccagaaaatgtctgaacaagctgctacaaacagctttaaagaattaacttacattcgtcaagaattaaggaacccactcaatggcatgcaatttacttataacttattgaagccttccgaattgacagaggatcagcggcaacttgtttcatctaatgttctgtgtcaggaccagctgaaaaagattttacatgacactgatcttgaaagcattgaacagtgctatatggagacgaacacagtagagttcaaccttgaggaagctctgaatacggtcctgatgcatggcattcctttgggcaaggaaaaacgtatttctattgaacgtgattggcctgtggaagtgtcacacatgtacatttacggggacaatataaggcttcagcaggtcctagcagattatctggcttgcgcccttcaattcacacaaccagctgaaggacatatcgtgctccaggtcattcccaagaaggaaaacattgggtctggcatgcagattgctcatttggaattcaggattgtccatccagctccaggcgttccagaggccctgatacaggagatgttccagcacaacccaggggtgtccagggagggtctcggcctgtacataagccagaagctggtgaaaacgatgagcggcacgttgcagtacctacgagaagccgacacctcttcgttcatcatcctgatagagttcccggtcgcccagctcagcagcaagcggtccaagccttcgccaagtaaattctgacactgatgctcctggaactgcagtgacggttcggccgtgtcaaattctcgggtgtagggtgtacctctggccaagtgactgatattctgaaaaacatacggacttctagtataggagaagaggaatcctaatcctagtaattatatcttagtagatatgtgcttagtctcttgttaattttttgtcttgagaggactatatatactgataaagtgataatttattcagagaataaagaatgggctccatgctttgtctaaaaaaaaaaaaaaaacaagctaaaaaaactaaataaaaa

SEQ ID NO: 12541 - DNA, 1724 bp, Zea mays
  misc_feature (65)..(65): n is a, c, g, or t
  misc_feature (89)..(89): n is a, c, g, or t
  misc_feature (110)..(111): n is a, c, g, or t
ttttttttttttttttgctgaaaattgaggtagtacagcttaggactataccagagttgcattanttttggatggacgtcagtacaganaagttaatctggtcgcatgcnnatacagttaccaatgtagcccgaatcctcatacatcgtactcaaacgctctttcattcaacagaacaaatgggcttgctatatcacatcttttggtgttatggtacataatggcgagatatgcagactaacgttttcaaagagtacactataattgcatcgttgtccagcttgatcaaccagtgtctcaatataccccagtcgaacttttcagtgagacgccatcgcaacggagatccacgcgttgtacatcccatggggtttttgcgagtgaatattttggggatcaatttcattaaataaattgctaaaaaagcggaatccatctggactaacatctctgcacaacaggcctttgttttctgcatttagaagatgctcctttgctaaagctggagcaattcccagcgtgaatgcagcatcacttgggctaatccctttctgaagagcatctggcttctgtgcaagtgatgagattcttgcaaatacctcttcatcactatgtgttttggtctggatcaccttcactccactatcaaatttcctgagcatgactgggacatcaactttctcccacagggaacaagcttgcaaaaggtcctctggtgagatcaactctgttcccctagcacggttgaagagacaataaacatcgactagtgccatcataccacctgctttctcaagtggtattcttacaaagtccgccagctgtagtgacaactgctgatgatacaacgcaccagcagtttcttttgtcacaggagacacaatgccaacactcaacagcaaatcctgcatgtcttgcttagaacccatctcttcatcattggaatttgattcagtggatgagttcattaatagcttgagcctcattttttctgctaactgcatcatttccttagctttgctcatgagggcattgagatcctggaacgcatcttgcaagttctgcccggcgttctcccatgactcctgctccatccgcagtatccccgagaccccaacaaccggcatccgtatcgcgatgtcctccgtaggcgcggccccctctgccaccgacgtgccactcgacggagcagctgcaggggtcacctcccaagcccttgcacggatcgcctcgagcagcctcccgaagaacacatcaacgtcagccttgcaggtcacgacgatggcgatgacctctgatcgcacgggtggcatggagatctggaggcggatgcggtgatgctgagacgaggaagatgaggacgaggcggagaagagggagcggagggggttgtggctgtgcctgcggtggggagggtacgcatggacgacggtggcgagcggcaggccgcgcgcggagcgggagggctcgtggaggaagatgaggcggtgggaagtcagcgcgaggaggcaggcgcggaggggagcaaggcgcggattttcctcgggctcgaggtcgacgagcgggaggagattccgctccacctcgcccgcggaaagcaccgggcggccggatgccgtcacggacgctgacggaagccagtcggctgcggcggcggacattggcgacggtgctgtggtgtgtacgggttttcccgtgctgaagcgttgtttgagatttttttt

SEQ ID NO: 12542 - DNA, 2637 bp, Zea mays
ctcaaatggtggttcagatccttttattttttgtgagttgagtattgccacactatcaagagggatgtttcaccaagatcgaggcatgcaaaatggtgcttcagataaacccaagagtaagagagagtaagtaaaactccactcaaaattttagccccaaccacaaacccgaccagaccaacttctgggccaacggctagtcggtttgaatacccggctaggtcggatttgtcaactcaaactcaaacaactagttttggcgtgatggctataaatacctcttccactcaccatttcatgttgttgatcctccccactcttatcaacgaccagaatagtccttgggcattcctctccctctctttgtgagtgtttgaatagagaaagcttaaaccttgattagggggtgtcccaaacttcgtgagcttgcctttgtggcaatacagagcttgggaagctttgagagttatcccatcctcgagaacttgagcaagtcgaagatctttggttcgttgctatctttctcttggaactttgttcttaggtgggaaaatgtcaccagcaggacccgagggtgtgtaggctgtttgcgttggtcttgtaagaaaggctagtcttcccactgaaagtggaaagaagacttcttagtggattggtggaaagaggttatttcaagtctgaccaagagtagaccttgatgggtccctcactgacttccacaatggagacgtagggcgccttgtggagttgtggtggcccgttctctagtcaaacaaatccttgcgtctcctgattggtttgcctcgtgcttattcatactgcatatgtatttgtatttccgcttgtgttctcgggtgtggttgtttgtgcttgtaggaagtgtgtgacagagttcatacacatacaatcaaaccctaagtagcaggcttgccaaacagggccataactgttaaatacaagctattttttctgtatatataattagtgcattattcatatggtgtgaacctcaaactaaatatttgatttatgtacacatcttcactgacaagatgggaccaaatctcctgaataaattctagtaatagtaaattgctaaatggttgaggaatctagctgacatacaaaaatgaactgtaagctgtaattattaaccactagaagttgtgattcccactagatggaggagaaaggtatatatcctgaaaatatattgctgtgcttctggaaatatattattgtgcttgcgccatacggcaatgaggcactgaactaaatattgacctaatccacacaaacttcttaaaaaaattgagcattatcaaagccaatttatagtccaaaacaagctacataaaaaacaattgcatgttacctgtagtgacaactgctgatgatacaacgcaccagcagtttctttcgtcacaggagacacaatgccaacactcaacagcaaatcctgcatgtcttgcttagaacccatctcttcatcattggaatttgattcagtggatgagttcattaatagcttgagcctcattttttctgctaactgcatcatttccttagctttgctctggagcataaaaaataacaataattgagttcaaattagaccatggtgatcaatctcagatgatagctccgcagcgctgcccatgagggcattgagatcctggaccgcatcttgcaagttctgcccggcgttctcccatgactcctgctccatccgcagtatccccgagaccccaacaaccggcatccgtatcgcgatgtcctccgtaggcgcggccccctctgccaccgacgtgccactcgacggagcagctgcaggggtcacctcccaagcccttgcacggatcgcctcgagcagcctcccgaagaacacatcaacgtcagccttgcaggtcacgacgatggcgatgacctctgatcgcacgggtggcatggagatctggaggcggatgcggtgatgctgagacgaggaagatgaggacggggcggagaagagggagcggagggggttgtggctgtgcctgcggtggggagggtacgcatggacgacggtggcgagcggcaggccgcgcgcggagcgggagggctcgtggaggaagatgaggcggtgggaagtcagcgcgaggaggcaggcgcggaggggagcaaggcgcggattttcctcgggctcgaggtcgacgagcgggaggagattccgctccacctcgcccgcggaaagcaccgggcggccggatgccgtcacggacgctgacggaagccagtcggctgcggcggcggacattggcgacggtgctgtggtgtgtacgggttttcccgtgctgaagagttgtttgagattttttgtggggcctgcgaggggtgaaaaacgaaaacgttaattttcggtgacggggatcttttcgaaattttaccaacttttagagctaaacggaacgaaaacaaaatctgtagaaacaatcgggaatagaaataatttgagtcccttccgaccgttttttaaaaaaatgcaagtacttatgtgcaaaatccatgcaaaccgactaacaaaagtcaaaaaaatctaaataatagagatgtacttctttgcccattctatcactgtataaatttttaagtttaaat

SEQ ID NO: 12543 - DNA, 1467 bp, Zea mays
gcaggcataaaatgaaatgaatcacttgtatctgtttccactgatgcaggtttgcgcggaacagatggagaggttcacagggaggctgctggaacagcatcgctgagcgatgaacggttcgacgaccccgtgtctgcggcagaagaggcagcgttctgcaaagcctgcgcgaggttcggtttcggcctttacctgtaccatgaagacgagacaccatagaagaccaacaatttctccacatcgtctatgccggccctgttctgttcagatttgcgcttgaggggctgtgctctactgttgttgatcagtaagtctatcagatacccatcccattgctgctaggtccttgagctgttgtaacgctggtactatgttgtttgctcgttttggtagctttgtcttgcaaaaaaatgttgtcagctacaattggtatggattatggaactattagtatatatgcaatacttttttgttgcttacctctaatatacacatctcacactgttcaagtttatagaaaaaatcacgtagcatcgaatttgtttcaatgaatccgccatgaaatatttcttattttgtattctggactagatgctgacatattttttttttctaaaatcttagaagttactgaaaatggtttgacacaagctctgtctctttttaagcggaccggcgaaccagtttgtaagttgtaactgtagaccctcagggttcctttggagcacatgattctcaaaacgcaagaatagaaaaacataagattagaatgctcatactattaaaatgctacagaaatttataacatagaaaagtcataaaatatcaacatgtgtttagatcattttagatcatgcacgagaaaaacatagaaatacaagacacaaaggaaagaaaacacgagcaaaacatacacatgattaaaatgcacatatcattgaaatcctataagaatttataacgtaggagagtcataaaatatgtgtttgtataatgagcatgaaaaatcttataattcaagacagaggaaagaaaacatgaggttggatctcatgcttatttttcctttaaaattgctatggaagatgtcattttataggaatttttaaggaattgataggatgtcaattacggtctcctttagaatgcgggattttccccgtttcctatgggcttctatgaaaatgaactaattcttataaaattcttgtataattatctgaaattactgcattgcaaaaaggccagaattgaatcctctaaaaaaccttttcccctgtattcgcgctggctacagttgagtggggggccgtgcggcgctgttcaaatgtcggatcggttcgggtcaggttaaggtcagtcgtatgtcgtttggcacgacccgtgtctgaccgtgtatagtgtcgggttggcccgtcagtcgaatgtgttgggtccaggtttttatgtgtttttttactttgggtc

SEQ ID NO: 12544 - DNA, 1014 bp, Zea mays
  misc_feature (26)..(36): n is a, c, g, or t
tgggaccctcgaggccggccgggaannnnnnnnnnnaaaaaaaaaaaaaaaaaaaaatcagcaagaacacgtctgcctctcaccaaccgcggcttgccaaccttctaattagcctttgacccacccccccgccgcccgccgccgcagaccatggaacacgcgtccgccttcctcgcgcgcgcgctcaccactccgctcccggcacccgccgccctcccgcgccgccgcccggctcgcgtggccgtcgccgccgcggcgccggagcgcaggccgccgggcgcggtggcgtccaccaccaactacgtcgtgccgctcgacgcggcgccgtccgggatcacgcgcccgctcgtcgagatcctccgcgacctcaacaagcgcgtcccggacgccatcgtgcggccctcctcccggcgcgcctccgcctccgaccccgtcatcccctggtaccatgccaataggatgctcagcttttatgctccaggttggtgtggggaagttcgtgatgttatttacactgacagtggaaaggtgacggtcatataccgcgtgactgtgcgcggaacagatggagaggttcacagggaggctgctggaacagcatcgctgagcgatgaacggttcgacgaccccgtgtctgcggcagaagaggcagcgttctgcaaagcctgcgcgaggttcggtttcggcctttacctgtaccatgaagacgagacaccatagaagaccaacaatttctccacatcgtctatgccggccctgttctgttcagatttgcgcttgaggggctgtgctctactgttgttgatcagtaagtctatcagatacccatcccattgctgctaggtccttgagctgttgtaacgctggtactatgttgtttgctcgttttggtagctttgtcttgcaaaaaaatgttgtcagctacaattggtatggattatggaactattagtatatatgcaatacttttttgttgcttacctcaaaaaaaaaaaaaaaaaaaaattcaagttt

SEQ ID NO: 12545 - DNA, 981 bp, Zea mays
ctgcagtgcatgctgagtgagacagagatgcgacgacgagacgatgctgctgcgaacctactattccggccattcgccatcctctcatttaattcgaacagaaacatttttattgatcagcaagaacacgtctgcctctcaccaaccgcggcttgccaaccttctaattagcctttgacccacccccccgccggccgccgctgcagaccatggagcacgcgtccgccttcctcgcgcgcgcgctcaccactccgcttccggcatccgccgccctcccgcggcgccgcccggctcgcgtggccgtcgccgccgcggcgccggagcgcaggccgccgggcgcggtggcgtccaccaccaactacgtcgtgccgctcgacgcggcgccgtccgggatcacgcgcccgctcgtcgagatcctccgcgacctcaacaagcgcgtcccggacgccatcgtgcggccctcctcccggcgcgcctccgcctccgaccccgtcatcccctggtaccatgccaataggatgctcagcttttatgctccaggttcacagggaggctgctggaacagcatcgctgagcgatgaacggttcgacgaccccgtgtctgcggcagaagaggcagcgttctgcaaagcctgcgcgaggttcggtttcggcctttacctgtaccatgaagacgagacaccatagaagaccaacaatttctccacatcgtctatgccggccctgttctgtttagatttgcgcttgaggggctgtgctctactgttgttgatcagtaagtctatcagatacccatcccattgctgctaggtccttgagctgttgtaacgctggtactatgttgtttgctcgttttggtagctttgtcttgcaaaaaaatgttgtcagctacaattggtatggattatggaactattagtatatatgcaatacttttttgttgcttacctctaagaaaaaaaaaaaaaaaaaaggccccta

SEQ ID NO: 12546 - DNA, 2059 bp, Zea mays
cctcgaggccggccgggccggggcttcgcagccagtggctcagcggctgcgcccgtgcctgtcacgtcttgtcctcaatctctctctctctctctctctctctctctctcaatcctcacctctccggctctctttctcctccccagtccccaacggtgaggcccccgccgcgcagcccatcgacgcattgccgctgcaagcgcggacaccgagggctagaagcggcggcggtgccagggttcggcgctcggtcggcaatggcgaggcggcttatgctggcgctccctgtgctcctcttcttattgctcgtcgggcaatgccacggcggcaagattggcgtctgctacggccgcaacgccgacgaccttccggcgccagacaaggtggcgcagctaatccagcagcagtccatcaagtacgtgcgcatctacgacaccaacatcgacgtcatcaaggcattcgccaacaccggcgtcgagctcatggtcggcgtccccaactccgacctcctcgccttcgcgcagtaccagtccaacgtcgacacatggctcaagaacagcatcctcccatactacccggacaccatgatcacctacatcaccgtcggcgccgaggtcaccgagagccccgccaacgtctccgccctcgtcgtgccagccatgcgcaatgtgcacaccgcgctcaagaaggccggcctgcacaagaagatcaccatctccagcacccactcgctcgggatactgtcccggtcgttcccgccgtctgctggggcgttcaacagcagctacgcctacttcttgaagcctatgctccagttccttgtggagaatcaggcaccgttcatggtggatttgtacccctactatgcgtaccagaactcgcggagcaatgtgtccctcaactacgcgctgttctcgccagagtcccaggatgtgattgacccaaacactggactggtttacactaacatgttcgacgcccaggtcgattccatcttctttgcgctcatggctctgaacttcaagactttgaagatcatgatcactgagtcagggtggccaaacaaaggggcggtcaaggagactggagccacaccagacaatgctcagacctacaataccaatttgatacgccatgttgttaatgacagcggcacaccggcgaaaccaggggaagagattgatgtctacatattttcattgttcaatgagaacaggaaacctggcatcgagtcggagaggaactggggactgttttttcctgataagagctctatctacagccttgattggacgggccgaggcaatgtggatgttatgactggagcaaacattacaagtgctaatggtacctggtgtattgcttcaactaatgcatcagaaactgatctgcagaatgccctcaactgggcatgtggtccaggcaacgtagattgttctgccatacagccaagccaaccctgctaccagccggacactttaacttcccatgcttcatatgcattcaatagctactaccagcaaaatggagccaacgttgtggcctgtgactttggaggtgcggggatacgaacgacaaaagatccaagttatgacacttgcgtctatttggctgccggcaataagatgagcacgatgaactcaacatctcttccagctcgcagcgactctggtccagtcccacgcgtcaaatgcttcgccactttgctgcccatgctggccctcgtgatggctgcagttatgctgtgatctatggggaaaaaatgctccagctagcctccttaagacgtgagatgaaaggtgaattgcgtaatgctgctggtaaccatcgaagttctgttttttgccatgagcagtagactagtagtagtctagtagagaggcaccttatgctgtaggaattctctggtcggttaagatgtacatcgtcgcgcggacaatatatatcagctggcattaagaacttgatatcgtattatgctgtgtttcggctctcaaaaaaaaaaaaaaaaaaaaaaagaaaagcaccggcccagggcggcacgctcgcacacacaaaa

SEQ ID NO: 12547 - DNA, 1725 bp, Zea mays
acgcgcacgagaccattacctagaacatcctaatcgaaaaagccagtggctcagcggctgcgcccgtgcctgtcacgtcttgtcctcaatctctctctctctctctcaatcctcacctctccggctctctttctcctccccagtccccaacggtgaggcccccgccgcgcagcccatcgacgcattgccgctgcaagcgcggacaccgagggctagaagcggcggcggtgccagggttcggcgctcggtcggcaatggcgaggcggcttatgctggcgctccctgtgctcctcttcttattgctcgtcgggcaatgccacggcggcaagattggcgtctgctacggccgcaacgccgacgaccttccggcgccagacaaggtggcgcagctaatccagcagcagtccatcaagtacgtgcgcatctacgacaccaacatcgacgtcatcaaggcattcgccaacaccggcgtcgagctcatggtcggcgtccccaactccgacctcctcgccttcgcgcagtaccagtccaacgtcgacacatggctcaagaacagcatcctcccatactacccggacaccatgatcacctacatcaccgtcggcgccgaggtcaccgagagccccgccaacgtctccgccctcgtcgtgccagccatgcgcaatgtgcacaccgcgctcaagaaggccggcctgcacaagaagatcaccatctccagcacccactcgctcgggatactgtcccggtcgttcccgccgtctgctggggcgttcaacagcagctacgcctacttcttgaagcctatgctccagttccttgtggagaatcaggcaccgttcatggtggatttgtacccctactatgcgtaccagaactcacggagcaatgtgtccctcaactacgcgctgttctcgccagagtcccaggatgtgattgacccaaacactggactggtttacactaacatgttcgacgcccaggtcgattccatcttctttgcgctcatggctctgaacttcaagactttgaagatcatgatcactgagtcagggtggccaaacaaaggggcggtcaaggagactggagccacaccagacaatgctcagacctacaataccaatttgatacgccatgttgttaatgacagcggcacaccggcgaaaccaggggaagagattgatgtctacatattttcattgttcaatgagaacaggaaacctggcatcgagtcggagaggaactggggactgttttttcctgataagagctctatctacagccttgattggacgggccgaggcaatgtggatgttatgactggagcaaacattacaagtgctaatggtacctggtgtattgcttcaactaatgcatcagaaactgatctgcagaatgccctcaactgggcatgtggtccaggcaacgtagattgttctgccatacagccaagccaaccctgctaccagccggacactttaacttcccatgcttcatatgcattcaatagctactaccagcaaaatggagccaacgttgtggcctgtgactttggaggtgcggggatacgaacgacaaaagatccaagtaagagtcccatccttttttactgttatgataatcatgatgctatgcatggtttcatgataacatccatttgcatatattcaggttgtggattatgtctttagttgatgttggagttaaaaaacaaaaaaaaaaaaaaaa

SEQ ID NO: 12548 - DNA, 2759 bp, Zea mays
gccctgcagtggcccagagcagacccggatttcgctcttgcggtcgctggggttttagcattggctgatcagttcgatccgatccggctgcgaaggcgagatggcgttccgggtttctggggcggtgctcggtggggccgtaagggctccccgactcaccggcggcggggagggtagtctagtcttccggcacaccggcctcttcttaactcggggtgctcgagttggatgttcggggacgcacggggccatgcgcgcggcggccgcggccaggaaggcggtcatggttcctgagggcgagaatgatggcctcgcatcaagggctgactcggctcaattccagtcggatgaactggaggtaccagacatttctgaagagacaacgtgcggtgctggtgtggctgatgctcaagccttgaacagagttcgagtggtccccccaccaagcgatggacaaaaaatattccagattgaccccatgttgcaaggctataagtaccatcttgagtatcggtacagcctctatagaagaatccgttcagacattgatgaacatgaaggaggcttggaagccttctcccgtagttatgagaagtttggatttaatcgcagcgcggaaggtatcacatatcgagaatgggctcctggagcattttctgcagcattggtgggtgacttcaacaactgggatccaaatgcagatcgtatgagcaaaaatgagtttggtgtttgggaaatttttctgcctaacaatgcagatggtacatcacctattcctcatggatctcgtgtaaaggtgagaatggatactccatcagggataaaggattcaattccagcctggatcaagtactcagtgcaggccccaggagaaataccatatgatgggatttattatgatcctcctgaagaggtaaagtatgtgttcaggcatgcgcaacctaaacgaccaaaatcattgcggatatatgaaacacatgtcggaatgagtagcccggaaccgaagataaacacatatgtaaactttagggatgaagtcctcccaagaataaaaaaacttggatacaatgcagtgcaaataatggcaatccaagagcactcatattatggaagctttggataccatgtaactaatttttttgcgccaagtagtcgttttggtaccccagaagatttgaagtctttgattgatagagcacatgagcttggtttgctagttctcatggatgtggttcatagtcatgcgtcaagtaatactctggatgggttgaatggttttgatggtacagatacacattactttcacagtggtccacgtggccatcactggatgtgggattctcgcctatttaactatgggaactgggaagttttaagatttcttctctccaatgctagatggtggctcgaggaatataagtttgatggtttccgttttgatggtgtgacctccatgatgtacactcaccacggattacaagtaacatttacggggaacttcaatgagtattttggctttgccaccgatgtagatgcagtggtttacttgatgctggtaaatgatctaattcatggactttatcctgaggctgtaaccattggtgaagatgttagtggaatgcctacatttgcccttcctgttcacgatggtggggtaggttttgactatcggatgcatatggctgtggctgacaaatggattgaccttctcaagcaaagtgatgaaacttggaagatgggtgatattgtgcacacactgacaaataggaggtggttagagaagtgtgtaacttatgctgaaagtcatgatcaagcattagtcggcgacaagactattgcgttttggttgatggacaaggatatgtatgatttcatggccctcgatagaccttcaactcctaccattgatcgtgggatagcattacataagatgattagacttatcacaatgggtttaggaggagagggctatcttaatttcatgggaaatgagtttggacatcctgaatggatagattttccaagaggtccgcaaagacttccaagtggtaagtttattccagggaataacaacagttatgacaaatgtcgtcgaagatttgacctgggtgatgcagactatcttaggtatcatggtatgcaagagtttgatcaggcaatgcaacatcttgagcaaaaatatgaattcatgacatctgatcaccagtatatttcccggaaacatgaggaggataaggtgattgtgttcgaaaagggagatttggtatttgtgttcaacttccactgcaacaacagctattttgactaccgtattggttgtcgaaagcctggggtgtataaggtggtcttggactccgacgctggactatttggtggatttagcaggatccatcacgcagccgagcacttcaccgccgactgttcgcatgataataggccatattcattctcggtttatacaccaagcagaacatgtgtcgtctatgctccagtggagtgatagcggggtactcgttgctgcgcggcatgtgtggggctgtcgatgtgaggaaaaaccttcttccaaaaccggcagatgcatgcatgcatgctacaataaggttctgatactttaatcgatgctggaaagcccatgcatctcgctgcgttgtcctctctatatatttaagaccttcaaggtgtcaattaaacatagagttttcgtttttcgctttcctaaaaaaaaaaaaaaaaaaaaaacacccgccccccgctaccca

SEQ ID NO: 12549 - DNA, 2826 bp, Zea mays
ggacttgccgtcggtgctcttcaggaggaaggacgctttctctcgcaccgttctgagctgcgctggtgctcctggaaaggtactggtgcctggaggtggcagtgatgacttgctttcctccgcagagccggtcgtggacactcaacctgaagaactacagatacctgaagcagaactgactgtggagaagacatcctcctcaccaactcaaacaacatcagcagtggctgaagcaagctcaggagttgaggctgaggagaggcctgagctctcagaagtgattggagttggaggtactggtggaaccaaaattgatggtgcaggcatcaaagccaaagcaccactcgtggaggagaaaccacgagttatcccaccaccaggagatggccaacgaatatatgagattgacccaatgttggaagggtttcggggtcaccttgactaccgatacagtgaatataagagattacgtgcggctattgatcaacatgaaggtggtttggatgcattttcacgcggttacgaaaagcttggatttactcgcagcgctgaaggtatcacttacagagaatgggctcctggagcatactctgcagcattagtaggtgacttcaacaactggaacccaaatgctgatgctatggccagaaatgagtacggcgtttgggagattttcctgcctaacaatgctgatggttcccctgctattcctcatggctcacgtgtaaagatacggatggacacaccatctggtgttaaggattccattcctgcctggatcaagttttctgtgcaggctccaggtgaaataccatacaacggtatatattatgacccacctgaagaggagaaatatgtattcaaacaccctcaacctaagcggcccaagtcactgcggatatatgaatcacatgttggaatgagtagcccggaaccaaagataaatacatatgctaacttcagagatgaggtgcttccaagaattaaaaagcttggatacaatgcagtacagataatggcaatccaggaacactcttattatgcaagctttgggtaccatgttacgaatttttttgccccaagtagccgttttgggactccagaggacctaaaatctcttattgataaagcgcatgagcttggcttgctagtgcttatggatattgttcatagtcattcatcaaataataccttggatggtttgaatggtttcgatggcaccgatacacattacttccatggtggtccacgaggccatcattggatgtgggattctcgcctattcaattatgggagttgggaagttttgagatttctattgtcaaatgcgagatggtggcttgaagaatataaatttgatgggtttcgatttgatggggtgacctccatgatgtatactcaccatggattacaagtgacattcactgggaactatggcgagtattttggatttgccactgatgttgatgcagtagtttacctaatgctggtaaacgatcttattcgtgggctttatccagaagctgtatccattggcgaagatgtcagcggaatgcctacattttgtatccctgtccaagatggtggtgttggttttgattatcgtcttcatatggctgtcccagacaaatggattgaacttctgaagcaaagtgacgaatattgggaaatgggtgacatcgtgcacaccttaacaaatagaaggtggcttgaaaagtgtgtcacttattgtgaaagtcatgatcaagctcttgttggtgacaagacaattgcattctggttgatggataaggatatgtatgatttcatggctctggacaggccttcaacgcctcgcatcgatcgtgggatagcattacataaaatgattaggcttgtcacaatgggtttaggaggtgaaggctatctaaatttcatgggaaatgagtttgggcatcctgaatggatagattttccaagaggtcctcaaagtcttccaaatggctccgtcattcctgggaataacaatagctttgataaatgccgccgtagatttgaccttggagatgcagattatcttagatatcgtggtatgcaagagtttgaccaggcaatgcagcaccttgagggaaaatatgaattcatgacatctgatcactcatatgtatcacggaagcatgaggaggataaggtgatcatctttgagagaggagatttggtcttcgtgttcaacttccactggagcaatagctattttgactatcgcgttggttgtttcaagcctgggaagtacaagatcgttttagattctgacgatggccttttcggtggatttagtcggcttgatcatgatgctgagtacttcactgctgactggccgcatgacaacaggccgtgttctttctcggtctatgcacccagcagaacagccgtcgtatatgcacctgcaggtgcagaggacgaatagggcacaagcagcggttgttggggaagaacttcagagggatgtactgctggtggactgacaccactgccacgcgcgatgctgccagatgttgccctcgagaccacgtggcaggacgatcagctattcaggtggataggttagcttaccgatgagctctcgctttcgagtgactggtgaaggaaatggacctcgcacaccgcattttcactatgcaatctgaaaatgtaccgtgtggttttgtacatatggcatcagtaggcattatatcattcatctcgctgaaccaaccatttacgctatactccgtactgctgtgcaaatctctctctcaatataataattgccacaatgccaccctcggcgtgctgctgtgcttttcc

SEQ ID NO: 12550 - DNA, 1299 bp, Zea mays
gccggccgggtcggggctatatagcctgcccccccccattcgaaaagtagccctgcagtcacccagagcagacccggatttcgctcttgcggtcgctggggttttagcattggctgatcagttcgatccgatccggctgcgaaggcgagatggcgttcgcggtttctggggcggtgctcggtggggccgtaagggctccccgactcaccggcggcggggagggtagtctagtcttccggcacaccggcctcttcttaactcggcgtgctcgagttggatgttcggggacgcacggggccatgcgcgcggcggccgcggccaggaaggcggtcatggttcctgagggcgagaatgatggcctcgcatcaagggctgactcggctcaattccagtcggatgaactggaggtaccagacatttctgaagagacaacgtgcggtgctggtgtggctgatgctcaagccttgaacagagttcgagtggtccccccaccaagcgatggacaaaaaatattccagattgaccccatgttgcaaggctataagtaccatcttgagtatcggtacagcctctatagaagaatccgttcagacattgatgaacatgaaggaggcttggaagccttctcccgtagttatgagaagtttggatttaatcgcagcgcggaaggtatcacatatcgagaatgggctcctggagcattttctgcagcattggtgggtgacttcaacaactgggatccaaatgcagatcgtatgagcaaaaatgagtttggtgtttgggaaatttttctgcctaacaatgcagatggtacatcacctattcctcatggatctcgtgtaaaggtgagaatggatactccatcagggataaaggattcaattccagcctggatcaagtactcagtgcaggccccaggagaaataccatatgatgggatttattatgatcctcctgaagaggtaaagtatgtgttcaggcatgcgcaacctaaacgaccaaaatcattgcggatatatgaaacacatgtcggaatgagtagcccggtatgtcaccttttccttttgattctttagacagtgctaggcatatgtaacacccggccacctgggggacgtcgtccccccagggcgagttttttttgactgctagccacctgcagttttagttaattataggcttcaacgatatttagatactagcatcttctcacattggtcttccttatctaagcgtatgtaatctaagtgtatatatttattttcattcaatttaaaaaaaccaaaaaaaaaaaaaaaa

SEQ ID NO: 12551 - DNA, 1394 bp, Zea mays
gcatgtcaagaagcccaaggtcagatgggacaaaaaaaaaatcgcgccgagtaccagagcgacgctacgcggcgtgacttctcccgaaacctccacatacccaaacccaccgaccgccgcctaggcttccacctctcccgctcaaactccggccactgaggtcgaacccgagcccgcgccgcagcggcacgatggtgaacgacgccgcggcgatggccgtcgtgagggcggcgcgcccagccctccgtggcgcccacgatggcgtcgccttcgccgcccacgccgccttcctcgccgatgggtactcgctctgcgccgtcggccctgccgcgctcgccgacccctcgcccttaggtgatgaggaggtggggattgatggttggaacatcatggagaattgttacgcctttttgtatagcaaggaggagaagggcaagaagaaaagggtactagtgaaatgtctggtgatcggtgaagtacttgcaattgatgtcttggatcttgaggcacaagataaggcgccttataatatccagattaatgtgaaagacttctttgtcgaagagcagccaaagaattatggggatatgtacaagaattttacaagtctcattgagactgtgaactcaaatgtgttgtgcaaattggatggagacggttccggtgctgaggctgctaagagcactgccgccgctgctgctaagaactctgatgggagaagttcaccaatacagagctctggagatccaggtcctagaactgctgacccttccggcctaatttatcctccaatagcaccgattggttctgatgatctctaccctgggcctggtgcaggcttctaccctcacagtggcattgggagcggtggcagcatgcatgttggtcctaatgatccgcgcttctttccttctaatcccttctctgccccatttggtgggcttgggagtgttccaccaggtagtcgctatgatccaattggcccacctgacgtcccagggtttgagccatctagctttgttaggcgtccaaggcggcctccaggcgggagcacccaccccgacctcgagttcttccagcaaggcccagacttctgagagtcgcgcagaggccggccggagcctcgccctaccctcacgaaataacttcaaaatgctgagccctcgagctagatatctcgcttggtgtgattgcaactgctgtatcaagtatagtcctagtgcgctttggctgtaaagatggatgtgaacatcgtcctagtgtatttactcttaattccaaaccatcgcctgtcatagcctaatatactcttttgtgtataatatcgggtgtaccggagcccaaaaaaaaaattgtcgacaagtatcgtgaaagcatgttgcgaaaaaaaaaaa

SEQ ID NO: 12552 - DNA, 3321 bp, Zea mays
cctagtttcattttgcatgcctaaataataggagaggttgaagtttccttttgcatgccttaattataggagagattggagtttccttttgcatgccttaattataggagagattagggtttctttttgcatgccttaattacatgagagattggttgggccattggctatatatatgccctgtaatcagacttggagaggcaagcaagatcaattatcctaaagttgctcctctccctcaaaccctctcaagccgccggtgagagcttctcacggtgaaggtctcgagcgcgactacgaattacgtagccgcggtccggcgacattgatcgttgaggcgcttgacatataggcaaacaaatagggcctaagtcgatgttccaatcctgaatttctggaggagattagtgcatgtcactagctagccaaactcatgtagtcttacaggtgctgctagctagtagcgcagtgcatgtctgcaaagcttctagcactggttgtacccttgcacgtagtcatggaacaccgaatccactccaagaaccaacgctgccgttcgccgtctcatgacgatccactgctctgaagcagtggtctatgccgtctaccgccacctcgtcgccgatgtggcggccgctctccccgaagcactgaatctgccggagtaacatgtcgatctcgtcgtccatactactctcaaacgtcgcggaggcagagcttgctgttggcgtcgagctcgagctctcgacgcctactgccgtcatggtgtctctggtgctagtcgaaagcggcggtgtgcaggtgccgtccacgttttcttgcactctacctcctgcgtagccgaaactgtaactgcctggcatgtgagtccaccagagcccggcggagtaaccagcagtgggagtagcaccggccggtggctgctgccgcggcagcatctctgagctctcactcgccgccggcgaaggagaagacgagggagccaggctcggccacagcggcgcaccgaggctgtcgtagttgtacaaggtgaaggccgccggcggcgggttgtcgtcgaggcgagcctcgtggcgccggtgcagacgcatgctcacatgcagcctctcgagcgccgacgaggcgaaggagttgtgctgccaggttgggttggtgaggagctggaggcgcgcctctgccctcggccgccggccgccaccaccgagcaggcggcgcttgagcttggtgttccagtggttcttgacgtcgttgtccgtcctccccggcagctgcgcggcgatcgttgcccacctgccatcgaagacgaacggcacccagtcaataagccatatgatatgatcaatggctaatccgatccttcggcgagctgggctgctgagtgctgattattgatctactaactcgtttgagttgcagtggttgaaaaggggcttttgcgtgcgctgaatattagctcctgaactgtacgcgtatgctcacctgctcccgatgctgatgtagaggctgcagatcagcctgtcctcatcctccgtgaagccgccgtgcctgatgttgggccggaggtagttgagccaccgcagccggcagctcttgccgcacctgttcaaccctacaaatgagcaaaacgcagcgatgatcccgttcagcgttcatgcatgagagttcgccgcaggctgcatcagctagtgctatgcagatgatgacacagctaactactgctcctaccgattttgtgggggagctgtatccagttgccgccggcgccgtgctcgtcgatgtggcccttgagcacggcgtcctcctccggggcccacggccccttcttcaccgtcgccttgtcgcagcacagcgccctgcccatctccgtctctattggccgctcgtgtcacgcggcgcggcggtgaggtcggtcggcagctctctctctctctctgtctctaccgtgtggcttggatggcgttagggcggcggcgcagcaggcacgctctctctagtctctatggactaagaccaactccagcagtgtgcgactccgtatccctaaaacgcgcggccgacacattctctctcctctccgtatccggctccgtttccagcaacactccccatcccactccgcatgcagtctatgacacctgggtcccgccagcaggcgcgcgcgcacgcagagagttgcggagaggagagagaaagtgtggaaatggggagcgcagggacacggcgtccattttgcggagagggatgcggagtctgctggagcgcgcaacagtgcctcagaccgcgcaaaatggggatgcggagtcggatacggagtcttgctagagttggtctaagagtctaactctaggaggcgtgtctgacaggctgagccttgtggccagggggtggctggatgatgttttatttatataaggggcgtttggttcgcacgaagaataagagtatctctaatagttatagttatgtaaatttattatgttaaattatagatttaaaaagttgctaaatcactttaagaagtaaaaaaatgtgtatggttctctatttattggtggctaatttttaaaattgtccacgtcaccaaaaaagtgaccatgttttctatttttaattgagctagcacatcagcacccttccataacgtcttggaaggtcgaagttatcgatggaagaccagaagtttgtagcgatgatataaagacagcacggggcattggagatagatttgtggtcaacaggatggtgggacgacgcaaaacggtggccggaatatggtttccagatggatttagaaccaacattgatttagggagtcccaacaaggttggtaaatgtaggaatgaaattgagttttgtagtgagtttgtaaatttgaggacatattttacataactgttgaagaagagttttcaccaaaaatttcttaaattcatatttagtgagttgtttgcataactattgaagatgctctaagaattcggcttatagaatgtaattgtgaaccaaacgtcacaaaattttcatctcgcataacacgccataaagagagtattcacggttagggcaacccatttaatatgggtttttagagtctctaaggagctaagtaaaaaaatataagaaattagctctttgtgaagagtctgtatagtaccttctatacatattgtctctagctgcattgatgatctagagtttcagggatatactatataatctcttagtcgtctcttatacttgaaaaatcgaattagtgtctcgattgtttcaaccacattttcttgggttatgtgcgcgggtgagattcttaaaatgcacggc

SEQ ID NO: 12553 - DNA, 872 bp, Zea mays
tttttttttttttttttgtcaacctcctccggttaatttaacttgcgcccattcattaataacatcaggttggtggttagtccatcgtcctgctaatcgcgatcagttcgcggttggtccgcccccatccggcaccagcgccgcctgaaagccaagcatatatacggacacgggcacgggcacgcacgtcacgtggcaaggaaacaaccaggtacggacggacggacgggcgactactagccgtcgccaagccgtgccatggcaagcaggccggcgcgccggcgcggcagcaggtgggagcggcacagcgggcacgtcacctcgcccaggtcgatccagcggtcgatgcagcgcgcgtggaacgcgtgggcgcagttgcccagccgccgcaccccgtccgccgcctccagcctctccaggcacacccggcacgtcggagccgcctccgcccccgacggcgacgacggagccaccaccatcagctccaggaactcgacgagcgggaggtgccgcttcaccgcctccggcccaggggcgtcccgcccgccgcgggcccgcccgttgatcaccggcgcgtggtcctcggggtcgtaggggaactcgtagaggcccaggaagcagaggaccagcacgaccaccagcgccgcggcgtggatggtcttgaacagcgcggccacggggcgcggcaccgcgttgcagtagcaaaccagcgggaaggtcatgacggccggcgcaggaggacggacgaaagagacgctaactgcggctagctagctgctagcttgctaccgcgaaggtcggcaggaggccgccgccgtgcgctccggagggcaccgcacaatgacgcgggctccgtccgtgtggatatatag

SEQ ID NO: 12554 - DNA, 1380 bp, Zea mays
ttgggtacctcgaggccggccggacgtcattcgctcaccactcccaccgccaccggcctcaagccaacaccaccagtccacacatgcgcaggcgcacacgcacggccgttgagacttgagacagagacgcaggagcgcggaggaaaaggaggcccagaccaccgacggggaaaaaacatcacgaacaccgttctccatagcgggagtagtgaggaacgaaagagagggggcggcctagggcttcgattccgcagccatggacgccgctgacgtgtggggccgctcatcgtcctcgtcttcttcgtccgccgccgccgcgaggcgcctgcaggcgcgctacgatctgtacatggggatcgacgacgcggacgccggcttggacgaggtgacggagccgcgcggcggggcggagtcctacaactgccccttctgcggcgaggacttcgactttgtcggcctctgctgtcacatcgacgacgagcatgccgttgaggctaagagcggggcatgccccatctgtgctacaagggtcggaatggacttgataggacatttgactatgcaacatggaagttatttcaagatgcaacgcaggcgcagagtccgaaaagtatcttctgggtcccattctttattatctttgttgagaaaggacttgagaaatggcagtttgcagtcatttctcggtggatcatcctatgtatccaatcctcctgctgcagcaccagatccatttgtgtcatctttaatttgtactttgcctgtggctgaaccatccaaagatttacattccgactcatctgacaataactttttgctaaataaattcccagatgaaaagcctgtagagagggctgaaccatcattgtcggagaaagatcagaaggaaagggttcaaaggagcaaattcgtccgagggcttgtgctctcgacaatatttgatgatgataacttgtaaagggggtcatcaaacttgataacagcatcacaatagttaaggaacacgaagagaatcatcagactctgctgctgttgtcgtgatcacacaagaggcccatctaagttcgtatatgtacggatggaatatttatgcatgtatgtatttatgtttatctccctgcatttacccttagtgcaacagggtggtaggggacggttgtagtattccaaatttatgtatcaaataaatgaggacactgtccttggggtgcaattgtgtatataatataataatagggagctactcgccatgatttaggatattttatttaactgttgtaataatatgcagtgttttgtatgatgaccccatttttttatatataactgttcattttaaaaaaaaaaaaaaaaaaaccatattaaaaaaaaaaaaaataa

SEQ ID NO: 12555 - DNA, 1552 bp, Zea mays
ccggccgggatggaaacacgcttcccatgtcacttgggccacccagaccccagtaacattgggtccctcgaggccgcccggcaccctcgcttccttttccttctctatccgcgagcctcgtaccggcgcagccatggcggaggagcccgccgttgtcgtggcctcctccagctacgaggttgacctcgggaacctcatggcgtacgatccgtcgcatcacgtcgccaccgcctccagggaggagctgagacaggagtgcctgcggaagggtacagagctggcgcaggcggtggccgacgtcctcttcgcgctgccgcccaacgaggaccgcgacggccccattatccacctcccgccgcccaccttcagactcccgcgggagaagcatctacccaagcccaagccaccgaccaagtgggagctgtttgcaaaggcgaaaggaattaccaagcgcaaaaagaacaagcgtgagtgggatgagcaaactcaatcctggaagcggactcatggctatgaccgtgttaatgatgacaaagacattccaatcattgaagccaaattgactgatgagcctggtgttgatccatttgcgcaaagaagggatgagaagaagaagagggttgaaaagcaagaaaaaaacagactggataacttaaagaaagctgcaaaggttggcgctttgccaagtcatatacagcttgctgcgaaggcgttgcccatcacaggaacaaaagctgaccttccaaaaaaatctagaaaagaggatcttgagagtgttgtcggcatggcttcatcagcaacagcaagtggtgggaagtttgatgagaagttgcctggcgagaaacctccaaagcaccctggcaaacacagaaagttcctcccagttgccgaagggaagggaatgggcagcctggagaaacagcagaatgacaaaatcctgaactctctacttgccagaaactctgatgaaccacttgatgtcggcaaggcaattacaatgtacaaggtgaaaaaggagaagcagagaaggaaagagaaaggcatgtcatcgaaatctgataagcttaagccccagaagaaaccccacaagaagtcatcgaagaaaaaggcttaggtccacatctttcaggtgaccacagttttgaaagctcaagcaaggaggcctgtcagcatattcaattgtatttttctgctttgaatctatgagagaaatattgttattccgtttactggctatgacacaaaaacctgaatgctgttataatatatgcccatcttgtaccttttcaaaaaaaaaaaaaaaaaaaagaaaaaaaaaaaaaataaaaaaaaaatacaagcccgccagctcgtgatctagaaaaaaagggggaaaaaaaaaaaaaaaaaaaaaaaaaaaaaaaaaaaaaaaaaaaaaaaaaaaaaggggggggcgtttttaaaaaaaaaataattaaaccccctttaaacaaaataaaaaatttttaaaaacgggcccaaaaaaaaaaaaatcggcccggttaataaaacctttggacagggaaaaaccctg

SEQ ID NO: 12556 - DNA, 2890 bp, Zea mays
actatattgtttataaggtaaagtttaaataagaaggtgtgatgagagataaataggtaagctgctacgaaacagcccatgggcgtaggttcattctaggaagtacagcgatgcacacaattgcgttggtaatgagacagaactgcacaagatccaagagtaagagagcttgatgtaagcaatgcacctcggtagcttgggtggcgcctaaatcctctcggcattcaaacacatcgaatggttgtgcctgttagataaggttgtgtctaacaaatcatgcatatgattgtgtaaaacaatgttttacaccatatataacactgtttatatagtaaagtttaaaataggagacgagatgaaagatatgtgccggagatggcccaagtagttgcctggcttttgatacagtgactttgacctttttttctttgtttgctgtacaacaatacacttgtgtttggaagcaaaatattttaaaagcatggttttggaatactacagatttaagatgccatgacacaaccatagtattttttatgttacccttagcaatacttgtttggagacaaaatattgcaaatcaaggtttagtatatatatgcaagggtagttatggtcaaaaacttttgattggggtggagtttcaaatacttcaaaaatatcatgtgtctacaaaatcatagtattcaaaacagatttttttacacctcttgataaaacataccatggtatcctccaatgccacagttttacctcaaaattctaaaaatattttgtttccaaacacccttcaaccttttttttggctgtgaaagcctgcttgcttttattttatgtgctgctggtgaatgggcatcaaagcaaaaacaatcaaattggttacaagtaagaatgatctcgaaccacgtcctagggattcctagcactctctgtgtaaccgatccatccttgcaaaatgacattacaaactaaaggcacacaagaaaaatgaaactaacaggcttttcttccgcaatcgaccaaagggcctcagctgcattgggggctgttggcaaatgtgtcgatggggaacgatttcgacatagggccggcggagaaacggagctggtcgccgtcgcggtcgacctgcttgacgccgacccacgagaacagcaccttcaccttcactccctccagggatgtgatggacagcggctgaatgtggccggcgacgcggctgctgtactggacccgcatgctgccggcgcggaagctgcagtccgccgggaggtacacctcgaaggagccgtcggcgttgaggacgtaccccgtcacgccctgcggcaggatgccctgcgtgaagttgtaccgctccagcatctggtacgcggtcggctgcggcggtgccggtggtgtgggtgccggcggcgagtcgtcggcaacagaggccacggtgagagtggcgacgaaaagaagggtcacgaggaggtggagatgcaaagtggcggccatgattggtggcttggtggtcagtggtgctggtacttggtttctgatgtcttttttcgatatagccgtcctgtactcctgtatatagtggttgctcctttggcccgctcttcgcggtcaatccttcgcgttgtgatttgtttcgggtcgatctgaaatccggtgataatactaaccataatgtgtattttatttaacatagttcttagatattaattatttatatggacaatgcctataactaatatactatacttatttagtactaggtaagtgctcgtacgttgcaacagaaacatataatactataatagttatgagaaaatagttcttttaaaagagcaacttcgagatccacacatttagttgctttcccaatttttagcagcaaaattacttttcagcaaataaaccaaacacaaccttggttacctgtcttgtgtagttttagtcatggtcgtttcggatctagctaaattattgaagcatcaaattttattggccacttcatatgcatatcaatcgctcaattattcggacccgcacatcacacgaaagtttggaagctctatttatattttctttcagtataaccaaaatgagcaagaagaatgatattgatctaaatccaacgtagtcgaacattgggagcatatgagcaagacaggcatgataaccaacgtcttataacttttgactatctagtgtacaatgtacagtttgaaatacgtgaaaatatacttcctccacctcaaagtagtgttgctctaaattttttcaagcacgttcttgcgcagcttgaacgccctacattatgtcatcagaataagagttatgactgaatatagtagtcacagtgctaagaaaacatttacctgttgaatcctgttgggatcaatggaactcgttatctaaaattgagaataatttaattcctacataaaattttaagttgtataaaattagaatatcacatattttattatataataacacctaacaccaaaagaagaaaaataaagggcaagggcaaatttccaacttgcaactaagaagatggtaaactaagacaactcaatacatataactgatatatccatctgagagaactgtagagataagttcaagctggatttaaaggcagataagttagaattcatagaaaaaaaatctaaaattcatctaattagcatcttatcaattttcccatatattcgaagacttcccaatccatttgtttgtatgatgcatcattctgcaaaagaggaaagaaaaaacttagtactcaagctgcagataaccacaacatcttagcaactaaaaagaatgataatgcaccaaaaacactccatgttaggtatgagtgcgtgtcatattttttccaataaactatgccgcaaaa

SEQ ID NO: 12557 - DNA, 1486 bp, Zea mays
gcacgactcccgtaattcctttctccagtcgcagcctcgatttctttccctttccctttcccttccccagtcagccgcgagcctcgtaccggcgcagccatggcggaggagcccgccatcgtcgtcgccgcctcctccagctgcgaggtcgacctcggcaacctcatggcgtacgacccgtgtcaccacgtcgcagccgccgcctccgcctccagggaggagctgaggcaggagtgcctgcggaaggggacggagctggcgcaggcggtggccgacgccctcttcgcgctgccgcccaccgaggaccgcgacggccccatcgtccacctcccgccacacaccgttcgactcccgcgcgagaagcatctacccaagcccaagccaccgaccaagtgggagctgtttgcaaaggcgaaaggaattaccaagcgcaagaagaacaagcgtgagtgggacgagcaaactcaatcctggaagcggacttatggctatgaccgtgtaaatgatgataaagacgttccgattcttgaagccaaactgactgacgagcctggtgttgatccctttgcacagagaagggatgagaagaagaagagggttgaaaagcaagaaaaaagcagattagagaatttaaagaaagctgcaaaggttggtgctttgccaagtcatatacagcttgctgcgaaggccttgcccatcacaggaactaaagctgaccttccaaaaaaatctagaaaagaggatcttgagagtgttgttggcatggcttcgtcagcaacagcaagcggtgggaagtttgacgagaagttgcctggcgagaaacctccaaagcaccctggcaaacatagaaagttcctcccagttgctgaggggaagggaatgggcagcctggagaaacagcagaatgacaaaatcctgagctctctacttgccagaaactctgatgaaccgcttgatgtcagcaaggcaattacaatgtacaaggtgaaaaaggaaaagcagagaaggaaagagaaaaatatgccatcaaaatctgataagcttaagccccagaagaaaccccacaagaaatcatcgaagaaaagggcttaggtccacgtctttcagttgaccacagttttgaaagctgaagcaaggaggcctgtcacatattggattgtatttgtgagctttgaatctctgggagaaatattgttattccgtctaatggttatgatacaaaaacctgaatgctttgccatggtatgcgcccatcttgtacttttcaaattatgtttgggatgtggtttgtagcttggtaagagtccctccctttggttctgaaacctgttcaaaggagctgtcctggaaacagtaccaatgaagctactgtctagtgtcgatggtactgatctgttgttggcctctgagtttactctacgatgtggtgtgagattatacattttaaatctttcctcccaaaaaatggccaaaaacaaaccccccc

SEQ ID NO: 12558 - DNA, 2746 bp, Zea mays
agtgatgagtaggagcagtcgcacaaataggttgggcatacagttttcaaaactttagtttgtttttgaaaaacttcggtttttcaaacattagaaccaatcggttttccagaaaatgaaaaaccgagaagttcaatttgggctttttactttggtttttgggtaaaaacaaacttatactcaataatgttacaagacaacacatacaacaagtttacatgacaattttaaaaagtaaaaagtatataggcataaggatttaagatacatcatacatgaaatacaaataagtgaataacaatttaattgcatttaattgcatcacacatttagttcacataattaaagagtcaaattttggaattgataaagtctggtattctgtttttggtatttcagttcggtacatggcgaaaaccgattacgataccgaactccaaacattttagatgtaaaaaccgaaaccgaatcgaactaaaaaaaccaaaatttcggttttgtttttggtttatggtaaaaaagtttccacccctacgcactgaaggggtcagggcaagaccatgagagagatcgtgcacgagcaatatgagcgagaagatgacacgaggtgtcatagttgggcactatagatcattgtgtcgatgtgttgtcacgttaattttatattaccaaagcattatgatctatgacacgagcaaccttatcattatagatcataacaccgatctttaaaaccgcatagtgatttatccatgattttatagaaaaatactaaggattaatttaaaaacttaaatcccgtggattttttagggattgaagtaaaattttttaaaaaaatctcatcaatctccgagaattccgtagcagacttaaaaaaaatccggacataccagtccggcggcggtgcactgtactgtgcggcgtagagcctgcgtggtccgtggcaggacgtggtagacccacagtgcgcactctttctcacgtttatgggaacggacggctgaaacgatagcactatggacaggagcgtgcaattgggccccatgcccccatgcgccccaagataacaatgccaccgcagggcacatccatttcggtcagcacgtcgatcggcttcagtactggccagcagcgcagcctactgagtgccaataggcatgctttttttgtctgtgctcaagcttgcaagttagtgtaatagcccccctacaaaaaaattaaaattaaagtaaacattaaaattaaagtaaacattcacacaaaaaagtgaccatatgactcagatactagatattagactgtaaatattgtactttatattataaaagactaagaaaaacatgagttgaaaagaagatctgtctcttgtgttatagctcgcttgatcgtgttccttcagctagtgagctggtattatcatacagcgctatggtgcgtgcagctttgtgacttgtccccacgtcacttgacgatgacgatgtgtataggagtggagaaaagatttttcgtttgtactaccattcacttttctttttgtaatgtatgatcggtgattcggcgtggttttaggtaatacttaaagcaaataatacatcatgccgagatgggatctcctgttgctaaccaagacaagacaaagttccacgtccctccgtgtcgttaccgtgcgttgtcttgtctttctcactctcccactcagggtcactcgctcaactcgccggccggcagcacagccacgcacaggggtcaggtcagtcgcctacgaaattcaatagcacagcgagagccaaggaagaagaagaagcaagcggagcgccatggcggcgtccaacggcgagggccacggccggttcgacgtgatcgtggtgggcgcgggcatcatgggcagctgcgccgcctacgcggcgtcctctcgtggcgcgcgcgtgctgctcctggagcggttcgacctgctccaccaccggggctcctcgcacggcgagtcgcgcaccatccgcgccacctacccgcaggcgcactacccgcccatggtgcgcctgtcccggcgcctctgggacgaggcccaggccgacgccgggtacaccgtgctcacgcccaccccgcacctcgacctgggcccgcgggacgactcggcgctcgtcgcctccatgaggaacggcggtgccaccgaagtcgtcgccggggatgagtcgtcgtcctggccgtgggcaggcgtgttcagggtccccgacgggtggacggcggcgcggagcgagctgggcggggtcatgaaggccaccaaggccgtggccatgttccaggcgctcgccgtcaagagaggcgccgtcctcagggacaggactgaggtggtggacatcacctcctccaagcgaggtgaaggtgagcgctccttctccccggcgcggccctcccgccttcctgcaccgtacccgaactaattctcttggaagcgtgcgccctctccgccctcttgcatctgcatctgcatctgcatgtgaccgtgacgctctgatgagtcactgggaagcatgtaacgtaatcaactgtgtgagagccatctgacttgctaatgctgtcatggactcatggtctagggatggctatctggcaacaacttggctctctctgttttttttttttacaatttttctgaaaactaaacaataccactaacaaaagttgtagctagaatatatgagtcgttgttattaatagcaacacatcacaaaaaaaaaagcgtagc

SEQ ID NO: 12559 - DNA, 1958 bp, Zea mays
ctagtgagctggtattatcatacagcgctatggtgcgtgcagctttgtgacttgtccccacgtcacttgacgatgacgatgtgtataggagtggagaaaagatttttcgtttgtactaccattcacttttctttttgtaatgtatgatcggtgattcggcgtggttttaggtaatacttaaagcaaataatacatcatgccgagatgggatctcctgttgctaaccaagacaagacaaagttccacgtccctccgtgtcgttaccgtgcgttgtcttgtctttctcactctcccgcacgagaccattacctagaacatcccaatcggaacacagccacgcacaggggtcaggtcagtcgcctacgaaattcaatagcacagcgagagccaaggaagaagaagaagcaagcggagcgccatggcggcgtccaacggcgagggccacggccggttcgacgtgatcgtggtgggcgcgggcatcatgggcagctgcgccgcctacgcggcgtcctctcgtggcgcgcgcgtgctgctcctggagcggttcgacctgctccaccaccggggctcctcgcacggcgagtcgcgcaccatccgcgccacctacccgcaggcgcactacccgcccatggtgcgcctgtcccggcgcctctgggacgaggcccaggccgacgccgggtacaccgtgctcacgcccaccccgcacctcgacctgggcccgcgggacgactcggcgctcgtcgcctccatgaggaacggcggtgccaccgaagtcgtcgccggggatgagtcgtcgtcctggccgtgggcaggcgtgttcagggtccccgacgggtggacggcggcgcggagcgagctgggcggggtcatgaaggccaccaaggccgtggccatgttccaggcgctcgccgtcaagagaggcgccgtcctcaaggacaggactgaggtggtggacatcacctcctccaagcgaggtgaaggagaggggtcaatcatctcggtgaggacgtccagcggcgaggagttccacggcacgaaatgcatagtgacagtgggcgcatggacgagcaagctgatcaagtcggtgaccggcctggagctgccggtgcagccggtgcacacgctcatctgctactggaaggtgaggcccgggcgcgagcaggagctcaccccggaggccgggttcccgacgttcgccagctacggcgacccctacatctacagcacgccgtcgatggagttcccggggctgatcaagatcgccatgcacggcggcccgccgtgcgacccggacggcagggactggtccacgggcgcgggcgacctggtggagccggtggcccggtggatcgacgccgtcatgccgggccacgtcgacaccgccggcgggcccgtcgtccgccagtgctgcatgtactccgtgacccccgacgacgactacgtcgtcgacttcctcggcggggagttcgggaaggacgtcgtcatcggcgcggggttctctggccacggcttcaagatgggcccggccgtcgggaggatcctggccgagatggccttggacggggaggcgagcacggcggccgaggccggagtagacctccgccccctaacgatcggccggttcgcgggaaatcccaaaggaaacctgtctgccagccaaggctgatcggcgacggggctctgtttcatggtttgatgtcaaagtgtgtgctctgcttgccaacttgtctgttaagtgtcttttgggttgttggatttaaaaaacaaaagtgcgcgcatctcctcagtgttttctgcaggctgcagtaataaactggtttggtcagttctattgataatgacagcaataataagttcgttattgtgcaaaaaaaaaaaaaaaaaaaaaaaggcggcgtgcaagtgaactggtagcccggggaattatttccggccggtaacctgaaggggtacaagtt

SEQ ID NO: 12560 - DNA, 2922 bp, Zea mays
cattgggaccctcgaggccggccgggaaaagccggccctccacccgctcccgtgccacggacaatcgaaaccaacagtgagagctagcctcgccaaaccgccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctctaccagccccgcctcccgccatgcctccagggaccgacggtaagggcggagtacggtgacgcgaccacaaccatagatcccacctgtgcccaagccgtcgcgcaggccttcccgcacacctttggccagccgctcgtcagcttcgtcgcgccggccgccggcgccggcgccgttgaggagcgccacccgatcagggtgggcgtggtgttctctgggaggcagtcgccgggagggcacaacgtcgtctggggcctccatgacgcacttaaagcctacaatcctcagagcttgctctacggattcgtcggtggcacggagggactgtttgcaaacaagacgttggagatcacagacgatgttcttgcttcctataagaaccaaggtggtttcgatttgctcggtaggagtatcgatcagatccgcactactaagcaagtgaatgctgcaatgacaacatgccacagtctgaacttggatgggttggtcatcattggaggtgtgacctccaattcagatgctgcacagcttgcggagacccttattcagaataactgtaagaccaaggttgttggtgtgccagtttcattgaatggtgacctcaagaaccagtttgttgaaacaacagttggatttgatacagtatgtaaggttaattcacagcttgtaagcaatgtttgtcttgatgcgatctcagctggaaagtactattattttgttcgtctgatgggacgaaaagcatctcatgttgcctttgaatgtgcacttcaatcacacccaaacatgctcatcttaggcgaggaggtagcattgtcaaaactcacactgatggaaattataagcaagatttgtgatggagtacaagcaagggcaaaattagggaaatatcatggtgtgcttgttattcccgaaggacttatagaaagcattccagaaatgtatgctcttattcaggaaatcaatatccttcacaacagtaatgttcctgtggctgagatgtcatcacaactgtctccgtgggcagctgctctgttccagttcttgccacccttcatcaggagagagctgctgctccaccaagaatcagataactctgcgcagctgtcccaaattgacacggagcaactgctggcccatctagtagaaacagaaatgataaagagaacgaaagaaggaaggtacaagggaaggaagttcagttcagtatgtcatttctttggatatcaggctcgaggatctacaccatcaaatttcgactgtgactatgcttatgctcttggacgtatctccctgcatatgattgcagttggattgactggctacatggcaactgtggctaatctgaaagaccctgttgacaaatggagatgtgctgctgctcctttaactgcgatgatgagtgtgaagaggcatttacgtggccctggagcaatccctatagggaggccttccattcacccttctccaattgacctgaaagggaaggcttatgagttgctgcgagagaaggcttcaagcttcctccttgacgacttctacaggactccaggaggcattcagttcgaagggcctggttcagatgcaaagcccatcacgctgaccattgagaaccaggactacatgggtgacattgagatactgaaagagtaccttggcaaggttaggaccatggtgaagccagggtgctcccgggagatcctgaaggcggcgatcagttccatggtgtcggtgacggatgtgctgactgtgatgtcccaccccctcaacgccgagctgcccctctaccatttcaagtgagcgagggcatcagtctggttgttatcctagagtgtttttgaaacagcagaagattctgcttcatggctgccggtcttttttttaatttgggtgagaattaagcactgggttgtaccaataaacactgaaacagtacttgatactgaactgagtcgcgtgctagttgtattattggtggcagtattccagttttcaagaggtctctagaatatccaagattgataacactcatctttcagcctagcaatatagtagtagttctttctttacttaccattaacacacaaaacctcctcccttggttaagaattgcccaaccacctcttcttcctcgctgccctccaaggtggccaagagccaacagatcgatgacagaaactacaaattaaaaacaaacaaataaaaaggacatgcatgacctgatcaccacccatctcatagagagttttttttatcaccacctgaccaccaaccatctcctagagaaggatggatcgacaaacctttttttaaagtaatcgttgcaggaggttgcaatctagcacagggcagtctggtccgactccgctgcttgccgcgcctcgccgaggtgccggctccacgctgctagagagatgaggcacatgtgaaggggcctgccgctccgctcggcctccatatgtcgggcgtttttcagcacaaaagaaggatgcggatgcggaaatcttctggtttcggtagcgtggcctaaagtcgcgtcatgataggaggaggctgtttccagcagacttgaatacgatgcggagagg

SEQ ID NO: 12561 - DNA, 1239 bp, Zea mays
cgttggacgccgtcctcggtcaaggaggcacccgaccccctcttctcttcagcgctgccctccaaggagctccggctagacgcccccctccccgatcccgcaacggcgctggtgaggtggtccgtcgcagtgacgccccctccccgatcccgcaacggcgctggtgaggtggtccgtcgcagcgattgagacaaaagtaagagtatggcgtgtcggatgtgaaggcaaccgcgtcagcatggcggatgaggagcatccagagaggatagaggaggcctccgaggtgagctagctatttctctgaccattgcgcagagtgtttctgttagtgttaattggtgagctcagggcggccgtgcggtggcccgtggtggcgagtcgcggtggctccaagggtcggcgccagtccgaatcagggcgtagggccaagcttttgcgcctagcgccatgccgcccctgtgcctccacccttccctctctgtgttgccgccggccccgacggagcggcgtcgggtgcctccgcctccttcctggccgccgggggccaagaccgcgacagcaccccacccgcctcacttccttggctcacagacggagcggcgtcggctcctccgcctccttcctggccgccgggggccaagaccgcgacagcgagcggtccgcctccactatgagcagagcggcagtgacaacgcctcctggccatcgacacgggcccacagctccaccccgacgtgcttctctgtgcgctggcgcttcttcgtccttgggcggggctaggccgtagtagagcgccgaacacaggccagcaacgacgcaattgctgctccctaggtcagcgggttgccattgctctgctttactctgtgctaatgcaacttgcttctgaaatgtcttttgccttgcaagctgcttggagatggaagcgagatttcgaagttacaaaaaaaaaaaagaaatggtcttgcgttgatatctgtagttgtacatagaaaatttctcatttggtgtatgtctttgctactttttccttaaacataaattatatttttataactatttggcagttactgatctatcactgccttactacatgttacctatctggcagttatgagatgcctattcttttcatatgtaaatcctaaaatattcgaatccattttatatgtaaatcctaaaatttttgaatccaaagccacccattacaatattatgtactgaaaatatatcttatac

SEQ ID NO: 12562 - DNA, 2512 bp, Zea mays
tcgctacccctggaaaggtaattatcttgtcacccatttggattagtaactaagcaggctgcaaccattattactactaagaaccatggctgatgtttttttcttcctatcagtactattattttgttcgtctgatgggacgaaaagcatctcatgttgcctttgaatgtgcacttcagtcacacccaaacatggtatgattttatcaaatctgtggttataactctctactatatgaaatgaagaaagagcatcagcatccttttttttcaatttctctttgcagctcatcttaggcgaggaggtagcattgtcaaaactcacactgatggaaattataagcaagatttgtgatggagtacaagcaagggcagaattaggtttgtacagttctttgattgttatgttgcagcagttagtaggaaaaaaagtttgtacctttggttgaggtaaattttctaatttaattttctagtcaatcaaggtatcgggatattttataaatcatacactaaaagactggttatccatcttcagggaaatatcatggtgtgcttgttattcccgaaggacttatagaaagcattccagaaatgtatgctcttattcaggtatgtgtgatctatcttcatggaaacaacgggatgataaatagcattatttcagttccgtcttcttgttttctgttcaaatattccaggaaatcaatatccttcacaacagtaatgttcctgtggctgagatgtcatcacaactgtctccgtgggcaggggctccgctccagttcttgccacccttcatcaggagagaggtattgcattgctagcaaagttggattttcttaatgtttgtaacattaagataaattctggattaacaatttgtaatatttcactcagctgctgctccaccaagaatcagataactctgcgcagttgtcccaagtttgtgattctgaatgcccaacaacaactcaatcaaaacttaatgtaattattggtgttatagtgtcctattgttttcagattgacacggagcaactgctggcccatctagtagaaacagaaatgataaagagaacggtaatttccattcttttgctatttcttgttttttttttccttctctgaacctctgtccatagtgattggggatgtttgatatttcagaaagaaggaaggtacaagggaaggaagttcagttcagtatgtcatttctttggatatcaggctcgaggatctacaccatcaaatttcgactgtgactatgcttatgtgagtactatttcactgagattttggaaaactgaatgttctgatgatccgatccttatgttattcatgctaacactgaacattttaggctcttggacgtatctccctgcatatgattgcagggggactgactggctacatggcaactgtggctaatctgaaagaccctgttgacaaatggagatgtgctgctgctcctttaactgtaataagatgtcactgaccatgccttcaagatcagatgctgaaaggttacttatctatttatgttgacctagttgcacaatctgttgtctctaccaggcgatgatgagtgtgaagaggcatttacgtggccctggagcaatccctatagggaggccttccattcacccttctccaattgacctgaaagggaaggcttatgagtaagtccacattgttcagggctttgatacctggtcctgcttttttttcccccgataagtagaggaaaggatgcgacctggaaggaaggtgaacgggattgactttgttcctgcatcattcaggttgctgcgagagaaggcttcaagcttcctccttgacgacttctacaggactccaggaggcattcagttcgaagggcctggttcagatgcaaagcccatcacgctgaccattgagaaccaggactacatgggtgacattgagatactgaaagagtaccttggcaaggttgtgatcgggaatcctttcatctgcttccgagtagtttcagattaaaaagaaaagaaaagaagcttttcgtttaagaagcaggtcccttcctaacattggcatgcccaacgatgatgtggtcccaggttaggaccatggtgaagccagggtgctcccgggagatcctgaaggcggcgatcagttccatggtgtcggtgacggatgtgctgactgtgatgtcccaccccctcaacgccgagctgcccctctaccatttcaagtgagcgagggcatcagtctggttgttattcctagagtgtttttgaaacagcagaagattctgcttcatggctgccggtcttctttttttttaatttgggtgagaattaagcaatgggttgtactaataaacactgaaacagtacttgatactgaactgagtcgcgtgctagttgtattattggtggcagtattccagttttcaagaggtctctagaatatccaagattgataacactcatctttcagcctagcaatatagtagtagttctttctttgcc

SEQ ID NO: 12563 - DNA, 801 bp, Zea mays
aatatcggatttaaaatgtgcgcacctcctcgcggccggggacaaaaaggtccctcgttcagttgttcctcaacctacctacgccgctccgcgctcgaccgcctttgcctgccttcccattccccccgtctcctcttcccttccgccatggcccagcccgctttcctctcctctctccgctcccgcctcggctccgcgccgccgcccccgccgaaccatcgcctccagcccaggcgcggctaccacgtcgagcttggggctcgcgaaaaagcgcttttggaggaggatgttgctttgaagaggttcaaatcatacaaaaacagtgtgaaacaggtctccaagatcgggaatgctctcactttagctgttgtacttgcttgcagctacgagcttgctgtgttggcgactagcacaaaatgaaggaaaactcagtcatgtggcggcacggttattccgggaagtgatccatcagcatgaactggcactctctctcttcgtgtttttttagccccgtttgttgatcactcgtaccgtgtaaaataaaataaactaggttaaccttgattggcaaataatgtctctgtttttatggcctagttgcaaacaaagtgagagaagcattccgtggtgaatcgtgaagaatgaacgccgcctgctttgtttaccacctgggagtgtatcctgctgcacattgtaacagacgtgcatttattgaactaagtttaatactatcaccattcttgaaaaaaaaaaaaaaaaaaaagaccccgaccaccagagcaagggcccctaaagggcggt

SEQ ID NO: 12564 - DNA, 737 bp, Zea mays
ataatttttgggaataatttttttggcttcgagttgctcttcctactccgcgcccggccgcctttgcctgccttcccatctcctctggtcttccgccatggcccagcccgtattcctctcctctctccgctcccgcctctgctccgcgccgccgtcgccgcaccatcacctccagcccagccgcggctaccacgtcgagctcggcgctcgcgagaaagcgcttttggaggaggatgttgctttgaagaggttcaaatcatacaagaacagtgtgaaacaggtctccaagattgggaatgttctcactttagctgttgtatttggttgtagctacgagcttggtttgttggcggcaagcatgaagtgaaggaaaacacagccattattccgggaagtgatccatcagcgtagactgtcattctatcacctcgtgtttttagcctgtctgtctctctcttattttgtcgtgcaccatgtataaaataaaactaaactaggttaaccttgatttgcgaataacgttttctgtttctatggcctagtcgcaaacgaagtggcacaagcattccatggctaatcttgatgcatgagcatcggctgcttttgtttgccacctggcagagtggcagtgcatcctgatgcacagacagtataacagacgtgtcatttgtcgaattcagttcatcaacaaaataaaggtcgttaatccctgcaaaaaaaaaaaaaaaaaagcggcc

SEQ ID NO: 12565 - DNA, 639 bp, Zea mays
ataatttttgggaataattttttgggcgattcgagtttctcgaggcgccgcctactccgcgcccggccgcctttgcctgccttcccatctcctctggtcttccgccatggcccagcccgtattcctctcctctctccgctcccgcctctgctccgcgccgccgtcgccgcaccatcacctccagcccagccgcggctaccacgtcgagctcggcgctcgcgagaaagcgcttttggaggaggatgttgctttgaagaggttcaaatcatacaagaacagtgtgaaacaggtctccaagattgggaatgttctcactttagctgttgtatttggttgtagctacgagcttggtgtgttggcggcaagcatgaagtgaaggaaaacacagccattattccgggaagtgatccatcagcgtagactgtcattctatcacctcgtgtttttagcctgtctgcgtctctctttttttttttgtcgtgcatcatgtataaaataaaactaaactaggttaaccttgatttgcgaataacgttttctgtttctatggcctagtcgcaaacgaagtggcacaagcattccatggctaaaaaaaaaaaaaaaaaaaaacaaaaaccccaaaaaaaaaaaaaagcggcc

SEQ ID NO: 12566 - DNA, 746 bp, Zea mays
tggggggagcaagacagacagggccctggttcagtcgttcctcaacctacctccgccgctccgcgctcgaccgcctttgcctgccttcccattgccccgtctcctcttcccttccgccatggcccagcccgctttcctctcctctctccgctcccgcctctgctccgcgccgccgcccccgccgaaccatcgcctccagcccaggcgcggctaccacgtcgagctcggggctcgcgaaaaagcgcttttggaggaggatgttgctttgaagaggttcaaatcatacaaaaacagtgtgaaacaggtctccaagatcgggaatgctctcactttagctgttgtacttgcttgcagctacgagcttgctgtgttggcgactagcacaaaatgaaggaaaacacagtcatgtgggggcacggttattccgggaagtgatccatcagcatgaactggcactctctccattcgtgttttttagccgcgttaccgtgtaaaataaaataaactaggttaaccttgattggcaaataatatctctgtttttatgacctagttgcaaacaaagtgacagaagcattcattccgtggtgaatcgtgaagaatgagcgccgcctgctttctttaccacctgggagtgtatcctgctgcacattgtaacagacgtgcatttattgaactaagtttaatactatcaccaatctcgaatatttgtgttaaaaaaaaaaaaaaaaaaggcccctagggcc

SEQ ID NO: 12567 - DNA, 3572 bp, Zea mays
  misc_feature (3263)..(3263): n is a, c, g, or t
attgtgttggggtctgctgaagaacgagttggagtctgggagacgtttagacaaacacaagcaaattttttttcaatcccgcagagggcaaaaccgtccaacgagacaaccccgcgcagaggcaaaagccccacgcttgagagctagaacatcctgacaggaaacagacgcatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctcgtcgcctatttcaccggcgagcggccgccgcctcccgccttcgaggatggaaaccagtaagcctccccgcagcgatcgaaaccgggccgcgttgcccccatatcgaggaggtggttttggatccatttcgatatagggttaggccaattcgtgttagatttgggcaaaaggcggcgccttggtagttttggtttcggctcggctcctgttgcgactgattcgcgatccgatctgattgactgtttgttggtcctggcgattgcggaatcgtgtggtcttagttttcgttgcaaggcagaggcgaagtgaagtattcacacttcaatggccacgtacctcgcctttcggcagttgccagcttcctacctctagcgattgtctgacggagaggacaaggaatctcactgctacacatctgagattatgatttaagtaggacagtcagtttaatcctaaggcattcagattctttgggaagttgggaggttaaacaggatgagctttcgtgttctgactgtgacgcactgatgtttcttattcatactccaggattcagacttttaattgagatcctttcaaccgtgtagtccacattaatttgtatggcttgtaaggcatcattgttctagcatacatgtttttaactcattgggtcaatttttttgtaactttggcccattgtttgtgacctggaagaaggctgccaatggttcagaaccacgcctacggggatgcataggaactctggagtcccgtcagattgtcagcggctttagggactacgccctaactaggtgactattgtttcagtattgaaattatgtctgatccaatgctgaaatatctggtcggtactcaaaacgttgatgggcttatgctgtaataagtagaaaagcaatcgtgcactttgtattggataatgtttagatatacggtaatcttgatatcctcttgcagtgcgctgagggaccgacgctttcccccaatacaatcaaaggaactcccaaccttggagtgcacggtatctatactcactgattatgaaattgcagaggactacctcgactgggaggtatagttccacacactttaaatctacatgttcagatgctcttctcacctgttatgcttattgtttcagcattttgtacatcaaagccttttctttcttgtgaatcaggttggaaagcatggtttaattattgaatttacagctccagactccaacacaaaacacagtgcgacctatttgcctgaagttgcgggccatgaaggtgaaaatttcctttttcatcgatgcgatgtacacttatcgtttctacagagttctttagtttctagaattattgcaggggataataagaagaaatgagttaagaaaatatgtaatttcatctttctaaatcatcatggaccaaatgcattataatgagcaataacggtaaaataaagagtcaactgatcagtacattccaaatctgtattgaatagtttgtaacttaggcttaatcttttggcaggttggacacatgtagaaactattgattcactcgtgaggaaggcaggttaccagagaatcatcactgagtccttgaggaagaaaatcaaagtcactcgctaccagagcaccctgtacacgatgcactatggtgaatatgttgcgtacctcaagaagaacagaggtgcagccccgtcaattagtggggctcctcctgtagttaatggcttcaagccaagccattgatttatcagtataaaaaaaagctcaaagaacatattactataatttatctgcgagcaatttggggggtgtagtgtaaccaccccccacagttcattgatctagcatcattcccttccaaggaaaaggccaaataggggcgtcatgacaagcgcccagaataataatgccttcctggatggatcatggatgatgcttatgtatcttgaaaacacatgtgcttcaagaagttcaaattgtgtggtgaagttaattgattcgagttggccattcctagttccagtgatttgtctctattcttaacttagtcttggtcggatatttctgtgcgttgaacggcaacgccctcctgttccttcccaattcaaacaattggaagcaggcacgccgcacaaaaaaaaacagtagcactgtatcatgcagggtgtttgatctgttggtcgcatactcgcatgaatgtcatagatgtccggcaagaccaagacccatgagcgctaatctagctgagagtttgagcaacgttcttcagtcgcaatcaccgaagatgaaatattcaattcacaggaaactaaatgatctctttcatttggtaataataattcgaagaacataagatgttttttttaaaaaaatgtaaagaaaatcccattggcggcatgcttagttctgagtacatattattgctgatctagtagagtttggcaagacaccaggggccatctcaagcgccgatctcatattacaacgacgttctcgtcaaatatccgcttctctggggccatctgaaggctgtgatcatacaaaccttcgtcagcttcaacggcactgtcaccattcaccaacaggttcgcacttcactgcaggcaccagcatgccaggaattacgttggcactcggcagtgctgcgcggagcaagaaagctagcaaaatagagctataaatcacaaagaggtgtccacggcttaggctgtcttcggtggatcgtgtatataagtaatgtaaaacactgttttcaactgttcgtatgatgaagtttaaaatatgagatgaatgtgagatttgatatgtaagctgctgtagacattacaacttataaaaacaattggattgaagatcaccacagagcatgtccgttttacataagcagatggcagcacaaaaccctatttntttccccactataaaacttgtttcagaattcgaagtggcatacaaggtaacgagtctcacgtgcgaatcaaaggggcacacggatttttcatcaatgcaaagccatttaatacgattagtggctttgcaaagttaataaacgaaattgcagatcccaataggtaaacgaatttgggattggagaggaccattaagactttagaaaccgcgagatgcatacgtgtgctggaattaagtggaacacaagagcacaggactgatactagtacttcataggtggttatattatataggcgcatcattcagttt

SEQ ID NO: 12568 - DNA, 2159 bp, Zea mays
gcacgagaccattacctagaacatcctaatcgaaaaaagacgcatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctcgtcgcctatttcaccggcgagcggccgccgcctcccgccttcgaggatggaaaccagtaagcctccccgcagcgatcgaaaccgggccgcgttgcccccatatcgaggaggtggttttggatccatttcgatatagggttaggccaattcgtgttagatttgggcaaaaggcggcgccttggtagttttggtttcggctcggctcctgttgcgactgattcgcgatccgatctgattgactgtttgttggtcctggcgattgcggaatcgtgtggtcttagttttcgttgcaaggcagaggcgaagtgaagtattcacacttcaatggccacgtacctcgcctttcggcagttgccagcttcctacctctagcgattgtctgacggagaggacaaggaatctcactgctacacatctgagattatgatttaagtaggacagtcagtttaatcctaaggcattcagattctttgggaagttgggaggttaaacaggatgagctttcgtgttctgactgtgacgcactgatgtttcttattcatactccaggattcagacttttaattgagatcctttcaaccgtgtagtccacattaatttgtatggcttgtaaggcatcattgttctagcatacatgtttttaactcattgggtcaatttttttgtaactttggcccattgtttgtgacctggaagaaggctgccaatggttcagaaccacgcctacggggatgcataggaactctggagtcccgtcagattgtcagcggctttagggactacgccctaactaggtgactattgtttcagtattgaaattatgtctgatccaatgctgaaatatctggtcggtactcaaaacgttgatgggcttatgctgtaataagtagaaaagcaatcgtgcactttgtattggataatgtttagatatacggtaatcttgatatcctcttgcagtgcgctgagggaccgacgctttcccccaatacaatcaaaggaactcccaaccttggagtgcacggtatctatactcactgattatgaaattgcagaggactacctcgactgggaggttggaaagcatggtttaattattgaatttacagctccagactccaacacaaaacacagtgcgacctatttgcctgaagttgcgggccatgaaggtgaaaatttcctttttcatcgatgcgatgtacacttatcgtttctacagagttctttagtttctagaattattgcaggggataataagaagaaatgagttaagaaaatatgtaatttcatctttctaaatcatcatggaccaaatgcattataatgagcaataacggtaaaataaagagtcaactgatcagtacattccaaatctgtattgaatagtttgtaacttaggcttaatcttttggcaggttggacacatgtagaaactattgattcactcgtgaggaaggcaggttaccagagaatcatcactgagtccttgaggaagaaaatcaaagtcactcgctaccagagcaccctgtacacgatgcactatggtgaatatgttgcgtacctcaagaagaacagaggtgcagccccgtcaattagtggggctcctcctgtagttaatggcttcaagccaagccattgatttatcagtataaaaaaaagctcaaagaacatattactataatttatctgcgagcaatttggggggtgtagtgtaaccaccccccacagttcattgatctagcatcattcccttcgaaggaaaaggccaaataggggcgtcatgacaagcgcccagaataataatgccttcctggatggatcatggatgatgcttatgtatcttgaaaacacatgtgcttcaagaagttcaaattgtgtggtgaagttaattgattcgagttggccattcctagttccaaataaaaaaaaaacaaaaaa

SEQ ID NO: 12569 - DNA, 1325 bp, Zea mays
cctcgaggccggccgggccggggctgcagaacgagtgtggagtctgctgaagaacgagttggagtctgggagacgtttagacaaacacaagcaaattttttttcaatcccgcagagggcaaaaccgtccaacgagacaaccccgcgcaggcccgccggccccacgcttgagagtgagaagaaacagacgcatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctcgtcgcctatttcaccggcgagcggccgccgcctcccgccttcgaggatggaaaccacccattgtttgtgacctggaagaaggctgccaatggttcagaaccacgcctccggggatgcataggaactctggagtcccgtcagattgtcagcggctttagggactacgccctaactagtgcgctgagggaccgacgctttcccccaatacaatcaaaggaactcccaaccttggagtgcacggtatctatactcactgattatgaaattgcagaggactacctcgactgggaggttggaaagcatggtttaattattgaatttacagctccagactccaacacaaaacacagtgcgacctatttgcctgaagttgcgggccatgaaggttggacacatgtagaaactattgattcactcgtgaggaaggcaggttaccagagaatcatcactgagtccttgaggaagaaaatcaaagtcactcgctaccagagcaccctgtacacgatgcactatggtgaatatgttgcgtacctcaagaagaacagaggtgcagccccgtcaattagtggggctcctcctgtagttaatggcttcaagccaagccattgatttatcagtataaaaaaaagctcaaagaacatattactataatttatctgcgagcaatttggggggtgtagtgtaaccaccccccacagttcattgatctagcatcattcccttccaaggaaaaggccaaataggggcgtcatgacaagcgcccagaataataatgccttcctggatggatcatggatgatgcttatgtatcttgaaaacacatgtgcttcaagaagttcaaattgtgtggtgaaagttaattgattcgagttggccattcctaaaaaaaaaaaaaaaactcgagcccggaaaaaaaaaaaaaaaaaaaaaaaaaaaaaaaaaaaaaaaaaaaaa

SEQ ID NO: 12570 - DNA, 2152 bp, Zea mays
ccggccgggaacgggccaatcaccgcgcgcagaactccaagtccgcgcacccattgggtccctcgaggccggccgggaaaccccccctagtttcttttcccccggttttttccgtcctctcctcactcgtgtccgatggctcgcccccgccgcctcctctgacgacggtctgactgacccccgcctccccggagagcggctccgctgtctcgccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccggcggcgacggaggctaggcggcggccgaggcgggcgctctcgacgcggcgggtggcgacggcggcgctcgtgctgggcgcgctcgcggtcgccgcctactattgcttctactcggacgtggccgtgcagttcctggggatggagcaggaggaggagcagaggaacgagaccaggtctttcctgctgccgctctaccccaaggcgcgtcagggccgcgcactgcgcgagttcggggacgtcaagctcgccgccaggagggtcgacgacggcggaagaaaggctaggaacaggatggaggtcgcgaaggcggccacggcgaggaccaattccacggcgttgctcccgatcaagggcaatgtcttccccgatggccagtattacacatctatctttattggcaaccctccaagaccatactttcttgatgttgatactggaagcgacttgacgtggatccagtgtgatgcaccatgtacaaactgcgcaaagggaccacatcctctatataagccagcaaaagaaaagattgtccctcctagagacttgttgtgccaagaattgcaaggcaaccagaactactgcgaaacctgcaagcagtgtgactatgaaattgaatacgcagaccaaagctcctctatgggtgtccttgcaagggatgatatgcatatgatcgcaaccaatggtggaagggaaaaattagattttgtctttggtgcggcgataagctttcccagtcagctggctagtcacgggattattgccaacgtttttggccattgtatcactagagagcaaggtggtggaggatatatgtttctgggagatgattatgtacctagatggggagtaacatggacttctattcgaagtggtccagataacttatatcacacacaagcccaccatgtaaaatatggggatcagcaactccggaggcctgaacaggcaggaagcactgttcaagtaatttttgacagtggaagctcctatacgtacctcccaaatgaaatatatgaaaaccttgttgcagcaatcaaatatgcgtctccgggctttgtccaagacacttcagatcggacattacctttatgctggaaagctgatttccctgtgaggtatctggaagatgtcaagcagttcttcgagcccttgaaccttcacttcgggaagaaatggcttttcatgtctaaaacattcactatttctcctgaggattacttgattattagtgataaaggaaatgtctgtcttgggcttctcaacggaacggagattaatcatgggtcaactatcatagtaggagatgtttctctgcgcggcaagttggttgtgtacgacaatcagcggaagcagattggatgggcagattcagactgcaccaaacctcaatcacaaaagggctttcctttcttcctctgacgaagcatcactctctacataatacatgtgtaaagcgtaaatagtgaacgccattgtattgtagaatacattattaagtggagactgcctttgtgtatgggtatatcgttccattggaactgtcagaaatcctccactgtgttgtacccgtctgtaatgtgtatactatgttgtttacttgtatgatgtatgtacactatctcctctacatggagttgtcccctacacatggattttttgtagattagttacattatgaacattttcgacagaagttgggtactttacacaaaaaaaaaaaaaaatgaaaaaccgtaaaaatctgttttatc

SEQ ID NO: 12571 - DNA, 2017 bp, Zea mays
agtggcggacccaaaactcccgtgcgcgtgcttaccgatggtcgccacatatggcagcgcaactagtgccccttctaacccggacgctgagcagcagccgcagctgcacgggggggagatcatcacgctacataccgcggaccaggcctgcaagggcaagaccgtcaccgacttcgactacaccaacgaccccccgccccctacgctggcccccggatccgggtatggggtacccggcggtgacggaggctaggcggcggcagaagcgggcgctctcgacgcggcgggtgacaactgaggcgctcgtgctgggcgcgctcgcggtcgccgcctactactgcttctactcggacgtggccgtgcagttcctggggatggagcacgaggaggagcagaggaacgagaccaggtctttcctgctgccgctctaccccaaggcgcgtcagggccgcgccctgcgcgagttcggggacgtcaagctcgccgccaggagggtcgacgacggcggaagaaaggctaggaacaggatggaggtcgcgaaggcggccacggcgaggaccaattccacggcgttgctcccgatcaagggcaatgtcttccccgatggccagtattacacatctatctttattggcaaccctccaagaccatactttcttgatgttgatactggaagcgacttgacgtggatccagtgtgatgcaccatgtacaaactgcgcaaagggaccacatcctctatataagccagcaaaagaaaagattgtccctcctagagacttgttgtgccaagaattgcaaggcaaccagaactactgcgaaacctgcaagcagtgtgactatgaaattgaatacgcagaccaaagctcctctatgggtgtccttgcaagggatgatatgcatatgatcgcaaccaatggtggaagggaaaaattagattttgtctttgggtgtgcatatgatcagcaaggccagcttttatcttcaccagctaagactgatgggatccttggacttagcagtgcggcgataagctttcccagtcagctggctagtcacgggattattgccaacgtttttggccattgtatcactagagagcaaggtggtggaggatatatgtttctgggagatgattatgtacctagatggggagtaacatggacttctattcgaagtggtccagataacttatatcacacacaagcccaccatgtaaaatatggggatcagcaactccggaggcctgaacaggcaggaagcactgttcaagtaatttttgacagtggaagctcctatacgtacctcccaaatgaaatatatgaaaaccttgttgcagcaatcaaatatgcgtctccgggctttgtccaagacacttcagatcggacattacctttatgctggaaagctgatttccctgtgaggtatctggaagatgtcaagcagttcttcgagcccttgaaccttcacttcgggaagaaatggcttttcatgtctaaaacattcactatttctcctgaggattacttgattattagtgataaaggaaatgtctgtcttgggcttctcaacggaacggagattaatcatgggtcaactatcatagtaggagatgtttctctgcgcggcaagttggttgtgtacgacaatcagcggaagcagattggatgggcagattcagactgcaccaaacctcaatcacaaaagggctttcctttcttcctctgacgaagcatcactctctacataatacatgtgtaaagcgtaaatagtgaacgccattgtattgtagaatacattattaagtggagactgcctttgtgtatgggtatatcgttccattggaactgtcagaaatcctccactgtgttgtacccgtctgtaatgtgtatactatgttgtttacttgtatgatgtatgtacactatctcctctacatggagttgtcccctacacatggattttttgtagattagttacattatgaacattttcgacagaagttgggtactttacac

SEQ ID NO: 12572 - DNA, 1490 bp, Zea mays
tcttattggacccccgcctccctcggtcccttccgaagcaaaggatcagatgcccaaaattcccggctcgaagactgcaggcatcggacgcgccccccgccgagaagctactcgaatcccctccaaaattcggaggcgagagccactgatctatcgcaaaacccatcaaattacacaattcaaatcagccaaccccacctacagccaccaattcgtgcgcatcaagtctagccccctaccccttcgcaatcagtgaacccccaatccacacacagcctgcgaatcgctggatcaaaatttggtctcggactctcgatccaccattccccgaggaaggagatctcagtcaaccgaataagtctcgggaagctctgtgttggaaacatggggaaaccgctgatctacgagatactggagaagccggcgagcagcagcgtcatcggcatctgctctctgatctggtggctcatccagaagcggggcatcgggtacgcggacgtcgggctgagctacgaggccgcggtggacagcgggcagtactggcgggtcatcacctccgccttctcgcacgtcagcgtggtccacctggtgttcaacatgagcgcgctgtggagcctcggcgccgtcgagcagctgggccagatcgggctcggcgtcgagtactacctgcactacacgctcgtcctcgtcgtgctgtccgggctactggtcctcgggttctaccacgtgatgatccagaggttcaaggtggagtacttcaggagggtcaccgcggtcgggtactcgtgcgtcgtgtttggctggatgacaatcctggccgccaagcaaccgtcgtccaagctgaacatcttcggggttctctcactgcccatcagcttcgcgccgttcgagtcgctgatattcacatccatcatggtgccacaggccagtttcattggccacctgtccgggataattgttgggtactcgattgcctggggtctggtccatgggatgaacaactactgggcagtcaccatgcttggctggactgcacttgtgtttgtcttgagcttgaagcgcacagggtctatggagctgagttttattgagatcgagccagtgacggacccctcgctgccttctgttggtgtggtagccaccagaaatggtagaagtagaactctgcaaatggatgccttgtctggaagaagagttgcagacattgtataacacgcagagaggaaatgtttgaggaatcctgagtttttgttctgaaaactgtatcatgtcgacacaatgatacgtattgggtttggaaaaaaggaaaagcaaaaaaaaatggtcattgctggtgtaaaggaattcttcgtcttggccttccagatgcatgttcattttgaatagaaatgaattctttgcgctagttgcctagttaccatgtaatgtaaagagattttttttccagtttaactggattccttcagtgctgccctcttcatgcaaaaaag

SEQ ID NO: 12573 - DNA, 1261 bp, Zea mays
  misc_feature (33)..(33): n is a, c, g, or t
gagctcactcttatcataaaggcgatgtgaatncactaacaactgttcctagtgggaacagggtattttccgcaggttagcgtggtcgcggccgaggtacaaaatatcaaaagatgaattcggtgctagtaaaaatgtgatcaaagagcaagttcagaaatgggtctatgtgggatatctcagagctcacactcatgatataagggcattaaccatggctgtgcctatctgtagagaagatgcattacctgaggaaaaggtggtgaagattcgccggcgtgaaaaacatgaattcagctaccacagatgggctcatcttggggttccgatgcttatatctggtggtgatgacgccaagctgtttgcatattcagcaagagagtttactcagttctcacctcataacttctgccctgcacctcaacaccctttgataaagctggctaggaatagcacagtcaatggagattatgtaatgcttgtccagtcttcgaacttcttggatgttttacttgtgacagttcagaacaagctgacgactccaagtacatcatcatctagaggagatgctacagtccgacaacttgttcgtttgaaaagcaaggggtccagaaaaataatttctagtgctgcctgtgccaatggaacacttttggcctattcagatggtgtgagaccctgcctctttgcactaagacataagggtggaaagaagtacacccttgacaaattagagctgccaaaaggattgccctgttctcagagtatgctgtttactgtggactcgtccaatttgatacttgctgggcgtaatggaaaaatatacatcattgacattgcaacaagagaaatttcaaatgtatttcaccctacaagaagggcagatggagccgacagcaccggagtcccgcctgtaacgaagatgttcctaagtgcagacgggcaatggctagctgcggttaactgctatggggatatttatgtatttaaccttgaggtgcaaagacaacactggttcatatcccgaatgaatggtggttctgttacatctggcggtttttgccctaagaacaacacacttatcataactacatctaaaaacgaggtgtatgtatttgatgtggaaacaaaacaactaggtgaatggtcccagttgcccagaagtttccaggaatttcctggagaggtcattggcctatcattttctccgcaaagctcatcatcggttattgtatacagtacctcggccgcgaccacgcta

SEQ ID NO: 12574 - DNA, 2885 bp, Zea mays
accttctagaatatcaggatcgccagcgccgccgcatcgagtggccctgtggcccatggacaagctccgcgtccaccggtgcaccggcgacgcggtcgagtggtccccctctcccatcgtcgcgctcgccgcctctccctgcgcctcccaggtcgccgccgcgcgtgaagacggctcgctcgagctctggctcgtctccccgggctccgtcggctggcacaaccagctcactatacaaggcaacgccgcgtcgagggtcacatcactggtgtgggggcggagaggtggagcgaccggccggctgctctcgtccagcattgatgggtcggtgtccgaatgggatctctttcacctgcagcaaaagactgttctagatactgttggagttccaatctggcaaatggccatcgagcctttggatgatgctaaaaatactgaaaataatagctcagagtttgctgtcaatggtcatacaaaccaaaatgactccagcgattctgactttagtaacattgatgatggtgacaactctgaggatgaagatggttctaccaacacaagatcttcatatcatgtgaatgatttccagcgaatggctcttgcatgtgatgatggttctgtacgattgtttaacgtgcctgaatcaggtgcattgacttactatagatttcttcccagagtgagcgggcggtctctcagcgtgacatggagtagtaacaccaaatttgtattttctggcagcagtgacggtttaatcagatgctgggattcaacatctttccatgaaatgtatcgtattactgctggattaggaggggctggtacctcacctgaactttgcatctggacactattgttctgaggtgtggaactattgttagtggagatagtaccgggagtgtacagttttgggatagccgccatggaacacttctgcaagctcactcctatcataaaggcgacgtgaatgcactaacaactgtgcctggtgagaacagggtattttccgcagggtccgatggccaggtaattttatacaaaatatcaaaagatgaatttggtgctagtaaaaatgtggtcaaagagcaagttcacaaatgggtctacgtgggatatgtgagagctcacactcatgatgtaagggcactgaccatggctgtacctatctgtagagaagatacatcacctgaggaaaagttggttaagattcgccggcgtgaaaaacatgaatttagttaccacaaatgggctcatcttggtgttccaatgcttatatctggtggtgatgacaccaagctgtttgcatattcggcaagagagtttactcagtttgcacctcataatttctgccctgcacctcaacgccctttgataaagatggctagggatagcacagtcaatggagattctgtaatgcttgtccagtctccaaactgtttggatattttacttgtgacagttcagaacaaattgacgactccaagtacatcatcatctagaggagatgctacagtccgacaacttgctcgtttgaaaagcaaggggtccagaaaaatcatttctagtgctgcctctgccaatggaacacttttggcctattcagatggtgtgagaccctgcctctttgcgctaaggcataagggtggaaagaagtatacccttgacaaattagagctaccaaaaggattgccctgttctcagagtatggtgtttacggttgattcgtccaatttgatacttgcggggcgtaatggaaaaatatacatcattgacattgcaacaagagaaatttcaaatgtatttcaccctacaagaaaggcagatggagcaaaaatctcaagagaatcacctataacgaagatgttcctaagtgcagatgggcaatggctggctgcagttaactgctatggcgatatttatgtatttaatcttgaggtgcaaaggcaacactggttcatatcccgaatgaacggtggttctgttacatctggtggtttttgccccaagaacaacacacttgtgataactacatctaaaaatgaggtgtatgtatttgatgtggaagcaaaacaattaggtgaatggtccaagcgatatacacaccagttgcccagaagtttccaggaattccctggagaggtcattggcttatcatttcctccgcaaagctcatcgtcagttgttgtatacagtaccagggctatgtgcaacatcgatttcggattgccagtcgttgaggatgttggcttgccaaatggatcaggtggaccagcagagaaggcagacgcaaaaaagagtaaaaaaacaaggcagaagcgtaaggcccgtgatgaagagtctacagaggagaaaaggaacaacttcaacttctttgcgtttaaagaaccagtgctctttgttgggcatctacaggacagttcaattttaatggtagagaagcgatggatggatgttgttgaaggtttcagcgcaccagttgacagacatatatatggcacatgattcttgctaacatcggcctttggcgctcgtgacaagcaaaccattgtttttgtttttttttctcaagtaatgcaaaacatccgtcctcaagcatgtcaacggttgaaaggggctacaagatattgcagcacaaagtgaaagctgcacgtagactttagagtcggggattgtggcaatggtgtattttcttttgttctctagtaatgtagtggactccctgcgccagtttgtcataccttgtcgctgcgcaaaattttgtcacatgtaaacactgtatcatcacttctgttattgttgagctgatatcttctgtttgcctcaaaaaaaaaaaaaaaaaaaaaaaaaaaaaaaaaaaaaaaaaaaaaaaaaaactcgagaggggg

SEQ ID NO: 12575 - DNA, 1982 bp, Zea mays
actactattccaatccgttctagaagtgtctctctcgtccctgcttttgcctcctccgggaaggaagacgaacccatttcttgcagtgccacaggaaggagcaagacgatccatatttggagaggccatttggcatccagagcatccagataaacttgaaagagcaagaaaaacgaggcctcgtttcttgcagtgcctgtgcgtgcggcggcagcgcatgcgcattctctcccctccccgttctcctctccccggacaacccggccgcgccgcccccactttcttccaccctcgttggtagagtaccgatatagttccccccatcggccaggaatcctcgcatcgcatcacgacacccggttcctctccctcccttcccttcctctgcttccggggaggaggagaggaaagagacagacgaagggcgcaccgggaaggaggacctggaggaggaggcacacaacacaatccttcctcttgcacgcggagtcctcaagcgggcctcctcctcggccttggctcaaattccgggtgccataacacgacctccgccggcggccaccggcagccatgtcgcccttctacctcgctcgcggtgcttccaagctagtgagaaggattacctcggagacatcggtcgagctcaagattctatctgataaatggcggcttctcctcgctggcctcattttccagtacatacatggtttggccgctcatggggttcattatctgcaccggccgggccctacccttcaagatcttggcttcatgattcttccggagcttgggaaagaaaggggttacatcagtgagacattgtttacattcgtcttcctcaccttcgttttgtggacatttcatcctttcatccttcagactaaacgcttctacactgttctgatatggcgcagggtacttgccttcttatgtgcttctcagtttcttcgaataataacattctatgcaacacagcttccaggacctaattatcattgtcgcgagggctcgcctctggctagattaccaccaccccagaatgcagctgaggtctttctgattaatttcccaacaggagtcatttatggatgtggtgacttgatattttcatcccacatgattttcaccctagttttcgtcataacataccagaaatatggaagcataaggttttgtaagatgcttgcttggtgcatagctgttgctcagagtcttcttattatatgttctcgcaagcattacagtgttgacgttgttgttgcatggtatactgtgaatttggtcgttttctttgtggataagaagcttacagaacttcctgatcgatcagtgggatccacatcagtacttcctgtgagtgcaagggataaagataccaagttgaaagaagaaaataccagattgctgaatggtaactctatggattcagctgatcggaggccacgaacacaaatgaatggaaagcaaattgagaatgaaagccatgttgatagtgaaactgtgaaaacatgatcaactatcatggagggggttttgttagctaagagacgtttcagacgactaaagaagaaatatgggatgccatccgctttggtgcctactgcctagctccttgacgacttcatgaaatatagctacgaaggaaatagttttacatctcgctgttctaggcagcagaagttttgtttgcaaaactgtacatcttcctcagctctctcattgtaaccccttttctttctggtttctttcatttatttaccagcttggaattcagattatttatactagttgtgtatagttagcacaggttctttgcatgtgaacagtaatcatatggacaatataagattgttcttgttataagcaaaactttttattattcaactttttattgcaagtgaaacagccgtagtgtaaaaggatgaaagtggtgacacgttgtatactctttccccgtcccccgttatatctctttggtggtg

SEQ ID NO: 12576 - DNA, 1077 bp, Zea mays
aattttacaaagtaggcaagctcttgccttgctctttgcgagttttactgatgggtacgtacgatttctcaatgacaggtgtcaggagctgttacgatgagggcaagcgtacagctgaaacgttgaccatggattaccaccgtggtgccaaccttggggcctcgagcccgcgggtctcctcttcatatggccctcgcatgtgcattgacgatggccgtgttgtcagtaacttcgttgctcaggcactgaggaaggagcccttgacggtttatggtgatggaaagcaaaccaggagtttccaatatgtttctgatctggtcgagggtctgatgaagctgatggaaggcgagcatgtaggaccatttaacctgggcaaccccggcgagttcaccatgctggagcttgccaaggttgtccaggacaccatcgaccccaacgcacggatcgagttccgtcagaacacccaggacgacccacacaagcgcaagcccgacatcggccgtgccaaggagctccttgggtgggagccgaagatccccctccgcgagggccttcccctcatggtcaccgacttccgcaagcgcatcttcggcgaccaagacaccgcggctgccaccaccggaaaccagcaaggctaggacggaagaggagcacgggacttggaaatttttggtggcctgcttctagctgcttggtcgaccctcctctccttactgacaaaagctatggccatgtagttcgtcgggaatgtgtcgctgaaataccttggttgatgctgtaatgctattctttctcctgtattttttctctctcagttcgctcagccattagctatacaaaaaaaattccagttgaaccgttggggataaacctggatgatctaattctttgttgagagcatagcatcatatatatggtatagctcacttttttttgtttgcttttgcaagtgtgcccggccgtggtgggtctagttctttctttgttgacacgcggagaatgcctatcctgctcccagaaactatactagaacaaagaaacacagttcttaacaaaaaaaaaaaaaaaaaagcggcc

SEQ ID NO: 12577 - DNA, 1684 bp, Zea mays
ctcgaccccccgccgccacccccgcgagacctgtccgaatcgcgtccaggtccctcgctgggagtttcgccgagggccctcccgcctcccccctagattcacgacggagatggcgtccgagctcacctaccgcggcggcggggcgttcacggccgccagcgccggcgccgggggctactccccgaagccgtccaagccgcttgcgtggctgccccgcgcggcccgctacgccgtcgccgagaaccgcccgctcttcgcgctcgccgggatgctcatcgccgccgccgtcatctccatcgcatccccgtccgcctcctcctcctcctcctccgccgccgcctcgtcctactccaacaacaacccgctcgcccgtttctccgtcgagcccgcccaccaccgcgacgtggccacgcggcacttcgtcggcggcaaggtgccgctgggcctcaagaggaaggtgctccgcgtcctcgtcaccggcggcgccggcttcgtcggcagccacctggtggaccgcctcctgcagcgcggagacagtgtcatcgtcgtcgacaacttcttcaccggccgcaaggacaacgtcctgcaccacctcggcgaccccaacttcgagatgatacgccacgacgtcgtcgagcccatcctgctcgaggtcgaccagatctaccacctcgcctgccccgcgtcccccgtccactacaaatacaaccccatcaaaacaatcaagaccaatgtggttgggactctgaacatgctcggattggcaaagaggatcaatgctaggttcctcctcaccagtaccagtgaggtctatggtgatcccctccagcacccgcaggtggagacttactggggcaatgtcaatcccatcggtgtcaggagctgttacgatgagggcaagcgtacagccgaaacgttgaccatggattaccaccgtggtgccaaccttgaggttaggatcgcacgtatcttcaacacatatggccctcgcatgtgcattgacgatggccgtgttgtcagtaacttcgttgctcaggcactgaggaaggagcccttgacggtttatggtgatggaaagcaaaccaggagtttccaatatgtttctgatctggtcgagggtctgatgaagctgatggaaggcgagcatgtaggaccatttaacctgggcaaccccggcgagttcaccatgctggagcttgccaaggttgtccaggacaccatcgaccccaacgcacggatcgagttccgtcagaacacccaggacgacccacacaagcgcaagcccgacatcggccgtgccaaggagctccttgggtgggagccgaagatccccctccgcgagggccttcccctcatggtcaccgacttccgcaagcgcatcttcggcgaccaagacaccgcggctgccaccaccggaaaccagcaaggctaggacgaagaggagcacgggacctggaaatttttggtggcctgcttctagctgcttggtcgaccctcctctccttattgactaaagctatggccatgtagttcgtcgggaatgtgtcgctgaaataccttggttgatgctgtaatgctattctttctcctgtattttctctctctctctctctcagttcgctcagcccttagctatacaaaaaaaaattccagttgaaccgttggggataaacctggatgatct

SEQ ID NO: 12578 - DNA, 1242 bp, Zea mays
  misc_feature (1182)..(1182): n is a, c, g, or t
  misc_feature (1210)..(1210): n is a, c, g, or t
ccggccggggaatgggtaaaaaatggatgagtatgcgagcattggggccctcgaggccggccggggccacccccgcgagacctgtccgaatcgcgcccaggtccctcgctgggagtttcgccgagggccctcccgcctcccctagattcacgacggagatggcgtccgagctcacctaccgcggcggcgggacgtccacggccgccggcgccggcgccgggggatactcaccgaagccgtccaagccgctcgcgtggctgccccgcgcggcccgctacgccgtcgccgagcatcgcccgctcttcgcgctcgccgggatgctgatcgccgccgccgtcatctccatcgcctccccgtccgcctcctcctcctcctccacctccacctccaccggcggcgccgcctcgtcctactccaacaacaacaatccgctcgcccgcttccccgtcgagcccgcccaccaccgcgacgtggccacgcggcacttcgtcggcggcaaggtgccgctgggcctcaagcggaaggcgctccgcgtcctcgtcaccggcggcgccggcttcgtcggcagccacctggtggaccgcctcctcgagcgcggcgacagcgttatcgtcgtcgataacttcttcaccggccgcaaggacaacgttcttcaccacctcaacgacccaaacttcgagatgatccgccacgatgtcgtcgagcccatcctgctcgaggtcgaccagatctaccacctcgcctgcccggcgtcccccgtccactacaaatacaaccccatcaagacaatcaagaccaatgtggttgggactctgaacatgctcggattagcaaagaggatcaacgccaggttcctcctcaccagtaccagtgaggtctatggtgatcctctccagcacccgcaggtggagacttactgggggcatgtcaatcccatcggtgtcaggagctgttacgatgagggcaagcgtacagctgaaacgttgaccatggattaccaccgtggtgccaaccttgaggttaggatcgcacgtatcttcaatacatatggccctcgcatgtgcattgacgatggccgtgttgtcagtaactttgttgctcaggcactgaggaaggagcccttgacggtttatggtgatggacagcaaaccaggagtttccaatatgtttctgatctggtangtctatctctggccaacatatattgaanaaaaaaagaaacccttgatttggcttttcctg

SEQ ID NO: 12579 - DNA, 5795 bp, Zea mays
  misc_feature (5670)..(5670): n is a, c, g, or t
  misc_feature (5780)..(5780): n is a, c, g, or t
cgcctttcttgatagttatttggctagtatcttagacccgtttgtttcctcttgctaaagtttagcactgcactttttagtttagctactaaagaaacaaacatggtgactaaaagtgttgtgctaaagtttagcacccattagcgctttagctccaccaaatatgttaaactacgctaaaactggtccctcaacccctttctcttacctcctccacccacaccacaccacctacttgtatccaaacaacccttaaatgctaaagtttagcgggtggaaaccccttatgctccgtttggatgttgatattggacaacaaggaattgaattgagctcaatattaaaccaaccatgatattgaaatgaaatgtaattttaattctattgtttgaatgtcactgaatttgaacttagaattgtgtggtctaattcacataataccatgggtgatgctctgtattgaaaagttgagtttcgagttgtagtctaatttccaaagaattgggtctctgattccaaatctcaattctatgcgcaaccaaacaacaaaaattttgagaaaatgatttcaactaccaattctgtgctctaatatctgcatccaaatcgggtattaaaatcatgtgagagcgagttttttaaagatgtcaaagatgctctcaattctaaccacctggcagcccgtgtagcacatgcccccaccgtcagcccacaacaacgagggtagccgccgacgaggccagtaggcagtggccacccacccctgtcctcctccgggtcgcacacctgtcccggcggcctcccttgcgcacccgatcacacgcacgcaccgccagtcaaagcccccacctcccggccagcccccaccgccccgcgaagactgggtccctgccgtccgccccacatccaagggccccgtatccctcctccggcgagccaccgctcccccgcccataaataccgcttcgctccccccgcggccggggccacccccgcgagacctgtccgaatcgcgcccaggtccctcgctgggagtttcgccgagggccctcccgcctcccctagattcacgacggagatggcgtccgagctcacctaccgcggcggtgggacgtccacggccgccggcgccggcgccggcgccgggggatactcaccgaagccgtccaagccgctcgcgtggctgccccgcgcggcccgctacgccgtcgccgagcatcgcccgctcttcgcgctcgccgggatgctgatcgccgccgccgtcatctccatcgcctccccgtccgcctcctcctcctcctccacctccacctccaccggcgccgccgcctcgtcctactccaacaacaacaatccgctcgcccgcttccccgtcgagcccgcccaccaccgcgacgtggccacgcggcacttcgtcggcggcaaggtgccgctgggcctcaagcggaaggcgctccgcgtcctcgtcaccggcggcgccggcttcgtcggcagccacctggtggaccgcctcctcgagcgaggcgacagcgttatcgtcgtcgataacttcttcaccggccgcaaggacaacgttcttcaccacctcaacgacccaaacttcgagatgatccgccacgatgtcgtcgagcccatcctgctcgaggtcgaccggatctaccacctcgcctgcccggcgtcccccgtccactaccaatacaacccccatcaagacaatcatggcctttctctacgaattccttcagttcagttccgttgcgttcatttcctttcctccatgaatgattcgtgattgatgcctggatcgcgatcgcttctatttttcttcttcttttggtgcctaaacaaaaatattttatattgttattgggatggacttggtttctattgctttttcgtggggaatttccaaatttgtttcttcctgcgggtttatcggttaacgcgcgatgcatctgaggaggaggatcgattcactactctttgagattccgtatccgtctctgaaatgggaatatgacaatttttttaaaatccggtaccaacaggtataaccccccagaactacgatttccttccacggaaggagaattttgtccggagctcgaatttgtgccacgtttcacttcgttttttggagttttctgctcaactgagggaaagcagagccaccagagcttggccgtttcagatctctgtctgctaggctgccctttgctcaagggcaatcctcccttttcattcaacgcaaaaaaaaagatctttttttgcgtctttctatgaaatctggtgacaaatgttcagttgaactcagattcttcagatgcaattgaagatctcaaatcatcacatcattttttctgtcgaaataatttatgtgtgtgtgtgtttttcttaaaaaaactgttttttatgcttctgaatgcttgctgcattttcccgtgcatttgaaacaggaaaaacgtactagcgaaagctatagctgtgatctgaactcaattgctccgtaccgttttactttgcttcatgatccgttaatgaaagcaaaaagtaagcgcacggtgcgcatggatctgggttagttatgtactttgcttacttctgacataaagggcgcatttcaattttcaacaacacaaaagttgacgtccaagtggcctttgccttttccgctttctaagcaacttcgcttactgttcacttcacgaaatttccttatgctttacttgttttgcaactgaatgtggagtagcaatgtaacaaagtgaaaaagggtgtctggctgattcatttagtttctgctcgttttgctttcttgagatggttcgtgttagccttaacctttgtgatagcacaagaccaatgtggttgggactctgaacatgctcggattagcaaagaggatcaacgccaggttcctcctcaccagtaccagtgaggtctatggtgatcctctccagcacccgcaggtggagacttactggggcaatgtcaatcccatcggtactagctcttctcgtttacactctctttgttgatctcttgaaattaatttcttgcagtgacaattaatcattcatttttcttagatctagcgtgatgaggttagctaattgttagttaggtcatgcatatgtcaaagacatagccggatcctccttttagcagggaactgtcagccccaaataaatgatctctcatgctcattctttctttgtcatgcttttgtatgacctttggagcgagcatagaccactgaggggttgtcctaaatatgttaccctgcagccatagtcttttagtgacatgattttggatgagcaaaaccacaaaaaggagagcaagggggagggagggaaatgcaagctggtggacaatgtactgttgcaaagaggacgggtctacgttgtcaaatctgtgcttatattttttttaccccgagctgtagaaagcaggaatgagcccttttcagaaaatagtgctggtccagacttgaagcttactgttgcatgaaagaggccttgtataagcaatatgcagaaaggcatttggaatcttactctcttgagatgctggccatggaatcttagcttggtgggttctggcatgctttgattctttttggtgggaagggaccatgttggtaggtggaatttggtccaagagggccactttgtggattccttttcaataaagcaagagggggggggacacaactatacttgaccagttatgcctaaccaaacacccaccaaccactgcacctaaaataatgaatgaagtttgttgagttattcacgtagtacttgttggctgttggatactcgttggattatttacaaagtaggcaagctcttgccttgctctttgcgagttttactgatgggtacgatttctcaatgacaggtgtcaggagctgttacgatgagggcaagcgtacagctgaaacgttgaccatggattaccaccgtggtgccaaccttgaggtaagtcaacgatccaaaatgtcggtttagtggatggaattccatttcatctgcgaccaagtatattcattttggtggtttctttctgtttcaggttaggatcgcacgtatcttcaatacatatggccctcgcatgtgcattgacgatggccgtgttgtcagtaactttgttgctcaggtaaatatgcgcagtgctgtctattctatctacagaacccaaaagatatgacaattggtcttgtatcacagaaattaaattacgtgcgattatggttgcaggcactgaggaaggagcccttgacggtttatggtgatggaaagcaaaccaggagtttccaatatgtttctgatctggtaggtctatctctggccaacatatattgaaaaaaaaaagaaacccttgatttggcttttcctgtggcctagtggcctagccagtggggcaggctctgaggaaggagcccttgacggtttatggtgatggaaagcaaaccaggagtttccaatatgtttctgatctggttgagggtctgatgaagctgatggaaggcgagcatgtggggccattcaacctgggtaaccctggcgagttcaccatgcttgagcttgccaaggttgtccaggacaccatcgaccccaacgcacggatcgagttccgcaagaacacccaggacgacccgcacaagcgcaagcccgacatcagccgcgccaaggagttcctcgggtgggagccgaagatccccctgcgtgagggccttcccctcatggtctccgacttccgcaagcgcatcttcggcgaccaagacgctgctgccaccaccaccggaaaccagcaaggttaggatgaaggagcgcacatgacatggaaatttttggtggccctgcttctagctgcttggttgctctctccttactgacaaaagctatgggccacgtagttcgttgggaatgtgttactggaatacctcggcacggctgatgctgtaatgccattctttttttcccctgtattttttctttctcagttctctcagtccttagctatacaaaaaaagttcagttgaacagttggagatgaacccggatgatctaattctttgttgagagcatagcatcatatatatggtataaatcctgtcattttgcaaaaatatgtatgcccttctgccatggttctagttctttgttgaagctaggcgtaggatgcctatcctgctctcaaaaactagacttggagcaaagaaacgaacgaacaagcagttgtgaagatgaaaacaagaacgtatctgggtgcaaaccaaccctttccatgcaaccgtgtaaatttctaatctgaataacccttccatgcaaccgtgtaaatttctaatctgaatcatatgatgttgatccaaaggaacgtgtggaaaagtgggaggagatttaaaaatgtgattaacaacgggcggttaaatgtaaaattatccacgtctccagatccccatgtttttacttcatttattagcattagaacaggatacctctggcgggctagcttccacatacatgcttgtcccgaggagctcctgggctgtcttcagccgcggcttgtcctggactcctggtagatgggcttgttcttcctgatctgttcatgcatcttgcacaagaattcaattcaaggatgtttttttattgaaaatgntatagatatgtttttttaccactgattcaaacttgtggatgtagcacctggcggccatggactcgccgtggccctcataatcgataccaaacacaacataccctgctgtngcaacttgatcccac

SEQ ID NO: 12580 - DNA, 2166 bp, Zea mays
  misc_feature (29)..(29): n is a, c, g, or t
gagaccattacttagaacatcctaacggnaaatttttctctacgaattccttcagttcagttccgttgcgttcatttcctttcctccatgaatgattcgtgattgatgcctggatcgcgatcgcttctatttttcttcttcttttggtgcctaaacaaaaatattttatattgttattgggatggacttggtttctattgctttttcgtggggaatttccaaatttgtttcttcctgcgggtttatcggttaacgcgcgatgcatctgaggaggaggatcgattcactactctttgagattccgtatccgtctctgaaatgggaatatgacaatttttttaaaatccggtaccaacaggtataaccccccagaactacgatttccttccacggaaggagaattttgtccggagctcgaatttgtgccacgtttcacttcgttttttggagttttctgctcaactgagggaaagcagagccaccagagcttggccgtttcagatctctgtctgctaggctgccctttgctcaagggcaatcctcccttttcattcaacgcaaaaaaaaagatctttttttgcgtctttctatgaaatctggtgacaaatgttcagttgaactcagattcttcagatgcaattgaagatctcaaatcatcacatcattttttctgtcgaaataatttatgtgtgtgtgtgtttttcttaaaaaaactgttttttatgcttctgaatgcttgctgcattttcccgtgcatttgaaacaggaaaaacgtactagcgaaagctatagctgtgatctgaactcaattgctccgtaccgttttactttgcttcatgatccgttaatgaaagcaaaaagtaagcgcacggtgcgcatggatctgggttagttatgtactttgcttacttctgacataaagggcgcatttcaattttcaacaacacaaaagttgacgtccaagtggcctttgccttttccgctttctaagcaacttcgcttactgttcacttcacgaaatttccttatgctttacttgttttgcaactgaatgtggagtagcaatgtaacaaagtgaaaaagggtgtctggctgattcatttagtttctgctcgttttgctttcttgagatggttcgtgttagccttaacctttgtgatagcacaagaccaatgtggttgggactctgaacatgctcggattagcaaagaggatcaacgccaggttcctcctcaccagtaccagtgaggtctatggtgatcctctccagcacccgcaggtggagacttactggggcaatgtcaatcccatcggtgtcaggagctgttacgatgagggcaagcgtacagctgaaacgttgaccatggattaccaccgtggtgccaaccttgaggttaggatcgcacgtatcttcaatacatatggccctcgcatgtgcattgacgatggccgtgttgtcagtaactttgttgctcaggcactgaggaaggagcccttgacggtttatggtgatggaaagcaaaccaggagtttccaatatgtttctgatctggttgagggtctgatgaagctgatggaaggcgagcatgtggggccattcaacctgggtaaccctggcgagttcaccatgcttgagcttgccaaggttgtccaggacaccatcgaccccaacgcacggatcgagttccgcaagaacacccaggacgacccgcacaagcgcaagcccgacatcagccgcgccaaggagttcctcgggtgggagccgaagatccccctgcgtgagggccttcccctcatggtctccgacttccgcaagcgcatcttcggcgaccaagacgctgctgccaccaccaccggaaaccagcaaggttaggatgaaggagcgcacatgacatggaaatttttggtggccctgcttctagctgcttggttgctctctccttactgacaaaagctatgggccacgtagttcgttgggaatgtgttactggaatacctcggcacggctgatgctgtaatgccattctttttttcccctgtattttttctttctcagttctctcagtccttagctatacaaaaaaagttcagttgaacagttggagatgaacccggatgatctaattctttgttgagagcatagcatcatatatatggtataaatcc

SEQ ID NO: 12581 - DNA, 1797 bp, Zea mays
cgggtgggcaacggggccctcgaggccggccggggccacccccgcgagacctgtccgaatcgcgtccaggtccctcgctgggagtttcgccgagggccctcccgcctcccccctagattcacgacggagatggcgtccgagctcacctaccgcggcggcggggcgttcacggccgccagcgccggcgccgggggctactccccgaagccgtccaagccgcttgcgtggctgccccgcgcggcccgctacgccgtcgccgagaaccgcccgctcttcgcgctcgccgggatgctcatcgccgccgccgtcatctccatcgcctccccgtccgcctcctcctcctcctccgccgcctcgtcctactccaacaacaacccgctcgcccgtttctccgtcgagcccgcccaccaccgcgacgtggccacgcggcacttcgtcggcggcaaggtgccgctgggcctcaagaggaaggtgctccgcgtcctcgtcaccggcggcgccggcttcgtcggcagccacctggtggaccgcctcctgcagcgcggagacagtgtcatcgtcgtcgacaacttcttcaccggccgcaaggacaacgtcctgcaccacctcggcgaccccaacttcgagatgatacgccacgacgtcgtcgagcccatcctgctcgaggtcgaccagatctaccacctcgcctgccccgcgtcccccgtccactacaaatacaaccccatcaaaacaatcaagaccaatgtggttgggactctgaacatgcttggattggcaaagaggatcaatgctaggttcctcctcaccagtaccagtgaggtctatggtgatcccctccagcacccgcaggtggagacttactggggcaatgtcaatcccatcggtgtcaggagctgttacgatgagggcaagcgtacagccgaaacgttgaccatggattaccaccgtggtgccaaccttgaggttaggatcgcacgtatcttcaacacatatggccctcgcatgtgcattgacgatggccgtgttgtcagtaacttcgttgctcaggcactgaggaaggagcccttgacggtttatggtgatggaaagcaaaccaggagtttccaatatgtttctgatctggttgagggtctgatgaagctgatggaaggcgagcatgtggggccattcaacctgggtaaccctggcgagttcaccatgcttgagcttgccaaggttgtccaggacaccatcgaccccaacgcacggatcgagttccgcaagaacacccaggacgacccgcacaagcgcaagcccgacatcagccgcgccaaggagttcctcgggtgggagccgaagatccccctgcgtgagggccttcccctcatggtctccgacttccgcaagcgcatcttcggcgaccaagacgctgctgccaccaccaccggaaaccagcaaggttaggatgaaggagcgcacatgacatggaaatttttggtggccctgcttctagctgcttggttgctctctccttactgacaaaagctatgggccacgtagttcgttgggaatgtgttactggaatacctcggctgatgctgtaatgccattctttttttcccctgtattttttctttctcagttctctcagtccttagctatacaaaaaaaaagttcagttgaacagttggagataaacccggatgatctaattctttgttgagagcatagcatcatatatatggtataaaccatgtcattttgcaaaaaaaaaaaaaaaaaagcggccggaaaaaaaaaaaaaaaaaagcggcc

SEQ ID NO: 12582 - DNA, 1805 bp, Zea mays
ccgaatcgcgcccaggtccctcgctgggagtttcgccgagggccctcccgcctcccctagattcacgacggagatggcgtccgagctcacctaccgcggcggcgggacgtccacggccgccggcgccggcgccgggggatactcaccgaagccgtccaagccgctcgcgtggctgccccgcgcggcccgctacgccgtcgccgagccattgggtacctcgaggccggccgggatgctgatcgccgccgccgtcatctccatcgcctccccgtccgcctcctcctcctcctccacctccacctccaccggcggcgccgcctcgtcctactccaacaacaacaatccgctcgcccgcttccccgtcgagcccgcccaccaccgcgacgtggccacgcggcacttcgtcggcggcaaggtgccgctgggcctcaagcggaaggcgctccgcgtcctcgtcaccggcggcgccggcttcgtcggcagccacctggtggaccgcctcctcgagcgcggcgacagcgttatcgtcgtcgataacttcttcaccggccgcaaggacaacgttcttcaccacctcaacgacccaaacttcgagatgatccgccacgatgtcgtcgagcccatcctgctcgaggtcgaccagatctaccacctcgcctgcccggcgtcccccgtccactacaaatacaaccccatcaagacaatcaagaccaatgtggttgggactctgaacatgctcggattagcaaagaggatcaacgccaggttcctcctcaccagtaccagtgaggtctatggtgatcctctccagcacccgcaggtggagacttactggggcaatgtcaatcccatcggtgtcaggagctgttacgatgagggcaagcgtacagctgaaacgttgaccatggattaccaccgtggtgccaaccttgaggttaggatcgcacgtatcttcaacacatatggccctcgcatgtgcattgacgatggccgtgttgtcagtaactttgttgctcaggcactgaggaaggagcccttgacggtttatggtgatggaaagcaaaccaggagtttccaatatgtttctgatctggttgagggtctgatgaagctgatgggagccgaagatccccctgcgtgagggccttcccctcatggtctccgacttccgcaagcgcatcttcggcgaccaagacgctactgccaccaccggaaaccagcaaggttaggatgaaggagcgcacatgccatggaaatttttggtggccctgcttctagctgcttggttgctctctccttactgacaaaagctatgggcctcgtagttcgttgggaatgtgttactggaatacctcggctgatgctgtaatgccattctttttttcccctgtattttttctttctcagttctctcagtccttagctatacaaaaaaaaagttcagttgaacagttggagataaaccaggatgatctaattctttgttgagagcatagcatcatatatatggtataaatcatgtcattttgcaaatgtatgtattcccttctttggtgggtctagctctttgttgaagctaggcgtaggatgcctatcctggtctcagaaactagacttgagaaaagaaacgaacgaacaagcagttgtgaagatgaaacaagatggcaggctagcttcgacatacatgcttattccgagcagctcgtgggctgtcttcagccgcggcttgccctggtagatgggcttgttcttcctgatctgttcatgcatcttgcacaagaattcaattcaaggatgtttttttt

SEQ ID NO: 12583 - DNA, 2186 bp, Zea mays
  misc_feature (7)..(7): n is a, c, g, or t
gccgggnaaggggccaccgatcccgacgacgacccaacaaagtggcagccagaaaactcggcagagcatctcgcttgcgaaacaaaggacggcgcgcgagaggaggggaaaggaaaacaaccaccacgaccccgtccattccgttccacttccacccgagctcagcgatcgcggcggcggatgcggatggggaaggggctgtcgtcgcgggcggggtcgcggcaccggcagttccgcgcccgagccatgacccgcgtcgacgacctccaggaggtcttctcgggcctgcagtccgcgcgcaaggactcacgctccgcggacgccgccgtcctcgaggcgcagctccagcagatgctgcgcgagtggcgctccgagctcaacgctccctctcccacctcctccctgcagggcaacgccagggaactgtcggatccgccttcggatactcttcgtctactgcagttggtggtggccgaggaggaggatgacgccacgagcaagatggtcgagcagcagcagcagcccccacctccgctcccagctaaccggagccagggccacgcgcatgttgtgtgccagggcatgaagccggagccgcacgaggaagcagttgacgttgctgtggaccagccgcagctgctgagtcagggggttctgcctaatggtgctgctaccgcgtctgcggtgttccatgatcagctgtactatgtgaaccaggagctcacggtcgaggattttctttatgatgatgattacaagatagatctttctgggtctaatctggatgtcattaataacctagaagggattgttcagctggaatatccagatcacaatttgccgcaagggttagcccctaatgcataccttgacatgaatagttgtgggcagagtgccggggctgttttcctgcacatgccagatttgctcacaacaatgacttcagcaccttctgcattcctgaagccaaaatgcgctctctgggactgccccaggcctgctattggatcagaaagatggcataattattgcagcatgtatcatgctgatttggctgtgcaggaagagggccctccgggcacaatgcctgtgatccgtccaagaggcattgatctgaaagatggccccctgtttgctgctcttagtgcaaaagtccaaggaaaaaatgttggggtccctatctgtgaaggagctgccactgcaaagtctccatggaatgcacctgaacttttcgatctttacatatttgaaggtgaatctatcagagaatggttgttttttgacaaaccaaggagggcatttgatagtggaaatcggaagcagcggtccttgccagactacaacggccgtggttggcatgaatctaggaagcaggtgatgaaggactttgggggtctgaagaggtcctattacatggatccacaaccatccaacagctatgaatggcacctatatgaatatgagatcaatgactgtgatgcttttgccttatatcggcttgaattcaagtcttcagatgcaaagaaaattgcaaaatccaaattaggttgtaatccactgaatgaaattcagcagcaaatggatagactcagtgcagacagtcctgtcgacaccaaacggacggcccggagccggacagagcctaacccgatagatgtcaatactaacatctattcagttccaaacaccacagttcaaactgatgttccaaatgcttatcagccagggtcacaagtggaccagatgacatatttgaacggtagtgtcgtttatgggcctcatctgccgtacggttactcgactgaaagaagtgacttctattggaactcaaatgatgggacatgagaagatataaacacatgttcgatttatggcatatttggccttcaagttctaacaattcccgttatgattattgggtcaaatctattagcatgacccccatcttcttgtaattgtagttggcccaatctacaggaaacatctctgaaacaagggatgccaataggcaatactgcagttctattttctgtggcaactttgtcgttgtaatatagccatatcatgataatagcaccctcctcgatgtgcagctgtatgtaacatatatctctggcttggtggacgataaccgttaaccagtcacgttggtgcctccatttatcggttacgttgtatgtgtaccg

SEQ ID NO: 12584 - DNA, 1706 bp, Zea mays
gaaaaatagggacaccacatcattgccatccgcatttcgtcctcatgttcttgttaccttgtgtccctcgagccccccggggccgctccctattcttcttctcttcaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagatttcagtatctacttggacatcagtgatgaagttaagtttgcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatccctcttgaagagagtgagaactcgatagatcaagaatcaccacacgttgtattaatcgtatggtataatatttatacatgtacaggatgagctatgcaaaaaaaaaaaaaaaaaaaacgcccccaaaaaaataaaaaaaaaaaaaaaaaagcggcc

SEQ ID NO: 12585 - DNA, 2473 bp, Zea mays
ctggtaagcttttccttagtgacttgtgccttcacatggtactggtgtacgtttttgccaccgcttagcctccgtggaatgcacctgaactgttcgatctttacatctttgaaggtgagtctatcagagaatggttgttttttgacaaaccaaggagggcatttgttagtggaaatcggaagcagcggtccttgccagattacggcggccgtggttggcatgaatctaggaagcaggcgatgaaggactttgggggtctgaagaggtcctattacatggatccacagccatccaacagctacgaatggcacctctacgaatatgagatcaatgagtgcgatgcttttgccttatatcggcttgagttcaagtcttcagatgcaaagaagattgtgaaatccaaattagcctgtaatccactgaatgaaattcagcagcaaatggttagactcagtgcagacagtcctgtagacaacaaacggacggcccggggcaggcaacatgctaacccgacagatgtcgatactaacatctattcagttccaaacaccacagctcaagccaatgttccaaatgcttatcagccagggtcacaagtggaccagatgacatatttgaatggtagtgtcgtttatgggcctcatctgccgtatggttactccactgaaagaagtgacttttattggaactcagctgatgggacatgagaagatgaacacatattcgatttatggcatatttggccttcaaattctaacagttccagttatggttattgggtctactctattagcatgaccctcccatcttcttttaattggaactggtccaatctacaggaaacatctctgaaacaaaggatgtcaatactgcagttctattttctgtggtaacttttgtcgctgtaatataggtgtatcttgaaaatagcaagcaagcatctccccgatgtgcatgcagctgtatcatatgcaagataaatctctggtttggtggactggtaacctgtcacgctggtggttccatttatctgtcacgttgtacgtgcatcaatacatcctgttctgaatctggtgggtgcaatctttatccgcaaactccaattatgctcttgaaacgtccctccattttgcagctgcaggttcgtgattaacatgtgttgtttggaagccaggagattagagtgtttggaagtcaggagattagagggaattgaggcagatacaatccctaactattcaaaattaaataggagattgccgatcccccttcatcccttggcccacctctcgtggcgtcactattttctcgcccagacgcccgagcgcctccgtccctccctcatcccgtcgtctcatctcatgattcacctcccgccattgaagaaaaagtactagtatagaagggaggaagagacggacgggatagatacagtttgcatgcaggcggtaacgccagaggcagaccgtgaaccggacagcccgtcccagaaagcgaagcgaccgagtgccggcccggtgcgtgaggtgaagtcacggtcaaagcgagccgccccgggcgttggcaggctgcaaaggtagctttgtcacaaacaagcccgtaggtagctttgtcatagcaacaaaagccgacgctagagaagtccctatatgatgaactgataaacagcgaatggatgttttttgttttgaaatgctgtcatgctggagcggctgatgccaaacgactgtcgaatacgtttgttctgatagctgctgcggctgatgcccgtctggtgaattgtgagtagagaatagttttgcttttggctggttagtgaccgatgccaaaatgaacgggcccagtgaacacagatggcacagagccatcacgagttcgttatgggcctatggtcccagcggtctcgctctgaaagagatgttattcttccatgtccatctcccgacgaggcccaagaggccaagattcgggtgggatcattacggaatccgcctcgatagagaaatataccaaggtcatgttcatttggtggtcatgattattgtggatgctcataaaagaaaaggtgggatgctttatcatttcaggcaacgacaagaaccgccgaaaaaaagtattttattttatgaaatacgtacgggtatcaagtaaaataaatttcgaaacacttttcttggggaattcatccgtcaggtggtttacctgcttgttatgttctctactctaatctctctactcacgatcatgggtctatctctcgttttccgatttgctctgcgtaccagttcaggaaccagtccgcgagagtgcaacagaacaaaaaggtaaggcaggcaccgaacattgtgatatatacccacgagtaatgcacaggtcggttaatcgcatttacctttaaaatctgtttacaaaaacagagttccaatgaaacacaaaataatataaaaatgtagaaataaaaactccaacaaaa

SEQ ID NO: 12586 - DNA, 2218 bp, Zea mays
ttgggtacctcgaggccggccggggttgctgtgatctctctttctcccgcgatcctgcacctttccctcctgtccaagatttccctcccctctaataattcacctgaagtggagttcctgatgcttattctggcgtccgcctagcggcgccgcgctgctacgtcctccctcgcgtccgggcttctggtgtgggtgttctgaaacaatacgacttctgcccacgcgccgcccccccacactccgcccgtgctgtccatttgcttgaatatattctttttcgttgtcatgtgtgccgtgggaattgctccattcgattggtaagtgctcgtctctgaccatgcagcctctcatccggattggattggttccggctgttgcttgctccaggaagaacactggacatggacttcttcacggaatatggggaggcgagtcagtatcaaatccaagaggtcattggtaagggaagttatggagtagttgctgctgcaattgatagtcacactggggagcgggttgcgatcaagaagataaatgatatttttggtaatgtctcggatgctgctcgcattttgcgggaaatcaagcttcttcgtctgcttcgtcacccaaacatagtccagattaagcacattatgttgccccctacccgaagggagttcaaagatatctatgttgtttttgagctcatggagtctgacctgcatcaagtgatcaaagcaaatgataacctgactccagagcatcaccgctttttcctgtatcaacttattcgtgctctcaagtacatgcattcagcccatgtatttcatcgtgatttaaagcccaggaacatactggccaattcagacagcaaactaaagatctgcgactttggacttgcacgtgcatcatttaacgactctctttcagctatctattggacagattatgtcgcaacaaggtggtaccgggctcctgaattatgtggctcctttttctccagttacacccctgcaattgatatttggagtatagggtgcatttttgctgaagttctcaccggaacgccattgtttcctgggaggaatgttgtgcaccaattagacttaataacagatctccttggaacaccatcgtttagatccttatcccagattcacagtgataaggccagggaatatttgcttggcatgccgaggaagcgccctattccattttctcataagttccgtaatgccgatcctctggctctccggttgctagagcgtttacttgcatttgacccgaaagatcgacctactgctgaagaggctttagctgctcgagccatacttcagtggcctttctaaattggaacttgagccttcagcacaaccaatttcgaaggttgactttgaattcgagggaaggaaactaacaaaggctggtgtgagagaaatgatatatcgggagattttggagtaccacccccagatgcttcaggagtacatcgaaggtggagatcagattcacttcctatacccaagtggggtcgatcgcttccagcgacagtttgctcatctcgaggagaactacaggagaggagtagcaagcaccccgccgcgaaggcagcccacatctctgccgagagagcgagtctgctcatcagaagatggccacagtcaggactctgacagcgaagagcagagagcagcatcctacgttgcccgaacaaccataagccctccaagatcacaagaggagggcggcaagctccagcctgcctaccagagcgccgccgccgccgcagactcctgcgccaagagctatctgaagggtgccgctagtatcagtagtgcttccaggcgtaccatcaagggggataatggccgaaaggagaagggatctccgaggctgtgaaagaggtggcgcaggctcgtgacctgttaggcaaaagaggtagcaacggcgccaatgcgactgcaacgtgagatgtcttagtcatcacgcatccaacaatgcaggagcacggagcaccacctcacccccccccccccccccccagtacaagtatgcaggtcatcctagctaggtcgcccaaattaaagcagcctgcttggaggaattagatttgtgtactgttaagtttttttttttggaattcaactgctagattctggcagatctgtcaaccgcactcgccttggtttcccaaaatttcctggtttgaacaagtttaaaaaaaaaaaaaaaaaaa

SEQ ID NO: 12587 - DNA, 2201 bp, Zea mays
cattgggtacctcgaggccggccgggaccgcacgtccgcacgccgctcttcttcccctgcttgctctgggttcctccattcctctccagtctccatcacaggagcacgcgacgcgcgccacaggaaggaagggaaaaaacatggcggcggcgaacggggacgcgtgccgcagcgtcggcggggtgccgcgcccgacgaaccccatggtgacgccgctgctcaccgacctgtaccagttcaccatggcctacgcctactggaaggccggcaagcacctcgaccgcgcagtctttgatctctacttccggaaaaatccatttggcggggagttcaccatcttcggtggcctcgaggaatgtataaggttcattgctaacttcaagttcacggaggaggaaatcaaatttcttcgatctgtcatgcctgcatgtgaggatgacttctttgagtacctccgttcgattgactgctcagacgtggaggtttatgccataccagagggttatgctgtgttccctaaagttccactgatgagaattgaaggacctgttgctgttgtccagcttcttgaaactccatttctaagtcttgtcaactatgcttctctggttaccacgaatgcggcacggcaccgacttgtagctgggaagtcaaagaatttacttgaatttggacttcgacgggctcaagggcctgatggaggaatcagtgcatcaagatattgttatatgggaggctttgatgcaacaagcaatgttgcagcaggaagattgtttgggataccaatacgtgggactcattcacatgcatttgtgagctccttcatgggtcttgatgaaattactgacaaaacacttactagttctgatggttcaaacacatgtgaagattttatctctctggtgcagaactggctgatcaggattcaggattctagttcattgcatggcacctttggagaaacgagccaaagtgagttggctgcattcacgtcatatgcactggcatttccaaattccttcctggccttggttgacacatatgatgtcatgagaagcggagtgccaaacttctgtgctgttgctttggccctcaatgatatggggtataaggcagtcggaattaggttggactctggtgatttagcatacctatccgttgaggcccgcaagttcttccatgcagttgaaaaagaatttgtagttgttggctttgggaaaacaagtatcacagcaagcaatgatcttaatgaagaaactatagatgctctgaacaagcagggccatgaggtagatgcatttggtattggcacctacctagttacatgctatgcacaagctgcacttggttgtgtattcaaattagttgagattaacaaacagcctcgtattaaactttctgaagatgtcatgaaggtatcgataccatgtaagaaaaaatgctacagattgtatggcaaagaagggtatccgttggttgatataatgaccggagaagatgagccaggtccaaagattggtgaaaggctcctatgtcgtcaccctttcaatgaatcaaagagagcgtacgttgttccacagcatgttgaggaattattgaagtgctactggcctggaaattcatcgaattcacgggaggagcttccatccatccatgagattaggactcggtgtattcaccatctggaccgaatgaggccagaccatatgaggcggctgaacccgacgccttacaaggtaagcgtgagtgctaagctgtatgacttcatccatttcttgtggctcaacgaagcgcctgtcggagaactgcaatgatgaaatgaagtggcggtagggtcggatcccaaacctaactctaataagctgctccgcttatgggtgccgtcggagcaaataacaaactgttgccgccggtgcaatttctgcagtagttttaccatcgcctgcgctctagtaaaatgtgagtatgtgctggtgcatctgtcaaaacagaccatagctgaagtgttacgtactgggaacaagaggatacccataccgagttagatctatatgactgaactaattgcaatgaggagcaatcactaaatttgagacaaatttacttgtcttgtcaattaccctaccattctcctctgcggcattttatgctttttactgaaccccagttagactgttaaaaaaaaaaaaaaaaaagcggcc

SEQ ID NO: 12588 - DNA, 3540 bp, Zea mays
tatcctaggaatcataactaatagcaatatgagcaacaatcaaatctaattaatcgaaaccatacaacgcaatatacgtaacaaatgaatgtgagacaccataccttgatctacagagttttccaactcgaatacaaagattggagcacctctgggtggtatggaagaagattcaaatggttgggcgcagctctcggccaggaaataactgatttataggtcttcctagctcgacgacaagatctgtgacgtctagctctgcgccaagatctgtagcgagctaggtgctacgtcggcgccgcgtcagccctcggcaccagcggggcaggttacctcggcgtcacgatctatagggccgagcgaagggtccaaatgcagaaataagttgtctaggggtataaacgtgaattttttttaaaaaaagaccgaaatacagaaaagttcggcaagaaattacgtactgacatgattttctgaagacggaaacatgtgtggcatggccacaaaagaaggggaaaaaagaagaatggtgtatttgcaagcttttggattctttcatgaactgccaattgctctcccacgcatgtcaaagggcaggtgacctaagaaaaaccttctggctgctggagtgcctgctgccggcttctagcttcttctccggcgtcatcgtggtggtggcggtgttgggatccaatgcttgcgttgcgtccctctgcacgcacccagctcgtcgcggcggccaaattttgtatggttttggtcggcgtctccacgtaggtctccactgtgatgatgatgcagactgctctgtttttctgaacggatctttctgacgattcatcggttgaagtggtatccactgtgaatatgcagcaggcagggcaagcgatcccgtccggaccggccgagtgcagcgcagtgacatcatcgcgcggaacacggttgctgactgaatcggacagggacagcacagggattcggagtgaagaaaaatcactgtatttgtttgcctggcgaggtgcatttatttagatcaaaattcagtggataaagatcaccgaaaagcaaaagcaaaggcttctttgttcactggataaagatcaccaaaaaaaaaagaaattcccaaacagaagttagaaacaaacacagaaatccccagacaaaaggtcccttgtcagatcaaacaagaaactaactggtgcagaaacaagttaccgcagccagaagcccagaactaggggcgcaggaggcggagagcggcagaacagctcatgaagcccatcacacattgtttgctcgtcaaacaaaagaattcatatagatgatgatgacaataatgactcttctcccgacggataatgaatcctgtggtatcatggaatcaaaatttgacatgccaaaaattaataaaccttgtctaccatgcctacattccctgctacaaaacttcgatttttcttcttcggggacatagagataacttcactgctcatatcaaggaacgggcggcccggcacgagactaaaattctggagaacgaaagaagcaatcgtttgacctcagcgtctgccttgctcaggcaacgtaaccctcagcagacagcagctgccttgttcgggcactccgacgagagatggccagcgatgccgcactcgtagcatgtccgcctctttctttttctttgcaggtgcagattttgcgtcctcactgcccttcttttcgtcagaaacgactggtagtacagcgtttgagtgattgccaggcttctcttcgttgcagacaggctcagcggccttgtttgctggggcaagccgaggagagatgaccggagatgccacactcgtagcatttccgcctcttcttcgaagctactgaattcgattcatcaccagcttttgtttcctcgggcatgatggtggttgcaggttttgcgtcagcaggctctctgttgttcagaacagattctgatgtccttttgtttgggcaagccgatgagagatggccaggagtaccacattcataacatgtccgcctcttcttcgacgatgcaggagctgaatcaacattagtgttcttttcatcagaaataaattcaggatccttcttgtttgggcaattagaagagaggtgcccagggatgccacattcataacatgttcgcctcttctttgaggctgctatggtggagttagaattatcctccttttcatcagaatccttcttatttgggcaagcagaggacaggtgcccagcggtgccacattcatagcactttcttacttcagaatccttcttatttgggcaagcagaagaaaggtgccccggggtgccacattcatagcacttccttccttcagaatccttcttgggggggggggaagaagaaaagtgcccaggggttccgcattcatagcatgtcctagttttacttttcagatgatctgagttcccattgtcattgactttttggttatccttttttggaacagcacatctgattctgactgggcgttccttgatcaccttctggtcgagcttcaaagcagcagcaagagacgcgctgtcagaaaaatcaacatgcgcgtagcctttgaaaccacctgtctccttgtctgtcccaaaccggatggatgaaattttgcactcggagaagaacttttttagatcatcatctgttatatcccatggcagatttccaacatatatcctattatacccctctatcaactttggtgcaaaatcttccttctcacggttatgtttgtaaggctgaattttcaaataaaatcctcccctgaaatggttatcaagaatgtcactaccatgattagaacaatgtgggatagcacatagaaggatgtatgcttacatatctgcaccatccatagctaatgccctctgtgcggcagcatcagtctgaaaaaaaagaaccgttagtcagatacctcaccacctcagactacaatttccaaaaaaaaggtaaaacacatagaagttaatttatagcaagccgtatgaaaagaattgtggatccagtctatgcagatattctagttgatttctatgattctgtggaattaacatggaagttaagatcatacaattccaacctgaagcatccaacttaatccgccgaacatacagtttgcatagttgttaaggcgtcctaaggtgtcgctcaggcgacgcctaagcgctaaggcgtgtgaaaaccttaaggcgtcttggtcgccttattttggagcctaaggcgtccgctttggccttgtttgtttggaatttttttagcttatgacaaccaaaagctgttgcggactgtcaaacgccccagcttttcagtccgcttttataagaatcgttttggtaaaaaccgtccaaaatcaacatgagcacagaatcggtcgagtcgtcaaccgtccaaaatcaacatgaacacagaattggtcgagtcgtcacgatagtagaaatccatcgctttctagatcctagaccctttggaccacttcatcttcctccgcacgtaatctccacgatactcag

SEQ ID NO: 12589 - DNA, 1241 bp, Zea mays
  misc_feature (1180)..(1180): n is a, c, g, or t
  misc_feature (1183)..(1183): n is a, c, g, or t
  misc_feature (1188)..(1189): n is a, c, g, or t
  misc_feature (1198)..(1198): n is a, c, g, or t
  misc_feature (1207)..(1207): n is a, c, g, or t
  misc_feature (1213)..(1213): n is a, c, g, or t
  misc_feature (1215)..(1218): n is a, c, g, or t
  misc_feature (1220)..(1220): n is a, c, g, or t
  misc_feature (1222)..(1222): n is a, c, g, or t
  misc_feature (1227)..(1227): n is a, c, g, or t
  misc_feature (1230)..(1235): n is a, c, g, or t
  misc_feature (1239)..(1240): n is a, c, g, or t
gggggggagagccctatattgggggggccccccttttttttttttccccctttttaatattattctattttttttttttttttttttttcaaacaaaagaattcatatagatgatgatgacaataatgactcttctcccgacggataatgaatcctgtggtatcatggaatcaaaatttgacatgccaaaaattaataaaccttgtctaccatgcctacattccctgctacaaaacttcgatttttcttcttcggagacatagagataacttcactgctcatatcaaggaacatacagtacaacacaacgagactaaaattctggagaacgaaagaagcaatcgtttgacctcagcgtctgccttgctcaggcaacgtcaagtgtcattaaacctcagcagacagcagctgccttgttcgggcactccgacgagagatggccagcgatgccgcactcgtagcatgtccgcctcttctttttctttgcaggtgcagattttgcgtcctcacttgccttcttttcgtcagaaacaactggtagtacagcgtttgagtgattgccaggcttctcttcgttgcagacaggctcagcggcctgtttgctggggcaagccgaggagagatgaccggagatgccacactcgtagcatttccgcctcttcttcgaagctactgaattcgattcatcaccagcttttgtttcctcgggcatgatggtggttgcaggttttgcgtcagcaggctctctgttgttcagaacagattctgatgtccttttgtttgggcaagccgatgagagatggccaggagtaccacattcataacatgtccgcctcttcttcgacgatgcaggagctgaatcaacattagtgttcttttcatcagaaataaattcaggatccttcttgtttgggcaattagaagagaggtgcccagggatgccacattcataacatgttcgcctcttctttgaggctgctatggtggagttagaattatcctccttttcatcagaatccttcttatttgggcaagcagaggacaggtgcccagcggtgccacattcatagcactttcttacttcagaatccttcttatttgggcaagcagaagaaaggtgccccggggtgccacattcatagcacttccttccttcagaatccttcttggggggggggcntgnagccnngggggatcncactagttntagagngnnnnananttaanaannnnnnaaanna

SEQ ID NO: 12590 - DNA, 1373 bp, Zea mays
ccgtacaccatcggcgcctccaggccggccggcaaccacccgttccgcgcccgtcctcgaccctcccacctattcgctcgctcgctcgccgtccgcgcccgcgcgggccgcgagatctaggccagtcgccgcggccgtggccgcgggctgacgggatctctgtcctcccgacacgacgaacctctaggaaggcgcctaagacgaggaggaagcgggggctatggaggcgtcttcctgggacgccgttcgcaagcaggcaaggaggttggaagctcagttagatgaccaaatgattgcataccgtaaattggtttctatgaaatcagacggttcagaggacaacattgagtctgatatagaaagatcactgaagcagttacagcaagtgaattcgcaaatgcaaacttgggtatcatcaggaggttctgaagttctttctcatactctgactcgtcatatggagattttgcaagaccttactcaggaattctatcggcttcgatcaagtctcagggcaaaacaacagcatacttctctccttgacttgagagattttgacagagcaaagtttgatgttgaggagccgtcagactcagctgatcaagttcttctcagggaacaagctgcgattggcaggagtactggacagatggataacgtgatatcacaagctcaggcaacacttggttctctcatgacccaacggtcaacattcggtggcatcactacaaagataagcaacgtcagcagccagcttccaacaattaaccacgtcctctcatcgatcagaaggaagaaatccatggataccatcattctttcgctcgttgcatctgtctgcacgtttctcatcttcatctactggctgtcgaagtaggtttaccagagcaaagatattacagtgttgtaagcttgggaccacaccaccagtaccggtacagatagtcttcattggtgtttgtacaatattattggttgattgaatgctgttacgattcgggcgtgctgtagccaccgtgtctccagctgtgcaactgctgccaatactgtgaactgaactctgtacctcgtgtacttcggcataactaagggtggagcaactggcgttgctttagctgccccatgttggcatgttgctcagatgtcggcttaaaggtggatcttcacctatgactatagttgacaatataggctctatattttatacaataaaatataaggatgaggctctatttgtttttatttttgaactaaaaataatttagaaccctatcaatttgtaaagaaacatttggatcacgatctattaccacccctacctatgtcgtaagcctctgttatcagacattttcgagtcaaaaaaaaaaaaaaaa

SEQ ID NO: 12591 - DNA, 1168 bp, Zea mays
gccggccccgcgccggctccccttcgccaaacacatcggcgcatcaaccaccccttccgctcatcctcttccctcccaccgattcgcccgctggctcgccgcccgcccgtagcctgcgcccgctcgagatctagaccagacgccgcagccgcggccgcgggctgacaggatctctgtcctccctacgcggcgaaccgctaggacggcgccgaagacgacgagggagacggggtcatggaggcgtcttcctgggacgcccttcgcaagcaggcacggaggttggaagctcagttagatgaccaaatgatcgcataccgtaaattggtttctatgaaatcagatggttcagagaatgatattgagtctgatatagaaagatcactgaagcagttgcagcaagtaaattcgcaaatgcaaacttgggtatcatcaggaggttctgaagttctttctcatactctgactcgtcatatggagattttgcaagaccttactcaggaattctatcggcttcgatcaagtctcagggtgaaacaacagcatgcttctctccttgacctgagagattttgacagagcaaagtttgatgttgaagagccatcagactcagctgatcaagctcttctcagggaacaagctgcgattggcaggagtactggacagatggataacgtgatatcacaagctcaggcaacactaggttctctcatgactcaacggtcaacattcggcggcatcactacaaagataagcaacgtcagcagccgacttccaacaattaaccatgtcctcgcgtctatcagaaggaagaaatccatggacactatcatcctttcccttgtcgcatcagtctgcgcgttcctcatcttcatctactggctgtcgaagtaggtttaccaaagcaaatgtattacggtgttgtaagcttgggatcacactaccggtacagatgatcgtgattggtgtttgtacaatattggttgattgaatgctattacgattcgggagtgctgtagtcaaaaaaaaaaaaaaaagtgattgattgggcgcatggattgagttggcctatcagcaacttatattataatggagggaaaaaatcatttggtgctattgcacgaagaacatggaaagtgggcctactatgaacaagctatttttcagattg

SEQ ID NO: 12592 - DNA, 636 bp, Zea mays
acgccgcgatcgtcgcccccccggccgggccggccggtcagtcacaacgccctcctcttcttgcaggcgctgctgggctccgtgccgctggtgcacgtggaggacgtctgcgaggcccacgtcttctgcatggagcaggagtccatggccggccgcttcctctgcgccgccgggtaccccaacatgcgtgacatggtcgaccactttgccgcaaagcaccccgacctcaagatacagctgactcaggtgaccggagaaggtgtcaggattcagcccaacaccagcaagctggaggacttggggttcagattcaagtacggagtggaggagacgctggactgcagcgtcgagtgcgccaagaggctgggagagctctagatgcatgctacacatgcatgcgcagcattggaattcagcgactgtgatacgagtaagtatggtggtatcatgttaatacgtgtgtatattgggtcgattcatcccaccagagtttgaactgttccatattcccatctgtttcccgtgatcataaaataaaaacagtaaaatacatcaacggtcatcaaaatcaagcggccgtattacttggccccctaaagccttaaaaaaaagaaaaagaaaaaaaaaaaaaaaaaa

SEQ ID NO: 12593 - DNA, 1461 bp, Zea mays
ctcgaggccggccgggagacgtctaggccataaaagcgctgcggcccacctcgccggccggggaaaaaaaggaaggggagaagagctagagggatgggtggcggcacggtggtgtgtgtcaccggcggcagcggctacctcgggagctggctcgtcaggaagctcctcggcagaggctgcgtcgtccacgccaccctgcggagcctcgcggacgagaagaagacggggctgctccgggcgctccccggcgcggcggagcggctgcggctgttcgaggcggacatgtacgacgccgacaccttcgagcccgccatcgccggctgccacttcgtcttcctcgtcgccacgcccctgacgcacgaccccaccagcaccaagtacaaaaacacgacggaggcggcggtggacgcggcgcgcatcatcctccggcagtgcgcgctgtccggcacggtgaagcgcgtcatccacacggcctcggtcacggccgcgtcgccgctcaaggaggacggtagcgggtacaaggacttcgccgacgagtccaattggacgccgctcaacctctcctacgaattcaccaacgcttacctggacgactacgtgcggtccaagacgctgtcggaggaggagctactgagctacgaatcctcctcctcctcctccaaggaagacgaccggacccgggcgttggaggtggtcaccctagcgtgcgggctcgtcggcggcgacagcatccagacgtacctgtggggcagcatcgccgcgatcctggcgccgctgacggggcaggcggtcagtcacaacgccctcctcttcttgcaggcgctgctgggctccgtgccgctggtgcacgtggaggacgtctgcgaggcgcacgtcttctgcatggagcaggagtccatggccggccgcttcctctgcgccgccgggtaccccaacatgcgtgacatcgtcgaccactttgccgcaaagcaccccgacctcaagatacagctgactcaggtgaccggagaaggggtcaggattcagcccaacaccagcaagctggaggacttggggttcagattcaagtacggagtggaggagacgctggactgcagcgtcgagtgcgccaagaggctgggagagctctagatgcatgctacgcatgcatgcgcagcattggaattcagcgactgtgatacgagtaagtatggtggtatactggtatcatgttaatacgtgcgtatattgggtcgattcatcccaccagagtttgaactgttccatattcccatctgtttcccgtgatcataaaataaaaacagtaaaatacatcaacggtcatcaaacttaacatgttgtattacttgggtctttaaagtcttaaaaccagaaaaacgggtgctagacttgatgacacatccaaaatcaggtttgctcaaactggatgccaacttaaatcattgagtgtgagcactcgta

SEQ ID NO: 12594 - DNA, 1268 bp, Zea mays
gccggccgggccgggatattcattgttcggcccccaagcgagagcatactccgcattgcgaatttgcaagctaaccatggcaccctcgcatgcccactctcgctccgtgccgctcctcctcctcgtgataggagtttgttgctgctgcagtggagcatcatcgcccgtcgtcggtcgtctcgacgacgacccgacctgtcctcgggagccgacggcggcggtggcagccgtgtcgtcagctgagtctagctacgtcgagccacgccggtgccagccgccggcgccgcacatcgcggtggccgtgttcccctacgacgtcgacccgatgcagttcgcgctgaacctggagtacaccgaggccgagttcttcctgcacggcgcgtacggcgtggggctcgaccacctcgcgccgaggctggcgctgggcggcccgcctccggtgggcgcccggaaggccaacctcgacgaggtgacgaggcgcatcgtcgcggagtttggcctgcaggaagttggccacatcagggctatccagcgcacggtcggcgggattcctcggccgttgatagacctcagcgcccacaacttcgctagggtgatggacgaggcgttcgggacccgcctggaccctcccttcgatccctacgtcaacagcctcaacttcctgctggcctcgtacgtcatcccctacctcggcatcaacggctacgtcggcaccaaccccatcgtcgacggctaccagacaaagaagcttctggcagggctgctgggggtggaggcggcgcaggacgcggtgttccgggcacgcctcttcgagcgcctcggcgaggccgtgccaccgtacgggaacatcacggtggccgagttcacggaccgcgtgtcggcgctgcgcaaccggctggggcggtgcggggtcaaggacgaggggctcacggtgccccgccggctcggcgccgagggcgccatctgcaccaacgtgctctccgcggacagggactcgctctcctacgcccggacgcccgccgagctgctcagcatcctctacctcaccggcgacgagcgcgtgcccggcgggttctatccggagggtgccaacgggaggatcgccaggtcctttcttggcaagccacatggaaactagccaatgcaagctgccgatttgaactacgtgtccgtgcagaaacccggaacatatatatgcatggttggatgaacttgcaaagtttgctgaataatataacagtggattgatatcaaaaaaaaaaaaaaaa

SEQ ID NO: 12595 - DNA, 955 bp, Zea mays
acctcccggccgcggcccgcttgcttctccatcgagttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccatccgaatatcaacagcaacgggagcatctgtcttgatatcttgaaggagcaatggagccctgcactgacagtttctaaggtcctcctctcaatttgttcccttctgacggacccaaaccctgacgatccgttggtcccagagattgctcacttgtacaagactgatcgcgtgaagtacgaatctactgctaggagctggactcagaaatatgcaatgggctgacaagctattggtctctcatagacccttctgtaactgaaaccagatgtctaaattattttgtccattcgtgcatcgaacttctgatatataatggaaggagaaacattgatagtacctcggtgttgtctgtggtccaatttaatttaattgatttttggtcttgtgggaaaaaaaaaaagtccatagttaggttcttcggctgttcctttgcggtcggtgttatctctgacatggagtcaatggtggtgcatgtcttggatgtgtcatcatagtgttaaacttgtcatcttgacaaggtagatatgttttgtcacactgatagttatcgttgattacgttgtcatgtataatatagttgttaaacagtgtagttgtttat

SEQ ID NO: 12596 - DNA, 768 bp, Zea mays
cgggccccgatccgtccactccttcctctcgattccgatcggaatcgcaactagccccgccgcttgattagccggcagccggccccgtccccatggcgtccaagcggatcctcaaggagctcaaggacctgcagagggatccccccacctcctgcagcgccggccctgtggcggaagatatgttccactggcaggcgacaatcatgggtccatcggaaagcccatatgctggtggtgtatttttggttactattcacttccccccagactacccattcaagccacccaaggttgcatttaaaacaaaggttttccacccaaatatcaacagcaatgggagcatctgtcttgatatcttgaaggagcaatggagccctgcattgacagtttcaaaggtgctcctttcaatctgctctctactaacggacccaaaccctgacgacccgttggttccggagattgcacacatgtacaagagcgaccgtgcaaagtatgagtccacagcgaggagctggacccagaagtatgcaatgggctgaccctggtagccgcgggtggaggatgatgttggagccatcttcgcttgtaacacctaatgtatctttgttcctgttctgctgctgctatatgggattgtactgtccacctgactgaattcaagtgtcatattgtgaagtgatggcaaaaggcctctaatgggtctatgggtgcacccattcaacaaattaatagagatgggaactgaaactaaagttgttccgttgctgg

SEQ ID NO: 12597 - DNA, 901 bp, Zea mays
cctcgagccggccgggaaaccgtgtgtccgtgtgcgactgcgacgagaagcttccagaacccaccagctaactacgtccgtcctccaccaatcccatcttgggacgccacgacaactccctccctcttccccgtccgtattcatttatacactccctgccggccggcccggggtgccttcttgcttctccatcgagttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccacccgaatatcaacagcaacgggagcatctgtcttgatatcttgaaggagcaatggagccctgcactgacagtttctaaggtcctcctctcaatttgttcccttctgacggacccaaaccctgacgatccgttggtcccagagattgctcacttgtacaagactgatcgcgtgaagtacgaatctactgctaggagctggactcagaaatatgcaatgggctgacaagctattggtctctcatagacccttctgtaactgaaaccagatgtctaaattaatttgtccattcgtgcatcgaacttttgatatataatggaaggagaaacattgatagtaaaaaaaaaaaaaaaaaagcgcccatttacaaaaaaaaaaaaaaagccccta

SEQ ID NO: 12598 - DNA, 912 bp, Zea mays
tatatccaccgtgtgcgactgcgacgagaagtttccagaacccaccagctaactacgtccctccgcctccctccccgccggccggcgccacgactactccctccctcttccccgtccgtatttatttatacaccccagtctctacccccttggtgccttcttgcttctccatcgagttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccacccgaatatcaacagcaacgggagcatctgtcttgatatcttgaaggagcaatggagccctgcactgacagtttctaaggtcctcctctcaatttgttcccttctgacggacccaaaccctgacgatccgttggtcccagagattgctcacttgtacaagactgatcgcgtgaagtacgaatcgactgctaggagctggactcagaaatatgcaatgggctgacaagctattggtctctcgtagacctaaagcacgtactgccttctgtaactgaaaccagatgtctaaattaatttgtccattcgtgcatcgaacttttgatatataatggaaggagaaacattgatagtaaaaaaaaaaaaaaaaaaggccccaagggcatgaataagcggccgtgccaatggatgcttttgttccg

SEQ ID NO: 12599 - DNA, 775 bp, Zea mays
  misc_feature (654)..(654): n is a, c, g, or t
  misc_feature (692)..(693): n is a, c, g, or t
gccgggcccttagttatctccacaatggcgctagtggagactacccggactgtacagacctggcctaccacagtgccgttgacgatggcgcagatgtcatcgactgtcctgttcaagtgacaagcgatggagtcctcatgtgcatgagttccattaacctgcttgacaccaccaatgttcagagaacacctttcgccactccttccctcgttccagaacttcagtccacaccagggatcttcacgttcaacctcacttgggccgacatcagcagcagcgctctaaaacccaagatatcttccccagtgagtcaatatttttatgtaaggaacccaaggtacacgaatcgagggaagtttctgaagctgtctgacttccttgcaatcgtgatggacagggatttgtctggtgccatgatcatcatcgagaatgctgcgttcatagcaaagtcactagggatcgacatcgttgactccgtaaccgccgccctaagtgccgccggcttcagtaaccagaccaccaaggaagctctgttccggtcaacagacagcgccgtcctcgtcaaactgaagcagcaggaaacggaatgcaagctcgtctacaccctccccctaggcatcggggacgcctccaagccctcgctgaaggacatcnaaggcgttcgccgaagccgtagtcgtcgacaggacctnncgtcttcgctctgagctacgctttcatcatgggacagaacagggatcgtgcgagaccctgcaggcggcgggcctggctgtgt

SEQ ID NO: 12600 - DNA, 4597 bp, Zea mays
gggggggggggctgggatgggaaaatcggaggagctttagtgctctcaaatgtatcatctaaccatgttttcgacttggaatgaggcgagggtcgtgtactcgtgtactacagagaggattggaccatttctattttctgtttgatcggggagggggacaaatgtgactcgtgatttgtctaatgatcagacactcgtctccttatatctccacagcattcatctttctctccatgttggattgttcgcggccgccggtcctgctcctgtcctctccacgtcgccaatcacttcaccctctcaagtctcatctcccttgccaccatggctacgcttctctccccccctgcccacgctgccgttgctcatctaatcctctcctcccagtcccaaaccatagcctcctgccaaagctgccatagttgaagttgcccacatgtgccactttggtcatcgtcgtctagttggatacattcgaggcgacgacacacatgtgatagagctcgaatagttacgactgggcattgggctcgccggaagccatggatatggttcttcccgtcgtcaccgaagaagcgtaaattacaggaccccaaacgaccccaaaacggtaacacaacgaccagttctattaggtagcttatcaattttctttccaccagtgcatgagtgcgggagcaaagtgcggtgcgctttacaactgcgtggcactaataaaacgcgcgcatacacggcttctcagtttcagactccagactgaaaaattcccccgctgtttgtgcctgagacgcagcgcgtgctcactagctagcgtgtcactgagcgccgggcccgtcctcggtgcgccaccttccctttccgctttccccgcgtttccatttcgtttcagtcagtggctcagtgcgcgactgaaggctgccgcaacaccattaaaccaccaaactgcttctcctccagtctccgcttcccgtgcgccgcgggaacaaggttctggaagcttcggagatggggaggagtagacgccacgaaggaggaggaggaggagaacgacggggtgcgggtgctggaggggtggccgccgccgccttcgccgctctgctgctgggctgcgtcgtcatggccctcgtcggcggcgccgccgcgcagggcccccggctcccctccgactacaaaaccctcagcggtaacaacccaccccacccttccttccttctctgccgttccttccctcgttcggggcaacagccagccatgaccatgagtccatgaccatcatcccttcgatttccgcaggcgccgctccgctcgtggtggccagaggcgggttctcaggagcgttcccggactccagcgagggcgcctactccttcggggcgtccgccagcgcgcctggcacggccatgtggtgcgacgtccagctgaccaaggacggcgtcgggctctgcctccgcgacgtcaacatgaagaactgcaccaccgtcgaccagacgtaccccgggaggaagcggacctacgtcatcgacggcgtccacaagaccggctggttcgtcccggacttcaccagcgccgagcttcttcagtccgtgtaccgtgagtacataactacatacagtacagagcatacctcggctatcagagcattcctaggatcatgcgcgtgccttccatggcctacagtacagatttgtagcttctaaccatgtcggctgtgcaaacttcttaattagctgatcatccattgtactgtgctggacagtaacacaagcaatctggtctcgcactgagaggatggacggcatataccctatcgtcactgtccctgacgttcagtccatcgtcaacacgtctcctatctggctgaatgtccaggttggattgctgttcctgtaaacttcaccatatactttgcttttactgtcctactgttttctataccttcaccttcaaaagatcctagtttcctgttttgtttttttactgtctcgtacgtgtagcatcccatcttctacaaacaacgcgatctggacatgagcagctacatacactcgatccggaagctggtgcgcatggactacatctcgtcgcctgagatcggcttcctcagaaacatatccgcaagagtccgccgcagaaccaagctcgtgttcagctttctcgacaaaaaactcctggatcactccgtgaaccagacatacggttcgctggcgaggaacctgacgttcgtcaggtccgtcgcgtctggcatactggtcccgaaggactacatctggccggtgacggccgataactacctgctgccgtccacgtcgatcgtcaccgaagcgcacgaagcggggctggagatatacgcctctggttttgtgaacgataaggctgtcccctttaactacagctacgatcctctggcggagtacctgaacttcgtcggcgatggtggcttctcggttgatggcgtactgtcggactaccctattactgcatcagaggcaattggtaagctagctactagaagttctgcattagtactacatcatacggattcagctacaatgcaattttaaacctgtttgattaactgttaatgacattcagttgttttttgtttgtgtttgaagaaataagcaaatacagttcatggtttaatgcgtctgaatcttctcccccgcaggttgttttgctaacctgaattcaagtaagactgatcatggtatgtttcagatgggagtaattgtaccatgatggttggatgtcttctatatctcaactcagtttaagtaattatctgtagtgcatctttacagttacagggaaacccttagttatctcccacaatggcgctagtggagactacccggactgtacagacctggcctaccacagtgccgttgacgatggcgcagatgtcatcgactgtcctgttcaagtgacaagcgatggagtcctcatgtgcatgagttccattaacctgcttgacaccaccaatgttcagagaacacctttcgccactccttccctggttccatctatcttaataaatgtaattctttcatcactgatcaatctatcttctctaccgcagaatgctgcgttcatagcaaagtcactagggatcgacatggttgactccgtaaccgccgccttaagtgccgccggcttcagtaaccagaccaccaaggaagttctgatccggtcaacagacagcgccgtcctcgtcaaactgaagcagcagaaaacgagatgcaagctcgtgtacaccctccccctaggcatcggggacgcttccaaaccctcgctgaaggacatcaaggcgttcgcggaagccgtagtcgtcgacaggacctccgtcttcgctctgagctacgatttcatcatgggacagaacaggatcgtgcgagacctgcaggcggcggggctggctgtgtacgcgcaggtgttccggaacgagtacgtagcgcacccgtttgatttcttgggggatccgaccgtggagatcaactactatgttcagacgtttaatctgtccggcatgatcactgatttccccaagacagtcagaagatacaaaggtaattagtctcatttgtttatgatccatgcatgttctaacaccgatgtgctcttgtattggcagactcctcccgcacacctccggggaaggatatgcccaagtacatgcggccagttgaggctggctcccttgcagatttcctccggtccttccaaacccagccgccgtctgtggcaccgatgccggcgctgaactcttcaagcgtggaggagccgcctcttccaactgctgcgccgagaaacgtgccgcctggtggtggcgccccagcggacgccgccgggactgctggcggcgctgctccttctgatgcgagttccggcggcgctcctccttctgacgcgcgtcacacggctaccggaagtagcggtatgctgcttgtggtgctggtttccgcggctctgctgatctgattctgagcagacacatgagactgtatagtagacagagccgaagcaaatgcaaatctccgttggattcgatcaagctttgaccagcgatataccatacacttgtttttctcgggtatatatgtttgtatttggccgcatttttcacgtccacatgtgtaaaaaattgtcagtggaaacgttatacgtatcagccggaaattttatccggcgatgatcaaagttctgacaaggattaagcgatcaccacaaactccaaataatatggtgttatgtaactgtgaatgatttactctttattgttatatttatatctccacgctaaaaatctttactacttattaaggctgcaatagtagtctgccaccattccatgttctacaattctcatgtcttgttctgcctttctgattccctcctccccgcgcacagtccatttcccatgttatgccaccattttatatctatcattttcattctccctccccgcaaagctcattcccatttccattcccccgtacagtcgacgtctagctaaaatttaaaaaatacacaatgccccaaggggattcaaacacacgacctctcaagcaaatgctagcagtaggtaacactacaccac

SEQ ID NO: 12601 - DNA, 1268 bp, Zea mays
ggtcccacactcccaccgtactcccaaacaaaacggtctccccgggacgccgccccgggggacggaaaggcatctattgcctttctcccaacccgccaaaccctacttgccaccgccaaacttccgccttcgtccgcgccggcgccgctctatcgctctaaaataacctttccagttccaccgggactagctgaaaggagagggaacggagggggatggcgtcgccggacgacgagataagccggctcttccgcatccgccgcacggtgtatgagatgctgcgcgaccgcggatacggtgtccgcgacgaacaaatcaagctcgaaaggcacaagttcatcgaacgctacggcaaccccgtccgccgtgacgagctcaccttcaacgccacaaagttgaacggcccatcggaccagatctacgtgttctttcctaatgaggcaaagcccggggtgaagacaatcaggaactacgtcgagaagatgaagaacgagaacgtcttcgccggcatactcgtcgtgcagcaggcgctcagcgccttcgcacgcagcgccgttcaggaggtctcccagaagtaccacctcgaggtcttccaggaagctgagcttcttgtcaacattaaggaccatgtcctagtgccagagcatgtgctcctgacaccggaagacaagaagactcttctagagcggtacaccgtgaaggaaacccagctgccccggattcagattacagacccgatagcaagatactatgggatgaagcgtgggcaggtcgtgaagatcacaagagccagtgagactgctggaagatacatcacctaccgctacgttgtctgagttttgctacattctcatggcttaagcttccgcaccaagcgaaaatgacctctacttgctaatcctgctgtgtactcggaatatctgttgccctggtgcccttccttgagaactgatctcgggctgttctggcgatagtaataggccgctgttccttaagctgtgttccatctcattttaggccctgttcggttgcagataggtgtgatattggggggtgatattggatcgtgatccaaatgtttcttcacaaattattagggtcataaattatttttagttaaaaaaaaaaaaaaaaaaaaacccgagactaatccgagctttatgttttatagtttaaaatttagagtctattattacctattattacctctagttgtacagttatagaatattggaggggttaggtggggattaaatccctttctgttt

SEQ ID NO: 12602 - DNA, 4162 bp, Zea mays
  misc_feature (5)..(5): n is a, c, g, or t
  misc_feature (3110)..(3110): n is a, c, g, or t
ggtgnaaaaatgtgaagtctcgcaggccaaaacccaaatggtcccccatgattttagaaaatatgaccataggcccccccggacccacgacgccgcaagccactagctgctctggctcccccgaggcaatcgagtaatcgacgaaggccaccaccacctccacaccactttgcctcgagaaggttccaccaagcctctcggctagggtttggggactttgggggcgatcgcaatggagggccgcggcgcggaacaagcacccgaggcggcggcggaggtgaaaaatccgaggtgcttcatggacgtcaccatcggcggcgagatggaggggaggatcgttgtagagctctacgcttccgtggtaccgcggacggcggagaacttccgcgcgctctgcacaggggagaaaggcatcggcgccgccagcggcaagccgcttcactttaagggctcatgcttccaccgtgttattaaagggtttatgattcaagggggagacacaactgctggagacggaactgggggagagtcaatttatgggtccaaatttgaggacgagaattttgttttaaagcatgagaggaaaggaatgctttcaatggctaattctggtcccaacacaaatggttctcagtttttcatcactactacacggacacctcatttagacgggaaacatgttgtttttggtagagtgatgaaaggaatgggggtagttcgctctattgagcatgtttctgtcggagaagctgactgccccactcttgaagttaaaattgttgattgtggggagcttcctgaaggtgctgatgatggagttgtaaactttttcaaagatggtgatacgtacccagattggcccaatgatcttgaagagaagcctgctgaggtttcatggtggatggatgctgtggagtctgctaaagcttatgggaatgacaatttcaagaaacaggactacaaggcagctctcagaaagtacaggaaagctctgcgctacttggatctttgctgggagaaagaagagatagatgaagataagagcacagcactgcggaagaccaagtcaataatactcactaatagctccgcatgcaaattaaagttaggagattcaagtggggctttattagacgcagattttgcactgcgtgaaagggagggaaatgctaaagcttttttccgacaaggacaggcacacattgcacttaatgacattgatgcagccgtggagagctttaaacaggcattggagttggagccaaatgatgctggaatcaaaagagagctggctgctgcaaagaagaagattgctgacagaagagatcaggagcggaaggcatttgctaggattttccaatcttctggaaagtctgacaagagcaacgaagagaataattgatctacagttcctttcccccgtctgaaactttgcttagcttaaatctggggcacattggaacaggagtctcatgggagtctgctctgcaaaaaaacgcagattactgatctttagatagaaggaaacatagtggggggaaaggaagcttttgttttcttgtactacagaagtagcaattcgtgcttttgtcccggtcttagtttattcaggaaacggacattgaatttaaatgtgcaatttttagacccaacctgacgattcacatcttttgtgggtagttcgcccgtttcactttcgtggtgttttcttgtagccttttgtctgcttgttgccagactctaaggccatgtgtgccacacttcatctcacagctttacatattcaagcagtttctgcagcagctttttagtccagctgcttatctcaatgaactaaaagcagctgtgtttagacccgaatcatacacggtatttctgtcctgtccacattctggttctgtggattgtcacttgtcaggctgctgggctggcagctcagctgtggctgttcgttgcaaatccgtagagataaagataaaagtactgataaaaatattgtagaagccaaagtcggattaaagccggatcgattcgtgtgcctttcgcctgcatcggacgatcgaagttgtttcgtttcgttccacattcttgttagccaatatatttttgagtgcaaactgggccaactcatttagtagtttttttatatggaacatgtccgtcttaataattcagggttagcatcggcgtttctgtcttgtgtgagatgaaccctaaacatgtattcgcatctgggctacgtccaactttaaggtgatgcgtccaaagttaaaattcaggtccttcaactttttaggtggtccattggaagtttaaattcaggtctgtgattggatttagagtgaacttacgatggattagttaaaaaagcgaaggacctagatgactactttgagagttcatagatctagataaaaatgctagaaaattttaataatttagatgaccacttcgatagtacataaacctagatgggaatgctagcaaaagggacattgtgggtgtgatatgtatatttatatgggtgcgtgattgagagcagcggtgccgagcaaaaatgaggataaaaacaaacaagcacaaaattaaggattggttagtgctatttaggccaagttactaatgtcaagatgggttaaagtgatgattttagatacataagatctcgacatgtagtatatttatatggtttaagttagggacaattatatggttgctcctgctcacgactctaacttcattttactcttgtttatcgaactttgaatcgttgcccctcttatttcaaaacgaaacctccttttatccctattccgttataagcacgtaacagtgttaacttagcctataaaaatatgttcatacccttgcactaatgtcccttttattatcaattgttttcaaatttctctccaatgtggcataagtataatatttatacgaccataaatttcaaaccagcgtacaatcggccgggcagccgagcaagatctgccagaagggatgagatttcttattcttaatagaacctgtagttggcgcgattgagggcgagggcggcgtcgcgttgccgatcctgagcccccccccaccccgtcagcctcgaacgntataagacacaacattttttatttttgtcttataatataaagcatgctctctctagatacatgtatatcaatgcagtagtattagtgttgataaagaaaattaaatattttttttttatatttaaccagatgcagttacattttacggttttggagaaatgaccggcctcttttatagttctttttaaaattattttgttcgcgtatcattctaatcatttgtgtctctgtcgtagtcatatagacatggggacatgtagtacgagtaccacaagcaagtaaacacagtggtggcccgccagcctcgaggatgaaatacacagctttggtaatggccggtcctaataagggcaacgagtgatattcaaacagtcattctgggcaaacgtgcaaataaaccatctatccattagattacaatccaaccacagatacaactatggtttgttagggttttttataaagattactgagctggtggtggaagggtttaaatgttaaacgtgacttacgattagatcacgatctaatggatcaaatggtttgtttgcacgcttgcacagaaggactgcttgcatagccgttgttgcccctaataattactctacatgtgttatcatggacacgctacgagatcagtgattgttggaacgtacgtgcacgcatcacggaccaacaaatcaaaatccgtgtctgcatcccaaagctaattaaaacgtatcatcattaggagcacactgaagattcaaaggtaagcggttttcgtccgacaagtgccaacaaaatggtcagatgctcagatgcatggacgattacatatacatgtaatgtacattatgttgcttccagttaattacgacctatcgatgggccggccggcctattcatctcatctagcaccgccattatcctctacagtaatgaagcgtcattatcctgagggaaaacaaaacaaacacactaccgttccgcttccgcggccctactacatactccctccgtttctttttatttgtcgctggatagtacaaaattccactatccagcgacaa

SEQ ID NO: 12603 - DNA, 1682 bp, Zea mays
aagtctgtccaccttccgcgtagactcggatcccacctagtcaatggagtgagcaacgagggttgggttcggcagcagcgagggaaaagccaaagccccccagggcagcaggaagcaatagaagcgagcgaggcagcggcgtggggcgaggagtggaggacaccgatccccgccggagagcgcgtccatcccaaatggcgactgcagcttcgcccgccgctgcctttccccacatcctctccctctcctcctaatcccctcccaatccccccctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcactgaagcttgcagactttggtttagccagggcatttggaattcctgtccgtacatttactcatgaggtagtgacattatggtacagagctccagaaatccttcttggagcgagacagtattccacaccagttgacgtatggtctgtgggctgtatctttgcggaaatggtgaaccaaaagccactattccctggtgattctgagatcgacgaactgttcaagatattcagggtgctaggtacaccgaatgaacaaggttggcctggagtcagttgtttgcctgacttcaagactgctttccccaggtggcaagctcaggacctggcaacaatagtcccaaatctagaacctgctggcttggaccttctctctaaaatgcttcggtatgagccaagcaaaagaatcacagctaggcaagcacttgagcacgagtacttcaaggaccttgagatggtacagtgacctgctaaatgtgcttcgcgttgctttggcatttgtaattgtctgagctgagtcgctcattcctttttatgggcgtctgtactctctcattctctctgcatttttgtcgttcagctggatattttgaatctggtgtgttttgagatgtattaaggaatatcaaatagattaccgccttggtctctatttactgaaagtaaatatcctccatgtttatttcccccgaagcagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaggggggcccgctttaagggaccaaattttacgtccccgggaatgcaaggtaatagttttttttttgggcccccaaatttaatttaatgggcggggttttaaaaacgggggga

SEQ ID NO: 12604 - DNA, 1609 bp, Zea mays
ctggccgggacatcgacgacacccgccgagccgagacagccacccagttgctcaagtgattccaggcccacgccacgccaaccccgggctcaactcgagtccacacgccccagcaccacccctgcctctcagtccagtcccccacccaccaccaccactcctcccctcgccgccgcccgttcccgaccgatccggccggatcgccccgccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaacacgtaagctcgcccttcggcgccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagcaggatatggatggatggatgaaccgtttcccctcccctgctccctctgtaaattacggtagcagccgcgatgcttggggccggcgagtacccccgtctgggcggccgttgagttatgtgtgttactctatagtatgactaagctggagtgcctcatgcccaccatgcagtgcagcttttttctccgacttttttttgctgcgtagagaaatgagatgagaaatgtgatccagagatccttgtgccatgggagacctagtagtagactagtagctatgtaggtgtcggcactggcctctcttgaacctgtatgatggctggagagagaggagagacggcggcttctctggttgataagttggtcctggtatggtgtgcttgccgccgatgcacgtcatggtctttcttcctttctgatgaggacttggggtggaccccgagtgagttcgtgctcatgcacggtttgttggccatgcaagctgaagcagctgcagcagagattttggctgccc

SEQ ID NO: 12605 - DNA, 1438 bp, Zea mays
gacgaaagctgccgcagtcaaacagcgaatacatgccgtaccccccggcccgccggcaatagaagcgagcgagcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgacctgctaaatgtgcttgacgttgcattgacatttgtatgagctgagtcgctcattcctttttatgaacgcctgtactcttctcattctctccctgcatttttgtcattcagctggatatttcgaatctggtgtgttttgagatgtattaaagaacgtcaaatagattaccgccttggtctctgtccattgaaagtaaatatccgtcatatgtttattttccaagcggccaaaaaaaaaaaaaaaaa

SEQ ID NO: 12606 - DNA, 1501 bp, Zea mays
gtcgacccacgcgtccggcgagcgccacccagttgctcaagtgattccaggcccacgccacgccaaccccgggctcaactcgagtccacacgccccagcaccacccctgcctctcagtccagtcccccacccaccaccaccactcctcccctcgccgccgcccgttcccgaccgatccggccggatcgccccgccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcccgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagcaggatatggatggatggatgaaccatttcccctcccctgctccctctgtaaattacggtagcagccgcgatgcttggggccggcgagtacccccgtctgggcggccgttgagttatgtgtgttactctatagtatgactaagctggagtgcctcatgtccaccatgcagtgcagcttttttctccgacttttttttgctgcgtagagaaatgagatgagaaatgtgatccagagatccttgtgccatgggagccctagtagtagccttgtagctgtcggaggtgtcggcactggcctctcttgaacctgtatgatggctggagagagaggagagacggcggcttctctggttaaaaaaaaaaaaaaaaaaaaaaaaaaaaaaaaaaaaaaaaaaaaaaaaaaaaaaaaaaaaaaaaaaaaaaaaaa

SEQ ID NO: 12607 - DNA, 2342 bp, Zea mays
taccggtccggaattcccgggtcgacccacccggccggcctttcccctccgcccgccagccattaatcgcgccggcatctccatccactcccccctcgcccccctcccactgctgctacttctagaagcgctggtggcagggcaggcggtatcccggccgctggcgctggcgcgagagttggttggtggtggtcttcagcccccctcgctcttcaggtttagggtggagcgatccgtgcaggccaacgcggggtgcgtgacccagaaagggaaaccgccggctttttctcttctgccgccccgcttttccaatccctcctcaacctcatccgcccccgcccgcaccccgcaggcaccatcaccaaaaaggtccccgccttcttcttcttcttcttcttctcctctgcccctgcttgtcgtttgctcgtgctcccccaccccctttctgattcagcaagggttccttccgcggcgcggcgcgtcgccatgggcaactgctggggcgccaagatcagctccgacagcccgtcccgcggcgcctcatccccgtcagggacggcgtccaagttggcgagcaggaacggggcggcggcagccctgagcgggtgcagcagccacgcgtcgtccgcgtccatgctgccgacgccccgcagcgaggacgagatcctggagtcggccaacgtcagggccttcagcttcaacgagctgaggaccgccaccaggaacttcaggccggacagcgtgctgggcgagggcgggttcggatccgtcttcaagggctgggtcgacgagaagacgctcgccccggctaggcccggcacggggatggtcattgccgtcaagaagctcaaccaggatggataccagggccacaaggagtggctgactgaagtgaactaccttggaacgctgtcgcacccctaccttgtgaagctcgttggctactgcctcgaggacgaacagcgcctcctcgtctacgagttcatgccacgcgggagtctggagaaccatctgttcaggaggagctcctatttccagccgctgtcctggaacctacggatgaagattgcgctcggagcagctaaaggcctcgcgtatctccacagcgacgaggctaaagtcatctaccgtgacttcaagacatctaatgtccttctagatgcgaacttcaatgcaaagctctctgatttcgggctggcgaaggatggtccgaccggcgacaagagccatgtctccactagggtgatggggactcacgggtatgcagctccagaataccttgcgacaggtcatctgaccaccaagagcgacgtgtacagctttggggtggtgctcctagagatgctgtcagggcggcgggcgctggacaagaaccgcccgaacggggagcacaacctggtggagtgggctaggccatacctgagaagcaagcggcgcatatttcgcatcctggacccacggctgggcgggcagtactcccttgccagggcgcagaaggctgcggcgctcgccctgcaatgcctctcggtggagtccaggcacaggcccagcatggacgaggtggtcacagcgttagagcagctccaggacaccaaagaaggaggtaaccatcacctacagaagaggccaggcagccggagcttggataacaatggcggcaaagcggcagggaaggggaagcctgctcctcatgtaaaaccagtttgagtgattggattttatatgccagagtatctctctttttttttcccatccatttgtaggtgtaggtaatatagtagggttcttagagggatttgtaaagaggcaggcagagttctggatgttttctgtctattatgtagttttttttacatcttcaagtctctgtaaagtacgctatgtaaatacataatgacatccagttcggagtgcgatgaattttagtccaggccaacagctcaaccgctgttaaaacttagcaagctgctgagcatagaacggatgcaattgatcaagtgttaacaggcatcacgacgggttccagattcaggcaaattaatctgaaaacatacatacaataaagctgaaaacttcatatatacacacacacacacttgtataacacatcacatttgagcaagtctgtatacatgctgagtgtgggcatctttgatcaaatgattaaacatgtttggtgcagagtgtgagcctttcagtgaccctccctcctgtgagcctttcagtgaccctccctcctgatagcaatggcaccttcgtagcctcttcagtagttcttcatccaaactgtatcatggattcatctaaagagaaaacagaaaagaatacaatgcagcaggggt

SEQ ID NO: 12608 - DNA, 997 bp, Zea mays
cctgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagcccccctccctcttcaggtttagggtggagcgatccgtgcaggccaacgcggggtgcgtgacccagaaagggaaaccgccgccttttttctcttctgccgccccgcttttccaatccctcctcaacctcatccgccccgcccgcaccatcaccaaaaaggtccccgccttcttcttcctcttctcctctgcccctgcttgtcgtttgctcgtgctcccccaccccctttctgattcagccagggttccttccgcggcgcggcgcgtcgccatgggcaactgctggggcgccaagatcagctccgacagcccctcccgcggcgcctcctccccgtcagggacggcgtccaagttggcgagcaggaacggggcggcggcagccctgagcgggtgcagcagccacgcgtcgtccgcgtccatgctgccgacgccccgcagcgaggacgagatcctggagtcggccaacgtcagggccttcagcttcaacgagctgaggaccgccaccaggaacttcaggccggacagcgtgctgggcgagggcgggttcggatccgtcttcaagggctgggtcgacgagaagacgctcgccccggctaggcccggcacggggatggtcattgccgtcaagaagctcaaccaggatggataccagggccacaaggagtggctgactgaagtgaactaccttggaacgctgtcgcacccctaccttgtgaagctcgttggctactgcctcgaggacgaacagcgcctcctcgtctacgagttcatgccacgcggggagtctgg

SEQ ID NO: 12609 - DNA, 740 bp, Zea mays
  misc_feature (690)..(690): n is a, c, g, or t
  misc_feature (701)..(701): n is a, c, g, or t
ttctcgagttttttttggttttctttgaaaacctagcacctgtttcttttcatatacagaacgggtttggccatgcagacgtgaaatcgtcgtctgtgctgcacggcaaacatgcacatcaaaattacacgcaccacaggacgcaggccatccgtgcagaccatccacaccacaagcactctttacacattataaatacccgcagaaaagaaaaagaaaacgaaatcgaaaaagaggaaaaacactactggcctgaagcttctttgcatggaatattacgataactcgtggctgcttcgaggaatggtacaccgccaatccgtgaatagtgacgatgccttgtgcactaagaacatcccaaacatttacttagtgggcctaagaattccaggaagcccgatgactgcggcagactctgttcctcagcttttgatggcaggtgtctaaggaatgccctaacagcacctgtcaccccgtcttcagattccatggctttcgccagctccacagccttatctttcacctctggtttcaccgggttcgtcatggctgttatagcgtcgaccaacttctgcaaaccaaactgatcaactggaataggcggaggccctagccctcttgcatgcacccggtcaccccagaagggttggtcaccaaagaagggtacaatagtcgtgggacacgctgctntaagactggcngctgtcgttccagcaccaccatgatgcaccactgttttt

SEQ ID NO: 12610 - DNA, 2352 bp, Zea mays
tcgaggccggccggggcctctccattatttatgcatttccgcccccacccttacctttcccaattcagccgaggaccgcaatcgcagggcactgggagcgattaaaaaaggcagcctcccccgcaagggtaaaaacaaacaaccaccgcatcgcggcaggcaaggcatcgcccgccagccaccgagcggagggggaagcaaaagcttgataaaaaggagaggaggagacgagacgtgccgtccggacccaagcaacttcctcccaccacctcctccctcccatgcccgcatcgagatcttagcgggacagcgagaggagaggcgacgccgacgcgggcgccccctgatccctcctcgccgccgccgccgaccgaccgaccgggggaggaggaggggaggggaggacggacacgatggaggcggactccgggaagctcttcgtcggcggcatctcttgggagacggacgaggatcgcctccgcgcgtacttcggtcgctttggcgaggtcaccgaggccgttatcatgcgggaccgcaacaccggccgcgcccgtgggttcgggttcgtcgtcttcgccgattccgggatcgccgaacgcgtcaccctcgataagcacatgatcgacgggcgcatggtggaagcaaagaaggccgttcctagggacgaccagagtattgcgagcaagaacaacagcagcatagggtcacctggaccaggacgcactagaaagatcttcgttggaggtctggcctcaaatgttaccgaggtcgaatttaggaggtattttgagcaatttggtgtgataaccgatgtggtagtgatgtatgaccacaacacgcagaggcctaggggctttggtttcatcacatatgactcagaagacgcagtggacaaggcactgcacaagaacttccatgagctgaatggtaaaatggtcgaggttaagagggctgtgccaaaggagcagtctcctggacctattgcacgttcacctgcgggagggcagaactatgctatgagcagggttcataacttcctaaatggcttcaaccagggttacaacccgaaccccctgggtggttatggcatgagggtggatggaaggtatggtctccttacgggtgcacggaatgggttctcttcgtttggtccaggttatggaatgggcatgaatgctgaaggtggaatgagtgcatattttggtgcaagttctggttttgccaatagctccaatgggcggcaaataggttcttacttcaatagtagttcaaacagattaggcagtccaattggttatgttggccttaatgatgattcaggatcaatactgagttcaatgtctagaaatgtttggggcaatggaaatcttaactacacaggcaaccctacaaacacgaattcttttgctccacctgtaggtggtgggggtattcctggtgatgaaattagttggggaaaccttacttctgttcatgggatgggcaacatttcaagccttggaccgggaaaccttggccgtggaaccggagataacaactttggattgccttctggaacctatgtgaggagcaactcaactggtacaattggcgagccattttctgcatcagccaatccatatgaatcgaacaatctaggtgcatatggcagcagttctatttatggtgactccacctggaggttcaactcatctgaggttgatatacctccttttggtcatgatcttggaaatgttgatccagatattaaatcagaaatatcagcaaactatatgggcaactatactgttaataataatcagacaagcagaggtatcacttcctaggaagagtattattatattcatacatgacttgggataggtgaaatacccactactatatcaggctttcaggtgcatgactgtgaattggtgatgtcagattaatatacaggttagttgcttgtttctagttaaggtaaccagaggtgtggtttacaacaccaaaaatgctagaggagcggatacaaacattttgtgaagctttcagattttagtttaatttctacatctattaggccttcgttttttaaatgagatgtgcagtgttgattgcggcacaaacttagaagtgttccaacataagctggaattctgtcatacggaaggataaacttgtataccaaagaaatgctgtattatctttgcccatttatggctacattagcttgcatgtttttattctcttcaaccattccatttgtatactagagagttgcttggcttactattcaaactattgggggtgcaaagccatattgagacccagtaataaagccacccaaagtatatacaaaaaaaaaaaaaaaaa

SEQ ID NO: 12611 - DNA, 2921 bp, Zea mays
  misc_feature (2897)..(2897): n is a, c, g, or t
agtcgacctgcagatttgaaactcttaaggagacctcatgcctttggagttttctatacgtcacggacttaactgcacaataacagtttattagttttggacgagtaaaagtacgaacaagataactgtctgaaaaaacccacacaccacacactacagtgtagtcggaaaaaataagaaaattcattaggtacctgtgacctccacgtcttccgtcttccactgatcgcagcacacaaactccctgccgggtgggcgccgcacgcctgcacctcttccgctgcgcgaggatccgcgagccgcggcgacacgggggagcccaagcgcccaacctccttcccgcttcgtttgcttgtatgcgctgcctcgtcggttccaccacctcactcactcgcttctcccccttccagccgtcccttcgcagcgcacgcacgtaaaccacaatccagcagctggtacgcccccagcgtcgccgtcgtctccttcccccgcgcaccacacccgcagccagcagccatatcatccatcacctcgcctccagcgcggcgccgacctgcctctccattatttatacgcatttccgcgttccccaccctcctctttctcaatccagccaagcaccggaatcgcagggaaccaggagcgattaaaaaagacagcctccccgcaaaggtaaaaaacaaccaccgcatcgcggcaggcaaggcatcgctcgccagcccccgagcggagggggaagcaaaagatcgataaaaaggagaggaggagacgaggcgtgccatccgaacccaagcaacttcctcccaccaccaggtccctggctccctcccatgcccgcatcgagatcttagcgggacagcgagaggagaggcgacgcggacgcgggcgctccccgatccctcctcgctgcccgtcgccgccgccgccgaccgaccgaccgaccggggccagggggaggaggagggaaggggagtacggacacgatggaagccgactctgggaagctcttcgtcggcggcatctcgtgggagacggacgaggatcgcctccgcgagtacttcggtcgcttcggcgacgtcaccgaggccgttatcatgcgggaccgcaacaccggccgcgcccgtgggttcgggttcgtcgtcttcgccgactctgggatcgccgagcgcgtcaccatggagaagcatatgatcgacggccgcatggtggaagcaaagaaggccgttcccagggacgaccaaagtattgcgagcaagaacaatagcagcatagggtcacctggaccaggacgtactagaaagatctttgttgggggtctggcttcaaatgttaccgaggtcgaattcagaaggtactttgagcaattcggtgtgataaccgatgtggtggtgatgtatgaccacaatacgcagaggcccaggggctttggtttcatcacatatgactcagaagacgcagtggataaggcactgcacaagaacttccatgagctcaatggtaaaatggttgaggtcaagagggctgtaccaaaggagcagtctcctggacctattgcacgttcacctgcaggggggcagaactatgctatgagcagggttcataactttctaaatggttttaaccagggttacaacccgaacccccttggtggttatggcatgcgggtggatgcaaggtatggtctccttgcaggtgcacggaatgggttctcttcgtttggtccaggttatggaatgggcatgagcgttgaaggtggaatgcgtggatattttggtgcaagttctggtttcgtcaatagctccaatgggcggcaaataggttcttactttaatggtagttcaaaccgattaggtagtccaattgggtatgttggccttaacgatgattcaggatcaatactgagttcaatgtctagaaatgtctggggtaatggaaatctgaactacataggcaaccatacaaacatgaattcttttcctcaacctggaagtggtgggggtatttctggtgatgaaattagttggggaagccttacttctgctcatgggatgggcaacatttcaagccttggatcaggaaaccttggccgtggaaccggagataacaactttggcttgccttctggaaactatgttaggagcaactcaactggtacaattggtgagccattttctgcatcagccaatgcatatgaatcgaacaatccaggtgcatatggcagcagctctatttatggtgactcaacctggaggttcaactcatctgaggttgatatgcctccttttggtcatgatcttggaaatgatgatccagatatcaaatcagaaatatcagcaagctatatgggcaactatactgttaataacaatcagacaagcagaggtatcacttcctagggagagtactattatattcatatatgacttgggataggtgaaacacccactactatatcaggctttcaggtgcatgactgtgaattggtgatgtcagattaatatacaggttagttgcttgtttctaggtaaccagaggtgtggtttacaacaccaaaatgctagaggagccgatacaaacattttagtttaatttctacatctattaggccttttgttttttgaatgagatgtgcagtgttgattgcggcacatacttagaagtgttccaacataagctggaattctgtcatacggaaggataaacttgtataccaagggaatgctgtattattatctttgcccatttatggctacattagcttgcttgtttctattctctttaaccatttcatctgtatactagacagttgcttgacttactattcaaactatattcaaactattgggggtacagagccatattgagacctagtaataaagccaccgaaagtatatacnaaaaaaaaaaaaaaaaaagcggcc

SEQ ID NO: 12612 - DNA, 1034 bp, Zea mays
  misc_feature (921)..(923): n is a, c, g, or t
  misc_feature (926)..(926): n is a, c, g, or t
attgatgttgctgccactggtttttgtacagggaagaaatatgatctggagttccaatcaaccaaggaattcagggcagaactttaaaactgctgatgatatgattgagatctatagccagctttgttcagagtacccacttgtctccattgaacagcccttcgataaagatgactgggagcactcaaaaaaattgaccactctagagctgtgccaggttgcaggggatgacttgttgatgtctgatcctgaacgcattaagcgggcagttaatgagtacacttgcaacgctcttgttctcaaggcaaatcaagtgggcactgtcactgaggccatagaggttgtgaagcaggcaaaggatgctcattggggtgtgatggtgtcacataggtcgggagacactgaagattctttcattgctgacctggctgttggtgcttcagccggacagatcaaagccggtgccccctgccgtggagagtgtctcactaattacaatcagctgcttagaatcgagggagaacttggaagtgaaggcgtctatgcaggggagaattggagaacagtcaacacgagctgatctgtggtatcgtttgagttgcggggagaattggaaatattgatccgccttcgtatgtagccacttagcttttctttgttttcttgtccaattgcgtgagttcgtcctcggcaagtatatggaaatagggtggtgaaatgtaccattttttactagatgatggcaattgttgttgaacatacatatagtggatgcactggtggggtttacatcttttgttttcttcaacttggatttgtttaatttatgtatagcatgggttataaacatggataccgaggtagactggcgccgccacctttaccgagcaaacctcccgcgctcttttggtttgcgtgtcnnnaancccgaggcgttcgccacttgcccaccgaaaaatctttgaaagcagccgggggaacctcggggaactccccccggccttgggatctccttttttttaacgggggggggg

SEQ ID NO: 12613 - DNA, 3177 bp, Zea mays
cattgggtacctcgaggcgcacggggccattgggtaccctggggcccgccgggcccgactccctcggctgcctcccgcagccgcccgctgctccggtccttccgaacgctggcctgttcttccctgcctttggcccattcgtcaggcggcccctccgcaggcgacgcaggcgcgggcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttggaagatggcagatgaggagcaggccccaagctctaggaaaagggttgcaggtactcaaatcaacaaggataatccggaacctgatgatgaaggaacagaacaagagatgggtacatttaagaaagctactgaagaagttatggcaacacggaggattgtaaaggttcggcgccagcagacgtcatcagcttcttctaaccctttctctgcaatcagatttgcccccactgattctagtgctcaaacaagtgctcctgtcccagaggtccaaccttcagatgtcaaagttgacgagggaagcaatggtagcgggaaagatactttgtctctgcccgacaagactgctggctctggggtaaatacggactctagtgcctcaactgaagcaccacctcagcctgttgaaaccagtgacaaggcagaagacacaaaggacgaatctagtggagacaaagtggtagttggagaacccaatgaaggcagttgcatgccatctgaagttgagggcaaaacaaaagagggagatgctgaagaaaaggaaaggacagatgaagctggaaatatcgataaaattagcaaggatgacactgggaagaaagatggagatgacactgagaagaaagatggaggtgatgatactggaggtgaatcagagcagaaagggcaaacaccatcagcaacaccccttttctcgtttaagaatctgtcaagtggtcaaaatgctttcacaggtctgaccggaactggattttcaagcacatcattctcgtttggctcagcctctaaagatggctcaagtgctggtcccctatttgggctgaaagctgatggttcttcgttcccttcttttaatcttggtgctgccaccaatgggggttctgccacagctcttgctacttcagcagaggcacccaagatgtttgctatgacagagggccctgtcgaaaccggtgaagaaaatgagaaggctgtattcagcgctgattctgctttgtacgagtacttagatgggggctggaaagaaagaggaaaaggtgaactgaagctgaacgtccccgtatctgggggcgagcgagcccggctcgtcatgaggacaaaaggcaactaccggctggtcctgaatgcaagcctctacaacgacatgtcgctcaaggacatggacaagaagggcgtgacatttgcctgtatgaacagcattggggagtcgccgagcagcctcgctacatttgctctgaagttcaaggacacggccaccagggaggaattcaaggatgcggtggagtctcacaagacaagcaaggcacaggaactgccgctgaagacgcccgagaactctccgaaggcagcagaagtctgaagccgcacccgagtcacgcttgctcgtgtcttttgtacgtgtccaggaaggaaggaactgagagagtttctgttgttgcggagtttttaagaatgtcgcgtcatgacatatgatgtcctgagttgtattttgcgtacgggttccctggtgctgtttttgggaacttaccattactacaggcgcataatcttgggatcctggacaagggactcgttttatctatttgctcgtcttgtgctccgttatgttctatcggttaagctgcgcgtgacgctattatgtcatgaataaatgtatgcaattatacatgttcctgttgttatattccacaacatggaatgcttttttttttcaaaaaaaagccgacgcggccgcgcttgccctttgctggataagggcctgttttaaaagctgatcgagaaagccagaaaggccagcttggaaccagattgtaaaacataatcagaacgaactaattattagcaaccggggatcaataaagcgcagtaaatccaaatttgaggagtgaacttgttagagcaaccggttccaattcagcgcactaatctaaatttgaggactcatgccaaaaacacatgtcaaacccatggaatccggaggccctcagatctcctcttcggcctttgcacgggtgtcgtgttagactttttccagcagtttatccctacctaaaataggtaaagattgttattgtagacgcttcccacagtttacctatagtttacgtaaaatccacggcgtcgccatatgtactgttagtcacctttatcttaaacgcactgtgtcaactatcgatctgtttgttttcatcaccttcttcccttcccttgccaaatgtagtttatgttaaggaaacacgtgtgaagtaacaagagactctctctcacgaacaatgagtatatggacaacctttttttggcaaaaaaacaaccaaaacgtgagttttcgataatatagaaggctaacacctatggatttttgacagacaaacaatctccactaaaatccaaataatgtggtttatgtcaagtaaacatatgtgggttcactaatatgagtctcacactcaagatcaatgggtatatgaccaactttttgtctgaaaacaaccaaagcgtgaattttcgttaatataaaaaaactaacacatgtattttgaccgataaatcgaattcactaaaaaccaaataatatggtttatgtcaagacaacatgtgtgtggtaagtaataggagcctctcactcacgatcaatgagcaaatgaccagcatttttggccgaaaacgaccaaaacgtgagtttttgttaatatcgaaggataacacctattgatttttgacagacaaatgatatccaccaaaaacaaaataatgtgatttatgtcgaggaaacatgtctggggtaactaataagagactcccactcacgatcaatgggtatatgactagctttttttttacgcggaaacgacccc

SEQ ID NO: 12614 - DNA, 3462 bp, Zea mays
gttccctgaacgccggcatcttcttccctgcattcggcctatatccggcagcccctccgcagtcggcgccggcacaagcccttcaggtcggacacgacggcgcgtagtcccgactacgtaggcaggttgccggcctccgcctccggcccttcccctgcgccccgactgagtcgctgctgcagccgccaacttcacccgaggcgagctcaccacagccctccggaagtttgttttaggggctatcaacttggaagatggccgatgaggaacaaaccccaggctctaggaagagggttgcaggtacccaaatcaataaggataatcctgagcctgatgatgacgaaccagagcaagagatgggtacatttaagaaagctactgaggaagttatggcaacccggatcattgtaaaggttcggcgccagcaaacatcatcagctccttctaatcctttctctgcaattagatttgcccccactgattctagtgttcaaacatgcgcccctgtcccacaggtccagccttcagatgttaaaggtgacgagggatgcaatggtactgggaaaaatactttgtctgtgccagacaagaatgcaggctctggtgtaaatactgactccggtgccacaactgaagcaccacctcaacctgttggaaccagtgacaaggcagaaggcacagaggctgaatctggtggagacaaagtggtagctggaaaacccaacgaaggtagctgcatgtcatctgaagttcagggcaaaacgaaagagggagatgctgaagaaaaggaaggggcagatgaagctggaaataatggtacatttagcaaggatgatactgagaagaaaggtggaggtgaatcggagaccaaggattgcttgtctgaggagcagagagatgctggcaaaattagcaaggataaatctgagcagaaagatggaggtgaatcacatcagaaagacgctgataacaaagggcagacatcatcagcaacatcccttttctcgtttacgaatctgtcaagtggccaaaatgctttcaccagtctgactggaactggattttcaagcacgtcattctcgtttggctcagcctctaaagatggcccaagtactggtcctctgttcgggctgaaagctgatggttcttcgttcccttcctttagtcttggtgctgccagcaacgggagttccgccacagtgcttgctacctcagcggaagcacccaagaaatttgctatggcagaaggccctgtcgaaaccggcgaagaaaacgagaaggctgtatttactgccgattctgccttgtatgagtacctagatgggggctggaaagaaagaggaaaaggtgaactgaagctgaacgtccctgtatcctcctccggcggcgagagagcccggctcgtcatgcgggcaaagggcaactaccgtctggtcctgaacgcgagcctctacaacgacatgtcgctcaaggacatggacaagaagggcgtgacgtttgcctgtatgaacagcattggggagtcgccgagcagccttgccacgtttgctctcaagttcaaggacacagccaccagtgaggaattcaaggacgcggtggagtctcacagggcaagcaaagcaccggacgagccgctaaaggcgcccgagaactcttcgaaggcagcagaagcagaagcctgaagctgcactcgggtcacgcttactcgttttttgtacgtgtcgaggaaggagctgagagatactttctgtcattgccttcttaagaatgttacgtcatgacaatgacatgatgtcctgagcactggtgctgttgttggaacagtgggtagccttgacgaactttcattagctacagtcctaatctagagttctggagacgagactcgttagatttattcgcttgtcttgtgctccgttatgtttgttctatcggttaagctatgcgtcatgtgttatctagttattatgtcatgaatgaacgtatgcaattatgcgtgtcctggttagtatattccgctaacggctagggctaggttggatgtatctgtatgcgggcaagggtgttccaaattgggctgccaccttccttcttcaatatttatctttttaactaaaacacgataaataaaaaaaccgaaaggagtaattgactttgtttttctttatttctctactcatataaaacaccagtttctatagttttcactgtcattcttttttaaaaaaaataaactatcattttttaaaaaaaaatatggagaggaaatccctaaccattcgatctacgacgtgtttgaaagcaaattattttaaaaccatggttctgcttttgagcctacttattctgtaatcaagactcctcctgagcttacttatattattgctaggaagcaccctctttggcttcaggccacaaatgatgaatttgaggcacttctcaagaacaagatatcccaccatgtgttagtgtgtttggttctgcttttgaggtaccatgaatctgactatctgaggcacttcagtccaacctgacagtccatctcgcacggtgcacgatcagagtcactctcccgtgcccccctgcagcgacttgcattgggaccgggagtccgggagtggaagcctcgtctcggctgtggaggctggaagcaatgcagggcagcatcgatcagcagttgagcacgcatggaggaggccggccagctgcgagtcaggctacaggttgccgtctcttcttgtctctcattagcttcttgcttcctacttaggttgttactctgttctcgcttttacttcgagtcttcgacgtttcagacttccgagtcatccagatgttggccgggctgttctcgtccctgtactgttctacgcttcccttttctcgtcaacgtgaaggattgtagatttgaaaccaagtgctaagtgtctacagtcggcagcaagcgtgcggtttcatacaatccagtatcagcacggatttatcgaaaacacgcaattcgagcggcggctgtccatggcaatttggtagcactgccgaatgagctttgagctgcgcgtgcatttcttttagttaaaagtcacacgggattgaggccctctccgtgatcccggcctctcgcctccgcgttcgcaccggccggtcccccgcgccggccgctggtcaccagctccgtcgccaccgcaacaactttatccggccatccgggggcgcaaaatcattccattcgacttccgctagcgtcaagacctgcgcctcggcggttgccacgccggtgaacaagccatacccatccgtcacggccgcaggcaagcccatctcttgcatccgccgtctgcgcttgatctaggactaggagactaggttgagtcttgaggaggaccaccgccagagtccgcgtcgtcgcgccagctgctcccaccgctagtgcggcattggggatctcgtggctgttcatctgca

SEQ ID NO: 12615 - DNA, 2429 bp, Zea mays
gtcagcaacgactaatatgcaattaggccctatgtgcaagcgtgtaagcaaacaccataatctgttggattatgatccaactgtatatatagttgtggtttgttaggtgcttctttataaatctatacgaactgttgatgaaatgatttaaatattaaatatgatatacggttggatcttgattcaacggttcaatatactctcttgcatgattgtacataagtcctgattgaatattagcccctgtttggttcctttagtttagggactaaaatttagtccatactatgtttggttttaagaactaaaactattcaaaacaaattaaatgaattataagatgattaaaatacctcttatcattctcctgtcattagtgcaactgaaataaaggatggatgaaaagtgaaatttatatggtttagtctattttagttatttttgaggaactattagttctaatacattcaaacatccacttgtttatattttagttctactacggccgctcgtagagactagtctgtagcccggtcttagttgttccctgaacgccggcatcttcttccgcgcattcggcctatgtccggcagcccctccgcagtcggcgccggcacaagcccttcaggtcggacacggcggcgcgtagtcccgactacgtaggcaggttgccggcctccgcctccggcccttcccctgcgccccgactgagtcgctgctgcagccgccaacttcacccgcggcgagctcaccacagccctccggaagtttgttttaggggctatcaacttggaagatggccgatgaggaacaaaccccaggctctaggaagagggttgcaggtacccaaatcaataaggataatcctgagcctgatgatgacgaaccagagcaagagatgggtacatttaagaaagctactgaggaagttatggcaacccggatcattgtaaaggtccagccttcagatgttaaaggtgacgagggatgcaatggtactgggaaaaatactttgtctgtgccagacaagaatgcaggctctggtgtaaatactgactccggtgccacaactgaagcaccacctcaacctgttggaaccagtgacaaggcagaaggcacagaggctgaatctggtggagacaaagtggtagctggaaaacccaacgaaggtagctgcatgtcatctgaagttcagggcaaaacgaaagagggagatgctgaagaaaaggaaggggcagatgaagctggaaataatggtacagttagcaaggatgatactgagaagaaaggtggaggtgaatcggagaccaaggattgcttgtctgaggagcagagagatgctggcaaaattagcaaggataaatctgagcagaaagatggaggtgaatcacatcagaaagacgctgataacaaagggcagacatcatcagcaacatcccttttctcgtttacgaatctgtcaagtgggccaaaatgctttcaccggtctgactggaactggattttcaagcacgtcattctcgtttggctcagcctctacagatggcccaagtactggtcccctgttcgggctgaaagctgatggttcttcgttcccttcctttagtcttggtgctgccagcaacgggagttccgccacagtgcttgctacctcagcagaagcacccaagaaatttgctatggcagaaggccctgtcgaaaccggcgaagaaaacgagaaggctgtatttactgccgattctgccttgtatgagtacctagatgggggctggaaagaaagaggaaaaggtgaactgaagctgaacgtccctgtatcctcctccggcggcgagagagcccggctcgtcatgcgggcaaagggcaactaccgtctggtcctgaacgcgagcctctacaacgacatgtcgctcaaggacatggacaagaagggcgtgacgtttgcctgtatgaacagcattggggagtcgccgagcagcctggccacgtttgctctcaagttcaaggacacagccaccagggaggaattcaaggacgcggtggagtttcacagggcaagcaaagcaccggacgagccgctgaaggcgcccgagaactcttcgaaggcagcagaagcagaagcctgaagctgcactcgggtcacgcttactcgttttttgtagagtccaggaaggagctgagagatactttctgtcattgccttcttaagaatgttacgttatgacatgatgtcctgagcactgccactggtgctgttgttggaacagtgggtagccttgacgaactttcattagctacagtcctaatctagagttctggagacgagactcgttagatttattcgcttgtcttgtgctccgttatgtttgttctatcggttaagctatgcgtcatgtgttatctagttattatgtcatgaatgaacgtatgcg

SEQ ID NO: 12616 - DNA, 843 bp, Zea mays
attgggaccctcgaggccggccgggggggtactcttggggccgctcttagttgttccctgaacgccggcatcttcttccccgcattcggcctatgtccggcagcccctccgcagtcggcgccggcacaagcccttcaggtcggacacgacggcgcgtagtcccgactacgtaggcaggttgccggcctccgcctccggcccttcccctgcgccccgactgagtcgctgctgcagccgccaacttcacccgcggcgagctcaccacagccctccggaaggggctatcaacttggaagatggccgatgaggaacaaaccccaggctctaggaagagggttgcaggtacccaaatcaataaggataatcctgagcctgatgatgacgaaccagagcaagagatgggtacatttaagaaagctactgaggaagttatggcaacccggatcattgtaaaggtccagccttcagatgttaaaggtgacgagggatgcaatggtactgggaaaaatactttgtctgtgccagacaagaatgcaggctctggtgtaaatactgactccggtgccacaactgaagcaccacctcaacctgttggaaccagtgacaaggcagaaggcacagaggctgaatctggtggagacaaagtggtagctggaaaacccaacgaaggtagctgcatgtcatctgaagttcagggcaaaacgaaagagggagatgctgaagaaaaggaaggggcagatgaagctggaaataatggtacagttagcaaggatgatactgagaagaaaggtggaggtgaatcggagaccaaggattgcttgtctgaggagcagagagatgctg

SEQ ID NO: 12617 - DNA, 956 bp, Zea mays
gggtacctcgaggccggccgggcctaaagttttgctctggccaaacacgtcaatagtagagattttggactagattcgtgcaaaacactagaaaagaaaaggccatcgaaaacgccgccgccgcctctgatgctttccgccgtgcgatgtggtgcccttcgccggtggcgcccgccgccgcacctcctcccacgcatcctttcctcctcctttggtacatctcccgcgcgaccacaggtgggggcgctgctggagctcccggaggtggagaaggtactgcgcgacgtacgagcgggtgacgtgcgcgtattccccgtcggcgagagcggtctgcacggcggggcctgcgccgactacatggtcgtcgccacaggccgctccgattggcacgtccgtaacatcgcgcaggcgctcctctacaagataaagcaaaagcagaagggctctgatagaatattgatgccaagtgtagaaggtcagcaagcgggaaaatgggttgtcattgattctggaagcataatcatccatgcacttgaagaaagggcaagagagtattatgatttagagagcatttggtcaaaagaggtgtcccctaacacttccattcaggagttggagacctcgctggtgaagacacgtcgccggaacctatcacagaaacccatgaagagcatctgaactaggggatctggtacgatgatccgtgaaccgagataaattacgggaggtcgagcttttatctctttccattttgtagcatcttttacttacctaaacttgtcttattatggtggtagttaatgtaagattcactgcaaacattactgagttcaccatggggtaaatccagtctcacatgagtcatctagtgcatcctatagcgattacacaaatgacacatggcacgcaaacttgaaatgtaggacattgttgttaccttgggctttttaccctcc

SEQ ID NO: 12618 - DNA, 1874 bp, Zea mays
ggacatgtttggcatggctccgctccacttcagaacaactctactccaaaactttggttggagcagccctactccaaaacgagcagctctgcttcagagtttagattgctttcataaccagtgcagtggcgggtaaataattctaaactctatgtttagattgctttttagagttttgagagtagcaaaagaggtactacaaaggtgtttgggcggctccagcttccaacgtggagacgtagtttataatattaatttaaatagttttatttttttaatctaaataataaacgaaatgacttatctaaatgtattctaaagccttacaattccagctccacaattttttggagcacctaatgacatgctccaccaactacactaaatttactggagctagagctatctcaaacatgacctacaaaaatttgtactgtaactctgaaaattctatagagtttgtaactatggagttaatgtgtttggtaggctcttacttaagctatgtttggatagctacaactctataaaatttgatggaattagtgaagcaggttattagatactccagaaaatcatgtagctagagctgtaagtctttaaaaacatttagaaaaatcattttatttattatttagattaaaaataattgtaaaactatttaaattgatattataaattacatctacacactcaaacacccccctctaaagttttgctctggccaaacacgtcaatagtagagattttggactagattcgtgcaaaacactagaaaaagaaaaggccatcgaaaacgccgccgccgcctctgatgctttccgccgtgcgatgtggtgcccttcgccggtggcgcccgccgccgcacctcctcccacgcatcctttcctcctcctttggtacatctcccgcgcgaccacaggtgggggcgctgctggagctcccggaggtggagaaggtactgcgcgacgtacgagcgggtgacgtgcgcgtattccccgtcggcgagagcggtctgcacggcggggcctgcgccgactacatggtcgtcgccacaggccgctccgattggcacgtccgtaacatcgcgcaggcgctcctctacaagataaagcaaaagcagaagggctctgatagaatattgatgccaagtgtagaaggtcagcaagcgggaaaatgggttgtcattgattctggaagcataatcatccatgcacttgaagaaagggcaagagagtattatgatttagagagcattgggtttagggaatcacctcggtctagatgaggtgcatccaaagttcatactttaatggattttactggagtgtttggtttggggatcaacccattagatagggtgaaacattatgagtctatttctcaaatttagtgaaatgacttcaaaatattagaaacaatgtggtgatggatcaactcattctattgaaagataatgatggatcagtttgttcaagtgatttcacaaaccaaataccctcaaaatttggtggaatgactccatacatcatacttgttaattattgacttataaaaaactgaagagaccaaaacaatgttctcggtcgagaaaatccccgaatcctgaccccctatcactaacgggccagcatcaactgttcactctacaacgacccaactggagggtggcgcacatgacatcgtaacccgagagaggatggagcacaacgagtggatttttttaaccaagccgaaaaattcgcccccgaggggaatcgaacccaggacttggaggtgctactcggaagcctttaaccactaggctagaggccctttcgcataattattgacttatgagaaaagatgccttaatgcattaactcattctgctc

SEQ ID NO: 12619 - DNA, 1923 bp, Zea mays
gttttctctgtccctcacccgccgccgcagaacgctgatggcccagcgctggcgctcgagggcgcggtgggactcagacctggacgaagatggttccccgccttttcggaagccgcgcaggggcgggagcgacgaggtggggaacgaggacctcagcctggagatcatcgcgcgcgcgcagcggaagcggcgttgggcgtcctgcggtggagtcaccgggttcgccaacctgctctcagtgtcctccggcgacgatgaggacgccgtggtggagctcgctgaggcggatgagccccggaggaatcagaagaagaggcagcactggaagcaaaggaaaaggcaacggaaggaggcgaccgctgctgctgcggctgccgtggacgaggaagagaaggaggttggtaccacccaggaggagcaaattgggacagcagaatcggtgctaactgaagatggggctgatgtccctacatctcacagtatgtttctgcggaagctccttgattcgagcttgagacctctagctttgattgcatgcactgaccagttcggccaaaagcttaagttgatcgggagaggtgggcagttcacttatacttgaacacttgacattgtgttacttctacttgtgaccagcgcataccgagatactttgatcctggggaaacactgttggagacttgctttaattgtagcgaggaagggcatgtagctgcaaactgcccattgggaaagcggaagaagccttgctttgtttgtgggttgttcgggcacaatgcaaagcagtgcacccagggtcaagactgtttcatctgcaaaaaaggaggccatatggcgaaggattgccctgataagcacaagaggaatgatcatcaatccacattctgtataaaatgtggagaaacaggtcatgatatgtttggatgtgccaatgattacccatcagatgatatcgagcaaataagatgctacgcgtgtaatcagaagggccatctatgttgttccgacttctttgacaattctctggaacaagttagctgttataactgtgcccaatctggccattctggtctgggatgtgctaagcaacgcagggaagctagtgctgtcacaaccccaaccttatgcttcaaatgtggcgaggaaggtcacttcgcacgcgggtgcacgaagaatgccaagtccgatgggccaaatggctggtcgtcaccacacagtcagaggaagggaagatggaaaaacgatggcaagtcaccatcacacatccggaggaaggaaaaatggaagaaagattccagtgctagatcagctcctcatgatgcctgtacaacaagcaaaagcaatagcccctctttcgaggaaagaatgggcgcatctaatcataaatcgaaatggaggggtggttggactggtgatgacgatctaccatcgaagaagtacaaacccaatggatggggttcaccagctactcccaagaggtcttacacgaatcaccagtacttgtctggtggtggtgactacttcactccccagtcctcacgaaggcacaaccatggtaccgcgtcacccggtgctaggaaacacaggttctcgtcgtcaatattcgccgccagcaacacccatgtccggttcaaaagaagctagccggatgcacgtgtctgtttttgttgcttgtttagccattgataacagttatctcctggggttgaactctagctgctggttcatgcccttagataggtgtcttgtctgagattacatatttacatatgtaagcgcggttgaaactgattatttctactgtgaacaaagctttcatgccatggcgtcgccctccggataacaatgccttggtgcaaaaaaaaaacggcaactgaaaaactgttggtttgcttgctaagcactacaatgtgcttaactttt

SEQ ID NO: 12620 - DNA, 2118 bp, Zea mays
cctcgacccccgccggcgccggcgacacccgctgggaaggctttcccatcctagttgtcggcgcctcctccacatcgagtgcgctagggttttctctgcccctcgcccgccgccgcagccgccgatggccgagcgctggcgctcgagggcgcggcgggacccagacctggacgaagatgcttccccgccgtcccggcagccgcgccacagcgggggcgacgaggaggacgatgagctggggaacgaggatctcagcctggagatcgtcgcgcgcgcgcagcggaagcggcgcggggaatcagccggcggagtgcccgtgttcgccgaccttctttcggtgtcctccgccgacgaggagggcgccgtggtggagctcgatgaggcggatgagccccggaggaagcagaagaagaagcagcgccggaagcaaaggaagaagcatcggaaggagactacagaggctgcggcgggggccgccgtagaggtggatgagaatgcggtttgtagcaccgaggaggggcccattgggacagcagaatcggtgttaactgaaaatggggctgatgcccctgcatctgataatatggttctgcggaagctccttcgcataccgagatactttgatcctggggaaacactgttggagacttgttttaattgtagcgaggaagggcatgtagctgcaaactgtccattggaaaagcgaaagaagccttgctttgtttgtgggttgtttgggcacaatgcaaagcagtgcacgcagggtcaagactgttttatctgtaaaaaaggaggccatatggcaaaggactgccctgataagcacaggaggaatgatcatcaatccacattatgtttaaaatgtggagaaataggtcatgagatgtttggatgtaccaatgattacccaccagatgatatcgagaaaataagatgctacgtgtgtaaccagaagggccatctatgttgttccgacttctctgacgattgtccgaaacaaattagctgttataattgtgcccaatctggtcattctggtctgggatgtgccaaacgcagggaaaccagtgctgtcacaactccaaccttatgcttcaaatgtggcgaggaaggtcacttcgcacgtggctgcacaaagaacgccaagtccgatcggtcgaaaggcaagtcatcgtcgcatattcagaggaaggagaaatggaaaaaggcttccagtagtgctagatcagctccttatgacgcccgaaaaacaagcaaaaggaaaagcccccatctcgaggaaagagtgggcacacctcgtcataaacccaaatcgaggggtggctggactggtggagatgatctaccattgaagaagtacaaatccaatgggtggggctctccatctactcccaagaagtcttacgcaaaccaccagttcttgtctggttgcgactacctcactccccagccttcacgaaggcacaactaccatggtaccatgtcttcaccgaatcaccaattcttgtctggctgtgactacttcactcccgagtcttcacgagggcacagccatggtaccatgtcaccgaactggaattattcacccagcgccaggaagcatgggttctcgtcatcaagattcgccgcggctgccgccagcaacacccatgtccggttcgggagaaattagctggatgcacgcgcctgatattgttgttcgttttagccatagatagataccaattatctcctggggatgaactctacctgtcgtcggttcatgccctttcgatagttgtttgttctgagattattatatatgtaatcgtggttcaaactatttattatttttttttactgtcttccatggcatggcgttgatgccttttgcaaaaacggcaactgaaagtctgtaactgtgctttgagcctttccctgatgtttgagtgggcagtgcatcactgatgcggcattacatgcaaatgggtaactcgtcaaagtgcttgggatgacatgcattttacttgctcgggctttggcggcttgttcttgaaggcgaggattcgtgtccagcttcttcctgtacgcctccatcgatgcccgccgcgttctcattatccttcctgcaggcatcaa

SEQ ID NO: 12621 - DNA, 1428 bp, Zea mays
aaatcttcccccccctcccgttcccacttaatataatatcgacggcgactgccgactggcttggttggctcgtggtcgctttgcccatctgatgatctcccgctagcttccttcttgctactcccgcagtccccagtccccacccgctgcgccctcgccatggatccgagctccgaaatcatactggacactccatacttccgcatctacagcgaccgccgcatcgaccgcttgatgggcaccgaaacggtgccggccggctttgatcccagcaccggcgtcacctccaaagatgtcgtcatagacagcgacgccggcctctacgtccgcctctacctcccgctcccggacacggtggctgccgccgcgtcaccaccgcccagcgttaacgacagcaagaccaagctcccggtgctggtctacttccacggcggcggcttcgtcacgcagtcggcagcgtctccgatctaccagcgcctcctcaacgcgctggccgcgagggccggcctgctcatcgtgtccgtgaactaccgcctcgcgccggagcacccgctgccggcaggctacgaggactccttccgcgcgctggagtgggtggcggcctccggcggggacccctggctgtcgcgccatggcgacctgcgccgcgtcttcctggccggcgacagcgccggcggcaacatcgtccacaacgtcgccatgatggccgccgcgtcggggccgcgggtcgagggcgccgtcctcctgcacgccgggttcgggggcaaggagcccgtcgatggcgaggcgccggcgtctgtggcgctgatggagaggctgtggggcgtcgtgtgccccggggcgacggacggcgtggacgacccgcgggtgaatcccttggccgccgcggcgccgcccaggcccagcctgcgggacatgccgtgcgagagggtgctcgtgtgcggggcggagctggactccctgctgccgagggacagggcctactacgaggccctcgcggcaagcgggtggagcggcacggtggagtggttcgagtcccagggccaggaccacgtcttcttcctcttcaaacccgactgcggtgagtccgtggcgctcatggatcgactcgtcgcgttcttcgctgcgaactgaaattcgtcatgtgcactcagtgttttatacatagtagttattgccgaggttttcaaatatgtaaaagtgccctataatttgaaaataggtatattttatataatatagggcaccaataaaatatctcgctgttgaaatgtcaaatctagattacagagcagtatgatgtagtatatttaagagcttgaaaaggtattttatatttttttaccaaattttatgaaacaagttattgttggagttgttttaaaaaaaaaaaaaaaaaaattttaatttaagacgtcagtttaaggt

SEQ ID NO: 12622 - DNA, 2393 bp, Zea mays
ggtaccctccgccgccggccggctcctcgcgtccggggacgaccgcctcgcgccggagcacccgctgccggcaggctacgaggactccttccgcgcgctggagtgggtggcggcctccggcggggacccctggctgtcgcgccatggcgacctgcgccgcgtcttcctggccggcgacagcgccggcggcaacatcgtccacaacgtcgccatgatggccgccgcgtcggggccgcgggtcgagggcgccgtcctcctgcacgccgggttcgggggcaaggagcccgttcacggcgaggcgccggcgtctgtggcgctgatggagaggctgtggggcgtcgtgtgccccggggcgacggacggcgtggacgacccgtgggtgaatcccttggccgccgtggcgccgcccaggcccagcctgcgggacatgccgtgcgagagggtgctcgtgtgcggggcggagctggactccctgctgccgagggacagggcgtactacgaggccctcgcggcaagcgggtggggcggcacggtggagtggttcgagtccaagggccaggaccacgtcttcttcctcttcaaacccgactgcggtgagtccgtggcgctcatcgatcgactcgtcgcgttcttcgctgcgaactgaaattcgtcatgtgtgctccctattttatacatagtagtgacatataaaactgccctataattttaaaataagtatattttatataatttaagtcaccaataaaatatcttgctctaacagtaaaacgtcaaatctaaattatagagcagcttattatggtgtagtatatttgagtcatttgaaaatgtgtactataacttttttactaaattttatgaaacacgttattgttggagtagctttttctatgtagaactatatatttcaatttgagacatcagttatattattggagatgctcttacaatcttatgtctcgatccatatgaagatgtgtcaagtctgtattttatttctatttatttataactatgtgtgatttgttattgtagaatgttgtatgtgaagttacgttctatgtgcgctttaaggatgtaattcgtattcgaattcgatcgaatttgatatgtctaagagagttaatattcatttagggttaaaattagatccatatccaagttcaggtactcattatttgatatgtatctgtattctcaaagttagatatttaagatatcaatatctattcaaattatatccgacacaacatgataatatctggtctgaatctgaagagaaaatgtaaaaaataaatatggaatgagtaatatctatctatctgtattcgatccattacacctttaatgcggttatatctgtattttaactctgtttttgtcttgtccatgttttgtatatttacaatcttaaggcctgcttcaacgattcatgcgtcggttctcccttccatgtatatggcgtgtacttgctcaatagccatgtgtttggttgcatgtatttgctggtgtttgcatcgcgggatacaatgagcaggtgtttggttgttgtcaaccaggctctacgcggtgtgaggtgtgtgtttagttacctgcatatagatgtgaagtcaggcttgcacgatacttaaagcactctgagtaagactctgcagacgcaagcaaattagtcgcatctctgcaggccggctttcctggctcatgcaaccaagctacgcggagaagccaactaaacaggcctctaaatgcgtccaacgtttctctctcctctcttcttagtgggccagaaaaatcccacgtgaggctccttcactaatcagtagtattaattgtaaattaattcttttcaaatttaatcattaaataacaatatatattatgtgactaaaaatattgtacggaatttttaaactgcaaaaaatgttgtataaatattaaatatcttagttaaagcgtaaaatggattaaatagaggaaatagttggagagaatgtgaaaaacgagaggaacgagaaaaggggatgtatttaaaataaatagaaaatacaaataaggacacatgcaggcgtgtcagcggcctatgatgaagctacaaggcctaggtgggagcttaggtcgcggcccaggttggcgggtggctggcaggacagcccatgatggaggcctaggcagtaggcacatatcaagactccatgtacttataaacaaatccatctgtttttttagagtgcagattttggagttagatcagattaaaaaattctagttgcttctgagatttcagggagaatttttttgtgatggtctggatagagcactatgcacacataattttagtgatcaaggtcatgtttatgcgaaacaaatgtggtaattctgttcctctttct

SEQ ID NO: 12623 - DNA, 1456 bp, Zea mays
gccccccgagtccccccccccccccttcgactctcccactcctctgtcgcttccgccgacacctgagtcttgtcgctgccgccgggatggccggagtcaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcagactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggtagtgtggctttagctgacctgctgaaaaaaaggcttctggaagaagggaggaagccgtatgtgattcctgttggtggatcaaactcattgggaacttggggatatattgaggcaataagggagattgagcagcaaattcagcaatcttctgatgttcagtttgatgatattgttgttgcatgtggcagtggtggaaccattgctggccttgctttaggatccagattgagcagcttaaatacaaaagttcatgcattctctgtttgtgatgaccctgaatacttctatgactatgtccaaggcctgattgatggacttaattctggtttggattcacatgatatagttagcatcgaaaatgctaaggggttaggctatgccatgaacacagctgaggagcttaagtttgtcaaagacatagctgcatcaacaggcattgtccttgatccagtctacagtgggaaggcggtttatggtttgctaaaagacatggctggcaatccagccaaatggaaaggtcgaaaagttctgtttatccacacaggtggtcttcttgggttgtatgataaggctgaccagttgtcatctttggctgggagctggcgcagaatggatcttgaagattctgttccacgcaaagatggcactggtaagatgttctgatcagtatggtccatgtgattccatgatggctcattcttgcaaacattgtatccattacagagttgttactcttaaatttgtgcaagaaaatgcagaatagatggttcacattgtatagaacactgatgcaatttaagaataaagcactctttctgccccccaaaaaaaaaacccaacaaaaa

SEQ ID NO: 12624 - DNA, 8612 bp, Zea mays
  misc_feature (4321)..(4321): n is a, c, g, or t
  misc_feature (5232)..(5232): n is a, c, g, or t
gtcggcgtatctgcacgcgcagccgcatgcatatggggagacaaaggcccatggactcgtagcttcggctgaaaaacggatcgaccttcttttgccgaagaagttagcacggttgccgattgccgttacctttttcttaacgcggcccagaaagattcgcgcgccggtccaaccgaggaactagtttcggcccagtaactcggcagcctctttcctccatttcctttttctttttatttttgtcccccggccagccctccttgccattgccagtctgccaccccaaggccccaagtccccaacccttgaaccccatccactccttcccgaccgacgggcgacggcgcgtcgccgcgtcggtgccacccactgccggtggccggtgccatatggcatagcataaggtggtccgccgttacgccgccgacgtcgccggagatgaatgccttaatttggcattattatttttacgaattatattatagtagtaattaatttagctgagaaatcactgctacaacgaaccaaacatcacttgtatgtacacgtatcgtttcgacgacgcgccaggacgccagtacacatacaccaacgtcttacgagcagcatatacaacacgacgtggcatgaatgtactacttgtacccaagctagctagagcaacaacacgatcaacgagtagctagttactattagcccctataataataataataatacacatggtcgtgcggctgatgcatggttggtttcatgaccaccacgtacagcagcagctacgcggcggcgcactcgacctcgtcgccgaccctgccggccctgacggtctgcttgtacgagcacttggtggcgaccagcgcgtagaatgccaggttgacggcgctgatgcacgccagcagccagtagaagaggtccagcctgctgcggttgaggtccttggcgaaccagccggcgcgccctccgcgggagctggcgcggtccgccgccgtgatcaccaggctgctcaggaagctcccggcgccaatgacgctgaggtagaggccgatgcccaggctgcgcatgccgtcggggacctgctcgtagaagtactcctgcaggcccaccagcgcgaacccgtcggccacgcccatcagcgcgaactgcggcaccagccacagcaccgacgtcgacggccgcgcggcgcccgccgacagcaggcgccgccgctccaccgccgccgccacgcccagccccgcgatggcgaacgccatgccgatgcccacgcgcccaaggatgctgatcccgcgctcccctcccgtggcgcgccgcaggtacggcaccagcgccttgtcgtaggccgccaccgtgccgatcatggccaccgccgacagcgcgaacaccgacgccgccggggcctccaagtgcgggcccaggcgacggtccatcacgctgccctgcttgatgaagaaggtggacacctgcgccaccgccatgccgaagggcagcgtgcacacccagatgggcaccatcgccagcaccagcttcgtctcctccacctgcgtcaccgtcgccagccgccacggcccgcaggcgtcctcgccggcgccgggctccactactatggctgccttgtcgaggaacctgcacgcaccatgccacgcacgcgtcacgctcaaggctcaacaacccaccaccgctggcgctcatgctccaattcgattacgctggtccttttgcttttcggagatctcatccagatcgatttatttgttcgtccacgagcagtaaagatagatggcaaaaacggatgaactcggatcgcaatcacgatgcactagcgactgtttcgtcagttctatctaaaggatccattgcatttcgcgatcgctttttttttttgtttatttgaaagggaagctaaattaaggccgccggggagaatgggaatgagaagtgaatgcaacgtgacctcagcgggttggtgtggcaaagcagcctcctcttgccactctgcggccgcctgacctcgtacagctcggcgtcgtcgtccggcagcgggagtcgcctattcctgaaggcggcgacgaggacctggagcagcggcgtgagcgggctgccctcgggcaccctgtagcggtagtaccggcggccggcgaggaagacggcgagcgaggcggccatgacggcggcgagcgcgacggtggcggcgccccagccggcgcggtcctgcgcgtagacgacggcggtgacgccgagcaggacgcccgagcagagcgcgcagttccaccagttgaagaaggacatcttgcgcacccgctccgccgcgtgggcctcgtcgaactggtccgcgccgaagctctccagggccggcttgtgcccgccggtgccggcggacaccaggtagatgccggcgaagaagagcgcctcgtgcaggcgcggcgagcggtcgggccccagccccggcgccagctgcgccgtcgccagcaccgtcaggccctgcggtaggagagaggtcaggaatcaggatggccgccggacgggggaaatgtggaacacacacacactacacaccgcagctgatcaggtgctggctgccgcctgccgatcggttgtcgatctcatgggccccgtgcatatataaatattagtaagtcccctcaccagcaggtagacggcggtggagacgacgacggtggagaacctgccgaggtagccgtcggcgaggaagccgccgagcaggggcatgagcgtggtgacgctcatccagtagttggcattcttggcggccgccttcatctcctcttgcagcaccttggtgaggtagatcatgaggctcgtggctatgccgaagtagctcagcctctcgctgaactcgatcactgcggacgtgcgtgcgaagggaggaggaagttaaaaacagctacgacgggacgacgacaaggagcgaccggtggtcggcatacatgcatggagctccgatccagactaaagctaataataagtagtaaacagcactcacggatgatgaacatggcggccttccaggacccggtggtggcgcgggcgggagacctcccgcggtgatcgacggaggagtcgtgcacccacgcctcctcgtggtcgtcgtcgtccatggcgcccctagcaacctccaagctcttggtcgtctccatatatagtctcctctcccgagcaaccaaacactccgcgcgcgcgacgccgacgatggagttgaagaagacggactcacggacggtgaggtcgatctcgcttccctttaatttgctagtgacgaaaaaggagggtttggtttggtccgtccgtctagtagagcagcagacgattgttcatgctcttggagagcgctagtgaggctgatcgagaagggctggccggtgtgctcaggtctttatattgtttatttatttacacacatatatatacacacacatggtaagagaagcaggcaggcaggcaggcaagaggaggagctgggaagaaaaggagagtgtggtcgctgtcgaggagaaagatgtgcacgaatcggatcgagtaaaggagagttcctctctcttttgttcgggcgagagaaatggagggaaagaaaggcaaatccgttgaagggatttgataatgtggcatggcatgaaattgttgagtgaaaagaggcgggcactcacttgagacttgactgactagtggatggctgggctggcttggcccttggctgactgagagccaaaagctgatagtactttactagcaggggcgctgtggtcgtctgcaggcaggcacataccataccataccacgccgattccacaggacagtcatctaccgaagtagattgcctggaatgaagtcagaggtgcagacggcagcagccagcaggtggtgacgcagtgcagtgcagtgcagtgcagtgcagctcgcgagtcgcgactcgtccgcactgatggtgaataaaatgaccctgacttgtcggctcgtttgaattatggttagtttggcccatttgaattattttaggacctaaaatgatatcatatttcggttcgttaacgagtcagttcacgagttaaaagggctatcatattacagcaaaacaaaattatatgcatatcatttaaataacaatttatgaacatgttataaatatttaggatctatgatctatgagttaaactaataattgattaattatctctatgtgttaaattggtctatgcgaatatgtgcgcgaattgtgaactaatgagtaatgatgtgtgttattttggtgttacattgataaatctgtaaaactatgagtataattactatttttctattgttaaattantttaaaattatttaaaaattaattattactatacacgcattttttcagtctggctcatgagctaaactagtcaattcgagcttataactgtgctgactctgcgactcattagtttaaagagtccagccagcctaaacttgaacgaaccgaatcaaactggctaaatatctagccctagtcagcacaacagttcatttgtgatagaatcgtcatgtcattctacgaagaatccaccgcagactcctctagtcagagtcggaggatgatggatgggattttgctccgaacgggaagtaaagctggctaccggacagtgcggaggaatgaactatgaggctcgttcgagcaccatccttctctcacccctcctacattagcttctgacttcattttcacctctgctgctccagtgtataaattatactaaattaataaattatagcctcaacctatagccatattaacttttttattttaaaattaagtaattcatttaagtttatttcaacatttaggaatcacacaacataatgaaatagtgtgtgaaatgagctccacctaggtagtggtatttatagagactgagaatgaaatttatgattgtttgcatatttttgatttttttggactataaaaacagctagatacaatggaaaccgcctgtcactctatctcgtgccagtgcccctccctagtccgagcgagatatcgtccactctcaccaggcgccagccgtgtcacccggaaacgctctcccgacctattctcgcctatagccggcccctgccgtccgcactcccgcccccactgacaccagcctgaactgagatccgttgaaaaggagatgaacactatccgcatgattggttggcacgctcatcaacgtcaggctcgcgccagtctggacgggntgggatctaggaacctcccgtccccgctcatgcatctaattggtgaaaaaagtacactgcattgcacccgcccgtgtagatcagtctttgcatgtgcatgcaaccaatcagcgctttggacgtagtcaacgcatgcggaggacatgagcgcgggtagcagggaaactaatcatgtggtatatgtttgttcatgcatcacctagtgcatgcaatgcagccggatcaagatcgttttcaggattcaaactacgatgttgactgctcttggatgtgcccatcggaccgtcgctcgcggctagtaaccgcattcgcctctgaaacgaaatataattgccccgtccacacagatcacgttgcaggtgtgagtccagactgagattgctaaccacgaccttgtcacatacgtacaccacacatcgtcgtcatcgtacgtcacaccagtccagctccttttgaatgctggattttcgcaggaatgctatataaattttaaaggaattattaaaaaaacatagaaaaaacgtaacgtatagcggtactgttattttaagtatttgcgtgcgtcaagctcgctgaaaaaaatgctcgtggatccatgcgtgcactcgcatcgccgacagcgtcgagttggatgcgattggcgacggattcactccacagtcctcacctttgcagctccacttgggcttgtttggctttacagtcagtcagtgcccgccgccaactagctagctagctagcttattccagcacatgaaacaaatgccgctgatcgagattatattggccgtcatcatcgatcacagcccaaaaccactgtcagttcgtcatgctgaaagggtacttactgctctagctgcaccgtacgtgctgcaaagcggccagaggttggtgagggggtggcatccactggtctgtgtggtactggtagtggcgccatgcatcgatctgatcaatgacgtgtgcctttgttgaaagaggatctgctgattatgtagccatgtatgtaataacgaccactgggtagtgcctttgtagagccgttaacagtcatccactcattctgagcagtgagcctgatgacaacgtgctgggaacagtacatggttcctttcttttggagatgccaatcagatcagacgtcccttcattgtagcctgtaggcgaggtggtattggtagccttttgtccaagtcgtctgatggaaaaagagaggaaattgcaggcgttttagatgtatagtaataacatgtttgttttgttttttcccagtaaaatgcaaaactgttagtttagcggtggtaaatactctctccgttattttttatttatcgtgttttaactaaaaaatgaagtaaccggcgacaaatattctaaagggagatattctaaataagggtcttcttgtgatttgtgcaggggtcccatctttgacttgcacaccatcctggagcatggaatctcctttaccaaaattctcattatgggagaacccctgtcctgcactggcaagctagagactgattgaaataaaaaaaatttagtcgttgtggcagattgcattccagccacacgtgagtatttgcttttctattacggcaacaacaaatatgcaaagcgtgcaagcgaattttttaatctgttagaccatgatccaactatagacattagtacaagaggttaagtgtgaaatgaaattatatgattggatcgtgacctaacggatcagaatgtttatttgtatgcttgcacataagatcgattgtatattagttgttgacttctattgcactggccgcacagtggttttctagcatggcctactctaaccctctctacctgatgaggacaagcatatggatggatggatggatggatgaacctccttttttccatggcaggcaatggtggtggcgcctacacgcgaacgtttttaaaatgcaagaatgtagccattggagtaagtgattaattatccatacattctggggatcatgatttgaggcagccagtaacgagaggaataccttgccgctcttgcattgcatcccagcaagcacgcacgcactgccttctccggtgtccgtagtgccgcttcacatcaatccatcgccaagggtaaattttctatctgggttcagtcgttaaccagcacatgcacgttcccatacaatcccgaattaccgagtgccaatccgcatcaatttacatcgctacacgagtagcgtagccacccccaccttgacgagagatcgcgatcagggccaaagctgcctgccactgcaaccggtgaagagagaacgacgcattggattctgatgctacgagcgagccaggtttctagaacggcctgcaacgcatgcatccatgcttgctttggcctgcaaagagaacacacacacacacacacacaaaagccggtcaatgcatggctatgcgcgttctcggcgaggggacagcacacgattcggcagaaaacgtttcgcgtcgccgggaatcccccccgtcggcgcagacgcgcacttggcaaatcacaggcaagactcaagaggcgcgcatcgagcgagagtctgcttcgggctgaaaagactggcagttttttttttctttttttggtgtggacagaacatgttcttcgtcttcctccctccttccctcgagcgagagtcttcttctctcggcggcagctgcaggcctgcaaatggaggtcgcaagttggtaaacacctcgcaaatcacaaggcgcaaggatcgatcccggtgtcgctagcagtggcgcccctgccttattccctctccctctctctctctctctctctctctctctctctctctctctctctctctctctctctctctctctctctctctctgatggctcgttccatctccacagaatccagccacacgatgctcttcggatttggcaacgctgtcgaccctcgtccctgaaagactgggcatctgaataatctggagcagtgctcgcgatacgctgtcgcggaatggatcggccgaaaccagcacggcgatttagcactcccggcctgttatcgtggagggttcttctgttttttttttctgcttctctctgaaaaaagacgtcgactcggcagagagtgtgttcgcagttatgcatggttgtcacactgactgacatgatagagaagatgcaatgcagttccaaagtgggagatggaaagatcagcttcagcagagaactccattcttttttttgaagaatcagtaggggtgcccctgctgagaaatttattaagtaagcgaaacgaaaacgttaagacagggtctttttacaaacgttaataagtaatgaaaagagaatactactcctatgcctgtcacaggctcagccaattcggg

SEQ ID NO: 12625 - DNA, 5129 bp, Zea mays
ctgaggaatttgaaataatatactccattgaacacaaaatatgtatatcttgtgttaaacctttttttataagctttgagatatacactcgttgttgtacaatttctagacaactgtgaattggttttctagtcttaaccttagctcacttagtcgttgcatctatcagtaactaatactaacttctttgtcatgcatataggacgtgtttggtaggctgcatatgggccggccaggctggtgagatacagcgtacgcttgtttggttgcttgtctctgtatctggtgggctgaggggcggtgtttggttgcctgtatgtctgtgctcacctgcactgcgggatgcaacatctcgctgtgagccaggctgtggagaaacgagtttcatttctgtatctcgggagccaggccctggctagcctgtttggagcgggcaggctccactgcgaaacgaaccaaacacgccctatatgtatctagctagctagggctgttacgttaagttagacaaggccgggcttagcgtgacctcataaattggcttgttaaacgttgcagtcacgtacgtatccgctatactagctgtgtaaacgacatgcatggtcgatcgatggagcttgttaaaccttgcatgtttgtcgatcggtcccccggccccgtccttctcttttctttaccctctgctcagctgctgctagtgcactgctcctacactgctgcatgctgcttattactgtgctatcagtctagctagcacgtaccaggccagcaggctatcgccggtcgtttatctttttatccctgctagcttgctagctctttacttgtgcgtctttttctcctcttcttttattcttttgtctcttggttcgtcgcccccggccccctgtcgagtaaagggaagccaggacagccacgggctcgcaccgtacgtctggaggtcctcccctgctgcccaaaagaccgccggccggtctttggctctttgcccccctccccctgtttgcttgcttgcagctgcagtgcaggaggtcgtagacgctggaattcaaacgcgcacacctgcatccctctgttctcgcaagagctagccgcatgcatatgcagtgaagtgaagcctcgacccagttgggttccacttccacagcagtggggtattgtttagtttgcatcgacgatcgatcaccgctacaccacttgctcttttgcaagctctctctgtgttttcttgcgacggcagagggcgcacgcgcacttgtgcacgtacgtacggcattacacgggctggccggatacatacatcctgctgatacgatgagagaccttccgagcccggccatgcatggttagttttttttctgtacaagtacacgtacggttctacagcatgaaataaatcaaataatcgtagccgctgtgcaaatatagggcctgcgagcgcggtgtccgtttccaatccgcgcggcactcacaatgaagcgatgggaccgtcgttaaagttggcgcccaaagcggaggcagcaggcgttttcttccagtcccctgctgtgcgtgccgctagctttttttgggcccgcgccggcgccgccgttacggggcacgagggcaaacaggtccacaggggaaaggccggggcgtggcctcgtttggagggaggtgtttggaactatttcacactctatgttttgctacttcgcttcattttctgtttgctaaacagtctaaacttcagcaactctctctaaaaagagttagagtgaactccgccatttcagtggagcaggaaaagaggagtaatcatgtactaattagatcacttaatagactcgtctcaccctatgtaactagttttgtaattatgctatatatattcagtacctctagctagtattcaatcgtccgggctaaaatttagtccaactgaagcatgcgtagaccgcgctcggcaggttcatccagtaagtccaatccaactgacaaccgacacggcctcgcgaagcctgcagctccactcgaacatccatgacatgatcggggacgcgctacggagccgtagttgggtttggacgggcctgtcggctccaacgggcgtccaacactattgcaatggggtccaggttaccattagcccacattttgagatgggcttaaaaattattacggatgaaagggatgttgtggcccaactggctggctgttgtgtcgatccgaccatcggttttcactcggtgctggtctgctggagcagcaggagtccaggacagtgagaggaagaagtaaaacaacagcccattttggcagccagcagcagcacagcacagcaccgcaccgcagcagtgggtcaatgacttcaatccagatctactcctgcagctcccaagctaggacgaggcggatccggtgcgtttccacagcacgagaggcgcaggtactgagaggtacatgtacatgtacatgccagtaggattcgagcaggcaagtagcactagtagcttccgatccggagcccgtcaaggctgcgaccagaccagagaccaccgaaatatgctcgcctccggcggcaggaaggcacgggagtaaagccaactcaaggaataactaacgggtgccgcgctgtaagccgcgaagcgagcacgacaggaatccgcgaggtcaggagtcaaaaacccaaaaccaaaagggcaggcagagcatcagggtgcgcagagcccggctgctggactagagcccaagcaacgaacatgccacgcgctgtgcctgtgccttgacctcagagcactctacagagccagctgtgcctcctgtaagtcctaatcatggctaaagtctaaagacacaggccctcgttccaaggctgacaatccggacgcttcggttcttgtttaacattctgaatgttcacaacttcacagcctcacacaggttgctgctggtctactgcgtctgcgtgcgtaggtgacgagatgcagtttactagtgattagtagtgaggatggtagccccagcccggacagctgtccggagccaaggatggatggacggggtcttgggtgccaccgggaatcaatgccctgtagctgcacgagtacggaaaccttttttcaatggaaagaggaggagcgccgaggaaaattattagatccgaggacgtcgatgattgtatctacgtacgcgagtccacgacggaatcggaattaggcgactagctttcttgggacaacggacggaagatacgggtgacaccgtgacaggagagaagaatccagaatcctttctccaaacgggacgaagaaaagtgtgttacctgctgaacccagcccctttctggagctcaacaaggcgctaagcatgtcttccggacagaaggcatgtgtgccacgctgcctacctgatcgactggcctctcgatccaggatgattttgcagccatttagcatgtcatggaaagaacactctgacgtaacggactaaacggtagttgcatatcgcgcagcagacggggtcagcagtattgaatgccgaacgtgcttgtatgctgctgcagttctgaatcgaccggacgacaggaaaaggatctgggggaggagaactatggcaaggtagcactcattaatcagtaggacaatgctttagcccgccttctgcttattatataagaggcccgcgagcacgtactccctcataaatatacatttacagatggaatcgacctacacccaaataattaagttacccaagatcagatggtaataacccttcgactctgttagaacacaaagctctcttcacccgttgacctttgtacagcccacaaaaaaaacaaaactaaatcaaaagataaatagctttctttatactcatcatcgagcagcgacttcgatcctgcaggttatttccacgcactgttcttgatcgcctttacataacctcctttttctttgggaatgtacagtttcctttctttgcctgtatagtttccactccagctcaaaccgaatctgtaatgtcttcttccctcttcccgtgatccagatacaccgtacactggatcactgtccctccgagccggaagcccggcaccaccgtgaacccgaccttcggccgcaccggcttcccgggctccttgctccccgcaaaacgcttcttcgaccggacaatgttctccatgtacaccgtcgagaactctgcgccccggccgacctggaatatgccgactgcggggtcgtatgcccaggctaacctgtggagtgtccagatcgagcttgccattgcgacgaacagctcgtagagtgggccggccacgctcaccaccggcagtgtcccgcactctgagttcccgaacagtgaggactcgatgcctggatggatcagctgtctgtacttgcggtcgcagaatcgggcaaagtcacagtccgggctagaattcatcagctccatgggatctgcatctgagtgctcgatgaattgctgcagtgactcgttcctgcgggctgccagctgggttcctccaagctccgtggtgtcggctgtggcgccgaactggtaggagtcgaagccgtcgaacatggagaggcagacgcgggagaggagcgcgtagcggcagtggccggacttggagtaggcgacgccagggtaagcggcctctgcggccgcggccaggtcccacccagcgcaccgcaggacctcggcaagcgcgcgggcgaaccggtgcgcgacgcggagcgcctcgcgtaggacggagtcgaagacgcccgcggacagcatcgcgccgacggcgtccccgcccggcggaggcgcgagcgcgcggtcgaggcggcccgcgagccgcgcgttggcgtcgtcgagcgcctcgaggtccagccgcagcgcggcggccgcggcgtccttggcgtcgagcgcggcctgtaggcggttcaccacggcgtcgaacgaccgcagcagtgcctggttctcgcgcacctgggcctcgaggtgcgccgtgagggccccgccaccgtccgtcacgggcgggcccaccggcccgctcctcgcgatccgcttgagctccgacagcctccggaggtgcgacacagcggcggcgtccgcggccgccgccgcatccggcaggaacggcgcgtgggcggcctgca

SEQ ID NO: 12626 - DNA, 948 bp, Zea mays
catccctccccaccaatccctcctgctggacgagatatccagcgccgcgaacccgagcctgcagttgctgcagcagcacggcctcggcggcatgatccccagcggcaggaacgggccccccccgcacccgcccccgccccagccccagccgcccgcagcgggtaaaggggccaaagagccgtcgccgcgcgctaactccgccatcaacagacctccggagaagaggcagcgcgtgccgtcggcgtacaaccgcttcatcaaggacgaaatccaacgcatcaaggctggcaatcccgacatctcgcacagggaggccttcagcgcggcggccaagaactgggcgcactttccacacatccactttggactcatgccagatcaccaggggcccaagaagacaagcctgctacctcaggatcaccagagaagcgacggcggcgggctactaaaggaagggctgtacgctgcggcagccaacatgggggttgctccatactaatataataataatcactcctacgtacgtgctcaagcttataatattagagtagcaaagctgctacgtactgttagggctctatggactactacgaagctatggacgtgtttggtaggctgcatatgggccggccaggctggtaagatacagcgtacgcttgtttggttgcttgtctctgtatctggtgggctgaggggcggtgtttggttgcctgtatgtctgtgctcacctgcactgcgggatgcaacatctcgctgtgagccaggctgtggagaaacgagtttcatttctgtatctcgggagccaggccctggctagcctgtttggagcgggcaggctccactgcgaaacgaaccaaacacgccctatatgtatctagctagctagggctgttacgttaagttagacaaggccgggcttagcgtgacctcataaaaaaaaaaaataaa

SEQ ID NO: 12627 - DNA, 1921 bp, Zea mays
ccggccgccgaggaacgattcccttcgcacaatcgtactgttcccctcaaaccccagccagccatggcgatcgcggcggattctgccgccgatcaagacccaaaccctatacccaacgaggccgcgggcgaatccgtcgagctacccgcgtacactgaccacggggaacccaatgcggatcttgctgacgtggactacgaggatgaagaggagctggacggggtgacggcggaagcggcggcgagagacaaggtgcaggcggtgttccagcggctgtcggaagcccccgttggcatccgcgtccacgacattatcatcaaaggcaacaccaagacccgcgacgcgctcatcgaggcggaggtcgtggggctcatccgctccgccgtcaccgtgcaggacctggtgcgcaccgccaacatcgccgccgtgcggctcaggctcctcgacgtgtttgactccgtccacgtcctcctggatgctggccctcccgagctgcctggcaccactaacgttataatccaagtcgtcgaggctgctaaccccatcgatggaagcgtcggctgcttctccaagccggaggcaaggtcatggacagttgaaggatcagtcagatggaggaacatatttggttatggtgacatctgggatgcttcgggagcatatgggtgggaccagtcatcagagataagcattggagtatccttaccaagatttagatcgataccaaccccctcgactgctcgggcatcactcttgtctcatgactggctgaaattttcatcatacaaggaacgtctgcttggcctatcctttggtttgctttcggacatgcaccatgatttatcttacaatctgacttggcgtaccctgactgatccttcacaagcggcatcaaaatccataacaagacagttaggacataaccttctttctgcattaagatatacatatacaatagctcttggggattcccatctcaggccaaccaagggatatgcatttgtctcaacttcccaagttagtggtctatggggcagcaaaggattgagattcttccgccaggagtttgatattcgcggggctgttccattgggcttttacaatgctgccctaaatgctggcatctcagcaggggtgattttaccgttggggagggggtttatggaatcaccttcatctgtacctgatagatttttcctgggagggcattcttctccagtaatcagtctttgtagtttaacttccctactgggtttcaaaacaagaggagttgggccaacagaactacggagaattgtcccaagtgaatctgtgacagatgaatccacagcctctccaggatgggactatttgggaggtgatttcgcagtttctgcatttgctgatctatcctttgatttgcccttaaagttattccaggatgctggcatacatggccatgcattcctatctgctggaaatctcgccaagttgtccgagggtgagttcagaaatttctcgttttccaagttcgggcgcacatttaggagctcagctggtgttggcattatcttacccactaagcttcttcgtgcggagataaactactgttatatactgaagcagtttgagcatgatcgtggaaagactgggattcagttcagtttttcgtctccaatgtagatgtcatgtttgtggttctccctgactatgaacaatgcaatgcttaatcgtgctgagcatttccgctcgttctattttggttctggctgaatcatctttttaactaactaggagtccagcaaatccatatccagatgattgatcttttgtatcatgctcgttgttgaccattagaactggaagagttgccttgctgacggttattgtgaactgtgatggtttcatggtcggctaaaaaatgcgtatatgttggtggcaa

SEQ ID NO: 12628 - DNA, 1153 bp, Zea mays
ggccgccccgtcggtcttcatcatccaggcgccgcagtgtgtaggtctagatcatccaatccaacacaccggtcgagcaatggcggcagggctgcaggtgttcggacagccggcgtccaccgacgtcgcgagggtgctgacctgcctcttcgagaagaacctcgagttcgagctcatccgcaccgacaccttcaagaagtcccacaagctccccgagttcatcaagctcagggatcctactgggcaggtgactttcaagcacggtgacaaaacaatcgttgattccagggccatttgccggtacctgtgcacgcagttcccggacgacgggtacaagaagctgtacgggacggggtcgctggagcgggcgtccatagagcagtggctgcaggcggaggcccagagcttcgacgcgccgagctcggagctggcgttccagctggcgttcgcgccgcacctcaagaacgtgcggcccgacgaggcccgcgccgcggagaacgagaggaagctgcacggcatgctgggcgtctacgacgacatcctctccaagaacgagtacctcgccggcgacgacttcaccctggccgacctctcccacctgcccaactcccactacatcgtcaactcctccgacaggggcaggaagctcttcaccgccaggaagcacgtcgccaggtggtacgacaagatctccacccgcgactcgtggaggcaggtcatcaagatgcagagggagcaccccggcgcgttcgagtgatcggtcggtggtctacgcggtgatgcatgcatgcatgcatgcgccgcggcgtgttcctcgatcgccgccagccaccggcggcttcgtcgtcgtcaggcttcgtaccttgacggggttgtcgacttcgtcgtacgtccctgtggcctgtgggctaaaataacgtgaagcctgcctacgcggtgtctcgtgtcttaccttttaaatttgcaccatatatacgcactgtcttttctgggtatttgttgtattgtgatgtacggagtattcatcaactccttttgcaagattggtcaattattcaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12629 - DNA, 1198 bp, Zea mays
ctggctcacctcacctgcagcaggcctcgtctcggtcatccagcgcattgctctcaatcgctgcagcgcatccagtccaaacacacaccggtcgaatcgagcaatggccgcggggctgcaggtgttcggacagccggcttccaccgacgtcgccagggtgctgacctgcctcttcgagaagaacctcgagttcgagctcgtccgcaccgacaccttcaagaagtcgcacaagctccccgagttcatcaagctgagggatcctaccgggcaggtgactttcaagcacggtgacaagacaatcgttgattccaggactatctgccggtacctgtgcacgcagttcccggacgacgggtacaagaagctgtacggcacggggtcgctggagcgggcgtccatagagcagtggctgcaggcggaggcgcagagcttcgacgcgccgagctcggagctggcgttccagctggcgttcgcgccgcacctcaaggacgtgcggcccgacgaggcccgcgtcgcggagaacgagaagaagctgcacagcatgctgggcgtctacgacgacatcctctccaagaacgagtacctcgccggcgacgacttcacactggccgacctctcccacctgccaaactcccactacatcgtcaactcctccgacaggggcaggaagctcttcaccgccaggaagcacgtggccaggtggtacgacaagatctccacccgcgactcctggaggcaggtcatgaagatgcagagggagcaccccggcgcgttcgagtgatgcgtcgtgcttccttctctctgcatgcatgcgcgcgtcgcggcgtgttcctcgtcgtcgccggcttcgtggtcgtcaggcttcacaccgtggtgtgtggttgtcgagttcgtcgtatttcgtatcgtatcgtatcgtatcgtacgtacgtcctgtgggctaaaataacgtggagcctgcgcctgcctacggtgtctctcgtgtcttcctttcgctgcatatataagcagtgtctttttctgggtattgtatggtgacctaatcatcaactccttttgcaatattggccaattcaataaaaatatgtccgggcattttgctcgttcgcactaaaaaaaaaaaaaaaaaaaaacgtatagagaaaaaaaaaaaaaaaaaaaaaaaaaaaaaaaaaaaaaaaaaaaaaaaaaaaaaaaa

SEQ ID NO: 12630 - DNA, 1425 bp, Zea mays
cggacgcgtggccaccgcatcagtgtctggctcacctcacctgcagcaggcctcgtctcggtcatccagcgcattgctctcaatcgctgcagcgcatccagtccaaacacacaccggtcgaatcgagcaatggccgcggggctgcaggtgttcggacagccggcttccaccgacgtcgccagggtgctgacctgcctcttcgagaagaacctcgagttcgagctcgtccgcaccgacaccttcaagaagtcgcacaagctccccgagttcatcaagctgagggatcctaccgggcaggtgactttcaagcacggtgacaagacaatcgttgattccaggactatctgccggtacctgtgcacgcagttcccggacgacgggtacaagaagctgtacggcacggggtcgctggagcgggcgtccatagagcagtaacatgcaaaagttataggagggtcaaaatttaaaagtaggacagcctagcgttccaattccaaggtccaagcctccaaggctgctcccagcaactcgtttctttcttcgagagagggcaaaaaccggcaaggggagcgaagcggagagtctcgagagcaagggagcgcggtgacgtcatcgttttccaaggtttctcgatcggctgctatggcgaccagggcggcgtcgagattcctgcagcgcaggctcctgtcttccggcggcaaggtcctcagcgaggaggagaaggccgcggagaaagtgtacatcaagaaaatggaacaagagaagctggagaagctcgcacgcaagggccccagctcaggagagcaaccttcgtcgactacagtctctgcagcaagtgatgtgaagactggggctgggccaacagagtcagcgtctgcaaacgtgtctaccgacaagaacaggaactacgctgtcctggcaggcacaattgctgctctgagtggcctgggttggtatctattgtcaaagcctaagaagtcggaggaggttgtggactgaagagggggttacgaatgcgagctgtggatggttggccttatatttcaccatggtttactttctgcgcacaccttctggaaataattgttgaaacatacgctgcagtctgcattacttgttctgaggcctgttgcaacaccgaacattgaagtctgtactcgagacgttccgtagttctctccctcgcttgacaggttgcaaatgttgagtgatgcttgtcctacgtcgttgctggagaagtggagaggtttttttggtactgatgttttgaatgtaaactcgttgccactggccagcacacatgacgaagagcattctgtgataatgagaatgtgttacacgcgttcccagtcccaaaaaaaaaaaccccaccggttttatgtatgttctctagcatacaatatatgcttgggcgagggctctttt

SEQ ID NO: 12631 - DNA, 1282 bp, Zea mays
tgctacgccaagcgcgcaattaaccctcactaaagggaacaaaagctggagctccaccgcggtggcggccgctctagaactagtggatcccccgggctgcaggaattcgcacgagaccattacctaggacgtcccgaggccggaatcatccaggcacaccgcatcagtgtctggctcacctcacctgcagcaggtctcgtctcggtcatccagcgcattgctctcgatcgctgcagcgcatccagtccaaacacacaccggtcgaatcgagcaatggccgcggggctgcaggtgttcggacagccggcttccaccgacgtcgccagggtgctgacctgcctcttcgagaagaacctcgagttcgagctcgtccgcaccgacaccttcaagaagtcgcacaagctccccgagttcatcaagctgagggatcctaccgggcaggtgactttcaagcacggtgacaagacaatcgttgattccaggactatctgccggtacctgtgcacgcagttcccggacgacgggtacaagaagctgtacggcacggggtcgctggagcgggcgtccatagagcagtggctgcaggcggaggcgcagagcttcgacgcgccgagctcggagctggcgttccagctggcgttcgcgccgcacctcaaggacgtgcggcccgacgaggcccgcgtcgcggagaacgagaagaagctgcacagcatgctgggcgtctacgacgacatcctctccaagaacgagtacctcgccggcgacgacttcacactggccgacctctcccacctgccaaactcccactacatcgtcaactcctccgacaggggcaggaagctcttcaccgccaggaagcacgtggccaggtggtacgacaagatctccacccgcgactcctggaggcaggtcatgaagatgcagagggagcaccccggcgcgttcgagtgatgcgtcgtgcttccttctctctgcatgcatgcgcgcgtcgcggcgtgttcctcgtcgtcgccggcttcgtggtcgtcaggcttcacaccgtgtggtgtgtggttgtcgagttcgtcgtatcgtacgtacgtcctgtgggctaaaataacgtggagcctgcgcctgcctacggtgtctctcgtgtcttcctttcgctgcatatacaagcagtgtcttttctgggtattgtatggtgacgtaatcatcaactccttttgcattattggccaattcaataaaaatatgtccgggcattattttgctcgttcgcactgaaaaaaaaaaataaaaa

SEQ ID NO: 12632 - DNA, 979 bp, Zea mays
cccggccctcactcgtagtcgtagctcaagcatcagcggcagcggcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtcttgagagaagaaccacactcgagcggaccgcgcgcgcgtcctccttgaaccactgccggcgcggcggcatatggcccttaaaggcggtggctgctgctacgtacgctgccgtagagtctcggtcgccgcgatagctctagctagtcgtttatgtgttgtgctttgtgtgtgcatgcttgtgtctgggggcatgcagtgcagtgcagtactatatgctgtatgcgtctctctttgatcggagaggcggatgtacagcatgctcgatatgtctagtttggatgtcatgtttatgatgaggaataaaatgcagtgttcaggtgagatgccaaaaaaaaaaaaagggcggccgccgactagtgagctcgtcgacccgggaattaattccggaccggtacctgcaggcg

SEQ ID NO: 12633 - DNA, 1891 bp, Zea mays
  misc_feature (285)..(285): n is a, c, g, or t
gctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggngcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccccggcccgcatctatcgcacccgtagtcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtcttgagagaagaaccacactcgagcggaccgcgcgcgcgacctccttgaaccactgccggcgcggcggcatatggcccttaaaggcggtggctgctgctacgtacgctgccgtagagtctcggtcgccgcgatagctctagctagtcgtttatgtgttgtgctttgtgtgtgcatgcttgtgtctgggggcatgcagtgcagtgcagtactatatgctgtatgcgtctctctttgatcggagaggcggatgtacagcatgctcgatatgtctagtttggatgtcatgtttatgatgaggaataaaatgcagtgttcaggtgaaaaaaaaaaaaaaaaaaaaccaaataagaatacggtacatctttgcaacgatgcccagccctgacaagtgctctttgagcttgtggccatagacgaaaatcgtgagagtttgctcagtctctaaacccaagcgacaaatcctgtagtctgcaggggactgcaggagcggcgatgctgggtggcaagtccctgacgagtgacgagctcaatacaggtgagccatgagcggtgaaccagacaactagtcagaccagacaattgtacactactttgatcgggaatttggatgcatcccgggctaccagtgcgggcctgcgtgggagaaatgaggcctagtttggatagtctaatattgaagtggtttggagagattagagagtatataaattctcaataataccaaaaattgggattggagagtataaattctcaatagatcaaaactcttactagaagtttggatcccttcattttagcggaattggaattcactcaataaaataacttatttagtttgg

SEQ ID NO: 12634 - DNA, 1332 bp, Zea mays
ggtaccctccgaggctcggccgggaaaaaaaaatccgtctataaatacgccaattagcccctcagcccccccccgcgccgcgagcagcaggccaatggagaaccctccgagcatcctagtgactcccatggctccggccatgtcggcgcagttcacaagaataaccttcagcaacctgtttgtccgtcgggctggcccaggcagcacggagctgaccgtggagggaaggccatccgaccagctgggcaggagaaacctcactgacagccccgtatttgacggccgtggccctgacgccagcctcgtggctcgcgtacagggagtcgctacccagatgggcgacgtgcgccagttgtacaccgtcgtgttccaggagaggccgctcaagggctccacgctcgtcaccgaaggcgcgatgacagaagggtcagacgagtgggcgatctacggtggaactggagtgttcgcgatggcgagaggcgtcataaggagaacgtttcttgccgacacgagcggcgggaactccgacgagcttgccgtggaggttctctgcccggtgttccgcccggcggcgtttggctcatcgtcgtcacagccagcagcaaaggacatcagctccaccgtcgtcgtcaccaaggtcggagtgtggggtggagagggagggtcggcgcaggacatcgcgacgacggagccgccgaggcgtctgcagagcctgaccgtccgcgccggcgttgccgtggactccatcgagttcacctacagtaccgacacaggtggtcagacgcgcaccgctgggcgatggggtggacttggcggcaacgtccggaagctcgatcttggcgacgctgaatacgtcaaggaagtttctggaacgtacggcgcattcgaaggtgcgactacccttacctcgttcaggattgtcaccagcaccgccagagcttgggggccatggggcatcgagagcggcacacgtttctgcatcaccgcgcccatcggcagcagcatcgtgggattctatggacgcgcgacgaccaggctcgtcgctgcgatcggtgtctacctgcgccaactttagtctggtttcagcagcaggacgggtactacagatatgctagataaaggtcttatatatgtcatatgacctatcatggtcttatatgttcgatcgtcgtcgtgtctgtatgtacatacatggttgtcaaataaagctctttgcattttgataaagattgacaccaccatgctattagatgtgaactaggtgagtgcccgtgtgttgcaacggaaccgtataataacacgataacttatgtaaaaaaaaaaaaaaaaaaa

SEQ ID NO: 12635 - DNA, 993 bp, Zea mays
ctcgagccgcgacacgagcggcgggaactccgacgagcttgccgtggaggttctctgcccggtgttccgcccggcggcgtttggctcatcgtcacagccagcagcaaaggtaagagcgagcgagcgagcgagaaaccgtttctctttcttgctcatcatatgaacaacactgggatgcatggatggatcatggatggatggatggatgcaggacatcagctccaccgtcgtcgtcaccaaggtcggagtgtggggtggagagggagggtcggcgcaagacatcacgacgacggagccgccgaggcgtctgcagaacctgaccgtccgcgccggcgttgccgtggactccatcgagttcacctacaccgacacaggtggccagacgcgcaccgctgggcgatggggtggacttggcggcaacgtccggaaggtgagcgagcaggtttcggtgtacgtacggttccatcaacggcgtctctagctatgaacttgtgcagggacgacgatcgagaactactgatgaacatatatgagcacaaacatgcgtgcgtgcagctcgatcttggcgacgctgaatacgtcaaggaagtttctggaacgtacggcgcattcgaaggtgcgactaccctgacctcgttgaggattgtcaccagcaccgccagagcttgggggccatggggcatcgagagcgggacacgtttctgcatcaccgcacccatcggcagcagcatcgtgggattctatggacgcgcgacgaccaggctcgtcgctgcgatcggtgtctacctgcgccaactttagtctgctttcagcagcaggacgggtactacgtacatatatatatgcaagataaaagtcttatatatgtcatatgacctatcatggtcttatatgttcgatcgtcgtcgtgtctgtatgtacatacatggttgtcaaataaagctctttgcattttgatcaaaagattgacgccactataaaaaaagggggggc

SEQ ID NO: 12636 - DNA, 1353 bp, Zea mays
tgggaccctcccgcccggccgggccgggaacgaaaaccagctctcatattggcataattccaaatttctctcgtccgcaccgccgccactcgccttttcattccgcaccgccgccaacccgccgcctcttctttccatggaagtggacgacggtagccgcgccaccccgccactggacgccgtggccgccgccttcaagtcccaagtcatggagttgcaggacctcgtcctcgcccgcagcatgttcccggccacggcgctgcccgacctcgccaacgtggacgcgttggtgacggcgatggagtcgcaggtggaaaccatcagccgccgccttcaggaggagcttgacgccatccctaaggccaagaagctagtccagcggtccttgaaggaggaagagaagctgcagcatatgcttgcgaacttaccttctggaatgcgcaagaatgattttgctaatcagcacgaacagagctcatcaaggatgctgcctcattttaactcttcttttactgaagctaatgaatgtgaactgaagattaaggatgaaccagttgcagctcctaggaagggaagagcacctgcacctcgttggtatatctcaaccgaggagcttgattcactctcatcgtacatgaggggaagactgactttggaaaaggttaatatcgcaataaatgaagtggcttcatatgcagatgccaatgctcatcttgttacatgccctaagaaaaagttgtcagaagatacatgggaaaaagctttggaactaagggatattgcagcaagtggtgcagtaaagggcaaccatttcttcctggaagcagatataaaaggacctgggttaaaacttgacaatactggcaaagctattcttaccgttcttcgccaccttgggcgcttccatgaagttcggattgggcaccatcgggtctttatactgtcaaagcaggcatgaagatatttcatttgatttgagttggtgcactgtaattcggcaaaatccggtagcctccaaaccgtgatattgcaaaatgtatttcacatgcacctacttattaagagatactccatccgttcataaatatatgacatcattgattttttttaaactgaccactcgtcttattaaaaaaataatgagtcatttattttgttgtgaaatgttttatcatttaaggtagttttagtttgtgcttatttaaaattttatatttttgaataaatattttgaataagataatggtcaaagttttttgaaaagaatcaataatgccatatttttgtgaacggaggtggtacctgtgctttcatcaaaaaaaaaaaaaaaagagagttaaaaaaaaaaaaaaa

SEQ ID NO: 12637 - DNA, 1850 bp, Zea mays
attgggtacctcgaggccggccaccattatccgtgcaaccagccaatgagccaaccacccattccaccaccctgcaattccagtccgatttggacattgtcttcgtctccttcatcccctgcccacctgttctgctctgccgccgccgccgctgccgctcccgctgccgcaggaaccctagaccacgctgagcaacccccggcctacacggcgtagctttgcaggaaatggaatacggcgccgtcctcgccgccgcgccgctcgtcgcacggccgaactggctcctcctctcgccgccgccactggcgccgtctattcagattcagaatcgtctttattcgatctcgtcattcccactaaaggctggacctgtaagggcatgcagagctttagcaagcaactacacgcaaacatctgaaacagttgatttggactgggagaacctgggttttgggattgtgcaaactgattatatgtatattgctaagtgcgggacagacgggaatttttctgagggtgaaatggtgccttttggacctatagcgctgagtccatcttctggagtcctaaattatggacagggattgtttgagggcctaaaggcgtataagaaaactgatggatccatcctattatttcgcccagaggaaaatgctgagaggatgcggacaggtgctgagaggatgtgcatgcctgcaccctctgtcgagcagtttattgatgcagtaaaacaaaccgttcttgcaaataagagatggattcctcctactggtaaaggttctctgtatattaggcccttacttatgggaagtggggctgttcttggtcttgcacctgctcctgagtatacattcattatatttgtctctcctgttggaaactactttaaggaaggtttagcaccaataaatttgatagttgaagacaagttccatcgtgctactcctggtggtactgggggtgtgaagaccataggaaattatgcttcggtgttgatggcacagaaaattgcaaaggaaaagggttattctgatgtcctctacttggacgctgttcacaagaagtaccttgaagaagtttcttcatgcaatgtttttgttgtcaaggacaatgttatttctaccccagcaataaaaggaacaatattacctggtatcacaaggaaaagtataattgacgttgctttgagtaaaggcttccaggttgaggagcggcttgtttcagtggatgaactgcttgatgctgatgaggtattctgcacaggaactgctgttgtggtgtctcctgttgggagcattacatatcaagggaaaagagtggaatacggccaccaaggtgttggcgttgtgtcccagcagctgtacacttcactgacgagtcttcagatgggtcaaaccgaggattggatgggctggactgtgcaactgaattagttggccgtggttcgtggatcattcccaacagatgatgggttcgcaagatccaaatctggaggatcacaaccatgtgtacctcttcggttacagttttgtagtgtcttatgcgatggcgtcctgctgtatatttcttagacggtatttaaaccataaaacagtattcgtctgtacgactgtacccttcagttctgtagcatctgccggagacgagtactagttttgttattttctttcttttacaaaccaagaacagttctatagttttattgtagacactggaccatcatatgatctcaatgggtagctttttcctttttatatttaaaaataaacagaatttaaattttataaattttaaatttacaaataaaagaaaccctgtagcgagggataattagctctctgtgcgcttaa

SEQ ID NO: 12638 - DNA, 1066 bp, Zea mays
gtgccagatcgccatcccaaggcaaggagcttctctttgcagttaaggaagcgaggcacgggtctgaggtttccagccgtggagctcctgtcgtggaaaaattgcactcgttttgccttgatggaaggagttgtaaggcaggctgacaattttacaacatttttacattcatggctaaggctaaaccggactaaaacactgggattcaacaagcgagctattccctcagcctatggtactctacaatcttctcaatgaaggtgaatataaaaaaaaacagagcgaagcttgtgatagaactgaaccaaccctaccagggacaaggagatgagatcaaggggctataactgcaacgcctgtaacctcggtaccagattggacgtgtttgcatgttgcgctcgctcgttgcggaggaggaggatgttaatggtgccggactctctcagccaggcagacaccaaggcactgggtgacacaaacctcccgatgttgaagcgctcggcctgaaacggcgctccaattgaaaggagcagcgcttcaatgactcgacggagggtgcttgatccagctatcttgctatgctttccccagcctgtcagaatgcttaaaaactcaggcatagctcgaccttcaaaaacaatagagcgcacgttcaggagccatgcatgcaccattgcttgagctgcaccacatgacatgaggtgcaggtccaagcagaagtcaccccatgtgttctcccaaacacggcggtttaccccttcaagcacaacttgctgagctccttgcctctggccgaaatgcccatagcacatcggtaagagcattgtaaaagggagaaaaatgttggaagaatccatgccggtccacctggattaaagaagggaaccgggcttgaaaaacaaagtttctcgatggccctttcaaaagcccattccgccaccccatagaccagagtttttcaaataagtccaactggtccccaataaaaagggttgtatctctttaaaacatttaccgggacctgtcaacatattatgattgcgccaaaaatgtgtcaaaccttttg

SEQ ID NO: 12639 - DNA, 1274 bp, Zea mays
ttgggaccctcgaggccggccgggattcctgtccgatttggacattgtcttcgtctccttcatcccctgcccacctgttctgctctgtcgccgccgccgccgctcccgctgccgcgggaaccctagaccccgccgagcaacccccggcctacacggcgtagctttgcagaaaatggaatacggcgccgtcctcgccgccgcgccgctcgtcgcacggccgaactggctcctcctctcgccgccgccactggcgccgtctattcagattcagaatcgtctttattcgatctcgtcattcccactaaaggctggacctgtaagggcatgcagagctttagcaagcaactacacgcaaacatctgaaacagttgatttggactgggagaacctgggttttgggattgtgcaaactgattatatgtatattgctaagtgcgggacagacgggaatttttctgagggtgaaatggtgccttttggacctatagcgctgagtccatcttctggagtcctaaattatggacagggattgtttgagggcctaaaggcgtataagaaaactgatggatccatcctattatttcgcccagaggaaaatgctgacaggatgcggacaggtgctgaaaggatgtgcatgcctgcaccctctgtcgagcagtttattgatggaggaaaacaaaccgatcttgcaaaagaagatgagttcctcctactggattgatacaaagttagggtacttttgtagtgctatacccattacttatgatcatgatttaattggtcattaaatatcttatgcttccagattcctcctactggtaaaggttctctgtatattaggcccttacttatgggaagtggggctgttcttggtcttgcacctgctcctgagtatacattcattatatttgtctctcctgttggaaactactttaaggttggtactggttgttttaaaattctgtttccactatttttgtaaaatactttttaaaataaatgaccattagattataaattgacctttttcccctatatatcatgtgctatgtgccccatggccttgtgctgtggaattaaagttatgttgcaactagaattatggttattgttgtgccgttattggttatgttaaatcagcctatggagttgttggatgttgatgcgtgatgcgtcaagataaaagtatttgttgaatatattcactggtgtctgcaggaagtttagcaccaataaatttgatagttgaagacaagttccatcgtgctactcct

SEQ ID NO: 12640 - DNA, 1253 bp, Zea mays
aacgtttggctcaccaagagaaaacgacacgggtgacgcgcctctcagcgaacttgacatgaatcacacctaaaccattttgtcgtcgtcgttccagctgcagtccagagttggaacccaagcgcacgcagcaccgtcgtcgaactcttcccttttcggcggcattggagatggcggcgaatctagaggacgtgccgtctctggatctgatgcacgaactgctccgtcggatgaagtgcagctccaagcccgacaagcacctcatcctcatcggcccacctggctctggaaagggtactcagtctccccttattaaggatgaatattgcctgtgccatttagccactggtgatatgttgagggctgctgtggcagccaagacaactctaggtatcaaagctaaagaagctatggataagggagagcttgtttcagataacttggttgtggggattattgatgaagctatgaagaaaccgtcatgccagaaaggtttcattcttgatggcttccctagaactgtcactcaagcacagaagcttgatgagatgttggcaaagcaaggtgctaatgttgacaaggtcctaaactttgcaattgatgatgctatattggaagaacggattactggccgttggatccacccacccagtggtaggacttaccatacaaaatttgcacctccaaagtctccaggagttgatgatgtaactggagagccattgattcaaaggagggatgacactgccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaaatgcccctttgtctgagtttcttcaggttaagcatgatatatgtaccgaaatccctttgtctgggtttcttcacaccagcatcatgcagtttcctttttgtgcgattacaccattttatcatagctttgacaagctcggtaactgtctgaataatctgttttgaatgagggaagttgtttttcagtaccaatactgagatgattacagcaattcatgtttgggaaattttccttaaaaaaaaaaaaaaaaaaaaaaaaaaaaaaaaaaaaaaaaaaaaaaaaaaaaaaaaaaaagaaagaaaaaaaaaaaaaaaaaaaaacctcgggggggggcccggaacccatttccccct

SEQ ID NO: 12641 - DNA, 1105 bp, Zea mays
cgttgctgtcggaaaagaattcgccacgagcccggacccagccgatcgagggagagtcagaactcggaaccacttgctgcaggctgcagctgcaagcatctgcacctgcattctgcaagcctcgtctggagctcttcccgttgcattggcggcggagatggcggcgaatctggaggacgtgccgtcgctggatctgatgcacgagttgctccgccgcatgaagtgcagctccaagcccgacaagcgcctcatcgtcatcggcccacctggctctggaaagggaacccagtctcccattattaaggatgaatattgcttgtgccatttagccactggtgatatgctgagggctgctgtggcggccaagacacctctaggtatcaaggcaaaagaagctatggataagggagagcttgtttcagatgacatggttgtggggattattgatgaagctatgaagaaaccttcatgccagaaaggtttcattcttgatggctttcctagaactgtcactcaagcacagaagctcgatgaaatgttggcaaagcaaggtgctaatgttgacaaggtcctgaacttcgcaattgatgatgctatattggaagaacggattactggccgttggatccacccacccagtggtaggacttaccatacaaaatttgcacctccaaagtctccaggagttgatgatgtaactggagagccattgattcaaaggagggatgacactgccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaaatgcccctttgtctgagtttattcaggttaagcataatatgtactgaaatccctttgtttgggtttcttcacaccagcatcatgcagtttcctttttgtgcgattacaccattttgtcatagctttgacaagcttggtaactgtctgaataatctgttttgaatgagggaagttgttttccagtaccaatactgagatgattaccgcgattcatgttt

SEQ ID NO: 12642 - DNA, 1412 bp, Zea mays
  misc_feature (1332)..(1332): n is a, c, g, or t
  misc_feature (1334)..(1334): n is a, c, g, or t
  misc_feature (1344)..(1345): n is a, c, g, or t
  misc_feature (1347)..(1348): n is a, c, g, or t
  misc_feature (1350)..(1351): n is a, c, g, or t
  misc_feature (1353)..(1354): n is a, c, g, or t
  misc_feature (1358)..(1358): n is a, c, g, or t
  misc_feature (1370)..(1370): n is a, c, g, or t
  misc_feature (1385)..(1385): n is a, c, g, or t
ctccacggccggccccgccgagggacgaaaaggcccaacaaccccccgacccgtcacctgacccagccgatcgagaatacccggaaggccggaacccacctgctgcgcacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccactggtgacatgctgagggctgctgtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgatgagatgttggcaaagcaaggtgccaatgttgacaaagtcctgaactttgcaattgatgatgctgtattggaagaacggattactggtcgttggatccactcagccagtggtaggacttaccactcaaaatttgcacctccaaagtctccaggagttgatgatgtaactggagagccattgattcaaaggagagatgacaccgctgaggtcttgaagtcaaggcttgaagctttccacagacaaaccgaacctgtgattgattattactccaagaagggcttagtggtgaacctgcctgcagagaaaccaccgaaggaagtgactgctgaggtgcagaaagccctctcgtgatgaaatgtccactcttgaggttaaacatgacatctaccaaaacccctttgtttgggtttcttcaaaatttgcactaggccaacatcatgaggttttttattttcagtatccttattgtgcggatgcaccattttttgttatcacacctttcacaagctcggcaattgtctgaataatttctgtgtctaatgatggaactgtttttcagtaacaaactgatatgattacaacaattcatctttgggaaaatttccctgcaaaccttgttccagttcttacaagactgctatgttactggctataataatcaggaagataccttgctctgtcgagccttgagcggagagattgatgtgctgcgagctcaagtaaatgtttcatgttggtatggttcccaactcgtgcgtgatgttattcgtacctgctataatttccagtgagttatgtagactccncncactttgccnncnngnncnnacangagaagtacctngcccaactgcttgcngagaggcagaagcttggaccggtcgtc

SEQ ID NO: 12643 - DNA, 820 bp, Zea mays
ttttttttttttttttgtaagagcaatgaaccaagggtctttttgcttcagtcagaacactctaactgatccaaggactaacaaacgatcgtttcttggcatcaagaaatttagttcgtcgcagctgaacacgaatctgaacaaaagagcaggaacgcagctaagctcgatagtttccaagaaagcgaatggcagaaacaatgaaaaaatgtttcaatgactaatctagactatcaggcgacacgcaccagcatactacccttgatcagttccaaaaaatgcagtgacagaaacgtcgaaagaatcattcaacttctagaacaagaactgatccagaccgccccaaaggacgcgtcaactccgtcacgtccaagctcgatcacgcctgtctactgcgatggagactcctgcaatagtgtttcgtcgaaccagtgcgtcggaagcagcacctcctcctccgagtccgcctgcagtagtgtttcgtcgaaccagtgcgatggaaacatcaactcctcctccgacgtccgtgacgatggcggtggccgcgaatgccacttgaccttggacagtaagaacgagaacggagacgcggcgagggcgaagccccatatgatgacgacgacattgacaaaaacgacgccgcacgcggccaggaccaggatgatgacgacaaggaaggcggtgatgctgaagtagacggccatcggtccttcactccggtccccgactctttattgcttcttgtgttgtcttctctcgatcttgctttctcgctcgctctcccacgtcgctcttggattgtgttgttctcgtttggaag

SEQ ID NO: 12644 - DNA, 1818 bp, Zea mays
ttaagttagggtcatatttggaagcaacctaagttttaaaaaatccagtttatatctctagtttctataaactggtttacgaataaaaatggtttatggtttttggaaaccaactcattttttatagactagttttagctaagcgaggctagcttcttggtttttaaaaaactggaaatctaatttctataaactgtaatataaactggtatgttggaaactaccctaattttcataaacttcacaaactagtttctaaaaaactaggtgcttccaaacaagttctaagtatgagatcaagggagcaatacagttaaattgcaactatactcacaaatatagctgcactcatttgcattcgctagtagcgcttgataactttaaaaaaaaactcgaacgtagtcaatttgcaacaaatgttagaacttaccactgttttgcaatatgttgcagtaaaacgtgcataaacaaagagtttcaaggtgagatgtatgattttttcttaaaaaaagaggctctactagctcaaatcctaattcacaaaggggaatgcttgaaacaactatattcattaaaaaaagcagttaaaaagtaaaaaccaaacaagaagcaaaaacgagatatatatgttgtgcagttaatattacagcgtaataagttttcaaatgccaaatcaaaatgtctgtatagctattgtacttttcattcataataggtccatctttaatacggttcacagttcatactatcagcacgaaccaaagctttcatccaacagacaggtttcgcggtaaacaaactttttcaatctcgagtcttgacattcaccatctacgtacaggatacaactacaggtttttggatcaagaaaaggactagcagatgaagcaactgatatcaaacacaatcgcaagaaattatcaaacaatgctgcgaacatatactaattaagaaccattttcactttttttttttttttttttgaaagagcaatgaaccaaggatctttttgcttcagtcagaacactctaactgatccaaggactaacaaaccatcgtttcttggcatcaagaaattcagttcgtcgcagctgaacacgaatctgaacaaaagagcatgaacgcagctaagctcgatagtttccaagaaagcgaatggcagaaacaatgaaaaaatgtttcaataactaatctagactatcaggcgacacgcaccagcatactacccttgatcagttccaaaaatgcagtgacagaaacgtcgaaagaatccttcaacttcaagaacaagaactgatccagttccaaaggacgcgtcaactccgtcccatccaagctcgatcacggctgtctactacgatgtagactcctgcaatagtgtttcgtcgaaccagtgcgtcggaagcagcacctcctcctccgagtccgcctgcagtagtgtttcgtcgaaccagtgcgacggaaacatcaactcctcctccggcatccgtgacgatggcggtagccgcgaatgccacttgaccttggacagtaagaacgagaacggagacgcggcgagggcgaagccccagatgatgacgacgacattgacaaaaacgacgcgcacgcggccaggaccaggatgatgacgacaaggaaggcggtgatgctgaagtagacggccatcggtccttcgctccggtccccgactctttattgcttcttgtgttgtcttctctcgatcgctctctcttgatcttgctttttcgctcgctctcccacgcgctcttggattgtgttgttctagtttggaaggctggccaaattagggtggcggat

SEQ ID NO: 12645 - DNA, 1936 bp, Zea mays
gcggagcacaagagaatcgagaacgtcaccaaggccgtctgaaagcgaaaaggccctttgcctctcgctctaccccaaaccacagcagtcagcagcagaccctcgccatgggactgagatccccgctcgtgctcctgctgctcctcctcttcctcgccgctactttccgtcccagcgcggccgctttggcccctccaacaggcagcatcgtgaagcagctgtcgtcggtcgtcaggtggccgcgggccgccccctcgacgcacgggcccaaacagcccggccacccccagtacgccgatggccacgtgggggtagccctgcaatttgagagcggctactttgtagagacacttgttgagggtgacaagcttggtgtcacgccgcacaccattagagtatctcctgttgagggcggggagctccttgcggtcgactcggcacatagcaacattgtgcggataaccccgccactttctgagtatagcaggggaagacttgttgctggttctttccagggccattctggtcatatagatggtaaaccaagtgatgcccgattcaagcgccccacaggcgttgccgtggatgatatgggcaatgtttatgttgctgatacagcaaacttggcgattcgaaagattggagaatcaggagtgaccaccatagcgggtggtaaatcgaatatcccaggatacagggatggccccagtgaagatgcaaagttctctacagattttgatgtggtgtatgtgaagaaaatgtgttctcttctggttattgaccgtggaaatgcagcccttaggaagatttctcttccacaagaagactgtacttaccaggattctgcactcctatcttcagatctcatattggtcattggtgctgttgtggctggatatatcttctctggtttccaacacgggtttggattctcaggctccgagaaggtagaggcacctgaaaacgagcagcacgagagcagcacaatcgggaagccacctctggtggtggagagcctgaaagaggaaccaggagctgggtggccatccctcgggacgctaattgccgatctcttgaaacttgccatcgagggagtggggaaactgctactcagcgtagtccctcaacgcatgcaacacgggaagaggaagacagatctcaccccgctcagggacaggctggtgatgcccgaggacagagaggagacggcagcggcggcgcagaagctcagcagcacaccaatgcggcccgagacagcccacgcccctaaccccgtaaccgagacggcagcacccaaggccccgaagagcacgaagccatccaagctcagggattcttcgaccctgtcaagcaagcacaggtcctccaagcggcaggaatacgcggacttctacggcacctccgagcccgctcccgtaggtgccgccgccaaggtccccaaggacaggctccgccaccgccaccaccaccgcgagaagagcggggaggtcgcctacggcgccgcccatcacgacctgaagcccgcggaagcgaagcctgccgattacagcgatccgagctacgatccgtacgtgaggagcaagtatgccgccgagagtgggtacaggtattgacgtgtcgctagctgtcctgtcctgtcctctcctgccgggggaaacagcggaatgaaaacctttcgccggcgtctgcctggcaatgttgtaagtgtgaagctatatagcctccacaagcgcaaagcgaggcgcaaacaaagctgctgctggtgcctggtgctgctcatggtttggtggtgcccatgagatgtggcaagtagtcatcctagttaggttaggtatggacggccaggacggggttggcatctggcccggtttcaggatatgctaagtgcgattttcgcagagggcgacatgcaaaaaaaaaaaaaaaattggaaaaa

SEQ ID NO: 12646 - DNA, 1758 bp, Zea mays
gccaacgtcagaaccaaacgcggcccccttgccctctcctacttctcctcccccgccccgccgccattcccccccccactcttcaccaccgcagcgccgccgcgtacaaggcgattaggcgaagctgcaccggaaggagaaggagagaagcgagagtctccccagccagagcaagccgaatccgaagctagcggagaggagagagggctgagtgaggatgccgacggttacctgcaacgcgtgcaacgcggggttcgacgacgaggagcagcagcggcttcactaccgctctgaatggcaccgttacaacctcaagcgcaaggtggctggagttcctggtgtcacagaggctctgtttctggctaggcaagctgctttggcggaggggagcaagcctgctagcaccccaatgctttacagctgtgctctttgtggaaaggagtacagaagctcgaaagctcacgagcagcatcttaactcgcgatcacatcttttgaaagcctctcaggagcccaatgcctctattgctggtatcacgatagtcaagccacttcctgaacgagtctcacgaagagctccatctgcagtagaggaggatcaagacgacgatgaggaagaagagtgggttgaagttgacccaagtgagatggagttggctgatgagtctacttcaaacatgcaagaagatgagcactcctcaaaatcagatgatgacatggatgaccttgaagagttggatatctcgtcgtgtttcatgtgtgacctcaagcatgacaccatagaagactgcatggtccatatgcataagaagcatgggtttttcatacctgacagtgaatacttgaaggatcccagtggtcttcttacttatgttggactgaaggtgaagcgtgattttatctgcctctactgcaatgacagatgccagtccttcttcagtctagaggctgtcaggaagcacatggatgcaaaggggcattgcaagttgcggtatggagatggtggagatgatgaagatgctgacctcgaggaattctatgattacagcagcagttatgttgattcagaaggcaagcagttgattgctgttgatgacttgaacaacaacattgagctgggaatcggtgggtctgagctagtaataacaaacaagagcgagaaaggcactcgggtcagaacccttggctctagggaatttatgcgctactatcgccagaaaccacggccttctgttgcaccagaccgtgcgcttgcactttcactagcttccagctacaagagcatgggtttggtgacagtgcagtctaaggagcagatggtgaggctgaaagttctccgtgctatgaacaggaccggggtcgagactatgcggaacaagatcggaatgaagagcaatgtgatccggaacctccctaagaattgcccgcactagacaacactgccttctcctgcaccctatctggagcttctcctggcatttatatggtgtcttatggtttcttgtctgtcgctgacaacgttggcgcttaagatatttggaataggactacaccttccatagtttttgttgaactctgtggtgcggaagcagctgttgccattatggcggaaattgctgacgcctcattgaacatgtttagtttttattttgttaaaaaattgggcaaaaaagtttgatgctcatattcatcacaaaaaaaaaaaaaaaaaagaaaaaaaatatccgttccctaaaaaaaaaaaaaaaaaaaaaaaggg

SEQ ID NO: 12647 - DNA, 1005 bp, Zea mays
ggcgattgggttcctcgaggccggccgggcccttccccccttccgttccgttccgatttgacgagttggtggctgctatagattcactccacccctctccatttctgataagtatccagctagctaccagtgtatgcaccaggcagcagcagcatggcggagtgcaaggacgacgacagcggccggcggtctccgtcgtcgtccatggacagcagcacccaccccccggcgctctccaccgcgtcctcggcctcccgccgcccgccggagaggagggaccagctcagccccgacctgcagctagggctcagcctgtcgccggcgtcctccgccctcctggtagcggagaccaacaacagcatcgtcccttctacgccaaggaaccaagcactcccggattggcccccgatcaaaccgttccttagaagcgccctgactgcctcggcacgccgacggcgaacgctgttcgtcaaggtgtacatggaaggcgtcccgatcggccggaagctggacatgctcttgctggacgggtacagcagcctcctagcgaaactttgccacatgttcaaggcatctatcacttcgggttcctcacgagaaggccgcgcatgttctcacctttgaagaccatgatggagactggatgatggttggggatgtaccgtgggagctctttctcggaagcgtaaagaagctgaggattgcgagaaccgacaggtgctagatagcaaactttttcatgcgggggatcgactctgttcccccctcttttaatatatattaggttcattaggaaagattttgctgaactaaagagtggagtcgtgatgctgaggctatactaaccgtgtacagtgtactgaagaaacgccagccttgctaccacccctgcaaaattaaattttggtattttatgtttcctttccctgtttctttgactgccttgtaaataccatggttatttggttatcaagtcaggagtatacgcagacctttttcttgttt

SEQ ID NO: 12648 - DNA, 3231 bp, Zea mays
agacaataataccgagccctctcttccattccagccttcccaggccagctgcaactactggctcatcaccagaaaccagaacgtacgccggcaacccatctccctgaaatggccgctgtggagccccggcagttcgggcgtctggagccgggctcctcgccagtgcgcgtggccacgaacggcgccaaggcgtaccctcctccggcaagccacctcccgcggcgcgctgactcccctgtccgcggctgcagcttccctcccctcgtctccccgccgcgcaggctggacgacgcgtcggacgacgaggacgaggagcaggaggactggcgagagctgtacggctcgcacctgcagctggaggtggagcccgcggtgcaggacgcgcgcgacgaaggcaccgcggacgcgtggatcgagcggaacccgtgcctggtgaggctgacggggaagcacccgctcaactgcgagccgccgctggcgcggctgatgcaccacggcttcatcaccccggcgccgctgcactacgtgcgcaaccacggcgccgtgccgcggggggactgggcgacgtggaccgtggaggtgacgggcctcgtgaggcggcccgcgcggctcaccatggaggagctggcgcgcgacttccccgccgtggagatccccgtgacgctggcgtgcgcgggcaaccggcgcaaggagcagaacatggtgcagcagacggtgggcttcaactggggcgccgccggcgtgtccacgtccgtgtggcgcggcgcgcgcctccgcgacgtgctccgccgctgcggcatcgtgccccgcaagggcggcgccctcaacgtgtgcttcgagggcgccgaggacctccccggcggcgggggatccaagtacggcaccagcgtcacgcgcgagtgggccctggacccgtcgcgggacatcatgctcgcctacatgcagaacggcgagccgctgctgccggaccacggcttccccgtgcgcgtcatcatccccggctgcatcggtggccgcatggtcaagtggctcaagcgcatcatcgtcacccccgccgagtccgacaattactaccatttcaaggacaaccgcgtcctgccgtcgcacgtcgacgccgagctcgccaacgcagaagcgtggtggtacaagccggagtacatcatcaacgagctgaacataaactcggtgataacgacgccggggcacgacgagatcctgcccatcaacagcattaccacacagcgcggctacaccatgaaaggatacgcctactccggcggcggcaagaaggtgacgcgggtggaggtgacgctggacggcggcgagacatggctggtgtgccacctcgaccacccggagaagcccaacaagtacggcaagtactggtgctggtgcttctggtccgtcgaggtggaggtcctcgacctgctcggcgccaaggagatcgccgtgcccgcatgggaccagtcgctcaacacccagcccgagaagctcatatggaacctcatggggatgatgaacaactgctggttcaaggtgaaggtgaacgtgtgccgtccgcacaagggcgagatcgggctggtgttcgagcacccgacgcagcccggcaaccagcccggcgggtggatggcgcggcagaagcacctggagacggcggaggcggcggcgccgggcctcaagcgcagcacgtccacgccgttcatgaacaccaccgacgtcggcaagcagttcaccatgtccgaggtgcgcaagcacgcgtcgcaggagtcggcgtggatcgccgtgcacggccacgtctacgactgcaccaagttcctcaaggaccacccgggcggcgccgacagcatcctcatcaacgccggcaccgactgcaccgaggagttcgacgccatccactccgacaaggccaaggcgctcctcgacacctaccgcatcggcgagctcatcaccacgggcaccggctacagctccgacaactccgtccacggcggctccgtcctgtcgcacctcgcgcccatccgcgaggccgtcagggcccccgcgctctccaacccgcgcgataagatccactgccgcctcgtcggcaagaaggagctgtcccgcgacgtccgcctcttccgcttctcgctgccgtcgcccgaccaggtgctcggcctccccatcggcaagcacatcttcgtctgcgccagcattgaagggaagctgtgcatgcgggcgtacacgcccacgagcatggtggacgagatcggccacttcgacctcctcgtcaaggtctacttcaagaacgagcaccctaagttccccaacggcggcctcatgacccagtacctcgactcgcttcccgtcggcgcctacatcgacgtcaagggcccgcttggccacgtggagtacaccggccgcggcagcttcgtaatcaacggcaagcagcgtcatgcgagccgcctcgcgatgatctgcggtggaagtgggatcacgcccatgtaccagatcatccaggcggtcgtgcgcgaccagccggaggaccacacggagatgcacctcgtgtacgccaaccggacggaggacgacatcctcctccgcgacgagctcgaccggtgggcggccgagtatccgtacaggctcaaggtgtggtacgtcatcgaccaggtaaaggagcggccggaggggtggaagtacagcgttgggttcgtcacggaggccgtcctgcgggagcacgttccggaaggtggggacgacacgctggcccttgcctgcggaccaccgccgatgatccagttcgccatctcgcccaacttggagaagatgaagtacgacatggccaattctttcgtcgtgttctaagaccgcgcgggcagtagccaattaataattaatttgatatacctacgacgtaccacggaccagatatatgtatataaaccagccgacttgccagcgtaaatttcgtgagatgcatgggatatcgttggaaggatactgtaaggtttgcacttgtactgtgctctagcctagaattaccagactagagcagcagataacataggccatgcatgttttgattttgccctcggaatgtgcaacatgtaaattctgagggtattgtttatttacttatgtatgctactactagcgtttaactattattgttgttaaccatcggacataaatatctcaaaatgttctttcacttggtttcgacttaaaaagaaaaaaaaaaaaaaaaaagcggcc

SEQ ID NO: 12649 - DNA, 6234 bp, Zea mays
agcttggtattttttttagttttgagacaatactatggtatttaataatattgtagtatttgaagtcaaaagttctttagttggtatatgtaaaacacagttttaaatattatggattacccaaatccatgttatttttggagttttaaagctccattcaagacctcagtattcttctgttctctctataaatactttggctttctaatgcaaccaaacacatcttgattttaagcaataccgtggttttactacggtaaaacaataatgtagtatttgtgttatgtacaattgtaaactacggtatttaaccatattatcaaacatgctcttagttggtcgtacattgctataatttctatatataaacacaactatatttattttatttttaagttattagtatgtatatatttataatatctctcctttataatctttatataatataaataaatataagttatactggtagaagtccactgctttataccaaatgaacagggaagacgacacacgaagacgacacacgacaaaacaatatttcacggggtagaggaaattattcgtcgctcgaggtcgaggaggaggcgtcatacggcgaaactcgcgcttaaatatagggtatattataatcactggtttgttactgaagacatatatgacggtggaaaaatcgccacagagatcctatgtatgtgcaattgggctctcacgtcgatcgcaagtgccatcaatttttgttattgatgcattgctccgcctcgcgttgctgagccacgactcggacggcggcgatagcggcggcaacttgaccgacgttgcgcgcggcaacggcatcgaggcggcctgcttgtgcttgtgcttgctgctgctcctctccctgccgatcctcgggctgtccccgctgtccattccagagcgagtcaacctgctcagcgccttccttgcgtccgcgcagtacctcttgctcgtaccaaggagcgccatgccccactccttgccactgccgctcttctcgtcgtaccaatgcgacaggctgccatcgcgtactttccgctccttctccagggcatcgcctagcgtgacgctccggcgaggaggagacgcggacgcggtggtggtgacagaggcgacgtcgccccgcggcgtccgtggacgtgccgggctccgctggaaaccgaggtgcaccggcttggcgctccaggggaagaagaacatgaacccgcacgctttcgggggcgtctgctcgccccgcgcgtcctctttggcacacgacgggagttgtgcctgtgccgccgcgtcttcgcgctcacactgcggctgctgcggggaatatataggctgctcagaagggagagcgcggcgccgaacgtgcatcgccactatggctctggccgtggccgtggccgcggcctcggcctccctgtcccggtcgcgcttggacttggagcggcgcgacgacggccgcctcctcgggtgcttgtccgcagacgtggtggcgatggcgttggcggccgggaggaagcggtccatgatgaagctcggcgagcggcgcgacccgaaggcgccgtcgatggcgctcaggcgcgcggagatcgcggcgagggcgagcctgtcggaggacgacaccctgtccagcgcgtcggagaacgtgtcgtcgtcctgccggtcgctgctgctcgagtcggcggtggcggtgctgtggtggtggtaggcccgtgcccgcgcacgcgcggcgtggcacgtgccgcaccgtcccggcggcggcttcggcagcggtacctcccgctccgccgcggccgctgcgctcttgggcacgcccggtgagctctcccacttgaacggcacgtgcccgcgccgcggggacgcgtcggcgcagccgcggcgcgcggcaggcgtgtcggctggccgcccgcagcacgagcggcgtggcgttggtagcggcgactcgagcagctgggcaacgacgtggtcgctgctacccttccgccgccgccgatggtcgtcagagctcccggctaccacgacgacgtccatgccacgcatctacccgtcagcatcaacaactatagctatagtacagtagcattgcatgcagcaacacgagaggcgtataaaaggcaggctgcgcggaggtggttggagatgtgcgcgccgggtccggcatggctgagccaaaggcttgcgacgctggtggttgggcgttagttggttaaacctaaatggagtgagctctctactcgtgaaggcgtttataggcctcaatggaggttgcccaaagggaggaggagcgcttccgtgtggtggggccaagcttagctcaatttttgcaagtgttgcattcccccggttggttaattgtttttttaatcaaacaggcacatagctataaattattgtcactttctcatttttaagtgggccgcgatcttgtgggcaggcacacagccaaccgatacacaagtggatttggtgagttcagtgcatttgcagcccgctaaagcccaaggcctatcccttaacggcaaattcggctgagttatgcggcacccccccgcgccggccggggagcacggctttgctaaacacgcagaaaagaaaagccgttctccctccgtttccccaaaccccaaggtccccaaccatggcagccgccgccgattctgcctccgaccaaaaccctaaggacgccgagcggcacgtgctcaccgccgaatccgacgccgatttctccgaggaggactacgacgaggatggggaggaggaatacgaggaggaggaggagctggacgggccggcggcggcggcggcggagcgggagcggatgcagtccgtgttacggaggctgtcatccgaccccgtgggcatccgcgtccacgacgtgatcatcaagggcaacaccaagacgcaggacgagctcatcgaggcggaggtcgccgagctgctccgcgccgcccccaccgtgcaggacctgctccgcgccgccagtgtcgccactgcgcggctgcacgatctcgacatcttcgacgccgtcaagatcacgctcgacgccgggccgcccgagctgcctggcaccaccaacgtcgtcatcgaggtcgtcgaggtggccaaccccctcactggcaccgccggcgtctattcgaagcccgaagcaagatcttggtcgctggaagggtcacttaagttgaagaacttgtttggctatggtgacatctgggatgcatcaggatcctttggttgggaccaaacaacagaggttggtgttggagtctgcctaccgaggtttaaatcaataccaacaccattgatggctcgggcatctttgtcatcacaagattggctgaagttttcatcatacaaggagcgcctacttggcctttcatttggtttgctgtcaacaaggaaccatgacttgtcatacaaccttgcgtggcgtaccttaactgatccatcacgtgtctcatcaaaggccataaggaggcagttagggcataaccttctttctgcattgaagtacacatacaagattgataagagggattcacatcttaggccaacgaaaggatatgcgtttcagtcaacttctcaagttggtggtctatggaatagcaaaggattgagatatttccggcaggagttcgatgtacgtggtgctgtgcctttgggattttatagtgctgctctcaacgttggtgtaggagcgggtgtcattttaccgcttgcagggggattcatgaattcgacttcatcagtgccagagaggttttatcttggaggtaattcttctccagtgtgcagcttgggcggaccgtcatctctgctgggtttcagattaaggggagttggcccaacagaggcgcggaggcatgtccttaataactcggagagtggctcggctgaccctggaagggattacttgggaggtgatctggccgtgtctgccttcgctgacctttcttttgatctgcccctcaagatattcagagacgctggaatccatggccacgcattccttactgctggaaaccttgcgaaactgtcggagggtgagtacaagaacttttcggcttctgaatttcggcaaacgttccggagctctgctggcgttgggattattttgcctaccaaacttttccgggtagaggtgaactattgccgcatcctaaagcaagctgagcatgacagcgcgaagactggaatccagttcagcttttcctcgcccatgtaggaacttgccatggcagccgaaacagctgcactttcctctgtagacttgcatttcttcccgttcttttcatgctgaagcaattgaagaggttatttacgtgctcccttttcttgtgacgcttgttcattgacacgaggagctgctccttttttttggtgtcttcaggagatgggtttattatttgctgtttttgacctcacgagggatttgtcctcgcacaactcaaataccgatgctgtggctacacaatggtggatagaataatattttggcccataatgttgtataattcataccacatcaaaaaaaaaagagatgcccgcgtcccttcgcgtgtgttgcctaggctttcgcaggcataattgcacatcaagggcagtggccagtgttcctgtgccaattctaaagaagcgggccatccgcttccgttgatcgcatcgggcatcggcgactgatgagccttgtgccgagtggcgacggaggaagccggcggtgaatgtcgccgtgtgtgccgtgtcggcctctggtttaaacccggtttgtgttcgtttagcatccatttccacacaaaagtttgaccggaaattatagttcatgccgtgcattgccgccccactcgcaaaaggctaaagccatattcacttacacaacatctcattcaatgtcccgggcacagcgaccattcccatctctttcagtaaattcaacggatcaaccgaagtggtccctgttaccagcgaacgagaaaccgccctagcaaaaagaaaaagaaaaaaaaaagaaaagaaaacatggcgaaagcgacacgccatagcggcacagtacagcagggacgaccgcttcacggagatccggccccaacggccaacgctgctctatccactgtcagcagatgagcggagcgatcgatcgcgtgccgtgccagtgccactgccactgccacctatcggcacaacaagactgcgggttcggtggcgctgcctgcaccgcgtaggccgtgtgatcggcagcgggcgccagcagggcccaagcaagcggcggcaagagcacggcagcgcaggccgaggacgatctgcctgggcgaacactagacatgtgggggtgacttgtgagccatcagccatgtaacgcgtgaacgtgtcatgtcagctgtaccggatgcagaaagcgcccggggatgatgagaaatggacacaatggaagagtcgggtaaaataggtgaattccatcatcaatactctggatttgtcatgcattctcgtccgggtccacaaacttccaatttacatgttctggtcttatagcaaactccaagagaatagctaaaaatactagccaaatttactgatttagctactatctaaaatagattttacagaaaaagtgtaggctaatccaacagactcattaaacctacggactgaatagagagtaaatcaggctatccaaaaatagagagcaaaggtggatggatagaaagccactaaatttgaagagttgtttatagagcctattggatacactttttttttctaatattaactaaatttacctttacaaaaccatatatacctaacctctttgagttgctcttaaacttatcatggataaatcaagtccaatcagatccatatcagccatagctgcctaatacttaggttaggttagaacatttacaatgaattccttaaatatgactcgactaaacagtaatccgaatgcacttatattcgttttgccttcccaactcatattttactcttttcttccctcctttttatcttcaaccgatgcagtataaatggtactagacattaaggtcactgaccactttcctaatccttgtgcaaagtctaaaaccaccagcatttaggattggagccttggaggacgtgtttgtttaggaaacactagatgcaaacaagacctgtatgaccgccaaaccatgcattgcaatgcagccccatgggtaaccaatttggacctacctggaaacccaagcc

SEQ ID NO: 12650 - DNA, 1164 bp, Zea mays
  misc_feature (946)..(946): n is a, c, g, or t
  misc_feature (1037)..(1037): n is a, c, g, or t
ttttttttttttttttgacactattgtttatcgttcacgttttaatttggtgaatcaaacagcaccctaattccaaaaaacgcacacgacggaatacagtgtccaaatcactatccagtattcactagtcactagtacctacaactgcacggaacaggtttagcgtcttttatttattcgactgaacgtctgaacgactgaacctacgacagaaatgtggaccggagctgcatgcgctgtgagcaggaggcgagtggatgacccatcgcggaacgaagagagggtctggttctggtctaggcgtctagcaggtgggcacgcacttcctgcacttgacgacgcaccgcgacgggacgtggttgaggctggcggcggcgcgcgacgaggcgccgtcgtagcacctcttgccgcagatgacccgcctcttccggcacgccgcggcgctgacgcagcccgcgccgccgccggaggacttcctggtggcgggccgccgcctccgggacgccacggccctcaggttctttgcctcggcgtcggcggtgacgttcgcggcgcgccagccaccgtccggtctgaagaggttgccggcggccctggcgatggagccccgcaggtcgcggccgagggtgtccgcgaggctggtgctgctctcgtgggcggcgagcgagagcctgcagctcgccatggcgatggccagcagcaggagcaccaacactagagcgcgcgagttattcatgcttgctgcggttgctaacggccaccgcgcctcgatcgtttatgttgctggctcgattgttcgtgcactgcagatgaacgcacgtttgccgcctgcgtggctccccctttatatacaggagaaagtcgtcagcagggtggggtgggaactatctgcatgagctacctaatttcaatgaacgtccaatgcgtggtggtgaacagttcgggncgtgagtagccatagagaggaaggaaacggtgagggcaggagtaacagaagaaggcctgcagagtgcagactgcagacaagctggcatgcnagattgtacaattcttcgccacatggcacgaagcaggaacgtaagtctaccgaaatggacttctccaaagacagaaagggacgtgtaaggtgacaggacacctatatatacagcttgggattaaaga

SEQ ID NO: 12651 - DNA, 1840 bp, Zea mays
cggaaagacagcgctcggcgcaatctttccctttccccaagatgggattcggcttcgttcgtctcgccgcccgcgccgcggtttctcgccggggcatgacgccagcaacctccgcccgccgcgcgctcgccccacccgccgtgccggcggagccccgctgcgggccccactggctcgtggccgcccgcggccacgtgggccactcgcaccaccgcggcggggaggacgagggcgagacatccgagaggatctttcgtctgggactcgccgctgacgtcgtactcaccgcggggaaggccgtcacaggctatctctccggcagcaccgccatcgccgccgatgccgcccactccctctcggacatagtgcttagcggggtggctctgctgtcttacagggcggccaaggctcccagagacaaggaacatccctatgggcatggaaagtttgaaagtttaggagctcttggaatttcaagtatgctgttggttacttcaggtgggattgcatggcatgcttttgaagttcttcagggagttatgtcttctgctcctgatataattggcaatacattgcatgcacaccatgaccatggtagcagtgggcatcatcatggaatagatttggaacatccagttcttgcattgagcatgacaactttagcaatatctatcaaagaagggctatactggataacaaaaagagctggggaaaaggaaggcagtgggtctgatgaaagctaatgcatggcaccatcgtgcagatgctatttcatctgtcgttgccctagtaggggtaggtggttccattcttgggttgcctcttcttgatccactagctggacttgttgtctctggcatgattctgaaagctggtattaagactggatatgagagtgttctggaattagttgatgctgctgtggatccttcacttctagcaccaatcaaggaaactattttgagggttcacggtgtgaagggatgtcatcgattgaggggaagaaaagctgggacatcattatatcttgatgtgcatatagaggtatatccttttctgagtgttagtgcagcacatgatatcggtgaaactgttcgtcatcaaattcaaaaggagcacaatcaagttgctgaagttttcatacacatagatccctcgtactcagtaggcccgaccatggacctaaaaaggattctgaaggactctgatggaacaaattcagaagctatcccacggcaacaaagtgcagaagccatcgtgtctaatattatttcatctcatttttcggagaaaatggcgctcgaacatctaatgctgcattacgtgcaaggaagagtgttgctccaggtccaagtttcaatgtctccagaaattttgattcgggatgcaatggaagtcgcgaagcaagccgaagaggagatactcagggctgatgccagcataagccaaatcagcttgcagctaagattgggccaacaaatcaagcaacttcagctagcatcgcaagaacgtcgctgatctacatgcaggagatcactgatccatttgctggctgcttcgtgggtctactcgggagtatttcctttcgctaatttttctgacatacatgagagcttggtctgctgatgaggcagtaggctataggattctaggaaccgactgtgtacattgtaatcagagtgttcggagacgtgaagctgagtttgtaataatacacaagcagccttgctcagaaatgtactgggcaacaaattgtctgccacatactgtcaatgtaaaatgtatgaacaagttcctcactggccccgctataataacaacgaaccattgctactgatgc

SEQ ID NO: 12652 - DNA, 1811 bp, Zea mays
gcacgagaccattacctagaacatcctaatcaaaaggaggcccagaagcgtccggaaagacagcgcacgaagcaatctttccctttccccaagatgggattcggcttcgttcgtctcgccgcccgcgccgcggtttctcgccggggcatgacgccagcaacctccgcccgccgcgcgctcgccccacccgccgtgccggcggagccccgctgcgggccccactggctcgtggccgcccgcggccacgtgggccactcgcaccaccgcggcggggaggacgagggcgagacatccgagaggatctttcgtctgggactcgccgctgacgtcgtactcaccgcggggaaggccgtcacaggctatctctccggcagcaccgccatcgccgccgatgccgcccactccctctcggacataggcatggaaagtttgaaagtttaggagctcttggaatttcaagtatgctgttggttacttcagggagttatgtcttctgctcctgatataattggcaatacattgcatgcacaccatgaccatggtagcagtgggcatcatcatggaatagatttggaacatccagttcttgcattgagcatgacaactttagcaatatctatcaaagaagggctatactggataacaaaaagagctggggaaaaggaaggcagtggtctgatgaaagctaatgcatggcaccatcgtgcagatgctatttcatctgtcgttgccctagtaggggtaggtggttccattcttgggttgcctcttcttgatccactagctggacttgttgtctctggcatgattctgaaagctggtattaagactggatatgagagtgttctggaattagttgatgctgctgtggatccttcacttttagaaccaatcaaggaaactattttgagggttcacggtgtgaagggatgtcatcgattgaggggaagaaaagctgggacatcattatatcttgatgtgcatatagaggtatatccttttctgagtgttagtgcagcacatgatatcggtgaaactgttcgtcatcaaattcaaaaggagcacaatcaagttgctgaagttttcatacacatagatccctcgtacttagtaggcccgaccatggacctaaaaaggatcctgaaggactctgatggaacaaattcagaagctatcccacggcaacaaagtgcagaagccatcgtgtctaatattatttcatctcatttttcggagaaaatggcgctcgaacatctaatgctgcattacgtgcaaggaagagtgttgctccaggtccaagtttcaatgtctccagaaattttgattcgggatgcaatggaagtcgcgaagcaagccgaagaggagatactcagggctgatgccagcataagccaaatcagcttgcagctaagattgggccaacaaatcaagcaacttcagctagcatcgcaagaacgtcgctgatctacatgcaggagatcactgatccatttgctggctgcttcatgagtctactcgggagtatttccttttgctaatttttctgacatacatgagcttggtctgctgatgaggcagtaggctataggattctaggaaccgactgtgtacattgtaatcagagtgttcggagacgtgaagctgagtttgtaataatacacaagcagccttgctcagaaatgtactgggcaacaaattgtctgccacatactgtcaatgtaaaatgtatgaacaagttcctcactggccccgctataataacaacgaaccatggctactgatgcaaaataaaatgaatattgttttttttc

SEQ ID NO: 12653 - DNA, 2164 bp, Zea mays
ctgtgttttatgttttatgttgcattatcaaattaatcttagcccctaataattttataacatttaagtgacacatcctgtcaagttccgcaacccaattgactggttacatgtgttctagtcgttaaccttccttcgctgcgtgtctaggtatctcgtatggtgtcgtgacggatgccatgacgctgtcgtcgtccacaaccacacggtaggaaaggaatccatcgcgtcgctccctgcctgcactcattcggagcatcggcacacgtagcattggacacggaccggcagcatcagatgcacacggacgacgtgtacgtttggaatttaagtaatttttttagtggaagaattatatcacccaccacctgctgttggatcgagcgtgtgcgtgtcggtgtctgtgtctcatcatcgccgtcgtcatctgtttaatactactagtcacatgggcttttgctgtagctttctggcatcgctactaccagacagagaggacaggggaggtcagagtcagagacgctcgctcacgacggcagcagccatggcagcaccgtgcggcggccgcgtggtggtcttcccgttcccgttccagggccacttcaacccggtgatgcgcctggcccgcgcgctgcacgcgcggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacggcgaggcgggggaggcggggggccgcgtccgctgcgtcctcaccgacgtcagctgggacgccgtgctgtcggcggcccgcggcctcggcgtgcccgcgctcggcgtcatgacggccagcgccgccacgttccgcgtctacatggcgtaccgcaccttggtcgacaagggatacctgccggtgagaggtgagtccgtccaagtcgatttcgtcggcggcggcgaggttagagttagattagatctgcctacttgcttatacataatggtttggattggatgcgtgaatcgatctaatcaaatcagaggagcgcaaggacgacgcggtcgccgagctacccccgtaccgcgtgaaggacctgctgcggcacgagacgtgcgacctggaggagttcgcggacctgctgggccgcgtggtcgcggcggcgcggctgtcctcggggctcatcttccacacgttccccttcatcgaggccggcacgctgggcgagatccgggacgacatgtcggtgccggtgtacgccgtggcgccgctcaacaagctggtgccggcggccacggccagcctgcacggcgaggtgcaggcggaccggggctgcctgcgctggctggacgcgcagcgggcgcgctccgtgctgtacgtgagcttcgggagcatggcggccatggacccgcacgagttcgtggagctggcgtgggggctggccgacgccggccgccccttcgtgtgggtggtccggcccaacctcatccgcggcttcgagtcgggcgcgctgcccgacggcgtggaggaccgggtgcgcggccgcggcgtcgtcgtcagctgggcgccgcaggaggaggtgctcgcgcacccggccgtgggcggcttcttcacccactgcggctggaactccaccgtggaggccgtgtcggagggcgtgcccatgatctgccacccgcgccacggggaccagtacggcaacgcgaggtacgtgtgccacgtctggaaggtgggcacggaggtcgccggggaccagctggagagaggggagatcaaggccgccatcgacaggctcatgggcggcagcgaggaaggggagggcatcaggaagaggatgaacgagctcaagatcgctgcggacaagggcatcgatgaatctgctgggtcggatttaactaatttggttcatctcataaactcctactgatcgatccttgtattgggtaccatgttccggatgatgagttggaataaatcaaaacttgtgttccagtcaaaaaaaaaaaaaaaagatctacgcttctcatcattcatcatcatcaatggaca

SEQ ID NO: 12654 - DNA, 1637 bp, Zea mays
tgtagctttctggcatcgctactaccagacagagaggacaggggaggtcagactcagaaacgctcgctcacgacggcagcagccatggcagcatcgtgcggcggccgcgtggtggtcttcccgttcccgttccagggccacttcaacccggtgatgcgcctggcccgcgcgctgcacgcccggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacggcgaggcgggggaggcggggggccgcgtccgctgcgtcctcaccgacgtcagctgggacgccgtgctgtcggcggcccgcggcctcggcgtgcccgcgctcggcgtcatgacggccagcgccgccacgttccgcgtctacatggcgtaccgcaccttggtcgacaagggatacctgccggtgagagaggagcgcaaggacgacgcggtcgccgagctacccccgtaccgcgtgaaggacctgctgcggcacgagacgtgcgacctggaggagttcgcggacctgctgggccgcgtggtcgcggcggcgcggctgtcctcggggctcatcttccacacgttccccttcatcgaggccggcacgctgggcgagatccgggacgacatgtcggtgccggtgtacgccgtggcgccgctcaacaagctggtgccggcggccacggccagcctgcacggcgaggtgcaggcggaccggggctgcctgcgctggctggacgcgcagcgggcgcgctccgtgctgtacgtgagcttcgggagcatggcggccatggacccgcacgagttcgtggagctggcgtgggggctggccgacgccggccgccccttcgtgtgggtggtccggcccaacctcatccgcggcttcgagtcgggcgcgctgcccgacggcgtggaggaccgggtgcgcggccgcggcgtcgtcgtcagctgggcgccgcaggaggaggtgctcgcgcacccggccgtgggcggcttcttcacccactgcggctggaactccaccgtggaggccgtgtcggagggcgtgcccatgatctgccacccgcgccacggggaccagtacggcaacgcgaggtacgtgtgccacgtctggaaggtgggcacggaggtcgccggggaccagctggagagaggggagatcaaggccgccatcgacaggctcatgggcggcagcgacgaaggggagggcatcaggaagaggatgaacgagctcaagatcgctgcggacaagggcatcgatgaatctgctgggtcggatttaactaatttggttcatctcataaactcctactgatcgatccttgtattgggtaccatgttccggatgatgagttggaataaatcaaaacttgtgttccagtcgatttacgcttctcatcattcatcatcaacaatggacaacaaaagctacagggtttagaccgttaaaaaaaaaaaaaaaaaaaaaaaaaaaaaaaaaaactcgag

SEQ ID NO: 12655 - DNA, 1362 bp, Zea mays
  misc_feature (11)..(11): n is a, c, g, or t
tcggccggggnaccccgcaccagcattgggtacctcgaggccggccgggccgcacccgcccggggtggaattgggaactgagaaggaaaaaaaaacacccacacccacacccgctctgccccatccgcgcgcccctcctcctccaccgcccgtcccgccgccgcccggccgtctggtggcgatggcgtaccgggcggacgacgactacgactacctcttcaaggtggtgctcatcggcgactccggcgtcggcaagtcgaacctgctctcgcgcttcacgcgcaacgagttcagcctcgagtccaagtccaccatcggcgtcgagttcgccacccgcagcatccacgtcgaggacaaggtcgtcaaggcccagatctgggacaccgccggccaggaaagataccgcgctatcacgagcgcgtactaccgcggagcggtaggggcgctggtcgtgtacgacgtcacgcggcacgtcaccttcgagaacgtggagcggtggatgagggagctgagggaccacacggacgccaacatcgtcatgatgctggtagggaacaaggcggacctgcgccacctcagggccgtcccgaccgaggacgccaaggccttcgccgagcgccagaacgccttcttcatggagacgtcggccctggaggcgatgaacgtggaggacgccttcaccgaggtgctcgcgcagatctaccgcgtcgtcagcaagaaggcgctcgacatcggcgacgaccccgccgcgcctcccaggggccataccatcaacgtcggcggcaaggacgacgtgtccgcggtcaagaagtctgcctgctgctcgtcttagcttgagaggacaggatagagcgggtacttgggtctggttgttgatacttccgcactagagggcacatgacgttattgcagtcatggtcctcgatctcgattcattcgtttccaggtgtctcgttgattttgccatttgatacattgattcattcaggacttgggcctttctggtatagtgtagggataccttgttccttttatttcttgtacctgcatactgtcgcttctcttatcaaactagctgcattacttcaacaggctatttatttgcttttgctagactgctgccatgttgcaaattgcaatccaattggtcactagggtacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccctttttaaaaaaaccaaattttatttcccgggggttggg

SEQ ID NO: 12656 - DNA, 912 bp, Zea mays
  misc_feature (9)..(9): n is a, c, g, or t
ccggccggngtctagcattgatccaagaaaaaaaaaacacgcacccgcgtccgcgtgctctctgccccctgcccccctcccatctgcgccgccctcctcatccaccgcccgtcccgccgccgccagcccaaggccaggcatccgccagcctctcgcaccacgcgtatcgcgtgcccgcccgaccggctcgtggcgatggcgtaccgggcggacgacgactacgactacctattcaaggtggtgctcatcggggactccggcgtcggcaagtccaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggtcaggaaaggtaccgtgctatcacgagcgcgtactaccgcggagcagtaggggcgctcgtcgtctacgacgtcacgcggcacgtcaccttcgagaacgtggagaggtggatgagggagctcagggaccacacggacgcccacatcgtgatcatgcacgacccccaatcccccatcccccagatccacctgtgctctgcgaggcgcgtcgacccctttatttcccggtatctcatctctgatcgagtccactcgttaccgactgccatgtctgcgtcctagtatggatttctgtagcttagtttggtcggtgccccctcttaacctaattgctgttggcctggtccattgcacatggacgcaaattaactgcctcgatcaccattagaagaaaaaatggaaagaatctgcgctcgttcaattcaattcacatcggtccgtgatcgcacgtgccgtcttcaatctgccacattcctagcaaccagaaacacgctgtttgagatcgtgcag

SEQ ID NO: 12657 - DNA, 1319 bp, Zea mays
acgacgaccacatctccccgctgggacctggtgctcggcggcgtgcgccccactacccaaccaactgaaccatgcacaagagcactgcacgacgcccgcacggcaccgaccccgcaccaagccaacggaaaccgagcacccgcacccgcccggggtggaattgggaactgaggaaaaaaaaaacacccacacccacacccgcgtccgcgtgctctctctgccccatccgcgcgcccctcctcctccaccgcccgtcccactcccgccgccgccgccgcccggccgtctgctggcgatggcgtaccgggcggacgacgactacgactacctcttcaaggtggtgctcatcggcgactccggcgtcggcaagtcgaacctgctctcgcgcttcacgcgcaacgagttcagcctcgagtccaagtccaccatcggcgtcgagttcgccacccgcagcatccacgtcgaggacaaggtcgtcaaggcccagatctgggacaccgccggccaggaaagataccgcgctatcacgagcgcgtactaccgcggagcggtaggggcgctggtcgtgtacgacgtcacgcggcacgtcaccttcgagaacgtggagcggtggatgagggagctgagggaccacacggacgccaacatcgtcatgatgctggtagggaacaaggcggacctgcgccacctcagggccgtcccgaccgaggacgccaaggccttcgccgagcgccagaacgccttcttcatggagacgtcggccctggaggcgatgaacgtggaggacgccttcaccgaggtgctcgcgcagatctaccgcgtcgtcagcaagaaggcgctcgacatcggcgacgaccccgccgcgcctcccaggggccataccatcaacgtcggcggcaaggacgacgtgtccgcggtcaagaagtctgcctgctgctcgtcttagcttgggaggacaggatagagcgtgtacttgggtttggttgttgatacttcagcactagagggcacatgacgttattgcagtcatggtcctcgatctgtattcattcgtttccaggtgtctcgttgattttgccatttgatacattgattcattcaggacttgggcctttctggtatagtgtagggacaccttgttccttttatttcttgtacctgcatactgtcgcttctcttatcaaactagctgcattactacaaaaaaaaaaaaaaaatttatttgcttttgctagactgctgccatgttgcaaattgcaatccaattggtcactagggtacctcattggattgtgccgatgcttggcaattggcatcgt

SEQ ID NO: 12658 - DNA, 1164 bp, Zea mays
ccgggactgcactgcacgacgcccgcacggcaccgaccccgcaccaagccaacggaaaccgagcacccgcacccgcccggggtggaattgggaactgaggaaaaaaaaaacacccacacccacacccgcgtccgcgtgctctctctgccccatccgcgcgcccctcctcctccaccgcccgtcccactcccgccgccgccgccgcccggccgtctgctggcgatggcgtaccgggcggacgacgactacgactacctcttcaaggtggtgctcatcggcgactccggcgtcggcaagtcgaacctgctctcgcgcttcacgcgcaacgagttcagcctcgagtccaagtccaccatcggcgtcgagttcgccacccgcagcatccacgtcgaggacaaggtcgtcaaggcccagatctgggacaccgccggccaggaaagataccgcgctatcacgagcgcgtactaccgcggagcggtaggggcgctggtcgtgtacgacgtcacgcggcacgtcaccttcgagaacgtggagcggtggatgagggagctgagggaccacacggacgccaacatcgtcatgatgctggtagggaacaaggcggacctgcgccacctcagggccgtcccgaccgaggacgccaaggccttcgccgagcgccagaacgccttcttcatggagacgtcggccctggaggcgatgaacgtggaggacgccttcaccgaggtgctcgcgcagatctaccgcgtcgtcagcaagaaggcgctcgacatcggcgacgaccccgccgcgcctcccaggggccataccatcaacgtcggcggcaaggacgacgtgtccgcggtcaagaagtctgcctgctgctcgtcttagcttgagaggatagagcgtgtacttgggtttggttgttgatacttcagcactagagggcacatgacgttattgcagtcatggtcctcgatctgtattcattcgtttccaggtgtctcgttgattttgccatttgattcattcaggacttgggcctttctggtgtagtgtagggataccttgttccttttatttcttgtacctgcatactgtcgcttctcttatcaaactagctgcattacttcaacaaaaaaaaaaaaagcttttgctcttaaaaaaaaaaaaaaagcggcc

SEQ ID NO: 12659 - DNA, 1202 bp, Zea mays
cattgggtacctcgaggccggccggggtggcactctggcactgtcccccttccaccaaacgcgagaaacttgattccaggcagcaacccctcttccattccattcccgccgaccccgacgccgccctgtctcctcggctcctctctccgatccaatggcctacgccgcacgcctcgtagccaaggtccacctcgccgcgacgccgcaggccgagccgcgccacctctccagcttccgcgtaggagcactcagtcgatccacaaccgttcaacggcaaaagtttgttgctaaatctgctatctcggctgtggaaagtggtgatacatttgttggagtaaagcaaaatactagacctatcatagtcatagacaactatgatagcttcacatataatttatgccagtacatgggagaggttggagctaattttgaggtttatcgcaatgatgagatcactgtggaagaaattaagaagatttctcctagaggaatacttatttccccaggccctggcactcctcaagattcaggaatatccttgcaaacagttacagagcttgggccctcaataccgttgtttggggtttgcatgggtttacagtgcattggagaggcatttggagggaaggttgttcgatccccttacggcgttgtgcacggaaagggctcccttgttcattatgatgagaaacttgatggaactctgttttatgatattcctaacccattccaggctggaaggtatcacagccttgtaatcgagaaggatagtttcccgcatgataccctggaaattgttgcgtggacagatgatgggttgatcatggctgctcgccacaggatatacaaacatattcagggcgtgcagttccatccggagagcatcataactactgaagggaggctcatggtcaacaattttatcaagattattgaaggctacgaagcctcgaattgctctccgtgatttatctagttggaagcagcagcagccctgcgtggggcgggtgacaataagatgatgtaaaagcttgtaactacatagctcgaacatgtaaactcagatgtatatgttcggatgtcacaaactcacgacactcagagtccaactactgtacatggtcgcatgtggcgtgtcgatgtcaaatcaaatcattgaacttttagctcggtgaccgctatatttgtttttttaaaaaaaa

SEQ ID NO: 12660 - DNA, 1063 bp, Zea mays
ttgggtacctcgaggccggccgggaacgcctttttactattttttttctgttcccatttccaccctcgcaccgcatccacctccacctccaccgcgccgccgcgagagaggggaggagggtttccgatggagaacggcgaggagacgttcgcctcccccaccgccgccgccgccgcggacttcgagatctccatcaacggcgaggacagcacgcccaagctccacaatttggcggacgagatggaggccctccgcgcggcgaagcgcgacctggaggagaagctcgatgccgtgggacacgagaaccggttcctgtcctctgagtcccggcgcctcgaggtcctcgtgtcccaggcccgcgaggaggtcgccgctgccgagcaagtcgccgccaccaacgagagcgaggccgccacgctccgcgccgaggtcgagcgtctccagggcctcctagccgcagagaaggccagccatgaggaggagatgcgcaggggcgcaaggctcggggaccagctgcagaccgcgtaccaggagaaggccgcccttgaggaggagatcgagaccctgaagggttccgccactgccgagggcaagggcgggaaggaggaagaggagggacgtgattccgtttctgccagggccgggacgcctaaggatgagggcgtggtgtctcccgctcttgtggttgccgcggctgctggagcagctgccacggctgccatcgcggtggtcttgctcaacctcaagagatgatgtggtggtccgatgctcgggaagttttgatctgctgctatggccttgtcgtggtactagtgttgctggactcagtgtggtatctttactatcagctggataatatattagaggttagaacaacctatattgcaagtactttttagtttctgcagttttccatgctaataagagttgtgaacacaaacgtgagagcctgagaggtaattgaggtcaggtgtgttgtttttaagttgcacctaattcgtgattttgagttatcatgacttggatggtttgtactgttatgccttgtgcttccctgaatgat

SEQ ID NO: 12661 - DNA, 1914 bp, Zea mays
aggcaatgaggcaacagcgaatctagcctttttcttctttttccgcgtgggtggaacgcgagtccgcgacccgtttttgctctcgcctttccacccaaacggcccaacgtcccatctcagccgtccgatctgaaaactcttctccacgccgtccgattggaacatcctggtcgcttttccttcgggccaccccgccggcgaacgcctttttactattttttttctattcccatttccaccctcgcaccgcatccacctccaccgcgccgccgcgagagaggggaaggagggtttccgatggagaacggcgaggagacgttcgcctcccccactgccgccgccgccgcggacttcgagatctccatcaacggcggggacagcacgcccaagctccacaatttggcggacgagatggaggccctccgcgcggcgaagcgcgacctggaggagaagctcgatgccgtgggacacgagaaccggttcctgtcctctgagtcccggcgcctcgaggtcctcgtgtcccaggcccgcgaggaggtcgccgctgccgagcaagtcgccgccaccaacgagagcgaggccgccacgctccgcgccgaggtcgagcgtctccagggcctcctagccgcagagaaggccagccatgaggaggagatgcgcaggggcgcaaggctcggggaccagctgcagaccgcgtaccaggagaaggccgcccttgaggaggagatcgagaccctgaagggttccgccactgccgagggcaagggcgggaaggaggaagaggagggacgtgattccgtttctgccagggccgggacgcctaaggatgagggcgtggtgtctcccgctcttgtggctgccgcggctgctggagcagctgtcacggctgccatcgcggtggtcttgctcaacctcaagagatgatgtggtggtccgatgctcgggaagttttgatctgctgctatggcctatatgagaatgggttatccgttttgtcgtggtactagtgttgctggactcagtgtggtatctttactatcagctggataatatattagaggttagaacaacctatattgcaagtactttttagtttctgcagttttccatgctaataagagttgtgaacacaaacgtgagaggtaattgaggtcaggtgtgttgttttgaagttgcacctgtttcgtgattttgagttatcatgacttggatggtttgtactgttatgccttgtgcttccctgaatgattgttacctttgtttctgaagtctctatgtgttggagatgatgatggcccagagtgagggtgcactgcaagaaatcgtaccaattttcttgtgatagttgttgtcagtcttttcaggtaaatgctgagcaggtatgctactttgtttagtagatggcttgagatgttttaaattgcaaatttgaaatatgtatgactgtttgcatgtctcttactgcttgacatggctgctagtctgtatggctggtaattagagatgtgttgatctcaatggattatcttgcatttatgaatttgttattaaggatccatgaatttgtttggtgggttagggtatgtagggggtctcatgtcattctatcccgctttttaatattgagcactgatcagctggtttggatatcccaaaggcatcaaaacttggatgtaacatgtttggcttgacctgttttgatatccagtaggcatctagttagatatgcttgtttcattggcattggcatgttccttttttgctcatagataaatagttatacgtgtctacctactgcccgaggcaattttttttagcaatgagccaatgatcatagaactgagtccatgttacttgattagaagaataggctcaagtgtaatcgatgtgcaggtcgacaaagaggatccgcgg

SEQ ID NO: 12662 - DNA, 824 bp, Zea mays
tctctctcgtgctcaccagccatttagcaaagaaagccaccaagaagcggccatggagcagaagccgtcgtccctcgtgctcatcggcctcctcgccacgctctgcgccggcccgggtcacgccctggccctgcgccttctgaacggcggcctggagttctccttcggctccaaggcggccacggcaggcacggagaccgagccgctggacccgtctctgggcgacgactacgaaaacgagatcagccacgtggagttcgagccggagctcggcagcgcggcgccgtacgccgcggccgcagcggggccggccacggggcctgtgagggcccggaacaccgcggccgggcgccacagcatgaaatggtggctgccgccgtcgaccatgccgtcgtttccgctgctcccgaaccccgtcggcatgcccgggcccggcatcccggggctcccgctgcccggcatgccgttccaccccatcggcggttggggggcgcccgcacctcctaccacagagaccacgagcacgaacgtcaacaaccccaacgcgagcggaggcggcgttaactgacctgcttgcgtatactgattactgagacggtgctagagctcacagttcattttttttttgttcagcttacaactatttattcactagtactagtatcctgtcatcgcgtgaatggaagcatgaaaacgtaatcgtattttgctccaatacatgtaaaatgcgcacaggcttttaagggtcggtttagaacataaaaatgtggaaatggttaaaaaaaagagtgaaaaacaacatgattccaaaaaaaaaaaaaaaa

SEQ ID NO: 12663 - DNA, 535 bp, Zea mays
ctctctcgtgctcaccagccatttagcaaagaaagccaccaagaagcggccatggagcagaagccgtcgtccctcgtgctcatcggcctcctcgccacgctctgcgccggtccgggtcacgccctgcgccttctgaacggcggcctggagttctccttcggctccaaggcggccacggcaggcgcggagaccgagccgctggacccgtccctgggcgacgattacgaaaacgagatcagccacgtggagttcgagccggagctcggcagcgcggcgccgtacgccgcggccgcagcggggccggccacggggcctgtgagggcccggaacaccgcggccgggcgccacagcatgaaatggtggctgccgccgtcgaccatgccgtcgttcccgctgctcccgaaccccgtcggcatgcccgggcccggcatcccggggctcccgctgcccggcatgccgttccaccccatcggcgggtggggggcgcccgcgcctcccgccccgtcgcagccagcacctgctgccacagagaccg

SEQ ID NO: 12664 - DNA, 1486 bp, Zea mays
aggccggccgggattccactctcttctagataataataataaagcgaaaggttatcccacctcttttctattcttttttccgcccgaagacaacgtaacaaaccaacgataatcctccctcttgctacaaaaaaggaaaaaaaaacatcaataataatccactgcggtcgctcgtcctcctcccaacctcctcccaagttgcctcgtgctctgcttcttcggttttcaggagcgtcggccattgctgctggaaaagcagaccattgggactccctcgtgcgttttccaaatcagtcaggttgatggcgatggagggaccagttttatgccgccctgcaatgcaagccaaatcgcctgctgctgcgctggtcaacaactccctgaccagattcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaacttgcgttgtgtccataacaattctcaagggagaaatattccagagagtgcaccccaacctgctattgttttgaggattgaagatggaagcgaaactttacttccaatcattgttttggagatgccaagtgtacttctgatggcggctattcgtaatgtccacattgcacgaccaaccatatatcaagttgtcaaggaaatgattgataaaatgggctatgaggtaaaacttgttcgggtaaacaaaagaattcaagaagcgtactgtgctgaactttgtctaacaaagattgatgattctacagacagcatcaccttcgatcttcggccttcagatgccataaacattgctgttcgttgcaaggttcctgtacaagtccatagaagtcttgcatacagtgacggcatcagaccagtcgagccagcaagaatggcagtagcagctggcctatcagatgggttgttatttacagagcttgacagacccgatggacaggcatctgttgaggctcaagagtttggattggtgaagaacatgctcattgcagccgtagaagagagatacaaggatgctgcatcatggaaggacaaactgatgcggctgaggtctaagcggaagaactgggcctgacagcgttgcatgtctggatggtgtaaataaagatgatgcccagctgaattccagtacgcattccagataattgatgctgggttatggctatgtaactagctgtacatattgtatggacccgaggatggtcttctgtaaattcagactaagctttgaagtgaaacactaatccttcggagaaaaaaaaaaaaaaaaaaggccctgagcgaacatatatatgg

SEQ ID NO: 12665 - DNA, 1511 bp, Zea mays
gagagagctcactagtcccccctttctatttctttctccaacaaatcaacaattaatactccactacggtcgctcttctcccctcctctcaatttgcgctcgtgctctgcttcttcggctccaaggagcggcgaccattgctcattgatggcgatggagggacctgttttctgccgtcctgcaatgcaagcgaaactgcctgctgctgcgctgatcaacaactccctgaccaaatccgggcagcttgggactgcattgtttggtgccatttcaaaatacagaaacatttcaagattcatttctcccatctctcaaacatctacgaagaacataggtccatgctgtagcttcagctcgtcttctgatggtaatggatacatggctggaaactctagcgagagtgatgaagactatgttaattctactgtgctagaagcagttgaggtgagaagtggatcagaaggatatgtgataaagatgcgagatggaaagaacttgcgttgtgtccatagtaattttcaagggagaaatattccagagagtgcaccacaacctgctattgttttgaggattgaagatggaagcggaactttactcccgatcattgttttggagatgccaagcgttcttctgatggcagctattcgtaatgtccacattgcacgaccgaccatatatcaagttgtcaaggaaatgattgataaaatgggttatgaggtaaaacttgttagggtaaacaaaagaattcaagaagcctactgtgctgaactttatttaacaaaggtcaatgatcctacagacaacatcaccttcgatcttcggccttcagatgccataaacattgctgttcgttgcaaggttcctgtacaagtccatagaagtcttgcatacagtgatgggattagaccagtcgagccagcaagaatggcagtagcagctggcctatcagatgggttgttatttacagagcttgacagacctgatggacagccatgtgtggaggctcaagagtttggactggtgaggaacatgctcattgcagctatcgaagagagatacaaggatgctgcatcatggaaggacaaactgattcggctcaggtctaagcgggagaactgggcctgagagcgtcgcatgtctggatggtgtaaataaagatgacgctcagctgaattccagtatgcactccagacaattgatactgtttatggctctatgtaactagctgtacatattgtaactagctgtacatattgtacgtactatgctcaggtctcagctaaattcagactaagatttgaagtgaaaaactaatccttttgtaatcttggccgtattaatttgtatgttagtctgttaggttgaatgtttggcatgaatttttagctcatcgacctgcggtgagatatgcagaatttcggttgtacacggaactaagcagcgctaatattttcacaggctgctgttaagaagagagattgctgctttgtttcccattacagggaacgtac

SEQ ID NO: 12666 - DNA, 1977 bp, Zea mays
agcccttgcacaccattgggactcgttacccatctcgtggactcttctgtttcttctccttttctccccccgtttattggaccagcggcggcttgctcctcttcgtgtaacgggatttggttttctgcggatgagtgtttattgttcgatgcggagcttcgatctggattcgtgcttgtcctcttggtctctgctcgctttgtaatgcttgggtacggtgcgctgaaggtgtttggggggtatgattgttgttgcacctgaataactgaggtgggtgtggcgcgaacttgggggtgtcttctctttggcgatcagtgcaatcgaatggtcagttgagttagatagtttttacatcggcgttgatggacttgcataattatgtgcgaatcatgggatcattaacttggtataaggggacgatcagtgatatgtgaagctgtcatgtttaggtgcttgattcagcaaagtggttaggcatccgacgctacgttttggggattgagatgcataataaagttcagcacttaactatggatcaagggttgtagagcgcaacccagctcttctgaatccaaactgtaggttgatacgtcggtgccatgaaactgaaaaccgatagttgtggcataggctcagggcaagaatcattttttttttcattttctgacttttccgtaactataggtcacacgatgattattttctccgcgacattatccgggtattaccgcgacagatatttttattggctccatttctgccatgtagtcaggttgatggcgatggagggaccagttttatgccgccctgcaatgcaagccaaatcgcctgctgctgcgctggtcaacaactccctgaccagcttcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaacttgcgttgtgtccataacaattctcaagggagaaatattccagagagtgcaccccaacctgctattgttttgaggattgaagatggaagcgaaactttacttccaatcattgttttggagatgccaagtgtacttctgatggcggctattcgtaatgtccacattgcacgaccaaccatatatcaagttgtcaaggaaatgattgataaaatgggctatgaggtaaaacttgttcgggtaaacaaaagaattcaagaagcgtactgtgctgaactttgtctaacaaagattgatgattctacagacagcatcaccttcgatcttcggccttcagatgccataaacattgctgttcgttgcaaggttcctgtacaagtccatagaagtcttgcatacagtgacggcatcagaccagtcgagccagcaagaatggcagtagcagctggcctatcagatgggttgttatttacagagcttgacagacccgatggacaggcatctgttgaggctcaagagtttggattggtgaagaacatgctcattgcagccgtagaagagagatacaaggatgctgcatcatggaaggacaaactgatgcggctgaggtctaagcggaagaactgggcctgacagcgttgcatgtctggatggtgtaaataaagatgatgcccagctgaattccagtacgcattccagataattgatgctgggttatggctatgtaactagctgtacatattgtatggacccgaggatggtcttctgtaaattcagactaagctttgaagtgaaacactaatccttcggagaaacttggtaccttgtccgtgttcacttgtggtatataatgttgcgcggccacagggtt

SEQ ID NO: 12667 - DNA, 2509 bp, Zea mays
attgggtccctcgaggccggccggaatcgcacacaggggcaggagtgtagtggcgtataggagcaaagttggtctctgatctttcccctgcaagggaaagagaagaacagagacctctgcccctctcgtcactctctctctctctcacaccaccagtgtagtatagggtttcggcttgcctgtgcgtgttactgtcgcaatggcaggaggtctcttctccatggagcacccatgggcctctgtttttggcattctaggcaacatcatctcatttctggtgttcctcgcaccagtgccgacgttcctccgcgtgtaccggaagaagtcgacggaggggttcagctcggtgccgtacgtggtggctctgttcagctgcacgctgtggatcctgtacgcgctggtgaagaccaactccagcccgctgctgaccatcaacgccttcgggtgcgtggtggaggccgcctacatcctcctctacctcgtctacgcgccgcggggcgccaggctgagggcgctcgcctccttcctcctcctcgacgtggccgccttctcgctcgtcgccgtcgtcaccgtcgtgctcgtcgcggagccgcaccgcgtcagggtgctcggcagcgtctgcctcgccttctccatggccgtcttcgtcgcccccctgagcgtcatcttcgttgtgatcaggacgaagagtgccgagttcatgcccttcaccctctccttcttcctcaccctcagcgccgtcgcctggttcttgtacggcctcttcaccaaggacccctacgtcacgctcccgaacgtgggcggcttcttcttcgggtgcatccagatggtgctctactgctgctaccggaagcgcaagccggcgtccgtggtcgtcctgccgacgacgacggccgccgccgccgtggcgcagcagctggaggcggagatggagctgccactcgccgcccaccagcaccagctggccgtggccgtgctgcccacgtgcgcggccccggtgctggccgagctgcagaagctggaggaggcgatggggtcgccgcgcaagggcggcgtcaaggccatctgaccatggcctgcgatgaaccgcgcgcgatgcatgcatgtcctgctctagtgctagctggatcagttgcgtgcttatttgattattgttatgcatggcttggtagatccgaattattaactgactgcaagtagacagacatatatatgcgtgtgccttcttttctttactattatatatataatcgttcgtttgtgtgttcttaattatatatagctatatataagcttgcttgtattggagatggataaattaatctggtgggttgtgcaataaaagaagagaacatatctaatgtaaaaaaaaaaaaaaaatacatgatgcacatattaaatcatcaccactaattttagatctaacgtctctagttgtttggtatattttgctaaggacaccctccaacgtggtggtgtgtaatggtggaaggtgttatttgtaaattgaatgatcaactagagacattagatttaaaatgagtgatggtgatttaatatgtgcaccatgtgcaccaatcctccatgtgcaccagatatgtcctcataaaagaagggtgcacgctctttaagctactactactttgtgaattgtgacccactggcgcagcgcatatgttgtcggtggcttctggttagagatggcaacgggtacgtacccgccggatattatcttttcatactcgcacctgcgacaaaaaaatgtacccggcacaatacccatacccggttcgggtagaaatgtttacccatgcctgtacccaagtggatattgttacccgacgggtaacccatacccggcaggtgcttttgggtctccatcgccgttgttgctcttgtccttcggatccggcaggcggtgctcggtcgaagtggcagcggcatccctttgggacggcggggcgtcagcaaagggcgagacgaagatgcggtcatgcggagctacaaggttaagacgaggaagaggaacgaggttcaagaagaagcatcaccggccgtcgtcgtttgtggtgtcattggtcaccgccatggatgcaggagcagccgaggaggactgcaggagggtggaccgctggactgctggaggcaggagcaggatgcctcagccgctcagcgtctcagcgactcagcatggggagttggggactggcgcttggggttttgggagagcgagcgccgaccgagcgtccgaggtccgagcggagagccagcggcggcggcggcgcgggttggggcttggcgcttggggttttgggagagcgagctggggcttgctgtttgcagtttgcttgtcgagtgcttgaccggtccgcagaccacagcggtgcagcacacacaagcggcaagacggcaaaagtagagatggcaacgcaccgcttgagttgaggcctgcttcaccgcttgacttgagtgcttgacggcccacttgtcagccacttagcctgcttgc

SEQ ID NO: 12668 - DNA, 903 bp, Zea mays
gccggccgggccggccgcggcaaacactggttcacgtccgtccacctctctacgcctttcctcttatcctcccgtctcgcgccgtcgcgcgtctcgggtctctcttctctctctcggctctcgcctccctcccggtccgggtcgcacgcaggtcgcagccaccagtgcatttttatgcgccgcgctggtggttttggggcgcggagtccatatccatggtcatggacgctggcctgcacgagccgtgcgcgctgctgccgggatccaagcgcgacagccacatgctagtctacccccaaatcgccgccgccgctaatgggttcacggcgcaggagctcgagtcgctgctgttcctgtcgtctgatgggattactttggctgcgggcagtggcggtggcggcggcggcggaagctatctgaatgtcgcgcctaccactgtggtcccgcccgccccgaccaaccgcgcgtcgccgccgagggatgtgtccgccgcgccgccctcggtggggcagccggatgattcggaggcgttctcggacatcgtcctgggctacatcaaccgcatgctcatggccgaggacatcgacgataagttcgagcactacccggaggcaccccgcggtgctcgccgccgagaagccgttcctcgagatcctcgccgagcggccctcgagctccggtggcagcgcggtggagagcccgggcggcagcagtgtggggaactcttgctacagcgcgcgctcctgcacctgcgcaccgccacggcggcggcgaacgcccttttggcgcccgtgctgacgccggcgctcgacttcccgtcggccgcgttcctgcagccaccacagctgtaccaggatctaagccctgaagggcagcgtggtggatgcaggcggcgcgtggccg

SEQ ID NO: 12669 - DNA, 6045 bp, Zea mays
gagggcatatgtcccgttcatttctcggttataagtaatacagttaaaaataatccagcgagaacatagatctctgtttattaggtctcctgcttggtaaatgcactcgctctgatattttagtgctcgttgttgcaaatataccctctactatttcatcatagtccgtccttgccaaccacatagtcttatgattgcaattttttgactgagggagtaagtttcaagatagccggtctgggtacaccagtagagtagccgtgtgccgcccaggcccaccgctgtgctgccgtgcgcaagcaatgaatgtaggacgacgtggcgagggccctgcacagcacgcccactcgctgacgtgtcgttcggctgcgacctggccacacactgcctcgcgctcgtctgtggaagcggcgtggatagctcgggaccaccacgtggctgtgaagagaggaacttggcggccaaggcagccggaccccgtacaccggtggacccggtccatgcaccggtggacccgcacgcaccctgccgcaaaccaggcaatcacacacggtgataaatccggcaagatctgtcatgtgcacactgcacatgatgtcatcgccaatcagttacggctgcgagaccgtgaaatttccgcgcggagaggcagaggccgatagccacttgattttttgagggggtagtcgtggagatgctagaacgcacgtgccatctgcgcagatgagccggcgacacgtgggacccacagtccctaatcacgaagtgatggcaacataaaaaaccattcttaaggtcgctgggctgtcaaggtagtcaaagtgtccaaagacagtcgggagacggacgactcagtcacgatcacgacgcaaacaacgctggctacttcctgttgctagttcggagttcggactcggacgattattaaccgagtcgcaggcggtccacagacacagtccacccgcccccagaacatccctgcggcccaaatagcctgcttctgggaaccatcgttcacgcggggcacgggcacgccctccgtgcaccggggcctcagaggcgggcccaggggttcatggtattcattaaatatctaaaattttggtgatttataataatttgttaataatgtatcacataaaataacgttaaaacattatttttttaatcttttaattttttgaatatccaatcttaaatgtctagcccgcctgtggcctttcggcgccgtcccgagcacccgcggacccgcctcccgcccgtgtgagatcgcacgccgcagagcgtgcgtggacaagaccccctcggctgcgcgggcctgggtgtcgacattcctgccccgcagtcccgcacccggtgaccggtggtgttgatacaaaagcccggggtccggccacctctgcgcctctcgcaaacactggttcacgtccgtccacctctctacgcctttcctcttatcctcccgtctcgcgccgtcgcgcgtctcgggtctctcttctctctctcggctctcgcctccctcccggtccgggtcgcacgcaggtacgcactcttgacgagctcgcgcatctccacgagcggagccgcggcgcggctccgtacggccactgatccgtcggattagtcagcgcgtttcagctcgtggacatggatatcttcttcgggttccagttctcattcttctagctgtatttccctgcattcgccaggtcgcagccaccagtgcatttttatgcgccgcgctggtggttttggggcgcggagtccatatccatggtcatggacgctggcctgcacgagccgtgcgcgctgctgccgggatccaagcgcgacagccacatgctagtctacccccaaatcgccgccgccgctaatgggttcacggcgcaggagctcgagtcgctgctgttcctgtcgtctgatgggattactttggctgcgggcagtggcggtggcggcggcggcggaagctatctgaatgtcgcgcctaccactgtggtcccgcccgccccgaccaaccgcgcgtcgccgccgagggatgtgtccgccgcgccgccctcggtggggcagccggatgattcggaggcgttctcggacatcgtcctgggctacatcaaccgcatgctcatggccgaggacatcgacgataagttcgagcactacccggagcaccccgcggtgctcgccgccgagaagcccttcctcgagatcctcgccgagcggccctcgagctccggtggcagcgcggtggagagcccgggcggcagcagtgtggggaactctggctacagcgcgcgctcttgcacctgcgccaccgccacggcggcgtccgacgcctttggcgccgtgctgacgccggcgctcgacttcccgtcggccgcgttcctgcagccaccacagctgtaccaggatctaagccctgagggcagcgtggtggatgcaggcggcgcgtggccgtacgactcgacggaattctaccagctgcacagcaacccgtcgtcgttcgcgtcatccaacggcagctgtgctacaatatcagacggctttgagtcgttgctgagctcgcctggtgtcatgccagatgttggcttcaccgattttgccgtgcaaagccagcaggctatgcagttctgccgtgggttcgaagaagcaagcaagtttctgcctgacgagagtaagcttgtgattgatcttgagaagccagcatctgttacaagcttggtggctaacatcaaaggggagaacaggtttgcagaggtcaaggcagagaaggccgatgttcaggcagaaattcacagaggaaagaagcatttctatggtgatgacttggatgcagaggaagggaggcgcagtaaacattcagcacccgctatcgacactgatcaccttgtgcgggagatgatggacaaggtcttgttgtgcaatggcgagacatgttcaaaaggcgtcaaggaactccgtgaagccctgcagcatgacgtggcaaagaattcacacggggttcatggaaaagggtccggacatggcaagggccgtggcaagaaacagccgaagaaggaggtggttgacttggagactctcctcgtccactgtgctcagtctgtggccaccgatgatcgacgtggtgcaactgagctcctgaagcagatcagacagcatgcatcgcccaatggcgacggtgaccagcgtttggcgcactgcttcgccaacggccttgaggcgaggcttgctggcaatggaagtcagatttacaagtctcttataatgacgaggtttccctgcaccgatgtgctgaaagcctaccagctttacttggcagcttgcccattcaagaagatctcccatttctttgccaatcaaaccattatgaatgctgtggagaaggcgaagaaagtccacatcgtggactatggtatatactacggctttcagtggccgtgcctcattcaacggctctctaccaggcctggtggccctccgaggctccggatcacggcaatcgacacaccgcaccctggttttcgcccagcagagcgcatagaggagacgggaaggtatctaaaagattatgctgagaccttcaatgtgcccttcgagttccgagccattccatctaggttcgaggcggttcagatagaggatctccacattgccaaggacgagctgctgatcgtcaacagcatgttcaaattcaagacactgatggacgagagcgtggtggctgagagtccaaggaacatggtcttgagcacaatcaggaagatgaacccacatctgttcattcatgggatcatcaatggctcctacaacgcacccttctttgcgtctcgcttccgggaggccttataccactactccgccatctttgacatgctggagacgaacatcccgagggacaacgagcagaggctgctcatcgagtcagcactgttcggtcgagaggcaatcaacgtaatctcctgcgagggcctggaaaggatggagaggcccgagacatacaagcagtggcaggtgaggtatcagagagctgggttcaggcagctcccgatcaaccaggacatcatgaagcgtgctcgggagaaggtcaggtgctaccacaaggacttcctcatcgacgaagacaacaggtggttactgcaagggtggaaaggacgcatcgtgctggcgctctcaacgtggaagccagatcacaggtcttcctagctcctcctcgagggcggctacatggttgcagatcgagcactgcactgtagatggatggaggcctgttcgtatctttggatgcttgggctggttgttcctgggatgcaacatatagctaggctaggctgtgctattcgaactactaaagcatgttttgcactgtctttatatagtgatgccatcaagggtccctgcatgtcatgttaggttatggttcagttttggacaggaacagttagtgcattctttgatgggacagcaggctaggtatgttagttacgcgttacgcggtagaccctagggttgtttcatgcatggatcagtcttatggattcttgtattatatttgttccccccattaaccagtgctgtcaaagttttgggcttctttggtaggtagtagtagtaggtactacaaactttgttgcacctccatgaggtacagatactggccagtgccgactgccgagataggcaagcaagtgataccatcgtgtcccgatcatgtttccagtcctccgagcgagaaggtgagcagagctagctaactgattctgtaagttgcttgtattggtgaaacacaacacaaacggaccgtttggtgtgttcagactttgcagctgcctgcttcaatgcagtgatggcgggcggcctgaatgattgctaccgtaccgtacgtcgcgcaaactgcaaaaggtgacaaacatgtcagccagaaaggtccactccaaatcgctactcacatatacatggtcaccgttggagtgtctagaacgttgcctggcaggcggcgggcggcgggcggcggcccgggcgggccggcccggggatggcaggggggggaggatggattgggttttggcatcgcggatggccgatcgatcgcccgcaatggacatcactttcatatgaatgtgaatgtataactctcgtcatgaacagcggagggaggaaacatcggcgaagaaaacccaaaaaaatgttaacagcgataggtattactgcagcgagcgaatttttaaaaatccacgtagatacagtacacaggacaatctttttctatctttttttgaaaggaaaaaagaatggaactacaacaccaagaagatgtggcttccagcaactacgcaccaagaagaatccaacacaacactcatcggcaatcgcggctgaaagttacgggcagctcggcgataacagttaggggacaaggcaggtcgccgtcgtcgctggcgggaaaccaaccgggctcagttcagtggtgcgccaaataatatgccgttcacactaggtcagcagaggcactctcgggttcactgaaccttgaagaatagatcgcggtcgcggagggatcacgtctgctcggccccggccacgaccgagcgaatcggacaggagattcttgtgatttccacaggcagagttttctacgatttccactagttttcgtgattacacttatacatggccatgtggccctgttctggttcgttgtcgtgagcttcgattgcgtatacgtgggtgcagatgtgctcgagacatgggcacaggtgacggcgcccaatatgcaaatcctgcacctgcccaaacatgtgctcgaaacatgagcttaattgtggcaacaagcttataatataaagatccgttccaaatatatatatatatacttccctaatcagtgacagatctaggaatttgtgtctagcgagcaagtaatttgatgtcaatattgataaataccagtaaaatttacctaactatataaagtacataatactggtttcaaaacaatatatttataaccatagtaattgccacatccgaattaaaaaccaaattcag

SEQ ID NO: 12670 - DNA, 1202 bp, Zea mays
acaagcagtggcaggtgaggtatcagagagctgggttcaggcagctcccgatcaaccaggacatcatgaagcgtgctcgcgagaaggtcaggtgctaccacaaggacttcctcatcgacgaagacaacaggtggttactgcaagggtggaaaggacgcatcgtgctggcgctctcaacgtggaagccagaccacaggtctccctagcttcctcgagggcggctacatggttgcagatcgagcactgcactgtagatggaggcctgttcgtatctttggatgcttgggctggttgttcctgggctgcaacatatagctaggctaggcttgtgctattcgaactactaaagcatgttttgcactgtctcatataatagtgatgccatcaagggtccctgcatgttaggttatggttcagttttggacaggaacagttagtgcattctttgatgggacaggctaggtatgttagttagtagttacgcggtagaccctagggttgtttcatgcatggatcagtcttatggattcttgtattatatttgttccctccattaaccagtgctgtcaaagttttgggcttctttggtaggtagtagtagtaggtactacaaactttgttgcacctccatgaggtacagatactggccagtgccgactgccgagataggcaagcaagtgataccatcgtgtcccgatcatgtttccagtcctccgagcgagaaggtgagcagagctagctaactgattctgtaagttgcttgtattggtgaaacacaacacaaacggaccgtttggtgtgttcagactttgcagctgcctgcttcaatgcagtgatggcgggcggcctgaatgattgctaccgtaccgtacgtcgcgcaaactgcaaaaggtgacaaacatgtcagccagaaaggtccactccaaatcgctactcacatatacatggtcaccgttggagtgtctagaacgttgcctggcaggcggcgggcggcgggcggcgttccgagctgatcgacacggatatggcaggggggggaggatggattgggttttggcatcgcggatggccgatcgatcgcccgcaatggacatcactttcatatgaatgtgaatgtataactctcgtcatgaacagcggagggaggaaacatcggcgaagaaaacccaaaaaaatgttaacagcgataggtattactgcag

SEQ ID NO: 12671 - DNA, 1018 bp, Zea mays
cattgggtacctcgaggccggccggaacgcccgttttttagtccacagaaagacgaaagaagaaacggggcgactcgcagatccaagcggagaagctgcgtcgtggcctgaccctgtccgtcctctccggtcggcgagagcaagaagagatcccgcgccgtcctcttctccacctccacctccacctccacccatggcggcctccaccttcagcggcgacgagacggcgcccttcttcggcttcctcggcgccgccgccgcgctcgtcttctcctgcatgggcgccgcctacgggacggccaagagcggcgtcggcgtcgcctccatgggcgtcatgcgccccgagctcgtcatgaagtccatcgtccccgtcgtcatggcgggagtactcggcatctacggcctcatcatcgccgtcatcatctccaccgggatcaaccccaaggccaagccctacttcctcttcgacggctacgcgcacctctcctccggactcgcctgcggcctcgctggcctcgctgccggcatggccatcggcatcgtcggagacgccggagttagggcgaatgcacagcagccaaagttgtttgtgggcatgattctgatccttatcttcgcagaagctcttgctctgtacggtctcatcgtcggtatcattctctcatcccgtgcaggccaatctcgcgccgattagaaggcttgatatacgccacactgagtcatctgccattgtattcaaagtgttcttttctcggtgaacaatgtgagggatcatgttgagcctgttccacctttgtaacattatattgctattatgtgaagacaaacctagctagctgttgcagttatgctgttgtacttgtatttgtttgaaaataataggcagcgagccccggatgtgatgaataataagcaagctggactagttgttaatgttttttctttaatgtggattggttttgttaaaaaaaaaaaaaaaaaaaaaaaaaaaaaagtactctgcgttgttaccactgct

SEQ ID NO: 12672 - DNA, 1228 bp, Zea mays
aagtagggagagaacggatatctgccattacgaagccaaccctggaaaaccagggccattaatactactcccacccgtcgtctatctcctcctcaaccaccgccccgagatctccccttctctctcctcgcgccgttttcctctctacctctttgatccggcaatggccgcgcccgcccctgccaccaccggcgacctcctacgcgtcgaccccctcgagctacgcttccccttcgagttgaagaagcagatctcgtgctccatgcagctgtcgaatcacaccgacgactacatcgccttcaaggtgaaaactacaagtccaaagaagtattcggtgcgacccaacactggggttgtcttgccacggtctacctgtgatgttgttgttacgatgcaagcacagcgggaagccccgcctgacatgcagtgcaaggataagttcctagtccaaagcgtcgttgcccctgctggtataactgtgaaggatgtcactggggatatgtttacgaaggagtctgggtataagatggaagaggtcaaattgcgagtgacctatgttgctcctccacagccaccctctccagttccagaggaatctgaagaaggttctccacctagggcttctgaatcagaaaacggagatggaccttctggaggattcaccagagcactaagagagcgcattgagcctcaagacaaatctacagaggctggagctttggtttccaagttgactgaagagaagaattccgcgattcaacagaatcatagacttagacaggaacttgacttggtgaggcaggagatcagcaagaggcgtggagggggcttctccttcatcgtcgtcataattgttgctctgatcggcgccatcctcggctacctgatgaagtcgtaattctttcaggctgtcctctgctggccataccagaggcagtcgtgcaagttgtgtttgggaagaactcgaaaaaaaaactgttgaaaccagatgtcctgagatcatccttcatattttgtcgatataggagtgggtacgtgaggaatgctgggccagtgtttaagcttttcttttccttgttgtttctccgttggatgggcattgcggacgctgtaacttgaaagttgcatcaattgcttctgtttcatagttttatcttgctgagcaaatttgttttttagcaagtaaaaaaaagaaaaaaaaaaaaaaaaaaacaaggtgattcccaag

SEQ ID NO: 12673 - DNA, 2769 bp, Zea mays
  misc_feature (1666)..(1666): n is a, c, g, or t
tgttatcttgttcttgatttacagcatttgagaacaaatgatcaacagtcccaattttttagaaaacatcatgttttattatattaagtttgatcaattataaataaaaaataattaatatcttaaccaatcttactaaggattgtatgtcctagtttataacacatatattttagaaagagtgcagaagagttttgcccacacgaaactctctccgctcttataaaacttttatcatctattttttttatcaatataacgttatgtcatcatatgtaatacccatgaaactttcgtaaaacactaactgagattgatattgtaatagcaaataaatattattagattaattatgaaatatagtttcattgtaaattaatctaacatgttaaatgtgaatagtatttaattgaattttggttgaacacgaaccactttaactagcacgtgacctataattacatccttcttggacagaagtatggtcagaaatcacgaataatatggcgaatggagacctagcaatgcttcgtcagaatgcttagagtatccttctataacgcccgaagaccggattgagcaatgaaccgaggcaggaggcacccactatacagtcgcaagcaaaaaagcatctaaaatgcagggttttaggtacctttctatcatgttccgaaccttcccactgcacgcaaagacggcaggcaggaaagagagcgcaaagcaaccgcggttccagggtcaccctcccgctttgttcccccaaagccaggaccgacccagcctgatgcgcccgctccgtcgccggccggtgctggatgcctcatgcctggcacggtggtgcgccgcgcacaaccgcaaccaaggccaccatgagcgtccagccgtccaccaatcactgccgtcaatagcggcgtacaccacgagcaacagattgtagcgtgtacgggcggtccagcgctataaatccacaaaaatgggcagtgtcacttcctgctctgcttcagtacgtagtgggctgagccagaaatgggcacgtcgttggctagaagcgttgctctgtttactctgctgctctgcctgcttcttccgtcccatggccatgggaagctctcgaccaagttctacgccaagtcgtgccccagcgtggccgccatcgtgcggtcggtgatggagcaggcggtcgccaaggagcccaggatgggcgcctccatcatccgcctcttcttccacgactgtttcgtcaatgtcggtcacatttaatatcctatattgccatccggttagcctaggctgccactcatcagacgtcagtgtgcagtgcgcggaaccactgacatgcatgtgcgcgcgcagggttgtgacgcgtccatcctcctggatgacacttcgacgttcaccggcgagaagaacgccggagcgaacaccaactccgtccgcgggtacgaggtgatcgacgccatcaagacgcaggtcgaagcagcctgcaagggcaccgtgtcgtgcgccgacatcgtcgccttggcgtctcgtgacgccgtggacttggtcagttagttcgtctgttgctgctaacacaacaacaacacgaccgtaataatccagtgtccagaaccgacgctgatccgcacgcaatgcaatgcaatgcagctcggaggccccacatggnaacgtgcagctcggccggaaggactcgcgcgcggcgagccagagcgcggccaacgccaacctcccgggcccgggctccggcgccgcgtccctcgtggccgcgttcgcggccaaggggctctcggcgcgcgacatgacggcgctctccggcgcgcacaccgtggggcgcgcgcgctgcctcttcttccgcgggcgcatctacaccgaccagaacgtcaacgcctccttcgcggcggcgcggcagcagacgtgcccgcagagcggcggcgacggcaacctcgcgccgttcgacgaccagacgcctgacgccttcgacaacgcctactacacgaacctgatggcgcagcgcggcctgctgcactcggaccaggagctcttcaacggcgggccgcaggatgcgctggtcaggaagtacagcggcaacgcccgcatgttcgccaccgactttgccaaggcgatggtgaagatgggcggtcttgcgccggcggccggaacgccgacggaggtcagattcaactgccggaaggtgaactgagaatggcttgcattcagagacgggatgacagggggagttgtctgaattctgaaacaaagcactaaaccgtatctttccctttcgttccaagatcaagtctttggttcctgggcatgatacaagtgaaaataattaagacaatcttaaaatgcttgatgttcacgccatatacacagaggcgtttttcctgttctatatttttttccattgaaaccatcctttagaacaatacatgtatcgactgtgaataatagagctcttttccgaagtctcgtttgaacaagcttcacgaaaaaggtactcattctattattgcagttgaaagaaacaaataaattaaactgagcgattaaagattaatctatggccgtgtttgtttcaccccaaccagatgttatcgagtgacatttcttagatttggctgtggatgtgcccggaaggggcctgggtaaaagctgggtttggtgacaagggaactgtaaatgatctatggaaaaaatccttgctattcgggctagattggaaaccagatttttccacgagattttaatttttccaagagaaattag

SEQ ID NO: 12674 - DNA, 1370 bp, Zea mays
gtcgcagggccgccctttttttttttttttttttttttttttttttttttttttgttggggcgaattagtgacccacaatttccatcgtatctctattggagcagtaggggatacttgttcacttgccagaactcctgatgcaagatagaagcagtatatgtacatcaaatcaaataattcacaacaagtacattagcatttttatttgacatttgagttcaaatggacatagtatcatctgtttgcgccatgacagaggtttgaacttgccaacttggacatgcatatcttttggtcagaataaaactgcagacctttgtttgatggtattgctttcatctaatcacactcttggccactgtgggctgactacctctaatgtgctgaaaactaactgcatgcgactagcaactactgatggtttctctgaacttcctgtgacagccatctgttccagctgcaaggttttcactggcaaccatgccattcctttgacatagtaagcgttcgcgattagagcacagaatcctttccactgatgcaagacgtcggctgacaccggtgggttcggagaccacctgataactgttagttgtggtgtgcacagtattgtgacgaacactatactgagccacaggatgcactcacggatctcaaaggagtggactttgaacttgaggctggtgccccccaaggaccctaagccttcaatctccagaccagaatcttcaatatccataagttcctttctaagcccctcatctgtacaccctagtgcgtaagcggtcactccagcactgacaaactcatttaggttttctccacctcctcggtcaatgacattcttgtaccgcttgaacaaactgatcgctatgttacgcgacgagcggaagtcgtcgtcatcgggcgaagcattaacatggaaccgatgcaggcagtgccttgtagttctctcgtttaagcttttacacagatgatggctggtcctagtgaagctaactttgtagctgtgaacaatgtgtggcttctgtacacgatggccttccgctgaactgcagaccgcactgcatcccaatttaccgtggagagcagaggcactcttctcggagagttttgggtcccggcaagaactcgtcggcctcacgaaaggaagagtttcgtgtagcatcagcagcatggctgagcgttcatcagacgtcaagctacctgcacattcgcctgaaaacaggagagggctctagaaggcagttcgacctcccggggggggcaggcgggcagcggccggaagatggcgcctggcggtgtctccaagaaggtgggagtgggccggcccggggcgacgccgcccgccggccctcgagggtcccaa

SEQ ID NO: 12675 - DNA, 1249 bp, Zea mays
gtacccacgcgattacgcgattagccgagtcctttattgcaaaaacacgcatcacctcctcggctccgtcgccatctcgctcccgtgacccacccaccccgtcgcgtctcggcctggcttcctcctcctcgaggaccgccgtgcaggagcggagctccccgccgcttctctctccgccgtccgagaggctcgacccctgataccacgctgagggcggtggtattaggagattagcgatggcgaggtggcggccggcggcgctgctggtagtggctctggcggcggttctatcggcggcgtggcgggcggatgcgctatcggttacggtgaccgacaccgagtgcatccacgagttcgtgccctatgagggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagtttaaagctccaagaggtggcatgtataagttctgcttccataacccatatggagcacctgaaactgtttctttctacatccatgttgggcacatacccaatgagcacaatctggcgaaagatgagcacttggaccctatcaacgttaaaatcgcggagctgaaggaagcattagaatccatcaccgccgagcagaagtacctaaaagcacgcgaagctcgtcaccgacacactaatgagagcaccagaaagcgtgtcatgttctatacgatggcggagtacctggctttcatggctgctagcgcgttgcaggtcctctacatccgccgcttgttcagtaaaaatgtgggatacaacagagtgtaggatagaaatctacttcaaaggcgacggtggaagcaccttatatggtcggaacgggaaacattctctgccagtttgacaaattgtagttctgcaccctctttttttttgttagtttataagaaacactttaatttatcatcatgtacttttagcaacacttgtggtatgttaagtgcatttggtgctgaacattgttccataactgatcttcagaggattgttatgaaagttaaaaataaaaaaaaaaaagcggccacatatataaaaaattaaaaactcgttaaaacatttttcagatgttttataattaaataaaagtaattcttttgatattatctcggacattatataattatttttacgtggggggg

SEQ ID NO: 12676 - DNA, 1151 bp, Zea mays
  misc_feature (11)..(11): n is a, c, g, or t
  misc_feature (1148)..(1151): n is a, c, g, or t
gggtacctcgnagccggccgggatgcccccgtttcgcaccccacccccgccgttacgcgattcgcagggtccttcatcattgcaaaaacacgcataacttacattgtcatcttcgctcccgtgacctacatcgtcgtgtctcggcttggcttggcttcctcctccccgacgaccaccccgcgcttctcctctccccccgtcccaccttccgagaggctcgagccctgatcccacgctgagggcggcggtgttaggagtttagcgatggcgaggtggcggccggcggcgctgctggtagtggcgctgacagcggttctgtcggcggcgcggcgggcggatgcgctctcagtgacggtgaccgacaccgagtgtatccacgagttcgttccgtacgagggtgacaccgtgtccgggaacttcgtcgttgtcgaccacgacatcttctggagctccgatcacccaggcatcgacctcacggtaacgtcaccaggtggtaacactgtgcacacattgaagggaaaatctggtgacaaatttgagtttaaagctccgaagggtggcatgtacaagttctgcttccataacccatatggagcacctgaaactgtttctttctacattcatgttgggcacatacccaatgagcacaatctggcgaaagatgagcacttggaccctatcaacgttaaaatcgcggagctgaaggaagtattagaatccgtcaccgccgagcagaagtacctaaaagcacgcgaagctcgtcatagacacactaatgagagcaccagaaagcgtgtcatgttctacacaatggcggagtacatagctttcgtggctgctagcacgttgcaagtcctctacatccgccgcatgttcagtaagaatgtgggatacaacagagtgtaggatacagctctacttcaaaggcgacagtggaagaagcaccacatggtcggaacgggaaacattctctgccaatttgacaaattgtagctctgcaccctctttctttttgttagtttacaagaaacacttttacatttatcatgtacttttagcaacacttgcgatatgttacgtgcatttgatgctgaacatagttccagaattaattttcagagaatttgtagtaaaaaaaagcggccggnnnn

SEQ ID NO: 12677 - DNA, 893 bp, Zea mays
  misc_feature (701)..(701): n is a, c, g, or t
acgcgattacgcgagtcctttattgcaaaaacacgcatcacctccgtcgccatctcgctcccgtgacccacccaccccgtcgcgtctcggcctggcttcctcctcctcgaggaccgccgtgcaggagcggagctcctcgccgcttctctctccgccgtccgagaggctcgacccctgataccacgctgagggcggtggtattaggagattagcgatggcgaggtggcggccggcggcgctgctggtagtggctctggcggcggttctatcggcggcgtggcgggcggatgcgctatcggttacggtgaccgacaccgagtgcatccacgagttcgtgccctatgaggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagtttaaagctccaagaggtggcatgtataagctctgcttccataacccatatggagcacctgaaactgtttctttctacatccatgttgggcacatacccaatgagcacaatctggcgaaagatggttagtttactgcctttgtatcttaagcttctcagcccctgcctactctgtcattcttaaccgtttcgcaaatactaaacaaccatanatttcgatggatttttttttaacttcattattgttcagagttatgtgtcatttgtctagtgttaacatcttagcactgccatgcgtaagcaatgtctcatttctgttgcagagcacttggaccctatcaatgttaaaatcgcggagctgaaagaagcattagaatccgtcaccgccgagcagaagtacctcg

SEQ ID NO: 12678 - DNA, 1008 bp, Zea mays
acgcgatcacgcgattagccgagtcctttattgcaaaaacacgcatcacctccgtcgccatcccgatccctgataccacgctgagggcggtggtattaggagattagcgatggcgaggtggcggccggcggcgctgctggtagtggctctggcggcggttctatcggcggcgtggcgggcggatgcgctatcggttacggtgaccgacaccgagtgcatccacgagttcgtgccctatgagggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagtttaaagctccaagaggtggcatgtataagttctgcttccataacccatatggagcacctgaaactgtttctttctacatccatgttgggcacatacccaatgagcacaatctggcgaaagatgagcacttggaccctatcaacgttaaaatcgcggagctgaaggaagcattagaatccgttaccgccgagcagaagtacctaaaagcacgcgaagctcgtcaccgacacaccaatgagagcaccagaaagcgtgtcatgttctatacgatggcggagtacctggctttcatggctgctagcgcgttgcaggtcctctacatccgccgcttgttcagtaaaaatgtgggatacaacagagtgtaggatagaaatctacttcaaaggcgacggtggaagcaccttatatggtcggaacgggaaacattctctgccagtttgacaaattgtagttctgcaccctctttttttttgttagtttataagaaacactttaatttatcatcatgtacttttagcaacacttgtgatatgttaagtgcatttggtgctgaacattgttccataactaatcttcagaggtttgttatgaaagttagtatcgctctgccaatattcggacc

SEQ ID NO: 12679 - DNA, 1250 bp, Zea mays
ggccgctttttttttttttttttttttttttttttttttttttcaaatcaaataattcacaacaggtacattagcatttttatttgacttttgagttcaaatggacatagtatcttctggttgcgccatgacagaggtttgaacttgccaacttggacatgcatattttttggtcaaaataaaactgcaaacctttgtttgatggtattgctttcatctaatcacacccttggccactgggggctgactacctctaatgtgctgaaaactaactgcatgcgactagcaactactgatggtttctctgaacttcctgtgacagccatctgttccagctgcaaggttttcactggcaaccatgccattcctttgacatagtaagcgttcgcgattagagcacagaatcctttcccactgatgcaagacgtcggctgacaccggtgggttcggagaccacctgataactgttagttgtggtgtgcacagtattgtgacgaacactatactgagccacaggatgcactcacggatctcaaaggagtggactttgaacttgaggctggtgccccccaaggaccctaagccttcaatctccagaccagaatcttcaatatccataagttcctttctaagcccctcatctgtacaccctagtgcgtaagcggtcactccagcactgacaaactcatttaggttttctccacctcctcggtcaatgacattcttgtaccgcttgaatagactgatcgctatgttacgcgatgagcggaagtcgtcgtcatcgggcgaagcattaacatggaaccgatgcaggcagtgccttgtagttctctcgtttaagcttttacacagatgatggctggtcctagtgaagctaactttgtagctgtgaacgatgtgtggcttctgtacacgatggccttccgctgaactgcagaccgcactgcatcccaatttaccgtggagagcagaggcactcttctcggagagttttgggtcccggcaagaactcggcctcacgaaaggaagagtttcgtgtagcatcagcagcatggctgagcgttcatcagacgtcaagctacctgcacattcgcctgaaaacaggagaggtatccagaagacagttcaacctcccggggtgggggagcaggcgggcagcggccggaagatagcgcctggcggtgtctccaagaaggtgggagtgggacggccgccccccgccgtcggggcccatgtcgcccttaggagtg

SEQ ID NO: 12680 - DNA, 1194 bp, Zea mays
ggcacggaaggagcatgacccccgtttcgcaccgcacccccgcgattacgcgattcgcagggtccttcatcattgcaaaaacacgcataacttacattgtcatcttcgctcccgtgacctacatcgtcgtgtctcggcttggcttggcttcctcctccccgacgaccaccccgcgcttctcctctccccccgtcccaccttccgagaggctcgagccctgatcccacgctgagggcggcggtgttaggagtttagcgatggcgaggtggcggccggcggcgctgctggtagtggcgctgacagcggttctgtcggcggcgcggcgggcggatgcgctctcagtgacggtgaccgacaccgagtgtatccacgagttcgttccgtacgagggtgacaccgtgtccgggaacttcgtcgttgtcgaccacgacatcttctggagctccgaccacccaggcatcgacctcacggtaacgtcaccaggtggcaacactgtgtacacattgaagggaaaatctggtgacaaatttgagtttaaagctccgaagaggtggcatgtataagttctgcttccataacccatatggagcacctgaaactgtttctttctacatccatgttgggcacatacccaatgagcacaatctgcggccagtgaggagcacttggaccctatcaacgttaaaatcgcggagctgaaggaagcattagaatccgttaccgccgagcagaagtacctaaaagcacgcgaagctcgtcaccgacacaccaatgagagcaccagaaagcgtgtcatgttctatacgatggcggagtacctggctttcatggctgctagcgcgttgcaggtcctctacatccgccgcttgttcagtaaaaatgtgggatacaacagagtgtaggatagaaatctacttcaaaggcgacggtggaagcaccttatatggtcggaacgggaaacattctctgccagtttgacaaattgtagttctgcaccctctttttttttgttagtttataagaaacactttaatttatcatcatgtacttttagcaacacttgtggtatgttaagtgcatttggtgctgaacattgttccataactgatcttcagaggattgttatgaaagttagtattgttctgctaccgacaagaaaaaaaaaaaaaaaactcgagactagttctctcgtgc

SEQ ID NO: 12681 - DNA, 1072 bp, Zea mays
ccggccgggaaaaaaaaaaaaaaaaaaaaaaaaagggagccgaaggaaaagctcggccggtcgggcgggcgggcctcgcgcgagccagtggaattcgacgacgaaactccgtcacgtcattcctctgcgcctcccgtctggccgtcttccagacgtctccaatcggagctcccagcgtctcggagaagaggagcagcacggcacggcagctgtggcgaggaaggctcttgtcctgtcccatcccaacccagcagccgtccaaggaggaggagatccaatcggcgtgcaggcgtccaccgtccatccatcgatccaattccaatctgcaggcctctgcgtcgcggcttgttcgtggaggagaggttgctgtggaacccgccgccagttagccatgtcgtcctccgtgctgagggctgcggccgacagggctattcgcaggcaggccctcacgctgacggacgccgcggcgtccaggatccggcagctcctcagcctcaggcagcggccattcctgcggctcggcgtcaaagcgcgtggttgcaacggcctctcgtacacgctcaactatgccgacgaaaaggggaagtttgatgagcttgtcgaggagaagggagtgaaagtgctgatcgaccccaaggctctgatgcatgtcataggcaccaagatggactacgttgacgacccgttaaagtccgagttcgtgttcgtaaacccgaactccaagggggagtgtggctgcggcgaatctttcatgaccacgggcagcaaagggtcgccatcgtgaggcggcgtcgtcgtctgtctgttggtgtaaagcaaacgcgtccgccgcaggatccagagctatacaggttctttaaggtttatcctgtaggcatctgtggctccgccggagtccttatagttgtataaacacagggcagctgactcgcatgtacttgtaaattcacttgaaatgttgacatggtcaggttttccccccatgtttatgcgtatctggtaatctcacggttcaagggctcgaatttgtgggcaaaaaaaaaaaaaaaaaaggcccctaaaaaaaaaaaaa

SEQ ID NO: 12682 - DNA, 923 bp, Zea mays
tcgaggccggccgggaacggcctacctcgagtgcggcccgcgtcgtcacgccatccctctccgcctctcgtcttccagacgcctccaatccgggctcccagcgtctcggaaaagaggagcagcacggcacggcggcgatggcgaggaacgctccaataatatgctaacccgttctacccagtccaattagcagcctcccaaggagaaggagatccaatcctgcgggcgggcgtccccgtatcccatccatcgatccgaatctcggaatctgcaggaccctgcggcgcggcttcttcgtggagaagaggttgctgccgaagccaccgccaggtagccatgtcgtcctccgtgctgagggctgcggccgacagggccattcgcaggcaggccctcacgctgacgaacgccgcggcgtcccggatccggcagctcctcagcctaaggcaacggccatacctgcggctgggtgtcaaagcgcgaggttgcaacggcctctcctacaccctcaactatgccgatgaaaaggggaagttcgatgagcttgtcgaggagaaaggagttaaagtactgatcgaccccaaggctttgatgcatgttataggcaccaagatggactatgttgatgatccattaaagtccgagtttgtgttcataaacccaaattccaaagggcagtgtggctgcggtgagtctttcatgactacaggcagcaaagggtcgacgtcatgaggcgtttttcagtgtaaatgcttagccaagtgtctgcaggctccagctacagattttcttgtgtctggtgcgtcgcagttcattcatatataataacacaggcagtggggtttgtactggatatgcaactaactcgcatttacttgtaaggtcagtccacctcatatgttgttactacatggtctgactctgct

SEQ ID NO: 12683 - DNA, 1030 bp, Zea mays
gttcgcccccggcgtccgcaaaaaaatcaaaaacaaaagaagcaaacctcgtcgtcacgccatccctctccacctctcgtcttccagacgcctccaatctgggctcccagcggccagcgtctcggaaaagaggagcagcacggcacggcggcgatggcgaggaacgctccaataatatgctaacccgttctacccagtccaattagcagcctcccaaggagaaggagatccaatcctgcgggcgggcgtcccccgtatcccatccatcgatccgaatctcggaatctgcaggaccctgcggcgcggcttcttcgtggagaagaggttgctgccgaagccaccgccaggtagccatgtcgtcctccgtgctgagggctgcggccgacagggccattcgcaggcaggccctcacgctgacgaacgccgcggcgtccaggatccggcagctactcagcctaaggcaacggccatacctgcggctgggtgtcaaagcgcgaggttgcaacggcctctcctacaccctcaactatgccgatgaaaaggggaagttcgatgagcttgtcgaggagaaaggagttaaagtactgatcgaccccaaggctttgatgcatgttataggcaccaagatggactatgttgatgatccattaaagtccgagtttgtgttcataaacccaaattccaaagggcagtgtggctgcggtgagtctttcatgactacaggcagcaaagggtcgacgtcatgaggcgtttttcagtgtaaatgcttagccaagtgtctgcaggctccagggtacagattttcttgtgtctgttgcgtcgcagttcattcatatataataacacagcagtgggtttgtactggatatgcaactaactcgcatttacttgtaatgtaagttcacctcaaatgttgttattacatggtctgactctgattatccatggtgtgtatatttgatcgctcgcggcctaagacctcgaaatttgcacgctgcagttcgctaaaaaaaaaaaaaaaaaagcggcc

SEQ ID NO: 12684 - DNA, 5482 bp, Zea mays
  misc_feature (187)..(187): n is a, c, g, or t
  misc_feature (585)..(585): n is a, c, g, or t
ccccagactgttcatgtgcccaagtctttataccatgtctttatatggaagaacgactgtgattttcttagttgtgtcctttggatgcaggttgtgatgcctacagtgggatctgatgtagcatttggtctcggtaagctcaaacttccgttagatgaggtcaggttaagggtatcaaaatctttgnatgccgttgggatgttgagctactctcaggtaggcttctaaattccagcttttggatcataatctaaagtcttcacaatgttaataacccttcattcaaacagaggccaatccaaactctgagtggtgggcagaaacagagagttgcaattgctggtgcgttagctgaagcatccaaagtattactgctggacgaactgaccacattcttagatgaacatgaccaggtttgaatctcctccatattctgatttttttgatttcatgaatttctttcccatttgttggagcttatcatcgtgccttatgttagttttgtctaacttgcatcgtaacattttatggcgaataaaaacttctgtgttcttaagtgattttactggttgtgatatacgctanttacagttctgcactctaatctccatttgctgccacgcctccagataggcgtgataaatgcagtgagggactctgtggctgccgatggggaggtcgccgcattatgggtgactcatcggttggaagagctgaaatatgcagatggtgccatctatatggaagatggccagataatcattcaaggcgacgtctctaccatatcaaaatttataaagaaaaaacaggcacgctactttggtcattttgaactctaaatccccaaagttttttggcaaagcttatcttgtgtatatggattaattccaaagcaacttattttgttgttgtcaactgtagttttgctggaacttctattttagtcatttttcaaagcaaattatgtgcgacatgcttgtctgcttgcattgcaatgttgagtgtttgcctgtgattcgattcacttgcaggcatatatgaatacggcctggcctgggaaaagcttggtccctgctgcctatactagattgatactctctgttccaaattaaaatttgttttaggtaattaatggattcattcaagtatcgatgcatgtgttttacatatttatctagattcatcatcatctatttgaatatttgaatatagacataaaaatcaaaacctaaaacgaatactattcttggacggaggagggagtagatcattttacttggttcaggcctggtctggaagaagcttggcatctctttgggttaagttgggtttgtgctcagttatcaagttagttttaggatgtgtttgatttttagggactaatttttaatctacttattttattgtagtctctaaattactaaatacagaatctaaaatagtaatttagggactaaaatagtataaataaagggactaaaaaatagtccctagattccaaacacccatttactttgcaatggtatgcactgctgcatctttagtcaactgttggaattgggaacgaacaaggttgaagctcgataatctgttatgtttaagcataggagactaaccgattagttaatttgttcgagttgcttagtaatgcaaccgaggagtttactactccatagtaattctcaccttctgcaacatatatgatggttctttcactattattcatcgtatataagtagaattgaaaatagtgaaacaaaacaatagcagagacaagcagattttgattcgttcacgctcaccaataatcacaaaacaggacattaaatagacaagatgtcaagtagatcaaggtgtcaatggtgtgggtgttaagtgtaccgaggcgatatttggagtgacaattatgcaaagccacttgtttagagctagtttggaaacaccgttttcacaagtggttccaattttccaagaaaaaataaattaatttctcttttaaaaataaaaatactttaaaaaattgggtttctaaactagccttaggtgtcgaaactacagattttctcttggctgtcagtagcttcgtcaccgctgtccactcgacctgcagcaagagttccctttcctcaacaagtcaccctcgcgtacagcgtactgagttggagcttgcgcaacaactcatcgacatcatggtccgtccccattctctctccgcttcgatgattcagccgtcattgttacgcccccaagctttcctctccaaatatccaggccgttccccgtttgcgtcagacagcgggaacggcaagcaaggaaaatgaatcccgcgctagggagcattcgagagtttgccatgccgcatgaccatggcggtgcactagattacctgcgggaaaaggaggttcactttgccctcgagcagtcgcttgagcccgaagtttgcgtcgatgacgccccgaataaagcgtaaaaccaatcatttgtttccacggatccccatctccaaatgagacgccatgttttgtcttgtcccctcgcgtcgcctgcacacgcggagcacggagcagttccccaactggcaggtcctccgtccgtcctcgtgcagtcggtggtgctgctgttccttccacgtcgtttcgtttcgtttcgtttcgggcggcggcgctgccagattcctcgtgcctagtagtccggagtgctgacactcgggcagagtagaatactcctgcttggttcgcatctcatctcgtctgatctgttctgcttgctcgcacttctcaactcatctcgtccaaccagttggtgctctgacagcaagccaggtttatttaatcgggcactttgttcctaagatccctccctctgcccactagtgttctgcaaagtcaaagcacctgaggtccgcccgacccgtcgtcggcgttgaggaacggggaacggacggctctggcacgcacgggcaacaggctcgctcagcgcgaggcgcgcgcgcactgcttccctgccctggcccctgggtgacgagagagtgaccgatccctatcaggtttccctggcttccacgccacccacagcgatgcgaacgcgatgtttgtgctctagtgctcaggtcagctgccagccaacgaatcctatcccatctggtattccggtggctggcggtggttgccgtcggaattttccagcggagagcgacggccagcctcagggcttcagccacttgccgggagcaagatctttcccaaaattccagtggaatccgcacagcggagcgctgcctgagtccgtccccgttgcttgggtgcctgtgccggacgcccgcagtcccaccgtcccaactctcaaccccagcgcagcagcctgcaccacaccagaaaccacaccaccacgctcaccgccgtgagcccgtgacccccacgtccccccacaccacggcacgtcggcaccagcttaactcccggtccgcggcgacacctcaccatcgcgcgcgcacacacacgagcgtgcgccgctccctgttcctcgtgacccccctccccgcctcccctctctctctctcacacacacacacaagtcggtgctgcagcagcagcagtcgcagtccagccgtgagctcttgccgtgcgagcgattcaccgcagggcgcacgggaatccaatcaaatcccccaggaaggtagccccgcggccgcccgttcctcgctccgccccgcgccgacgcttctccccgatcccgatctgtgcgcccgcaccctgcgtgggatggaggcggcgccgcggcggcagcagcagcagcaggaggaggaggaggaggggtgcccgtgcggcgggcccgaggccgcggaccacttcgagcggctccacgacgcggtgctgctcgacgtcctcaaccgcatcggcgacgtcaaggcgctcggccgctgcgccctcgtctcgcgccgcttccacgcgctcgtgccgctcgtcgactccgtcttcgtccgcgtcgactgcgtcatccccgacgacccaccctcttcctcctccgcgggcgccgcaccgggctccccgccgcaccaggcgccggcgccaaccgcgcgcgggcgcggcgcgctcgcgcgcgtcgcgcgcgccctgctcggcggcgtcgctaggcccatccacgcgctcggccagatcctctcctccgccgcggcgaccgtctcccggcgctccgagccactgcccgcttccccgccgcccgcgcccgtcgcggacgtctcccaccactcgccctccgaggtgctccgctccttcagggagctgcggcgccttcacatcgagctgcccacgggcgagctcggcattgacgacggcgtgctccttaagtggaaggccgacttcggctccaccctcggcagctgcgtcatcctcggcgcctcgtcggtctcgtccaagccgccggcagggtccgctcaggcggaaactgctgcggccgacagcacgcccgccgctcccgataccggtagggagactgaagagccgggaagcctgcctgattctctctacacaaatggagggctcaagctccgcgttgtctggaccatcagctccctgattgccgcgtcggcgaggcattacttgctgcacccgattatctgtaatcacggaacgcttgagagcttggacctgacagatgccgacgggcaaggggtgctcaccatggacaagaggcagctgcaggaactgcgggtgcggcccgtctctccatcagggagctcgcaccgcacactcatgccggcactcagtatgcgtctgcactacgcaccactcattgaactgcctgggggaacgctgctgaaaggtgcaacactagtggcgatcagaccaagcgaggatgccttgagggagggccaaggggttgcaggtcctgctggtacatgctggatttcagaggcctttgaggagccatatcggactgcggcaaaggtgctcctcaagagaagggcatattgccttgaaatgaactcgttctgagcaccagggattcacttccacagagttctacccatctgacaggatgggggaagtgagatgcccttcggttaatatatgggaattcatcattcagtgcaaaaattggaccaactctccccatcattaatttatctgatctcggtgaagagatgacttcgtgtacctgtacctttagggttgtaattacagatacgtatttgtgctggactactacacgcggaacggaatgctatttgggccgattcccacagagtgtcccatgaagagaagccatatcacttgagcgtttgagcgtggtgctcctgggccaagctggcattatacttctttcctcaaaggaagcaccagagatttcgtttttagcagggcctttttgcttaaatcttgccgagtcatgcatcaatttatactcattgttataaaaaaaattatagactcgaatatactgtcccttttaagaaaataaaaaaaaaactcgaaaccgggcc

SEQ ID NO: 12685 - DNA, 3523 bp, Zea mays
aattcggcacgaggcagtacagccgtgagctttgtgccgtccccgtccccgtgcagaacaaccaagcgagcgatccaccgcaagggaatccaatcaaatcccccagcaagtcagccccgccccgccccgcgccgacgcctctccccgatcccgatctgtgtgcctggctgcctgcaacctccgtgggatggaggcggcgcggcacacaggaggagtgcccgtgcggcggggccgaggccgctgaccagttcgagcggctgcacgaacgcggtgctgctcgacgtcctcaatcgcatcggcgacgtcaaggcgctcggccgctgcgccctcgtctcgcgccgcttccacgcgctcgtgccgctcgtcgactccgtcttcgtccgcgtcgactgcgtcatccctgacgacccgccgccctcgtcctcctcctcctcctcctcctcttccgccgcaccaggcaccccgccgcggcaggcgccagccccaaccgcgcgcgggcgcggcgcgctcgcgcacatcgcgcgcgtcctgctcggcggcatcgccaggcccatccacgcgctcggccagatcctctcccccgccgccgcggccgtctcccggcgctccgaggcactgcccgcttccccgcgcgcgcccgtcgcggacgtctctcaccactccccctccgaggtgctccgctccttcaaggagctgcggcgccttcacatcgagctgcccacgggcgagctcggcattgacgacggtgtgctccttaagtggaaggccgacttcggctccaccctcgtcagctgcgtcatcctcggcgcctcgtcgatctcgtccaagccgccgacagggtacactcaggcggaatcggaaactgctacggccgccactcccgataccagtcgggagactgaagagccggggagcctacctgattctctttatacaaatggagggctcaagcttcgcgttgtctggaccatcagctccctgattgccgcgtcggcgaggcattacttgctgcagccgattatctggaatcacgaattgctggagagcttggacctgacagatgctgacgggcaaggggtgctcaccatggacaagaggcagctgcaggaactgcgggtgcggcccgtctttccgtcagggagctcgcaccgcaccctcatgccggctctcagtatgcgtctgcactacgcaccgctcattgagctgcctgggggaacgctgctgaagggtgcgacactagtggcgatcagaccaagcgaggatgccttgagggagggccaaggggctggggctgcaggtcctgctggtacatgctggatttcagaggcctttgaggagccatatcggactgcggcaaaggtgctcctcaagagaagggcatattgccttgaaatgaactcgttctgagcaccagggggttcacttccacagagttctacccatctgacaggtgaaattcctacagctctaaatatgattatgggttgaactaatgctgaaatactgaaaggccgttgatttgcaatactacagtatctaagaggaacaaatgtgtttttgtaaagtggaaacataagtgacagccaaaagtataactgacaaacaacaaatatctgacattcctggaatggtgtagttctgaatttatttagctataaagtattggtatttcattttagtggtttccattggttctttgacagcactgccagcggctgttccaatattgcatgaactgcacaaaattgtaagcacagcgcttggacctcttgctcttgtagttttgtggatctcagttgtcaaaccaatttggattcatgagtgcggtaatgaacgtaacatagaaccaaacatgatagatgatcaggtttccttgtattgtgttggtggccagctagacactatatatttctcggcctcagactgaggttgtcatatttccttcccagcttgactatccagtcagcactcagcagtcacaatgcaagtttgctgtagttttgagagtaagtgtgttatgtgatataattaatgatagaaaattaattggatttggatagctatgtgtgggacagatgcaaatttggaaatccggtttcactgctttcctgttggcctcttggattgtaatattcggcttgtactagcaagttactgtcaaattgttgatgccttgacatatactggcatgtgtcatgattaacgcaccaagtactatctgggatgcattttatttcctttcttattcaaactagcatgtgattcggcatgtctagttcctggaggattaggcaggtcgttactggcaatgaagatggatttgtttttgtgtattcagattttacaggacataatttgaaggactattacatatgctgttggcactataatgtagtagtttcatttgtatgtgtcaaaacccatccattctgactggatcgagtttaaagtatgtcatactccctctgtcccaaatcgatattcgttttagaaattaatggattagtaaaatacttaatatttgtgtttaatatatgtgtctagattcattatcatccatttgaatatagacacaaaaattaagagctaaaacgaatactattttgggacggagggtacttcagatgtggcaatgcttttaccataatcctgttagttgtgagactcgatatcatgatatgttagttgaggattttctctaattgccatccagccatgtttcctcactgcatttggtgtgcgtcagtccaaacgacataaattcttgtaaaactagaagacgtcattttccttctgcatgttatactgaaaaatttttgcggcaaattttttgggattaagattgctgagcgttgcactgaactctctttcatctttgttttcaggatgggggaagtgagatgcccttcggttaatatatgggaattcatcattcagtgcaaaaattggaccaactctccccatcattaatttatctgatctcggtgaagagatgacttcgtgtacctgtacctttagggttgtaattacagatacgtatttgtgctggactactacacgcggaacggaatgctatttggccgattcccacagagtgtcccatgaagagaagccgtatcacttgagcgtttgagcgtgacgctcctgggccaagctggcattatacttcttttctcaaaggaagcaccagagatttcgtttttagcagggcctttttgcttaaatcttaccgagtcatgctcctagcactgcaatactgcgtcaatttatactcattgttataaaaaaattatagactcgaatataatgtcccttttaagaaaaattatagtgcactctcttttttctaatgctttgtgtgcaccagatgaccagactgccatgagctcaccctcacctagggttaaatgtttcggtagggatttgtcaggaagcccaggtcgcagcagcagaagcggcatgtccaagtaaatgtggagcgtgagaaggaagaagtggttcaagacaacgattcgctgatggg

SEQ ID NO: 12686 - DNA, 1179 bp, Zea mays
ctagaacatcctaatcaaaaatttgctggaagcatggccgacacctatgacctatccatgtagagcaccggcccagaaactcctgctgctcttcttagctcgccgaaatgacgcacggcctcgccgtcggcttcggcttcggctccctccgctgcggtccctccgtgtcgtcgtcctctgccaccattcatcacaccctggtcgctccccctcgtcgaagcttacggatatgctcctcgaccttccctcctccacccgcgcccgccatcgagggtcgtgacgtcagcctctcggtgaccacgcggcggggcagggtgttgccggtgcttaagggatgctccctccttgtcccgcccgggcagctctggatgctcctcggccccaacggctgcggcaagtccacgctgctcaaggttttagcaggttttctgaatccaacggccggtacagtgtatataaacagaccatgcagctatgtcttccaaaatcctgatcaccaggttgtgatgcctacagtgggatctgatgtagcatttggtctcggtaagctcaaacttccgttagatgaggtcaggttaagggtatcaaaatctttggatgccgttgggatgttgagctactctcagaggccaatccaaactctgagtggtgggcagaaacagagagttgcaattgctggtgcgttagctgaagcatccaaagtattactgctggacgaactgaccacattcttagatgaacatgaccagataggcgtgataaatgcagtgagggactctgtggctgccgatggggaggtcgccgcattatgggtgactcatcggttggaagagctgaaatatgcagatggtgccatctatatggaagatggccagataatcattcaaggcgacgtctctaccatatcaaaatttataaagaaaaaacaggcacgctactttggtcattttgaactctaaatccccaaagttttttggcaaagcttatcttgtgtatatggattaattccaaagcaacttattttgttgttgtcaactgtagttttgctggaacttctattttagtcatttttcaaagcaaattatgtgcgacatgcttggctgcttgcattgcaatgtttgagtgtttgcctgtgattcgattcacttgcaggcaaaaaaaaaaaaaaaatggcctggg

SEQ ID NO: 12687 - DNA, 758 bp, Zea mays
tgacagcacaaaccacaatttgattttgacccgtcgcctgcctggccgcctcctagtcgtaatcccgccccgccgcctccccctctccggccttctccgctccgcgcgggcgccatgtcggtgacgctgcacacgaacctgggcgacatcaagtgcgaggtgttctgcgaccaggtgccgcgcacggcggagaacttcctggcgctctgcggcagcggctactacgacggcaccgtgttccaccgcaacatcaagggcttcatggtccagggcggcgaccccaccggcaccggcaagggcgggtcgtccatctggggcgccaagttcgcggacgagttgagggagtcgctcaagcacaacgcgcgcgggatcatgtcgatggccaacagcgggcccaacaccaacggcagccagttcttcatcacctacgccaagcagccgcacctcaacggtcactacaccgtgttcgccaaggtcatccacggcttcgaggtgctggacctcatggagaaggcgcagacgggacccggggacaggccgctcgccgagatcaggctcaaccgcgtcaccatccacgccaacccgctcgccgtctgaactcctcttcctaccgctctcccctccactcgctcctgtcctcatccaccgggatctgagcgtcatcagccttgctttcaaccgcaaaatcacgctttggtttcggaacatcaatctgtagctctctaattttataccgatgctgtgacatgtaacctttg

SEQ ID NO: 12688 - DNA, 904 bp, Zea mays
ggcgattgggttcctcgaggccggacagcgcccagtcgcccacccacccgctgcgtcccgctcaccaagtcaccactcaccagccttgctgcgcgcgtcctcccacccgccgcccgtagccatgtcggtgacgctgcacacgaacctgggcgacatcaagtgcgaggtgttctgcgaccaggtgccccgcacggcggagaacttcctggccctctgcgccagcggctactacgacggcaccgtgttccaccgaaacatcaagggcttcatgatccagggcggcgaccccaccggctccggcaagggcggctcctccatctggggcaccaagttcgcggacgagttcagggagtccctcaagcacaacgcacgggggatcatgtcgatggccaacaacgggcccaacaccaacggcagccagttcttcatcacctacgccaagcagccgcacctcaacggccactacaccgtcttcgccaaggtcatccacggcttcgaggtcctcgacctcatggagaaggcgcagaccggccccggggacaggccgctcgccgagatcaggctcaaccgcgtcaccatccacgccaacccgctagccctctgaactactactgccttccacctgctcctgcagtcctgtcccgtggccttattaattactattattactcatggaaatcaggatgaggagagtaatttcgcgaggacacttttgattgattttgaaacatggatctgtagctctctaaacacttgtagttgtagagctctaaaaaaaactttagattctcatttctaaaaaaaaaaaaaaaacgagttctgtttctggggatcctagagcctatagttctgcgaataattcagcagcagacaccaccttttttgtgcaaaaaaaaaaaaaaaa

SEQ ID NO: 12689 - DNA, 838 bp, Zea mays
catcctaccctatcccccccccccccaccggcgccggcggtcggctcccgccctgtcggtgacgctgcacacgaacctgggcgacatcaagtgcgaggtgttctgcgaccaggtgccgcgcacggcggagaacttcctggcgctctgcggcagcggctactacgacggcaccgtgttccaccgcaacatcaagggcttcatggtccagggcggcgaccccaccggcaccggcaagggcgggtcgtccatctggggcgccaagttcgcggacgagttgagggagtcgctcaagcacaacgcgcgcgggatcatgtcgatggccaacagcgggcccaacaccaacggcagccagttcttcatcacctacgccaagcagccgcacctcaacggtcactacaccgtgttcgccaaggtcatccacggcttcgaggtgctggacctcatggagaaggcgcagacgggacccggggacaggccgctcgccgagatcaggctcaaccgcgtcaccatccacgccaacccgctcgccgtctgaactcctcttcctaccgctctcccctccactcgctcctgtcctcatccaccgggatctgagcgtcatcagccttgctttcaaccgcaaaatcacgctttggtttcggaacatcaatctgtagctctctaattttataccgatgctgtgacatgtaacctttgatagatttgttttgcctggcgtttttttttttcttcatcgaccatcaaaatcttcaccggccatgtctgccagggtttgagtttgacactgtaacttgcaaaacaatatagcagccatggggcagctaaaaaaaaaaaaaaa

SEQ ID NO: 12690 - DNA, 3747 bp, Zea mays
cgctacaaggatacacatgcattggcattgttgggatcaaagatcctgttcgtccaggtgtcaggcagtccgtggcaacttgtcggtctgctggcattgcggttcgaatggttacaggagacaacataaatacagctaaggcaattgctcgtgaatgcggtatacttactgaggatggtattgccattgaaggcgctgagttcagagagaaaaatcctgaagaactcctcgagttgattccaaagatgcaggtcctggcccgatcatcaccacttgataagcatgcacttgtgaaatacttgcgtaccacgtttaatgaggtcgttgctgtgactggggatggtacaaatgatgcaccggcactacgtgaggcagatattggacttgccatgggaatttcagggactgaggttgctaaggagagcgctgatgttgttattcttgatgacaatttctccaccattgtaacagttgcgaaatggggacgctctgtttatgtcaacatccaaaagtttgtgcagttccagctgactgttaatgttgtcgcacttctggttaacttctcttcagcgtgctttacaggagatgctccactgaccgctgttcaacttctttgggttaacatgatcatggataccctaggagcgcttgctcttgcaactgaaccacctgatgacaacttaatgaagaaatcaccagtcggaaggacagggaggttcatcacgaacgtgatgtggaggaatattgtggggcagtcaatattccagtttgtggtcatttggtatctacaaacacaaggggaatacttgtttgggcttgaaagctctgaagctaatactgttctaaatacaatcatattcaacactttcgtattctgccaggtaaatcaaccatcactaaatcctcacctttgttaattttctacctagtctattcagagtacctgagataagagaaactcggcagaaatgaggaggccattcgttggtttagcattatagagtacagaacaagaaacagaacagatagagctggaaagagaggataatggtgtggttttttttatttctgaaatggctctccggtgctgaatctttgcatgccatgtaggttttcaatgagataagctcgagagacatggaggagatcaatgttttgaagggtttgccacagaactccattttcatgagcatcctcggtggcaccatcattttccagttcatcctggtccagttcctaggagattttgccaacaccacgcctctcacccatctccaatggctcgtcagcattctctttggcctcctcgggatgcccattgctgctgccatcaaactcattcctgtggaacctcgcgaagatgatggccggataccataatcatgtacattaagagcaatagatcagcttcaccagctgctaactactgtaaccttacctaatccacaagaataggagcagagcaccaatttgtgaagaaacggtttgtttgactgcgacattaatatacccgtattactaaactgtatattgagtcgtccatttatttttatttttttccttacaaatagtaccttgtggcttgtatacaccagcgtccatttgctattatgaaatggcatgtggtggattacaataacgtgggattgttacatagtttgtacctgtgtcagttgtaagtagactgcaaatttgaatgcaacagcagttataactctagcttgattgttgattcaaacagttcatttctggtctctacttgtcagtggaaatgatcttctatccaatcacacatggtcactgcagtgcctttgttgaacaatgacacaacgtgatactaatcagcccctgggctgtaccatgacagcaacgaatatacatgcttaaagagatatacatacctaagcaacaccattttctaaaaaaaactaagtagtactatcagcgcttttgctttctccagacaccggtggaaactgatcttatcggtttgttgcttacaactggtatgtacatcaatcagacatcggtgagaactgatcttatcagcgcttttgctttctccagttgctgcctcgaatcgtcatcatggacaagctcatcgcggacatacctatcaatctcgaggaaattctcacgaagaaagtcacgggtaagctgcagcttttccaatgctagggagttgttcccaagcaacttgtcacaaatgaaacgagtcatgcccaggacaatgtcatagtctgatcttcgcagcgtcaactggaaagtggacagaaggactccactcgcgcaatcgaggattctggggcttcctttcttcaagaggatcgccatcatttctgctagctttctggataacagtgagtcctcgccctccgcagtcagattgctttgctcgtcctggccaggctctttggaatcaacaagctcattctttgccacggcagtgacccacagtggtaagacagagtcagcaaagtggaatacgttgggtgccatttcattatgtgatccaattagccaccggcatacaagacccaacaagagcacaggcagccattgcttcagagcagaaactatgctgggtgcaaatcttgagccagcaaaggactcgacagcgggcacaatatcaagaagatcatttgcaaggaagaaggcctcctctggagggcatgactcctcaggggagcttgataaaaccaattgaagtagcttcgaagcgtatgtaaaggagctccgtacaagcaacaaagcgtccttcagatcaccccccttgaaacatgaactctgttcctgatgcttttttatggatgatactgcatattttatgtaggatgatgcaaatttgaggcaccttattttgtcatcattgagtggcttcatatttgtgtcaatgataaacttcagaattgaagcacccagcataatcacattaaatgtgcctttcgctgcatttgcattaagtacatcacccacttagttggcagtatcaataacattatacacaggtatttgtaataaaggataggttaatcacatttttgcatgttttcagaagataaatagataatacaaacattttagtttttattataagagtaagtttaatagatttttcacaaaaaaaatgtaaaatgtggtgtggctgtaccttcagatgctcctttctgctggtcttttgatcgtaaagcttttccattcttgttcaatttcgatggtggattgctaacagttccatttagaagtttgtcgaaacaattgagcagatgatccagtgactgatttgccgttgacgactgaaacaatgaaatataatatagtaaaaatatccaaataatgcaacctttttaacgggacttttttttttgccatccttacagatggcaccaattcaccccaaatcaccagtcactgaccagtgggaccaggttagttactgacagagcatttggtctgccattctctctgtaagaatgacaaaaagattagattgtcccttccttaagtagcaattcttggatggatgaatttatttatggttctgtcttgatggcagtggaaaccattgtgtcttgtaggaatggatggaaccttcaatccccggtctttgctcgacctgcatctagtggaggattactttgcctcttgtttctgacctcagttttattccgtggttgcaggtaatcaatcgccagacttttgggagctgtgttgggggggaccggggggaagagccaagttactgca

SEQ ID NO: 12691 - DNA, 537 bp, Zea mays
  misc_feature (1)..(1): n is a, c, g, or t
  misc_feature (6)..(6): n is a, c, g, or t
natgtnaacagacaatactgcatacagtccgcgttttctgttacgaatggaaaatacattgtcagtggatcagaagacaactgcgtgtacatatgggacctccaagggagaaatatccttcagaaattagaaggccatacggacactgtcatctcggtgtcctgccatccaacagagaacaagattgcttctggtggccttcataatgataggactgtaagattatgggttcaagatagctgatcaacttgcaggtgtggactacgctcagaccagacctaaacagcacttgcctatcaatgagaaaatatgtctgctgcccatggatatggataactattccagatacgtttacaacttacacaaagacattaaccatgcgagctttgttttaatctgatgtgttatcctaagttgtgaatgctgaataaatcaacatctagtcatctctaataatgttgtgatatgttatgcccaacggctgtattccaatcaatattgatttattttgcaaagttcgcaaaaaaaaaaaaaaaa

SEQ ID NO: 12692 - DNA, 1473 bp, Zea mays
agataaccatcatcaaggtgccggaatacagttagatcgatctaacggatagagctgactgcttgcatatgcgctagtacaaatagagcgccgcagtgaatccggcccaattcactttcccatcgcgtgaagaggttgccgttaccgaccatgtcgcagcagccggcgccggcgccgccatatcggccgtataggcaggtgagggaggcgacgccccatagccgggcgatctcctgcgtgcggttctccccctgcgggcgcctcctcgcgacagcctccctcgacggaacggtagcgctgctctccccgtcctcactggccgtaatcgccgtcctgcgcggccactctgacggcgtttccgacctgtcctggtccacggagtcgttctacctctgctccgcctccgacgaccgcaccatccgcatctgggacatccggcccgtcctcgccggtggcgcccaggcagccgccgtctccggcgcagaccgctgcgtccgcgtgctcaaggggcacaccaacttcgtgttcagcgctaacttcaacccgcagaccagctcgcagatcgcttccggaggatttgattgtaccgtgcgcatatgggacgccacgagcggccggtgcacccgcgccatcgaagcgcactctgagcccgtcacctccgtgcatttcattagggacggatccatcgttgtatccggaagccatgacgggagctgcaagatctgggacgccaagagcggggcttgcctcaagacggtcatcgatgaaaagaagcccgcggtgtccttctccatgttctcgcccaatggcaagtttatcctcgttgccatgctcgataactcactgaagctatgcaattttgccaccggcaagttcttgaaggtatacagtggacatgtgaacagacaatactgcatacagtccgcgttttctgttacgaatggaaaatacattgtcagtggatcagaagacaactgcgtgtacatatgggacctccaagggagaaatatccttcagaaattagaaggccatacggacactgtcatctcggtgtcctgccatccaacagagaacaagattgcttctggtggccttcataatgataggactgtaagattatgggttcaagatagctgatcaacttgcaggtgtggactacgctcagaccagacctaaacagcacttgcctatcaatgagaaaatatgtctgctgcccatggatatggataactattccagatacgtttacaacttacacaaagacattaaccatgcgagctttgttttaatctgatgtgttatcctaagttgtgaatgctgaataaatcaacatctagtcatctctaataatgttgtgatatgttatgcccaacggctgtattccaatcaatattgatttattttgcaaagttcgccactttaagatgtaaaaaaaaaaaaaaaaaaaaagtcgacgcggccgcgaattcggat

SEQ ID NO: 12693 - DNA, 1323 bp, Zea mays
  misc_feature (1313)..(1313): n is a, c, g, or t
agacatttcgtcgagcatcggctagacgacgcgcagcgatgccagcgtctgcgcgagcgtgtcgtcctccccgagccgcggctggtcgccttgaggacgcgtctcctcgtcagtcatccctcatctccctgggagaaggcgcgggccacgctgtggcagccttcctgtcgaccaccgcatcatggccgtcggggtggagcttccacgcagcagcggtgcacctggcctcggtcgcgacattcgcaaccgagcgctcgagccagcagaaggaccacggcctcgaagactacgacggcctcgatgtcgcacgggcagaggcatccagtccgccgccctcgatgtcggcgagctgttccagccaccgctccaagctgcagccatgaggtggtggtacatcaacatcacgcgcaaggcgctcgacaaaatgctcaagtccctgtgaagctataaaggactgttctgatcgcaatgtgcaagcgcaacaacttgagggcagagtgttggcggcagctcgctcggctcgactcagtttacggctgggaaggctttctgggcctgtgctgctcggcttccacgcgcaattgaggcccattgggccgccgcctcagacccctttcgccaaccccctcctcctcgagccgccgtcgccagatctcccccagggacgcgctcatccttttgcctcccaactgtgctgtgcaggaacctgcggggaaggcggtcgctcgctcgctgagaggatgcctctggggctgacgctgggctcgctggggcggtcgatgcgccggaagcggctgtcctcgctcgacatcctctcctccaagcgggcgccgcgggattactacaagggcaagaactgcaagcccaccgggttccacacccgcaaaggtggatatgtgattgttgatgaaaagttgccaagatttgtggtccctgacttgactgatttcaagctgaaggcatacgtgtcacaatgcgccagggacctcacagcgtcgacagcatcctctacttcagcagaaagtactgaaagcaagagctgatctgatctttgcttgcggggaggcagcccaactctgaagttatgtttccctagactgcccatgttccgaggattagcatcagcattctagctacaaacatttcagatatctttcttgtaagggcaaacattatggcatacctagattcacttttcctgcttgtaattttgatcttcattttgaagtaataagtacttgagttaaggggacatttcttgtggaaaaaatgacgggaaatagctggacgttcctcttgtgaaaaaaaaaaanaaaagcggcc

SEQ ID NO: 12694 - DNA, 3948 bp, Zea mays
acttccccccggaaggacataacgaatatattgtttcgggatcgggaatcaaacaactttcggtgtattacaatttgaagtatccaaatgatatatttaaaatagcataaaaaactcttattcatcatctcggtggtgctcatttgttgatgaaagccacgatccgctcctggagctggacgccctgctctgagtccagcatgtcgaaatggaacgcgtggccgacgcctttagactcgaacagctcgacctcgccggcgtacccgctggccttgatctcccggtggtaccacagcgcgcgctccttgagcaggaagtcgttctcggccacgcacaccagcacgcgctggcacgggatccccgcggaggccctgcgcgccgcgtcgtccacgaacgggttcacgcgcgggtcgtccagccccaccgtgtcggagaccacgaaccgccaggtgcggtccatgaacggccggatctcggagccgaaggctatctcgccgcccacggcctcgctgcccgtgaagtaggggtgcacgacggcgagcccgcggatggtcacgccgtcggggagcgcgccggcggcggaggcccgcacggccgtgttgtgcgcgatgttggcgccggcgctgcagcccgccaggaacacgcgggacaggtcggcgtgctccagcagccacgggtcctcgccgccccccaccgcccaccgcagcgccgcccacgcgtcgtcgtacgcggcgggcagcttgtgctccggcgcgaggcggtagtagacggacatgccgatggcgcccgagcgggcgacgaggtcgttgaggtagctgtgccgcgagcggtccggcggcgcaggggaaatggttgccatacgaatgaagagggaaacctccgcgtcggtgcaggattcaccagcggccgatgtgtagcaaacgcatagagtctgccacatttacaggatggaaggcgaacggtaaaatttagagtgccatttaccggtcattgctggaggcacacagaacgtctgtatccgctaaacttaccgaatagaaccatatacagaaccttgttagagacagccttagtctgtggagcggtaaggcagcccttcacttgaaaccacacatgtttcttttgccgaactttatataacaatccgccaaaccagaagagcttcacgagacagtctatcatttacaacatgttttaaaagattatatcatctatattttcatcatctccagtagtatcgtctaattcggttctctatatttacagcgttctcaaattttacaatacacagttgtttttatcgatcacttcaaaaataacagttcacatgtcgcgaaatttaaatatgtagcacatatttgttttatgttgaaattaatattagttcatatttaggcgaataatttactacacattgtcgttttcatatacgccatcaaaaaaaatcttcttatgctgccaaaaataaattagggactaattataataattacattttgtaacctacattactaatcgtttttttttcataacgaaaaagctatccaactatgcttatgtctatattgttcatgtctatatgtgtattggacataaacatcggtcatgtctctattgcttctcagacatttcgtcgagcatcggctagacgacgcgcagcgatgccagcgtctgcgcgagcgtgtcgtcctccccgagccgcggctggtcgccttgaggacgcgtctcctcgtcagtcatccctcatctccctgggagaaggcgcgggccacgctgtggcagccttcctgtcgaccaccgcatcatggccgtcggggtggagcttccacgcagcagcggtgcacctggcctcggtcgcgacattcgcaaccgagcgctcgagccagcagaaggaccacggcctcgaagactacgacggcctcgatgtcgcacgggcagaggcagccagtccgccgccctcgatgtcggcgagctgttccagccaccgctccaagctgcagccatgaggtggtggtacatcacgcgaaaggcgctcgacgaaatgctcaagccgctgtgaagctataaaggactgttctggtttgtgaagccataaacggaaactacgacggccttgcaatattagttattgtttagtaaaaaaaatatattattaattaagttgacatattagagttgatgaagattaggatacaatcttttagagtatcttataaagaatatataatatttgtttagatgataaaatttagaggacgttctatagagatagtagattctaaaatagcgagatgaaccaaggtgccatataaaaaaatgatatctcagttccacaactctaatataattgaatatagacgtgattatatatacatgtaacacaaatttagaaaccaaacacaattttataaagcagcttgcatttacagaataatcacctccagtctcctgaaactgcaacttgtgtgcatgcagatcgcaatgtgcaagcgcaacaacttgagggcagagtgttggcggcagctcgctcgactcagtttgacggctgggaaggctttctgggcctgtgctgctcggcttccactcgcaattgaggcccattgggccgccgcctcagacccctttcgccaaccccttcctcctcgagccgccgtcgccagatctcccccagggacgcgctcatccttttgcctctcaactgtgctgtgcaggaacctgcggggaaggcggtcgctcgctcgctgagagaatgcctctggggctgacgctgggctcgctggggcggtcgatgcgccggaagcggctgtcctcgctcgacatcctctcctccaagcgggcgccgcgggattactacaagggcaagaactgcaagcccaccgggttccacacccgcaaaggtaccatttcgccctccactggtccagcagtcctccaggtcgcccgtgctttgtcgtctgggctatgttttggtggtgcagttcgtcaattcgtacccgtctcttgcttgcaagattaggcgatcattgagatattggggtgaggattcacaggagtgaactgcgcgatcattgtcgcttgaagagaccatctgctggaaaaacataatgacgttaggtgaaacttagcaatgttttcagccaaacggagtggtgatggtatgcatgagttgaacagcgttaagtgaatcgggcaatccagcggcagttgacgacgtcccaattgtaagtttataatttcagttgacaaaccacctggattaccaccccacattattatccgtttgaatattagggggtagcagtggcacctgacaaaccatctgggttatcaaatgcaagctgctagaaaaattatggctcaatatgcagactaacataatcatcacttctcaagctatgaattagtaggttaaccctataattgctcaaaggagaaacagggaaactatggaataagcaaatctatacattactaaagaagcgttggatctaactacaaatagaagaacatttagaacaggattaatgttcaatgtttctagattctagtatagataatgtcataacaacacatagaaaactgccaaaaatgacagtaaaattaatcattcacaaagcaagactggaataacaagaaatcactgttaaccatgaaggagctcgcaaatgcatgtgattgctatcccaaacaatctttctgctgcaacattgcagttcaggtagatatcatatattatgaatttatgatgacaacaaatgcctttccttccaagtaaatttataaaataatcttctagcgtcgcaagatcaagtatacctatagagttggaaaacatctcacctcattatgacgtatcatatatatgaatgatatacatgttactatactctagatgatttatttcgactgcatcaataattcaatagcataagtagtcaaagctacaca

SEQ ID NO: 12695 - DNA, 2171 bp, Zea mays
ttttccgtaaccaacaaaaaaaactacacaaaggaactaaataacgcgggaacccagaattcttctcgcgcatatctgtgacacggctagccttgaatgcgggacgtgaaaaaaagcaggggagggaaggaggctgttggagtaataaaaatagtgtttcgtctccaatattggttttggaaagactctgtgtgtgtgtgttttttttttttgaaatgctctaatattggttatggtgttgtttggttcattttttttttttttttcaggaatggagttacataccgctggtgatcaatcaccgcactgatagctctgtgaatcgatacaaattgttctaacaaaaaacgagacaacgaattactccgtggaccgacagcggataaaatggaccaaaccaaacaatcgatttactccgtgaatcgatagtggacaaaaaaaagaaaactcttatttatcgtctcggttttcatttatttatgaaagccacgatccgctcctggagtgcgacgccctgctccgagtccagcatgtcgaagtggaacgcgtggccgacgcccttagactcgaacagctcgacctcgccggcgtagccactggccttgatctcccggtggtaccacagcgcgcgctccttgagcaggaagtcgttctcggccacacacaccagcacgcgctggcacgggatcccggcggaggccttgcgcgccgcgtcgtccacgaacgggttcacgcgcgggtcgtccagccccaccgtgtccgagaccacgaaccgccaagtccggtccatggacggccggatctcggggccgaacgccgccgtctcgccgcccacggcctccctgccagtgaagtacgggtgcactagggcgagcccgcggatggccacgccggcggcggaggctcgcacggccgtgtcgtgcgcgatgttggcgccggcgctgcagcccgccaggaacacgcgggacaggtcggcgtgctccagcagccacgggtcctcgccgccgcgagcgtcaccgcccaccgcagcgccgcccacgcgtcgtcgtacgcggcgggcagcttgtgctccggcgcgaggcggtagtagacggacacgccgatggcgcccgagcgggcgacgaggtcgttcaggtagctgtgcgtgcccggccgcgccggcgagccgaccacgaagccgccgccgtggaagtagacgatcaccgggatcttgccggtggcgccgggagggaggtagacgcgcgcggaggcggggccggagcggatgtccttggagacgacgccggtggccgggtccgtgccggcggggacggtgggggcgccgccgggccggtggatgcggccgctcttgtactggcagaggtagggctggaagtcgaagacgacctcggagtcgggatccatggctgcggtcgccgaggaggggttggtggcggtggagtcgcccatttgggttgggggaggaaatgagttggctacctagcagtagcagtagtacaagtacaacacaggcacagcgaggcggacgagatcagccggaggcctttctcaccaagatatacaaaggctgcactgcaggctgccctctgcaggtgagggttggtgagagttgacttgtatacaacggcacttcaaagcgttttttttttgttttgtttcccatgtggttcacaagattttccatttctaactaaaaaaaagtgttaccttccattgtggttcagaatattttccatttcgaaaaaagcaacatattatgaatttcaaaaatgctactgactaagggtggtgttttgtttgtacctcagtctcaatatctcattgttaaaaaaaacaaatatctataaacatgtcttatatgaaaaaattgaattatagaaaactactttaaaattgttcctagcaggaagccttgaacttgagagccattgcgatcatgtagaatttatattcaccaaatcatattcaacgacagtgccacttttcagatgaacaattccgcggtgcattgttctccaagttctcttctaaagtgatcagaagggtgcataagctttacagtttacagtatctctcacaaattgaacgctagtgtttttcagcaactccgtaaaagatggagcctatctcccagacatctacttctggcaaccagatcaaacagcaacagt

SEQ ID NO: 12696 - DNA, 1582 bp, Zea mays
gcttataattatattctgcggtcatcataaattatggtctgattttagtatagaaattgcctttgtattcaacataatctactgtcatttgatgctttgggttgaaggatgggaagatactaaagttcagcgtcaactacataacccaacgactcttctgtaccagagccggacctcctaaccgcacacagtcgaacattgttgcttgctcggcccagatctccaatggccgccgcacccgtcgctccgccgctagcctccacggacgacgagatcgtctacgagtccatgccctgcattcgcgtctacaagaaacgcgtggagcgctacttcggtaccgagttcgtcgccgcctccacggacgccgccaccggcgtcgcctccagggacgtcgtcatctcccccaacgtctccgcgcgcctctacctcccccgcctcgacgacgagagcgccaagctccccatcttcgtctactaccacgggggcggcttctgcctcggttccgctttcaaccccaccttccactcctacttcaacagcttcgcgggccttgccaacgttctcgtcgtctccgtcgagtaccgcctggcccccgagcaccccgtccccgccgcctacgccgattcctgggaagcgctagcctgggtcgtgtcccaccttgccgccgccggcgacaacgtccgggacccatggatcgcgggccacgccgacttctcccgcctctacctgggcggtgagagtgcgggctccaacatcgcgcaccacatggcgatgcgcgttgcagcggagggcctggcccacgacgcccggatccagggcctcgtcatggtccacccctacttcctgggcaccgacaaggtgccctccgacgacatcagcctggaggtgcgcgagagcctgggatccctatggcgcgtcatgtgcccgaccaccacgggggaggacgacccgctcatcaaccccttcgtggacggcgccccgccgctggcttctctggcgtgcggccgcgtgctcgtgtgcatcggcgagggcgacgtgctccgcgaccgcggccgcgcctactacgaccggctcagggccagcggatggcccggcgaggcagagatttggcaggcgcccaacaagggacacacgttccacctcctggagccgtgctgcgacgaggccgtcgcgcaggacaaggtcatcagcgacttcctcaaccgctgactcgcatcgccggtgatggcggcgttgttgggcttggatcaaatttagcttcgttcattgtatacctggagattggaataattgcagcttcgtcaccggtgaagaatgctggcgctacactacactcctactagtacgtttcaggttcaaagttgtgtttgtattatttgaaattgggtctaaggatgaagggggctttgccattgttagtaatttgggtacgatgatacagtcatatgtcatacacatgaaattatacttgttagacacacgtaatttgttgaaacatttatttcaaaaaaaaaaaaaaaaacctcccgctgctaggacccccgcctcattattatttgtagcagctattggctctggaacc

SEQ ID NO: 12697 - DNA, 2245 bp, Zea mays
cggacgcgtgggcaaaaccagccgagcgccagaggagaagagctccgtctggccttctcttccttcctctacctgccgcacccgcacagccacagccaaccacacacaccccatcacaacagctccctctgcatctccgcctcgtcgccgtcgcctgcctgcctgcacaaccttcttcctcatctctctcttcttacgctgccaccctcccagcaccgagggaagggaagcccaggaatctccgtcccgctcccggccgccgtcccttctcataatctcatcggatctgtattgggttttcagtaaggagcagaaaacgccttagggaatgcagaaagatgtgcttgcacgtcgaagagctactttgtgagggacttggcaggaaagcacgccatactcttcattctctgccagctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcatttttttttaactgtcaaggataagcaagtgacctctgtgtgcataccaccatacgtagcatacacaggcacagatggcagagcataaagggaacgttctcttgcacaagtatgagatggggaaattgcttggtcaaggcacctttgccaaggtttaccatgctcgtaacacggcgacttcggaaagtgtcgcgatcaaagtgattgataaggagaaggttatgaaggttggtctcattgatcaaatccagcgagaaatttctgtgatgaagcttgttaggcatccaaacatcgtacagctctatgaggtcatggccaccaaaaccaaaatatactttgtgctggaacatgttaaaggtggagagctgttcaacaagattcagcgaggaaggctcaaggaagacgcagcgaggaagtacttccagcagttgatctgtgcggtggacttctgtcacagcaggggtgtctatcatcgagatttgaagccagaaaatcttttgctcgatgagaatagcaacctgaaggtatcagattttggtctaagcgcacttgctgaatgccatagacaagacggcctgctccacacgacttgtggcacgcctgcttatgttgccccagaggtgattaacagaaagggttatgatggtgcaaaggctgacatatggtcttgtggggtcatcctgtttgtgctattggctggttatcttccgttccatgataagaacttgatggacatgtataagaagattgagaaagctgacttcaaatgtccaagttggttttctaccgatgttcggaggcttttgcaaaggattcttgatcctaaccctagtagaaggatctcggtggaaaaaatcatggagaatccatggtttaggaagggtttaggtgcaaagctacttaggtacgatttacagaataagaatgcccctcatgtggacaagaaggcagattttgattcactgagcaccaacgtaacaactgagagcaagcaacatgaagaaaagaagcctaccaacatgaatgcatttgatataatatctctatcaactggcttggacctctctggtttatttgaagaatctaacaagaagagagaatccaaattcacatctaccaacacaagctcgacaatcatatcgaagatcgaagatattgcaaagaatttgcggttgaatttgacaaaaaaggatggtggcttgttaaagatggaagcttcaaagcccggaaggaaaggggtaatgggtatcgatgccgaagtatttgaggttagccccaacttccatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttaaaaacttatgagctagtgcaatgtttttagccaatttccaatctttcgtgtatttgtgtagtttttactcttttattatccatttttgttttcccgtgtaataccaacaaaaacttgtgtagttgtgttattttctgaggacaaatttgtttcaaagatgtgtttacgctgttattaagagtttcctttatgttataagctgttttcaacacacgaaatatattgttattaaaaaaattgaacctaag

SEQ ID NO: 12698 - DNA, 2785 bp, Zea mays
  misc_feature (319)..(319): n is a, c, g, or t
  misc_feature (406)..(406): n is a, c, g, or t
tccgctgccaccctcccagcaccgagggaagggaagcccaggaatctccgtcccgctcccggccgccgtccttctcataacctcatcggatctggtacgtaatctattcctaccgccgtgctcctcgtttccctattggtatttgtgtagtaatggttaccattcccagcttggttgtttgtttagaacaggaagaatgttcatctcttcatttttaacgctccttgccctcggcccacgatttttaatgtaatagctgacgcgaaattaataaattacatgcagcagccagcagcctcttcctttccctccttttttnttcttcttcttgcgttattagatccgatttaaagacgccatgccatgggttcatgtacgtctctgtttttttttttttgggggggtnggggggggggggagggggtgccttgtgttccgaacaaagttttttttagagcagaagaaaccatcaagttcgttttgcggtttatgcgtaagccaacaacactgtctagatctggttaagaaggtgtcaacaaaactgtctagatctggttgagaaggtgtcaacagcactgtctggatctggttatgaagtagaattttttttagttttgctacttatgtctaaaaatcagattagacaaactcacgtaacgattgtctgaactaacttgtgcacacatgttcgtgcaagaatatctgctctgttttcttccaatttttcattatccttgaatttttttcatactaacaattatattttatatttctatatacagataggtatgtgttgtattgatcttataactgatgcccttctcttttacatcttcggcagtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcattttttttaactgtcaaggataagcaagtgacctctgtgtgcataccaccaccaccatacgtagcatacacaggcacagatggcagagcataaagggaacgttctcttgcacaagtatgagatggggaaattgcttggccaaggcacctttgccaaggtttaccatgctcgtaacacggcgacttcggaaagtgtcgcgatcaaagtgattgataaggagaaggttatgaaggttggtctcattgatcaaatccagcgagaaatttctgtgatgaagcttgttaggcatccaaacatcgtacagctctatgaggtcatggccaccaaaaccaaaatatactttgtgctggaacatgttaaaggtggagagctgttcaacaagattcagcgaggaaggctcaaggaagacgcagcgaggaagtacttccagcagttgatctgtgcggtggacttctgccacagcaggggtgtctatcatcgagatttgaagccagaaaatcttttgctcgatgagaatagcaacctaaaggtatcagattttggtctaagcgcacttgctgaatgccatagacaagacggcctgctccacacgacttgtggcacgcctgcttatgttgccccagaggtgattaacagaaagggttatgatggtgcaaaggctgacatatggtcttgtggggtcatcctgtttgtgctattggctggttatcttccgttccatgataagaacttgatggacatgtataagaagattgagaaagctgacttcaaatgtccaagttggttttctaccgatgttcggaggcttttgcaaaggattcttgatcctaaccctagtagaaggatctcggtggaaaaaatcatggagaatccatggtttaggaagggtttaggtgcaaagctacttaggtacgatttacagaataagaatgcccctcatgtggacaagaaggcagattttgattcactgagcaccaacgtaacaactgagagcaagcaacatgaagaaaagaagcctaccaacatgaatgcatttgatataatatctctatcaactggtttggacctctctggtttatttgaagaatctaataagaagagagaatccaaattcacatctaccaacacaagctcgacaatcatatcgaagatcgaagatattgcaaagaatttgcggttgaatttgacaaagaaggatggtggtttgttaaagatggaagcttcaaagcccggaaggaaaggggtaatgggtatcgatgccgaagtatttgaggttagccctaactttcatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttaaaaacttatgagctagtgcaatacatctttttagccaatttccaatctttcgtgtatttgtgtagtttttactcttttattatccatttttgttttcccgtgtaatgccaacataaacttgtgttattttctgaggacaaatttatttcaaagatgtgtttacgctgttaaaaaaaaaaaaaaaaaaaaaaaaaaaaaaaaaaaaaaaaaaatcaaaaaaaaaggccccta

SEQ ID NO: 12699 - DNA, 1024 bp, Zea mays
cattgggtacctcgaggccggccgggatacaaaaccacattgggtacctcgaggccggcgggggtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcaattttttttttactgtcaaggataagcaagtgacctctgtgtgcataccaccaccaccatacgtagcatacacaggcacagatggcagagcataaagggaacgttctcttgcacaagtatgagatggggaaattgcttggccaaggcacctttgccaaggtttaccatgctcgtaacacggcgacttcggaaagtgtcgcgatcaaagtgattgataaggagaaggttatgaaggttggtctcattgatcaaatccagcgagaaatttctgtgatgaagcttgttaggcatccaaacatcgtacagctctatgaggtcatggccaccaaaaccaaaatatactttgtgctggaacatgttaaaggtggaagagctgttcaacaagatccagcgagggaggctcaaggaagacgcagcgaggaagtacttccacagctgatct

SEQ ID NO: 12700 - DNA, 921 bp, Zea mays
attgggacctcgaggcggcgggagagattgccggccggcgtcctccgtcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcattttttttaactgtcaaggataagcaagtgacctctgtgtgcataccaccaccaccatacgtagcatacacaggcacagatggcagagcataaagggaacgttctcttgcacaagtatgagatggggaaattgcttggccaaggcacctttgccaaggtttaccatgctcgtaacacggcgacttcggaaagtgtcgcgatcaaagtgattgataaggagaaggttatgaaggttggtctcattgatcaaatccagcgagaaatttctgtgatgaagcttggtaggcgtgcaaacatgggacaggtctatgaggtcatggggcccaaaaccaaaatatgcttgtgtgctggcacat

SEQ ID NO: 12701 - DNA, 878 bp, Zea mays
  misc_feature (28)..(28): n is a, c, g, or t
cagagagtggctctgtggatcccgacancagcaacaatagagtaggcaacgacgtggagtcacaacgatagttgttgtctgctctcttggcctttccaatgagcatgaagatgatggaggggctctttgatgcggtctaattaaactgacaatcatataacaaactacaagtaggaaagttacacactatatggtccaacaagtcctcttttttcctgatggttttgtttcatcttaccaatatagtatttcctgcctcagtgcagagcagtgtgttcaacattgttcttggccgaaacattttcgcttaggaaccatggctgctggtagtggtggccacctaagatgaccccactgtgttggtggttgatgctatgttgctaacctccttgctgtcaggatttgcctggtgattgtctccttgtatagaaaatgttacctgatcagctggtggcaccgctgcagctcctgtaatggtttaccgtgtacattgcataggttcatgtatatatatgctaggtccttggtacatgcctacaaggtacagttccattctgttcgagagatgtacttatgcacacgggtctctgtaacatcgatgcaataatggccgggtgactgtaagtgcacataccgacgcggccgcccatgatatatagaaaagagcacatcaatccgtgaaatgtgagcccacatttcctaattcctcatgtttattttggagtgaatcattctagcacaaatgcagatccaacaaactgattctcccacacatgattaagttgttaaagcttatccaatctttttcattgcaacatgaaaactccattgacaactgttgcttgcccttgcatccccaatttcctcatatagaggag

SEQ ID NO: 12702 - DNA, 4291 bp, Zea mays
  misc_feature (135)..(136): n is a, c, g, or t
  misc_feature (155)..(155): n is a, c, g, or t
  misc_feature (631)..(631): n is a, c, g, or t
  misc_feature (2230)..(2230): n is a, c, g, or t
  misc_feature (3505)..(3505): n is a, c, g, or t
  misc_feature (3738)..(3738): n is a, c, g, or t
  misc_feature (4222)..(4222): n is a, c, g, or t
agggcgacacagaggagggcgccgggatcgtgaagatcgccggcgagggtgggacggaggaggaggcacctgagcgagaaacaagggggcgggcgggaaatacgagcggactagcgggggagccgagtggatggnngggggaaccgagcagacgngcaggagagcctagcggtcgcatggctccccagtgtttttctttttttggttattgaatctctagaacttttcccaacattatttgtaaatgtaataggtagttcgtgtctagaaactcactttcagtcatagtttcagtgtcctcgctgaacttcctgcagattgatcactagtgcaaaattgaacgccagttactagtgaagtagtgatttatacttgtgcaccattactgtcacagcaatggccaggccaataaagttgatgaaacagcgtcacacagagcaaatggaacacttctaaaagcattcttcttcccctaattgaactttaccttgtggctgaatagaaagcaatttagtgcaggcgtccatgttgatactgttgtcatgaatcctccctttggtacacgaaggaatggagcagacatggagttcctctctatggccttgcaggtcagaaccggtgcttgtttgcnactagcagtttcctttggaagatgatatttgacattttaagtgcccatttgctactgacaggttgcttctcaagctgtctattctctacacaagacttccactagagaagtaagttctttcacagaacaagtccgaatatataactcgcgagatatcctggcaatgccaaatcttcgtttattttcctttcctcgtgcatttcacctttttttttactttgactgttcacatttattttcattttcggaactgtcagcatatcaagaaggcagccttgcgtggcttcaatgccatcagtgcggaggttctatgcgaggtataagtatataaacaccagtcgcttttccttgctaccagggatgcatttcagcgccttggtccgcagcagacatggagttcctctctatggccttgcaggttgcttctcaagctgtctattctctacacaagacttccactagagaacatatcaagaaggcagccttgcgtggcttcaatgccatcagtgcggaggttctatgcgagctgcgttacaatctaccgcggacgtacaagttgcacaagaaaaaagagattgacattgcagtcgatctgtggcgctttgttcctaacgcccaacgccgcagctagcgcgctcgctatgggccgaggggcacaggtgatggagtggaactgaacatgaatggaaaatgatcaaatggatgtgtctcaaaaggctggacttgatcgaagagatcccaggcgtcacgcttggtgtgcttatcgtcttcttggtgcccgtaaggatagctcagaatttggcgaactgtgtagagttttgtcattttgtgggcacagatgatgctcccagtagtgtgcacaatgaatgctttgtatgtattgtgctctattgcctgtgctaacgctacagaataaaatatttacaattaatttggtgatcaaaaaaaaaaaaaaaaaaaaaaccggcgtcccgcgccggggtgaggagccatgagcccatgaccggccgagagagaccccgactggcccaggtctgggcgttcggtcttatatctgtgaactcagttcggttcttttggtttttacaaaatagaaccgaattgtgactcaaaaggtacttgaaaatactggccgctagcctggctgcttgactttggcgtactgctaagcctgcggccctgcacctttcagcaagcaacaagcaaaaatatgcaggcaccgcatgaagccagggcgctagacagccagcaagcataaatatatactactgtataatggtataagcaaaaatacgaaattaaatagtggttcatacttcacggcaatatagaaatacaacataagtgtatgattggcaattggacatagattaacaagttaacaacttagtctcaccaagtcacaaataacacatttctgaataagttcagaattaacaaggacacaagtcttcactgaaacacaaccatagttgaacgtaatacatcactacttaatagaaaaatagcatcaggaagatatcgtttaaagttgatgaagatcaaacttcaatgctgccctcagcgtcacagcagtaagttcttcgtgccgcgctccancaatccacgccatagcagctagaaatgaaacaatatatatggattaacatatagcacttgctatagatattgaggatagaaaccattaggatatttatacataggtggggggcctcggccacatggttaggagcggatcctgatatgttgacttttacaaatatcctatgggagtatgggtaatttttttggaggttctagatgttccatgtattagggagtaggctcccatattccggtcgaactaggcctttcttgttattcatctcaaatgtattgacagggaacaactatttatcaatttgcacatcttcaaatatcaactgaccttcatttattgtctattgtatccaccgatagaaaacattgcaatcgatggtggcatgaaaaaaaggagttatgcaatttacactaagcacgccttttcaattcatctgttggaggaattgtgtgggacaatttaatgtttccgctcttaataatttatcaaatatcttgtcacacttagcaacattgaatgtgaacttaacttctctttgtcgattcttttgaaccgactgcagggaagagcaagtgggaagttttgtccttagctgaccaaacaagttcgtcaacatatacctcttttggctcatcatttgagctactactgtcatgacacgtattatgatgagatggctcttgaatttctatgcttcggctttcataagccaaagcttgatgatgtaactaagctagcgaaaagaactgtgtgctaccttaatttttcttttaagtatggacgcaacccattgaaagccaactttgctaactgcttatctatgacatggatctgaaaacatcagtttctagtatctctaaaccttcagaaacaatctttactgattcattgaccccttgccagagcgatgccagaccaactaaatctaacacgtaatccttggagaaaacgtttttagaaaacttatgctctagatcatcccaggaactaatcgagtaaggggacatggcagcataccaagtggatgcagtgctaataagagatattgaaaataagagaacacaaacgcttatttgtcaatcaattctcctagttgtactaacaattggactatatgttcgtgagtgcttctatcgctctcgcttgcaaatttggagaaatccggcacactagtccctaaagggtatggaacagtgtcccattagggtcgtatggccaaatatgaatgccttgggatggacacactaactcctagtttgtcccggaacaattcngctagttcctcctaaattttattcatagtgcccggtggtaacccactggcccttgggacatggggcttaggtggccatttatcgttatgccgaccttctgccccaagtcaatcaaagatggcatccgactgctgaggcatatcggtgtcgtgtcccactaccgtatggtgtgaggtgaacctctatagctccttaggggctaaaaatattttaccccacacatggttggtggnatgctgaggctttgatatgtcgtaggtggaagagagtagtgctactgaggtgcgaggaaaactaggtgttgtgcttgtgcatagcagcctgctctggatatgtgacgctggacagtccacacagggtttaggacgatcctttgtaggaccggatagttcaagattatatccagacggtctggttgtgctcagcggtgacgacccgttatgtagtgagctcggtgtgacgccgaacaattcgacatgaggatacaaacagtccgtagtatgtctagatggtctgagattgtacctggtctatctggtactgcttagcgttgctgctctatcttataatgaaggtggcgatggaggttgccctagatatgagttcaacaacatactatagaatggcttgggcttgtgaggacccatttgcagccgatggattaggcacagatgtcctagtgctagcttcgtgcgatgggaagctagggataatagnttttctcgaatacacgtgttagttttttgaacgatttttccatccctccaatatattgctttaatgttc

SEQ ID NO: 12703 - DNA, 1582 bp, Zea mays
  misc_feature (1405)..(1405): n is a, c, g, or t
  misc_feature (1425)..(1425): n is a, c, g, or t
  misc_feature (1514)..(1515): n is a, c, g, or t
  misc_feature (1552)..(1552): n is a, c, g, or t
  misc_feature (1574)..(1574): n is a, c, g, or t
gatttaacagaacatcccatttctcgtgcggccaaggcccagtccgatgactctggccctataactctgagccccatcggagactcggagtcgggggcgccagcgtctcgcctcgccgtcagcagcagcagcagctgcacctccattccacggcttccgtcgtgcgcttcgtctgcacccacaaaggcgacggcgacggcagggggaggagatgaagctgaagcagctggagggcctcttgggtggcctgacccagttctccgaccccaagctggagctggagcagtatgcgacgggccctcacatcgcgtcgcggatgctctacatggcagagaatagtttcaatgacataactggcaaagtggtagctgacttcggctgtggctgtggcactctggctgtggcgagtgctttactggatgctgaacatgttcttggtattgatattgacccacagtcacttgaacttgctcaagaaaatgctgctgatctggagctggacatcgatttagtttggtctgacataaagaacttaaatctgaaaggcgtccatgttgatactgttgtcatgaatcctccctttggtacacgaaggaatggagcagacatggagttcctctctatggccttgcaggttgcttctcaagctgtctattctctacacaagacttccactagagaacatatcaagaaggcagccttgcgtggcttcaatgccatcagtgcggaggttctatgcgagctgcgttacaatctaccgcggacgtacaagttgcacaagaaaaaagagattgacattgcagtcgatctgtggcgctttgttcctaacgcccaacgccgcagctagcgcgctcgctatgggccgaggggcacaggtgatggagtggaactgaacatgaatggaaaatgatcaaatggatgtgtctcaaaaggctggacttgatcgaagagatcccaggcgtcacgcttggtgtgcttatcgtcttcttggtgcccgtaaggatagctcagaatttggcgaactgtgtagagttttgtcattttgtgggcacagatgatgctcccagtagtgtgcacaatgaatgctttgtatgtattgtgctctattgcctgtgctaacgctacagaataaaatatttacaattaatttggtgatcaaaaaaaaaaaaaaaattttttttttccccttcttttccctttctttttcttcttttttcctttcctcttttttctctttcccctctctctcccctctccctcccccccctctttccccatttttcttcctttttcttcccttttttttttttcttttttgctttctttttttttctttttttttccattttcttttttccctttctttccttctctctttacctttttcttcttatccttttttttnttttcttctttccctcttcnttttcttcttattcactctccaaatttttttttttttttttcttttttatttcttcttttttttttttttttttttttttttttttttnnttttttcttttctttttttttcctctttttttttttntttttttttctcttttttttantattttta

SEQ ID NO: 12704 - DNA, 2801 bp, Zea mays
  misc_feature (10)..(10): n is a, c, g, or t
ggtgcatttnaactattactgtttgtcagaaatttcgtctttttgtaacggctagagtaagatgaatttgaccatgaagttttgtatatagttgaggtaagctgagatgtacattcatgtttttttcagatttttttgaaacttttttagtaggtttgcacggggtttgcagcaaaacatggtttgcatttgatatgttccccacatagtataaggtatgtgcaacttattcaagtacctaaacctcatgttttttagctttatctaaagttgcacttttggtcttcatttcttactcatttggacttgttttcttcaacttgctcttgctaaaacttgtgctcatactcatatcgaagtagttagtccaatatggtgtgttgagcacttaatcaccaaaacatgtataaatggcaatatgacacatttccctttaaaaaccgaattaggatcagactctatttttatttatttttgaattaaaattaattaagggttcaatcaaattgtgaatgaatttggcttgtggtccattatcacccctagctagaggagggtgatgatgagttattgttgacataattgtgtttgacttgtccttacaagaattttttataatgaaaaccaaaaaataacgggaaaccaaacaaagcaaaaacgaaaagaaacattccaatatggaaattcgtgggccatgttggttcgtagtgggctataccacggcaaaagggcatgagcctagtaattagtaaacacgcaactgggctgaaccacattccgttcaggttttctttaaagcccagctcggtccatgtcaaatcatatatattcatatatatcgcatattattctttttgcagagagagagagagagagaatcaaaatcactttgcgtgcagcatcgattgggtcggaaatcgagggtttggtaagcgagatcgccgccggtgacagctgacagggacgagatggacgccggcggaggcggctcttggtcgccgttctctgcatgctgctggtcttcgccatcttccccctcctcctctggcgccgcgctccgatgccgccaccgccgataaccaccgcgtcccgccccagcccctccaggaggatcaggtgctgcacggtcgcgcggcggcgcgacggatgcgtcggaggcctggggctgccggagcaggctcctctactgcgtcaactagccgcaatggtaccacaattgccagttgccaaagcccaaagctctgtttgtttttccgtttcccctttcttctgttcgccctaactctagcctcggtcctcggctgtgcagctgtagaggacgacgcggagagtgacgatgaggaggtccccgaaggtcgcaacgtacccagatcctccaaaaaggagaagaaaaggcaagagcgagagatgcagcgtcaggttggttactcacttcaacgccaagtcatgccataagtttcagccagtgcttacgcttgcgagcttgctgctaaatcgtgttccgatgattgctgccattttccgctgtaatttcagctgcacgagcagatttagtctttctactgtatgtattttagtgtgttgaaatactccttcagtttgtttatttatttgtggtttgcacatttaatttcgtcatgtttggcataagtgccaacttactgtgatagttgctgttgttaaaacagaggatggaatccaattacaattatgtctgccatataattccttggtggttttgatttccattcggaaagaaaaaagaatcagaaagtgacatgaaagaaactcttttcttgcaaggccgaagaacctgcacgggattcatggaggagtaaacaagaccgatacgacgaaatgaggaggaagaaggatgaggagcgtgaggcacaagagaggcaattggttagggattctattttctgatagttctcttctttgattaatgctgccatgttttcagttataattctgacaagctaattaatttatccataggaagaagaagctagggcacgaaaagcaaaggaggaggctgctgctgctttagagtttgagaaatggaaaggggccttctctgttgatgctgaaggtacaacagagagtgagacacaagacgatggtcagggtttgctccacaactttgtggaatacatcaaggttatgaagcaagtgtctttacttgtgccctcatgactgcttattctcaaatttgacaatcagaaaaattatctccccatgatgaaccatgatgtccacaccaatatttggggctctgtttggcctctagccctctagtctacgcacagataccattttatttcctctacatcggagtctgtcaaatatcttacgagaagttgtcacaatgcacctttttctcaagtattttgaaggattcagtgttgttctgccatgttcttgagcatactgtttgccaatatctatgtggtatgatatgctttgatatgtaaactgagtaactgacaaacttcactgtaaccttttctttctctaaacttcagaagcaaaagtgtgttcccctagaggacctagctgcagagttcaggatgcgaacccaggtacttcaaaattacgtataagatgttcgaatgctgttatgaataataggattaacttcccatgccctattatttttaaatagaaattgtgataatgcccattagataggtgttgatagcttcgctgtttgctgagttgctaatttgctattgcgctattgaagtggtaatttctgaagcaatattatgtttaaatagaagtagaggtaatgttcattg

SEQ ID NO: 12705 - DNA, 1281 bp, Zea mays
ctcgaggtcctgccgggatatatatcgcatattattctttttgcagagagagagagagagagaatcaaaatcactttgcgtgcagcatcgattgggtcggaaatcgagggtttggtaagcgagatcgccgccggtgacagctgacagggacgagatggacgccggcggaggcggcgtcttggtcgccgttctctgcatgctgctggtcttcgccatcttccccctcctcctctggcgccgccgctccgatgccgccaccgccgataaccaccgcgtcccgccccagcccctccaggaggatcaggtgctgcacggtcgcgcggcggcgcgacggatgcgtcggaggcctggggctgccggagcaggctcctctactgcgtcaactagccgcaatgctgtagaggacgacgcggagagtgacgatgaggaggtccccgaaggtcgcaacgtccccagatcctccaaaaaggagaagaaaaggcaagagcgagagatgcagcgtcaggccgaagaacctgcacgggattcatggaggagtaaacaagaccgatacgatgaaatgaggaggaagaaggatgaggagcgtgaggcacaagagaggcaattggaagaagaagctagggcgcggaaagcaaaggaggaggctgctgctgctttagagtttgagaaatggaaaggggccttctctgttgatgctgaaggtacaacagagagtgagacacaagacgatggtcagggtttgctccacaactttgtggaatacatcaagaagcagaagtgtgttcccctagaggacctagctgcagagttcaggatgcgaacccaggactgtatcaatcggattgttactctggaaagcatggataggttatctggtgtgatggatgaccgtgggaagttcatctacatctccactgaagagatgaaggcagttgcagagtacattaggaagcaagggagagtgagcatatcacatctggccaacaactcaaaccagttcatcgatctggagccgaaggcccagtacgaggtggagagccagcaggatgacagtgcagaagcaggcacagaagcatgagaattccttgtgacctggcaccatgtcgtgctcaatgatgttttgtagtgtgatgacttaacatggtttgagttgggcactggccatataatatatgcagtagtcggtataaacatacttgttctgacatgctagataccattaccccatgcagagaactcaggcttttgttctatcatcatgattgaaaatcatcggttggg

SEQ ID NO: 12706 - DNA, 1195 bp, Zea mays
cggacgcgtgggcggacgcgtgggcggacgcgtgggccgggaatcccaaggtcatttcggttaagctccacaccattcccggacacggagacttgccttccttttggtgcggaaaaagaaagagaggagaagcgaaggaggttctcagttggagcggctccctctccccgcgcgcgccaccgcctccgatccgagcagccgcctacagtcaacccattcaacctcaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaggcacttatggcttagctgaatatcaaatagaaggagatgggaattgccagtttcgagctctggcagaccagatattccgcaatcctgactatcacaaacatgtgaggaaggcggtagtgaagcagctgaaggagttcaggaaacactatgaaggttatgtgccaatggaatataaggtttacttgaagaaaatgaaaaggtctggggaatggggtgatcatgtgaccttacaggcagctgcagacaggtttgctgctaaaatatgtctgttgacatcgtttagagacacatgcctagttgagatagtccccagagatgccactccaacaagagagctttggctaagtttctggtgtgaagtacactacaattcattgtatgcagttgaagatcttccaacacggaaaactaagaagaagcattggctgttctagctcgccaggctttggtgatttcttggtatgctattggtcttctctttgtagtccagcagcatctgtaagcctgcttagttatgcctttgtttgttgtaagttgtaacttgacctggaatcaaattcatttaagatcatgcaaaatacagtgagctcttgcttcgtccgtggctgaaatatttccaacacatagtaaacatgttttcagggacgtagtttttttctctctgtgtgtgtgtgtttgtgtgggtactttgcttcgtag

SEQ ID NO: 12707 - DNA, 1847 bp, Zea mays
tgctgttactcctgcccgttccatgctgcagcgcagaccactaaccgtgtcggttgttcataatgaagcctttgagaaggtgaagcggacgccaaaggccaatcaattgtaccaaaattcccagcgtccggcttgccaaggataggatccctccctcagattcacatggtgcgcaagaaatcccaagcaccacaagaagaaacataggtccctagaatctcgtggcgcagactttgatgccgagcggcgcctgtactctcatgcgttcaagaagtcctcatcacttctgagccgcttaatgaagcacaagtttgggtgggtgttcaacaagcctgttgatccagtcacacttggtttgcatgattattttactattatcaagcacccaatggatcttggcacaataagggggcggctgagccgtgggcagtacaggaaccctaaggagtttgctgaggatgtccgtcttactttccataatgcgatgacatataatcccaagggtcaggatgtgcatttcatggcggagcagttgttaggaatctttgaggcacagtggcctgagattgaggctgaggttaactacctcgcatcatgtcctccattgccgaagaagtttcccccgccaccaattgacctgcgcttcctagagaggtcagattcaatgagacaccatgtggcattggacaccaattcaagaccgatcagtcatactcccacttatacccgaactccgtcaatgaagaaaccaagagcaaaggatccaaataagagggacatgacaatagatgagaagcgtaagcttagtgagaacctccagaatttgccgccggtgaagcttgatgctgttgtgcaagtcattaagaacaagaacttatcagttaagcaacatgatgatgagatagaggttgaaattgatagcatggatgctgagacactttgggagcttgacaggtttgtgtcgaactacaagaagaacctgagcaagcaaaagagaaaggccgagcgagcgatgcttgcccgacaagatgcagagttgcgtgcacagcaccctatacaacaaccacaaccaaccccagtcccccaagaaccttttggtgaaaaatctccaaaacaagttgtgaaagattcgctggaaggcgagcaactgccagcatctgcaccagaacaaaatggtgagaatagacagaatgcgagtagttcaagcaattcaagcagctccagcagtggctcaggatcatcttctagtggctcagacagtgatagctcctcttcagatggatctgatgctggcaattcatcttgagatatagatgcatgcctttttcttttgagaccagtgccatggggccttgggcgcctccgttctggtcagccctgatgttaacgtttctgctagataccgttcttgtttggtagacgagaaacattgtgtggctggtgttaaatggttcagaagttctgtcgagtaggcaataactgcctatttgacgcgacaatagcaccataagattgtacatgcttaccttgtctggcttagggaacccctgtagtttaagtaggttttgtatgtcgattcacccgctgatgaaggcagtaacttgtaggtttcgtggtgtacccgcctaataagactaggcttgttgctgacaccgtcccttggtacaccgcacttttgctaggagccctctggctggcccagacagtactagcatgtacattagcggcagcttgaacgctgattttgtttagctgtgttgattgcagtatgtaggaaggcgactgctgtatgcatttttttcttacttttgtttaacttacggatgaaagcattggcaggccataca

SEQ ID NO: 12708 - DNA, 1715 bp, Zea mays
ttgggtacctcgaggccggccgggagcatatgtccctagaatctcgtggcgcagactttgatgctgagcggcggctgtactctcatacgttcaagaagtcctcgtcacttctaagccgtttaatgaagcacaagtttgggtgggtgtttaataagcctgttgatccagttgcacttggtttgcatgattattttactattatcaagcacccaagggatcttggcacgataaggggacggcttagccgcggacagtacaggaacccgaaggagtttgctgaggatgtccggctcactttccataatgcgatgacatataatcccaagggtcaggatgtgcattttatggcagagcagttgtcaggaatcttcgaggcacagtggcctgagattgaggctgaggttaactaccttgcatcgtgtcctccattgccgaagaagtttccacctccaccaattgacctgcacttcctagagaggtcagattcgatgagacaccacatggcattggacaccaattcaagaccgatcagtcatactcccacttacacccggactccatcaatgaagaaaccaagggcaaaggatccaaataagagggacatgacaatagacgagaagcgtaagcttagtgagaacctgcagaatttgccacctgagaagcttgatgctgttgtgcaagtcattaagaacaagaacctatcagttatgcagcatgatgatgagattgaggttgaaattgatagtatggatgctgagacactttgggagcttgaccgcgtttgtggccaactacaagaagaacctgagtaagcaaaagaggaaggccgagcgagcgatgcttgccagacaagatgcagagtttgcgtgcgcagcgccttatacaacaaccgcaaccaaccccagtcccccaagaacctgttggtgaaaaatctctaaagcaagttgcaaagcatgctgcaaaaggtgagcaactaccaacatctgcatcagagaaaaacgacgagaatagacagaacgtgagtggttcaagcaattcaagcagctccagcagtgactcaggatcatcgtctagtgactcagacagtgatagctcctcttcagatggatctgatgctgccaattcatcttgagatataggttcacaagttctgtcgagtagacaataactgtctatttgacatgacattggcaccataagactgtacatgcttaccttgtctggcttaggaaaccccctgtattttaagtagctttgtatgtggattcaccagctggaggcagtaacttaggtttcatggtgtacccgcctaataagactaggcttgttgctgacaccgtgtctttgtacaccgcactgttgctaggagctctcggttggctcagtagcctgtacattagcggcagcttgcacattgattctgtttagctgtgttgattgcagtatgtaggaaggcgattgccgtaagcattgtttcttccatctgttaactgactgatgaaagcattgacaaagccccgttggtgttcagtttgccaccatctttctgtggactacctgtaacccctgtgggttcatccccatgtgccaagtctttttgatgttgtaaattaaagtttgttgatgcatctgatgtttagcatcccgcctattgacggtccgtttttatgttctgatttgaggaatgtttgctggaaaaaaaaagaaaaaaaaaa

SEQ ID NO: 12709 - DNA, 736 bp, Zea mays
actcctaagggcgattgggtccctcgaggccggccggagaaaaaccctacagttcatccctctcgacgcgccgccgccgtctcgccgctgcccacccagattgacggctccaattggcgcccatggcggaagaaaccaacataaaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaatgttcgtgagatgtggaccgaggtaccgaagaccggtaaaggcaagaagaaggctctcccggtgaacaaggacaggttcataagcaagatgttcctccgcggggattcggtcatcatcgtcctcaggaacccgaaatgagtaccctgtacacgtagagagtctgtttgctagcagtacgttgtgctattgggtgtaaggtgtatgccaaatgctcaaagcatgggagtgtaagtcgcggcagaattcgctatgtgtgttgatggtgggggattcagcttaaggcaggatgctagggctggattttgcttcttgtagcagacttgaacaggatgcttctttgatgtatcgacagaccccactgcttgaatcaccggttccgatccgtgtatcgcataaaaaaaaaaaaaaaaaagcggccgagggccggcccggtaccc

SEQ ID NO: 12710 - DNA, 704 bp, Zea mays
  misc_feature (672)..(672): n is a, c, g, or t
ctcccgcccggccgggccgggagaaaacccctacagttcatccctctcgacgcgccgccgccgtctcgccgctgcccacccagattgacggctccaattggcgcccatggcggaagaaaccaacataaaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaacgttcgtgagatgtggaccgaggtaccaaagaccggtaaaggcaagaagaaggctctcccggtgaacaaggacaggttcataagcaagatgttcctccgcggggattcggtcatcatcgtcctcaggaacccgaaatgagtaccctgtacacgtagagagtctgtttgctagcagtacgttgtgctattgggtgtaaggtgtatgccaaatgctcaaagcatgggagtgtaagtcgcggcagaattcgccatgtgtgttgatggtgggggattcagcttaaggcaggatgctagggctgggttttgcttcttgtagcagacttgaacatgatgctcggcaatctcttgtcccccctcaaaaaaaaaaaaacaaaggccccgagggccaanaaaaggaaagcggccaaaaaaaaaggccccta

SEQ ID NO: 12711 - DNA, 1373 bp, Zea mays
gccggccgggccgggatacacagctttgcatccaatagcccacccaccagctgcgaaatctcctccaaacaacaactgaaccggacaaagaaagaaggccaaaaagggagtctcctttccgggttccctccgggctcgaaaattcgaaacgtcccaagagaaaccgaaaccaccataaaaaccagcaaccaaccgtcatcgccgcacaagcgcacgcactcctcgccgtggaccaactccgaagccccatcccgtcccaactcccaagagccgaacgcgagcggcggccgccatggcgcggtgcagcaacggcctcctgggtctcctcaacgcgggcgtgctggtcctcgccatcgtcgcgctggggggcggcgcctggctcagccaccgcgcgtccaccaccgactgcgagcggttcctcgagcggcccgtcatcgcgctgggcgtgctcctcctcgcgctctccctcgcgggcctggccggcgcgctctgccgtgcctcctgcctcctctggctctacctcctcgcgctcttcctcctcatcctgctcctcttcgcattcaccgtcttcgcgttcgtcgtcaccaaccgcggcgccgggtgggtcgtctccggcagggggtacaaggagtaccgcctcggggactactccacctggctgcaaaggagggtggagaactcgcagaactgggccaagatccgcagctgcctccaggacggcaaggtctgccagaagcttgcgtccagaaaggagacggccgcccagttcgtcaacagcaacctctccccgatccagtctggatgctgcaagccaccaacgggttgcaacttcacctaccagagcgaaactgtctggaccaagcccgctggcttcaacaccacaactgacgaccctgactgcaccacatggtcgaacgaccagaccgtgctctgctacgactgcatggcctgcaaggcaggcgtgctggccaacctgaagaacgactggaagaagatcgccaccgtcaacatcgtcttcctgatcttcctcgtcgtcgtctactccgtcgggtgctgcgcgttcaggaacaaccggcaggacaactcgtacccggcctggaaatgaggtgcgcgtggcaatgtataggttgtttatgctatcatgctatgtgagtgactgcgtttcggtgaggaggggttcgctccttggtgtctagcaacctaccgtatgtattaactattaatgtgtccggttcatgtcactggtcgatgctgttttgccctcgaacgcatgatgatagtgtcccaaggctattatccagatatatgccgaaaaaaaatatgcgttttctgtgggcgtgcaaaaaaaaaaaaaaaattttgttgaataaccc

SEQ ID NO: 12712 - DNA, 1153 bp, Zea mays
cggcgagcggggcttcctggaagctgccgttgaccccgacccggaggcataagcataactagggtgtagggggggcggcctgtagtgtagcgccccccgactcccgagcagcaaccaaccagcaaccgagccagccatgtcgcccacccctgcgccggccgcccgcgccggcgaggagctgccgtccactgaggtggtggtggtccggcacggcgagaccgcgtggaacgcctcccgcgtcgtccagggccaaatggacccggagctgaacgaggccggcaggcggcaagccgtcgtggtggcccgccggctgtcgagagaagccaagcccgccgccgtgtactcgtctgatctgcggcgagccgccgagaccgccgagaccatcgcgagggcctgtggcgtatcaaacgtggtgctgacggaggcgctccgcgagaggcacatggggtacctgcagggcctcaggtgggacgacgcggtggacaagagcccggactccttgcacatcgtcaaggtcatcgagggctctgaccccgacagcagaaaccaggagctgcccggcggtggagagagcctgaaccagctgaacgagcgttgcgtctgcttcgtgaacaagatcgcgcaagaacacgccggggagcgggtggtggtggtctcccacggcgcagcgatactggagctctgccggcacaccgacccgccgggcagctgcgtccgcaggcacgtccccaacacctcgctcagcgtcttccgcgtctccgccgccaccgggcagtgggcgctcgagaggtgcggggacgtcggccatctcaagggacacggagacggagacggcttcctggagggctcgttcgggggcgacggggcctcggcgtaaacgtacatacaggcccatcagccgagagctcgcgccagtcttcctttggatcgaaccattctttggttccgatgctgtttggagcttgtattccattgtttttcaaaaagagaaccaaccattggagtttgaaacgttggtcaatttgtggtttacagccttttgctgtagcgccatgcatggcgtttgacaaaactgcggtatctctgagaaaactgtcttcaaacagcgtgatgcatagctctgccctgccggccctgcctactgtttgcccct

SEQ ID NO: 12713 - DNA, 4504 bp, Zea mays
  misc_feature (20)..(20): n is a, c, g, or t
actcattttttcatgtatgnaaaatatcaagtggcaaaagaaagtcatgcacccgcaaggttggagcgagaatttgccgaaccattcacgtttatgtcatgcgtctacgcccattgccccgctagagcccagcgaggcaagcgagcacgcatgtggattctccctttttctcttctcaatggcttcaaccatgtggagacaactcaattatttaagttggtcttactccatctacagtagcgaggtggtactaaagttctcaccataccatgcactagtaactcgcacgcgccccgcgcgtgtttttttgcaatataagtagaaaaaatcgcaatataagtgataacatggtgctctaatgcttgtaagatgcacattaattaaactattcacatatattacaaaagctagaacaaaggctagttctgactgtgtcaacatctgaaatcaagttgttatatttatataaattatcttcaaaaggttgatgcatccatacaccatacataattacacagagcttacaaaataaacacccagaacttcaaagagtgttgatggtagaagtcgacattcagttttgggaatatttctgggtaggttcttcttggatgtgcacgggttcttccttgatcctattggtcagttatgaaaaaacagtgagctattatatatattttactcatgaattaattagctagacggcctgtctcatgagctttgtatttaagtatttccacgcgaggggccaacctacagagtccattggaaaataggttagtaagcggtcagcaatgtctgtaaataattctgcaaaggaaaatgtatgtgttgaaatgtatcgaggaaatgaactgttgtacatatgaatcaatgaaatgcaaataaaatagggatagggtagacgtggtaattaaacctgatggtagcttgcagaattggagttgaacctgatttggtgcatataaagagaaatctactgagttagttgctattagtggcatttctctaacacaccggaatcggactgtgctggggtgtggccaactggccactcctttacttggccatgtttggtttgagggactaaagattagtccttctattttagtctcatttattaatccagcaacacggattcgaagtcggcaagcgatacttaattatgaataaaataataatattatttataagactaaataaatactatcagattgattataaaatagttttttataatgaattattttagagtcgtaaatataaataccgtttattaaaattttatttagttagacgtggactactcaaacccttgcacaatttatttataatagttgcactcggcgatagagggagtagcatttctgtcacggcaaaagcttgggaatatactagtatcaagaaacatctaggagcatgaagctgcgcacctggtccacgtgtcagcttacgaactgagaggacggtatggtagccccgggcgaggcacacgtgagctctcgtcgagacgatgccggtagcctcgtgtgggtcgccggctgcaaatgcgcagcaagtgttccacgccccagtcccagagagcagtgcacatttcgtttcgttggaccccagcacccaggaccaggagacctaatggttccggaaccatcgtggcctctcgtcccagttccgcccttccggtgagaactcgagggagcagcgatgtgaggtcacgagagcgccgtgagaactcggaactcgtctgggcggtctagactccacgcagcgtatagacgacgtggcccattgtgaggatatgactgcaagtctgcagaagccttgggagtccactcttgagccgcgatccagcacgtcgttcttgagttgagcatgaacgtactgcttcccggagctagttcgcggctgttaaaactatacgttccggtgctagaactataaatctgtgtttttttaaaggaaatgacaatcaaagatagaaattttgtcttagtattaaattaataaggtatttatgagagagagagagagaaaacagagagtaggaaggatagtagatgagggaaaaaaggatattctcatacaggtatggaatcatttgattgccgtgatcccgtcactaatttgtttcccgttttgaagctcagatgtcattgagatctaaggtggaacgtctcttcgtctcttgcaatgggacgtggactttggtccaccgacagggggaatatattatatgtaatatagtaatcaaatgcacaaccccccgggtaaaaagggtttatccattgccttcccctttatcgcattaaatctcgattcgactagtcccagtacgaatatgcaagtaaaaccaggatcccgcgaggaaaacgaaagtaaaagcaagatcaccggattggataattagtttcttaatcaggcgccaattagcgagcggaaattgcgaccataaatataaataaacgaggtggcagggcccgccactacagagagagcgtagagacatgttatctcctcacttctcgggccttcctcctggaattccccaaactgccccaccgagaaacttccgtccacggcgtccgggccgtccgatctgtctacgccgcgacacgtgcgcctcagatggaagagcggccgtgcccagcgaccgacgcaaccggggaccattccgccctccggctatctatttaactcgtcgccaacccagggcggaaacccccaatcgcaagctcaagcaaaaacacaaagcgcttaaaccacactcaaaccaaccgccaacaaacaggcctcctagtcccgaccagaacttgctcgtagccccgcccccgagaacccgacagcgcgagatggctcccgagctgatgacagccaagatgaccgccaaggccgcggcggcggcggcggcggtgaagcctgccacgagggcgtacgtgacgttccttgcgggcgacggcgactactggaagggcgtggtggggctggccaagggcctgcgcaaggtccgctcggcctaccccctggtggtggcggtgctgcccgacgtgcccgagtcccaccgccgcatcctcgtctcgcagggctgcgtcgtccgcgagatcgagcccgtgtacccgcctgagaaccagacgcagttcgccatggcgtactacgtcatcaactactccaagctccgcatctgggaggtacgtggacgtactgtgtgtgatgtgtgttcttttttgtttactttttagccttttcttttgcccataattgttctgtagcagtgctcacgtcacgtgtcgattcgtgcagttcgtggagtacgagaggatggtgtacctggacgcggacatccaggtgttcgagaacatcgacggcctgttcgagctcgagaaggggtacttctacgcggtgatggactgcttctgcgagaagacgtggagccacaccccgcagtacaggatcggctactgccagcagtgcccggacaaggtggcgtggccagcggcgaccgccgagctgggccctccgccgtcgctctacttcaacgccggcatgttcgtgcacgagcccagcgtggccaccgccaaggcgctcctcgacaccctccgcgtgactccgcccacccccttcgcagagcaggtgagcggtgtgatccatgcgtggcgtgcgtgcgtgcgtgctcactcttcttaattggcacagcatacagcatgtgtgctcactcatctcgatcgaattcctccccccgcaggacttcctgaacatgttcttcagggatcagtacaggccgatccccaacgtgtaccccctcgcgcggccccggcgccggaggcaccccgagaacgtgcagctggagaaggtgaaggtcgtgcactactgcgcggcggggtccaagccgtggaggttcacgggcaaggaggcgaacatggacagggaggacatcaacgccctggtgaacaagtggtgggacatctacaacgacgagacgctggacttgaagggcctgccctcgctctcgcccgacgacgacgacgaggtggaggcggtggccaagaagccgcttcgcgcggccctggcggaggccggcacggtcaagtacgtcaccgcgccctcggccgcgtgatcccgtgctctggccttcccccaccgcgcaccgtaccggtggccgcgcgctatagcttgtgtgtgtgtggccatcgcggaacataagaagaatctctcactataaaggccttcgttctgtgtttgcattttggttttggattagggtgtctaatttttcaccagttccttttccccttgtgtaagtgtggagcttactatatagctagcgcccatttcaaggtgctgcaagcgttggtcaggaattgggctagagtgtttgtcctgtaccgagggattatgtgtatttttgctatttcgctcggtaaattaatacaataataaaaaatagggagccgcaaaattatggccaaaaaaaaaaaaaaaaaggcgccccgcgccttactggtgggtg

SEQ ID NO: 12714 - DNA, 4343 bp, Zea mays
taggttttgaaagaaattattcaaggtgaggcattcattctctaacaaaggatgatcagtttcataactttttagttttatgggtcatgactttggtcttttgcaccgttgttgtatatggcatatcgaacgaatgctaactcctgtagaagtggagtttattttaggggtgtggtttgaagaatcaatctattctatatgtggtgtatcatgaatctattccataaatttggtggaataaactcatttatcatattattattaactattaggttacaaggaataggacgatgatggatcaactcgttccattttctacaaactaaacaagaaattgagcagtgagaatatgatggactacctcgtccctcaaactaaacacgttattactatatggtgtaggaaacaagttctacaatgatgtaataaataaattgtacaatgtcatgtgccacgcaataaaaaattatatccttttgtttttccaattcaccattatagacgcgtcagataaaatgcgcctctgcccagacgcgctctattctataaacgctcctcatcatagacgcgctttgtggcgaattttttttgctactttcatcaaccaataagctgaaatgtcagctcaataaagctagtaaaattacaattctccctctgtttttagatgtcacattaggtgaccgttagtttcaaaattctatagttttacaacaaggaatgatgcattgcaaaaatatttaagtgaacctaaaaatattaatctatacaaatattttgaatttaacaataaaaatagattttttttgacttagtataaaatcaatatggcatttatagaaaaaacagggagcaggaaggatagaggattgggtaagtatattgtcacattgtgacattgacgtgatttatcgtgatcgcatcactaatttgtttcccattttcaagctcagatgtcaataagatctgaggtggaacgtcctttgcaaattgcaacgggatgtgtactttggtctaacgtcaaggaatatttggtcctttgctgcattattaatatatataataattaaatcaaatctacaaataagcaaacccgggtaaaatggcttatccattgccttccatatttggccctttgctgcattattattaaatctcgattcggctagcactcactgtcgctccagattagagtactggcatgtacaaatatgcaagttaaagcaggatccggcgaaaaaaatgaaagtaataaagaacatgatcaccgggatggatagttaatttcctactgaaacgccaattagcgagcggaaattgcaatcataaataagcgagctcgcagggcccgccgctacagagagcgtagaggcctgaacgtggtaaacaaatctccccacttctcgggccttcctcctggaaatcgcggaagtgccccaccgagaaacttccgtccatggagtcctgtccgttcgatctttctacggcgcgacacgtgcgcctcagatcgtccgcgcccacgcccagacaccgacgcagccggggaccattccgccctccggctatctatttaagccctcgccccccctcgacccggccgcgaagcgaaagctcaagcaaatacaagctctcagttagaccacactcaaaccagccacggacagcctcaaaatcccgagcaggagctcgctcgtagccccgagaacccgaaagctctgcagcgagatgtctcccgagctgaccggcaagatggccgccaaggccgccgccgccgctgcggcggtgaagcccgcgacgagggcgtacgtgacgttcctggcgggcgacggcgactactggaagggcgtggtgggcctggccaagggcctgcgcaaggtcggctcggcctatcccctggtggtggcccttctgcccgacgtgccggagtcccaccgccgcatcctcgtctcgcagggctgcatcctccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacgctttgcccgtaactctgcggtgctactgctcaccacatcatgtcgccgttttcgtgcagttcgtggagtacgagaggatggtgtacctggacgcggacatccaggtgttcgagaacatcgacgagctgttcgagctcgagaaggggtacttctacgcggtgatggactgcttctgcgagaagacgtggagccacaccccgcagtacaggatcggctactgccaacagtgcccggacaaggtggcgtggccgaccaccgagctgggccctccgcccccgctctacttcaacgccggcatgttcgcgcacgagcccagcatggccaccgccaaggcactcctcgacaccctccgcgtcactccgcccacccccttcgcagagcaggtgagcagcgatccacggcccggccgtcttgcgagctctcgtattttgtttaaaatttggcagcagcgtacatatatgctcacgcacgcactgttttgcaggacttcctgaacatgttcttcagggaccagtacaggccgatccctaacgtgtacaacctcgtgctcgccatgctctggaggcaccccgagaacgtccagctggagaaggtgaaggtcgtgcactactgcgcggcggggtccaagccgtggaggttcacgggcaaggaggccaacatggacagggaggacatcaagacgctggtgaacaagtggtgggacatctacaacgacgaggcactggacttcaagggcctgcccctctcgcccgccgacgccgacgacgaggtggaggcggtggccaagaagccgctccgcgcggcgctggcggaggccggcacggtcaagtacgtcaccgcgccctcggccgcgtgaccccgtgcttcggcttcccgccggtggccgcgctatggcttttgcgcggtcctcacaagtccgtaaagaagaatctcactataaggcctttgttttgaattttgtttatgaattagggtgtctaattttggatcagttcctttcccttgtgtgtctatttagggtgtgagcttatatatatatagtaccaattcaaggtgcaagcgttcgtcaggaattgggctttatgaatacgcccttcggtcacagctagagtatttgtcctgtaccgagggattatgtgtattttgcttggtgaattaatatataaaatacgaagccgagaaaatatggacacatatctgccagattcgatgtcgctcgccggcctggtggtgatgctgctgtcgttttcgtgtttttgttccccgatttctttcttcgacgtctttttcctcggttttaaaggccagactgtttctccaaaacagatgcgtgcgctacgcctatattttccctttttttttcgtatggcgcttgagagttccttgatgattctggatagttcggacattgctctgcgatgcttccgattatgaataacaatgggtcgagttcagggctgatgtaccatttgcggatctagatttgtaactgaaacccgactaaacccaaaaagtgtcatgggaaaaaacttagcctcgcacccacacccgatggggactgaaaccctcaaacatgccagcaaaccgccaaaaacccacatgttccgaccaatatacatgtattcgactgctagttttctcagcagacaatggttgaggttgcacttgctactgttgtgcaccttagctatctcattattgcagcagttgcacctgcaaattcagtatacaagtgtaaagcccaaaattcgtataagagaaaaataataaaataaataaataaagaaataaaatagtaaattcagatatctcaaactatacttgagttttgaaaattgaggaatgaattttgaaaccaaaaattattttagaaaagaagtaatagaaaggttttatattcaactaaatgattacacatttcattaaatgatgcactataagcattatttgcatgaatattgaatttagatgactcaaatctagactagactttttaaaattaacacataaaattgaaactcgggaaaataaataatagagagaatactccttgctcgaatattatttttagagggtcaacaaaaaaattataaaatataattttgcaccatgttgggattttgagttttgcttaggcataaattgaaatttagaatctaaacttggtttgaattggatttgaaataagaaaacagaaaatattgaaaaagaaaaaaggaat

SEQ ID NO: 12715 - DNA, 854 bp, Zea mays
tgcagagcaggtgagcggtgtgatccatgcgtgccgcgtgtgacacgtccggctcctcctgatcctgtcttaattggcacagcatactacagcatgtgctcactcttctcgaattcatcctcccgcaggacttcctgaacatgttcttcagggatcagtacaggccgatccccaacgtgtacaacctcgtgctggccatgctctggaggcaccccgagaacgtgcagctggagaaggtgaaggtcgtgcactactgcgcggcggggtccaagccgtggaggttcacgggcaaggaggcgaacatggacagggaggacatcaacgccctggtgaagaagtggtgggacatctacaacgacgagacgctggacttgaagggcctgccctcgctctcgcccgacgacgacgacgaggtggaggcggtggccaagaagccgcttcgcgcggccctggcggaggccggcacggtcaagtacgtcaccgcgccctcggccgcgtgatcccgtgctctggccttcccccaccgcggaccgtaccggtggccgcgcgctatagcttgtgtgtggccatcgcggaacataagaagaatctctcactataaaggccttcgttctgtgtttgcattttggttttggattagggtgtctaatttttcaccagttccttttccccttgtgtaagtgtggagcgcccatttcaaggtgctgcaagcgttggtcaggaattgggctagagtgtttgtcctgtaccgagggattatgtgtatttttgctatttcgctcggtaaattaatacaataataaaaaatagggagccgcaaaattatggccaaaaaaaaaaaaaaaaaagcggcc

SEQ ID NO: 12716 - DNA, 1538 bp, Zea mays
gcacgagacccattgggtccctcgaggccggccgggaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggcggcggcggcggcggcggcgaagcctgccacgagggcgtacgtgacgttcctggcgggcgacggcgactactggaagggcgtggtggggctggccaagggcctgcgcaaggtccgctcggcctaccccctggtggtggccgtgctgcccgacgtgcccgagtcccaccgccgcatcctcgtctcgcagggctgcgtcgtccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacggcctgttcgagctcgagaaggggtacttctacgcggtgatggactgcttctgcgagaagacgtggagccacaccccgcagtacaggatcggctactgccagcagtgcccggacaaggtggcgtggccagcggcgaccgccgagctgggccctccgccgtcgctctacttcaacgccggcatgttcgtgcacgagcccagcgtggccaccgccaaggcgctcctcgacaccctccgcgtgactccgcccacccccttcgcagagcaggacttcctgaacatgttcttcagggatcagtacaggccgatccccaacgtgtacaacctcgtgctggccatgctctggaggcaccccgagaacgtgcagctggagaaggtgaaggtcgtgcactactgcgcggcggggtccaagccgtggaggttcacgggcaaggaggcgaacatggacagggaggacatcaacgccctggtgaagaagtggtgggacatctacaacgacgagacgctggacttgaagggcctgccctcgctctcgcccgacgacgacgacgaggtggaggcggtggccaagaagccgcttcgcgcggccctggcggaggccggcacggtcaagtacgtcaccgcgccctcggccgcgtgatcccgtgctctggccttcccccaccgcgcaccgtaccggtggccgcgcgctatagcttgtgtgtgtgtggccatcgcggaacataagaagaatctctcactataaaggccttcgttctgtgtttgcattttggttttggattagggtgtctaatttttcaccagttccttttccccttgtgtaagtgtggagcgcccatttcaaggtgctgcaagcgttggtcaggaattgggctagagtgtttgtcctgtaccgagggattatgtgtatttttgctatttcgctcggtaaattaatacaataataaaaaatagggagccgcaaaattatggcc

SEQ ID NO: 12717 - DNA, 1557 bp, Zea mays
tgggaccctcccgcccccgcaatcgcaagctcaagcaaaaacacaaagcgcttaaaccacactcaaaccaaccgccaacaaacaggcctcctagtcccgaccagaacttgctcgtagccccgcccccgagaacccgacagcgcgagatggctcccgagctgatgacagccaagatgaccgccaaggccgcggcggcggcggcggcggtgaagcctgccacgagggcgtacgtgacgttccttgcgggcgacggcgactactggaagggcgtggtggggctggccaagggcctgcgcaaggtccgctcggcctaccccctggtggtggcggtgctgcccgacgtgcccgagtcccaccgccgcatcctcgtctcgcagggctgcgtcgtccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacggcctgttcgagctcgagaaggggtacttctacgcggtgatggactgcttctgcgagaagacgtggagccacaccccgcagtacaggatcggctactgccagcagtgcccggacaaggtggcgtggccagcggcgaccgccgagctgggccctccgccgtcgctctacttcaacgccggcatgttcgtgcacgagcccagcgtggccaccgccaaggcgctcctcgacaccctccgcgtgactccgcccacccccttcgcagagcaggacttcctgaacatgttcttcagggatcagtacaggccgatccccaacgtgtacaacctcgtgctggccatgctctggaggcaccccgagaacgtgcagctggagaaggtgaaggtcgtgcactactgcgcggcggggtccaagccgtggaggttcacgggcaaggaggcgaacatggacagggaggacatcaacgccctggtgaacaagtggtgggacatctacaacgacgagacgctggacttgaagggcctgccctcgctctcgcccgacgacgacgacgaggtggaggcggtggccaagaagccgcttcgcgcggccctggcggaggccggcacggtcaagtacgtcaccgcgccctcggccgcgtgatcccgtgctctggccttcccccaccgcgcaccgtaccggtggccgcgcgctatagcttgtgtgtgtgtggccatcgcggaacataagaagaatctctcactataaaggccttcgttctgtgtttgcattttggttttggattagggtgtctaatttttcaccagttccttttccccttgtgtaagtgtggagcttactatatagctagcgcccatttcaaggtgctgcaagcgttggtcaggaattgggctagagtgtttgtcctgtaccgagggattatgtgtatttttgctatttcgctcggtaaattaatacaataataaaaaatagggagccgcaaaattatggccaataaaaaaaaaaaaaaaaggcc

SEQ ID NO: 12718 - DNA, 1585 bp, Zea mays
gcacgagccattggtacctcgaggccggccgggggaagcgaaagctcaagcaaatacaagctctcagttagaccacactcaaaccagccacggacagcctcaaaatcccgagcaggagctcgctcgtagccccgagaacccgaaagctctgcagcgagatgtctcccgagctgaccggcaagatggccgccaaggccgccgccgccgctgcggcggtgaagcccgcgacgagggcgtacgtgacgttcctggcgggcgacggcgactactggaagggcgtggtgggcctggccaagggcctgcgcaaggtcggctcggcctatcccctggtggtggcccttctgcccgacgtgccggagtcccaccgccgcatcctcgtctcgcagggctgcatcctccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacatcgacgagctgttcgagctcgagaaggggtacttctacgcggtgatggactgcttctgcgagaagacgtggagccacaccccgcagtacaggatcggctactgccaacagtgcccggacaaggtggcgtggccgaccaccgagctgggccctccgcccccgctctacttcaacgccggcatgttcgcgcacgagcccagcatggccaccgccaaggcactcctcgacaccctccgcgtcactccgcccacccccttcgcagagcaggacttcctgaacatgttcttcagggaccagtacaggccgatccctaacgtgtacaacctcgtgctcgccatgctctggaggcaccccgagaacgtccagctggagaaggtgaaggtcgtgcactactgcgcggcggggtccaagccgtggaggttcacgggcaaggaggccaacatggacagggaggacatcaagacgctggtgaacaagtggtgggacatctacaacgacgaggcgctggacttcaaggccctgcccctctcccccgccgacgccgacgacgaggtggaggcggtggccaagaagccgctccgcgcggcgctggcggaggccggcacggtcaagtacgtcaccgcgccctcggccgcgtgaccccgtgcttcggcttcccgccggtggccgcgctatggcttttgcgcggtcgtcacaagttcgtaaagaagaatctcactataaggcctttgttttgaattttgtttatgaattagggtgtctaattttggatcagttcctttcccttgtgtgtctaattagggtgtgagcttatatatagtaccaattcaaggtgcaagcgttcgtcaggaattgggctttatgaatacgcccttcggtcacagctagagtatttgtcctgtaccgagggattatgtgtattttgcttggtgaattaatatataaaatacgaagccgagaaaatatggacacatttctgtcccaaggaggcaaaaaaaagctcaaaaaaaaaaaaaaaagggcggccggctcgcgat

SEQ ID NO: 12719 - DNA, 1505 bp, Zea mays
gcacgaggcgcacccagtcccctccaatccgtggcgcgcacccatcaggcgcacccatcagaattagaaagctgaaagcctgagcctgactaccgacgagtgacgagccatggagctccgcgagctgggcggtacgggtctccgcgtcagcaccgtcggctttggtgcctccccgcttggcaacgttttcggggacgtgccccgcgacaccgctcgcgccgccgtccgccgcgcgctcgacctcggcatcaacttcttcgatacctcgccgtactacggtggcacgatatcggagtcagtcctcggagattgcctccgccacgcggccgttccgcgggaccgagtcatcgtcgccaccaagtgcggccgctacaaagacgagggtttcgacttctccgccaaccgtgtgacacgcagcatagacgagagcctcgcccgactggggctggactacgtcgacatcctccacgctcatgacatcgagttcacccatctcgaacagattgtgaatgagacaattcccgcactccagaagatcaaggagaatgggaaggcacggttcattggcatcaccgggttgcctctcagcatctacccttatgtcctcgaccgtgtagcaccaggctcggtggacgtgattctatcttattgtcactacgggatcaatgacacctcccttgttgatctgctcccctacttgaagagcaaaggtgttggggttatcagtgcttcgcccctctccatgggtcttttaacagataatgggccaccggagtggcaccctgcaccagaagaacttaagtcagcatgcaaggctgcagcagatcactgtagaaagaaggggaaaagcattacgaagctagctatgcagtacagcttaatgaacaatgaaatctcgacagttcttgttggaatgaactctttggaacaggtggaggagaatgtggcggctgcactggagttgtcaacatcaggcatcgatgatgaacttctgcgtgaagttgaagcaattctcgagcctgtgaagaatctgacatggcctagcggcatccaacaagcctgacggccagaagcagctttgcctaactggagaagctggcatgatgagcgtataactgctgttcgatgcagtcaattgtgcacaccagcatcattggctgctgattgcaaaatttgcaatgcccgtatggtcattgatggaaggggacgattgggactgttgggcttttatggttgggccctgtggtaatttagacatgtcgaataaacgcgatacgagcaatgaaagatcgatgctgatcattgaataagccaaaccaatacggccatacatctagggtggagtaaaacacctgttagttttgctgccagacaagcaattgcgcacccctcttagtgttgtttggttcacataatttagtgttgtttggttcacataattgtacgggtaatcgataacgttaaatcatatttgtttaaatccaaccgtaattaaatatcacact

SEQ ID NO: 12720 - DNA, 6059 bp, Zea mays
  misc_feature (1004)..(1004): n is a, c, g, or t
caataattaatgtatttgttttatatatgtgtctagatttattatcatccgtttgaacatagacataaatattaagagctaaaacgactaatattttggaatgaagattagtatatagatatgtgcattattcatttcttctcacctagatttggtaaagagctaaaacgactaatattttgtaacggagagagtgttacatatatgtgctatgtgcattattcatttcttctcacccagatttggtaaatggcagggccttgggatgctgacgctgtcatcagttttctcatcgcctcagcaatgccgtgactccgccgacgacggagaaggtatatgcccgccttcctcgcttcagacggccttcttctacgcctccctctacttggtggccatcgcccagagcgggcacaagccctgcgtgcaggccttcggcgccgaccagttcgacgcgacagaccccgacgagtccgtgtcccgggcatccttcttcaactggtggtacatgggactgtgcaccagcgccaccgtgacaattgcgctcatgagctacgtgcaggacaacgtgggctgggccctcggcttcggcgtgccgtccatggccatgctactcgcgctcgccatcttcctgctcggcacgaggacctacaggttctacggctcccgcggtggtgccggtgccagtgccagcgcgtcgtcccttttccgcaacgccttcgtggcctggaggaaaaggtcgcgtgaagtggagctgggacatggtgagctcgcccaggacgatgccgtgctcgcggaagaggtgaaggggctggcgaggctgttcccgatatgggcgacgtgcctgctctacggcgcggtgttcgcgcagccgcccacgctcttcacgaagcaggcggcgacgctggaccggaggatcgggcggtcgtcccaggtacctcccgcggcgctgcagtgcttcctcggcgccagcatcgtcacctgcatcgtgctgtacgaccgcgtcnctggtgcccgtgacgcgcagggtctccggcgccgcctcgggcatcacccatgctgcagcggatcggcacggggatcgcgctgtcccttgtcactctagtcgtcgccgtgctggtggagatgaagcggctgcgagcggcgagggacgccggcggcggcggcctggtggacggctctggcaccggcacggcggcggtccccatgagcctgtggtggatcgtgccgcagtacgtgctgctcggcgccgcggacgtgttcacgatggtcggcatgcaggagttcttctacgaccaggtccccggggccctcaagagcctcgggctggcgctctacctcagcgtcctcggcgtcggcagcttcatcagcagcttcctcatcacggtgattgatgccgttacgacgaggaacggaggcaccagctggttcgccgacgacctcaaccggggtcacctagactacttctacctgctccttgcagcgctcgccgcgctggagcttctcgctttcgcttacttctcaacgtcttacgtttacaagacaaaggcaggcaatctctaatctccgtggacagaggcatgcatgtcagcatatgtatgtttattatagatagaaggattgcatggcagcgttcttcagtgtccttgcaaactaaaatgggctgcgtttagcgcgcagacagcaaagtactagaggctatcgggaaattgtaaaatggaggtgtactacggtcacaagtggggcacaataataatgaaattacgtgcttcacaaagcataaaattgtgcaaaaacaagatttttttagggtgcgtttagctagcagcctgacccccgcgcgcaatgcaaaattttatgttcagaattagtccaaaacatagcaatgccgtggatgataatttgatcatcagcagtaacttgatgaagatcacaagttcacaacggcacaccaggggcggacacaattactagactttgccttttcttgtcattttcttattggtaatccttcagtaccatgataaagagcttcttcaccatattataaagctacagccttgaggttgaggcgcgcaaaattatccaacactccgaacagagctgaatcagagctgaatccaacgacctagacgtactggcagacgaagcagagcagaggtcagtaggtcacctggctggctcctggctcaatcctccagctcggcggccggatcggccagcgtgggcagcacagggtacttgcgcgagaagcacgcgtcgcagtagttccccgactcctcgccgtagatgctgtgcagcttgtccagcgagaggaaggcgagggagtcgctgccgatctcccggcgcacgccatcaaggtccatccggttggagatgagctcgccctcgctcggagtgtcgatgccgtagaggcaggagcccacaacgggcgggctcgcgatccgcatgtgcacctcccgcgcgccggcgtcgcggagcagccgcacgatcttgctcgaggtggtgccgcgcaccagggagtcgtccacgaccacgacgctcttgccggtgatgacgccgcgcacgggggcgagcttcagcttcacggcgaggtcccggatcgcctgcgtcggctggatgaagctgcggccgctgtagtgccaccggatgagaccctgctggaactcgagccccgacgcgcgtgcgaacccgagcgcggcgtagaaacccgagtcgggcaccgggatgacgacgtcggcgcccggggcaggggactcctcggccagcgcctgcccgaaggcggtacggcgctcgtggacggcgtgcgagaacaccaccgagttgggcagcgagaagtagatgtgctcgaacacgcaggcgcggcgggggcggtgcgggacgaggcaggccgaggccaccgacatgtcgcggcggtcgaccacgaccacctccccaggctccacctcgcgctcgtaggtggcgtcgatgaggtccagcgcgcacgtctccgacgcgaagacgacggcgccgttccggcggcggcccatcaccagcgggcggaacccgtgtgggtcgcgcacggcgaagagcttgtcggccgtgaggaacaggagcgagtaggcccccgcaaggcgctcgcaggcatcgcagacccgggcgaggaggggccgcgacagcgacgtcgcaatcaggtggagaatgacctccgtatccgaggacgtgttgaagatggatcccctggcctcgagtttgttccgcagagcttggtagttgacgaggtttccgttatgcgccacggcgacctgcccgaaccggtacccggccaggaacggctgcacgttgcgcagcgacgcggcggcgccggccgtggagtagcgcacgtgcccgatggcggcggggcccgggagcgaggcgagccgggacgggtccgcgaacacgtcggccacgagccccagcccggtcacggacttgagcttgccgtccccgcccacggcgacgatcccggccccctcctccccgcggtgctgtagcttctgcagccccagatagcacagcgacgacgcgtctgggtcgcccacgaccccgattacaccgcactcctcgcgcgggtggtcatccgcgtcctcatccacgccgtatgagaacggggtaacgcggtcgggcaggagcgcccgggccgccgcctcacgccggccggagccgcagcgcagcgagagaggatacggactcgcgtagtacctgaggtggtgccggttatggcggtcgctgccagcggctgcgtagcggtagaggagacgggacgtggcacgtcgtggcggcggcggcggcggcgacaattcccattcccgcttatttgagagatcgaggggatttggggcgggcggcggggcgagccgggcccgcgggccgatgcctctctctggctgcgcgtcaatgggccagatttgaagaagtcttggcgattggcgagtgcctgactgccgctggattagggcccgtttggttcaccatctgacattacagtttgtcaattttttctatctaatggtagttctttaatttagccgaataatctttaggacagttagacgagaaccaaacagaccgtctatataaggtttcgagaaatttgctattttgccactctcaattttggctgcctgttattatgccatcccgtgtctatgactggtgggaccgtctgtgtctatgatttgtgggcccgatggcatactggcgaagcccacaaatgataatggcaaaattgccattggctcggtttcatatagcattggccaatatccactacttgtgtggtgtagccggtgattgatatcgacagtcacacctccaataataggtgactcggtcggtcgatcaatggatcgatggatgtcatggtttaacgatatacgatttggtcgtttggtgggttatcgaatggtcatcaatgtcgatactaattgtggtgagatcgggtcggtcggtaccgactgtgacgttggagcgcttgaactattgattaggcacaatcaataccaacaacctatttgtgtggtgtcgatcaattggttgacgttattttaacaaattgaatttttaaaaatccaaaaaaataaataaaaaacatgaatccacccctataaagagaggggtacttattcagtcacacaccttcctctctaattcacgtgtcctctccttcattcgtagccttcctctctatgtttcaatatagattcgatgtagagtatcaaatttgatatgttcacgaacttgctcaacgagcaattttcacaacatcccaagacctctgcttatgtcgggcaagtcttattcgatggtctttcttctgtccatcatcggcgagaggatattcctgctcatcctcgttttctaactctgcaacctcacttttcttatttgtattctccatatccataccgaccaagtgttgatgtgcctcctcttactaatcctccaacaactgatgctcctcctaccattgaagccccttccatcgatgcttttcctccacaaccttttgtgtatttgtatcctcctacatacccttagggctagtttggaaactaaaatccccttcgggattgaaggggattgaagagaaaattagtttatttccacctcaatcccctccaatcacgaaggggatttgaggttcccaaagtagcccttaggaatatccgccttatgggtcgtatgacgctcctcctacatatgctcctccttatggtgttcctcatagatggtactagcaaggggttcacaggagcactagtgacatagggagagcatgggcgcgctggctcaatggggtcagtggtggtgtgtggagagggctcgatgggctcatggaggaggacatgggaagaagaagacaatgagaaaggcatgggaaagaccaaagttatagggggacactttaacactgattctttcatagaatcaatactgaagacttttcgacggaaaccaaaaggacaccttttagtgtcgatttaaaaagaactgatactaaatacttttgggctttaactaatagttctgggtgggaaccaaagttataggggcacttttggaactaaaacttctaggtgggaactgaaaatggacctttagtaccggtactaaagacatttctgttcttggcggcaggtcgaggtacatgagtatcagttggagttttcaactagtactgatgacttaacattagtataggttgtggacaccaactaatactatcggcatctgtcgataccctaaatattgggtacccactcctgttgggtcaaggcgagacccatgtggctgcccatagccatggaaccacttgatgtctagcctgactcagggctcgggccccaccatatgtgacctagggctagctaggcatgtctcctgggttggaccgacataaccacaagtcccatagagaggagtaatcagcaacttcgaccgtaggtctggggccccacagacggggcctggacctccacatgggacttctggatcccgcaagggaggtctggagcagctccatgcccttggagtaaaacact

SEQ ID NO: 12721 - DNA, 954 bp, Zea mays
cattgggtacctcgaggccggccgggaccggccggggcttcatctcctcctttcctccccaaaagacacaagagggggaagagagagagaggagaggcagagagaagagggggaggcagtccagtgtccacgcacgtacgctccacagaagagagatggcgatgcggatggcggcggcggcggcagtggcgctggtggcggtgatgggcgtgctggcgccccgagcggcggcgcagacgccgaactgcgcggagaagctgatcccgtgctcgccgtacatgaacacgacggggacgccgccggatacctgctgcggcccgctcaaggacgccgtccagaacgacctcaagtgcctctgcgacctctacgcctcgccggagatcttcaaggccttcaacatcagcctcgaccaggccctcggcctctccaagcgttgcggcctcagcgacaccaccgccgcctgcaagggcctttctcctacgcagtctcctccaggttcgccgccatcaggcggcagcagcaacgccgcccatcgcgctctgccggccagtttcgcgcgactggtgacgagcttgttcctggctctgtggtctgtattattggcgtaaattaaaagctccgcatgctgcaacgggcggcaatgcttgttgcttgtcttatcccacagtagatgatttcacttgcacatacgatacgatcaacatttgttttgctgtgctgtgtgtctgatgagatcagaatttctcattggttccttcgtggtgttcgtgttagactccgcacaattaaatggaaggtttctggctagttgctataccatgtgtattgtgtatgtcagtatatgtgcatgcttcatggttccctcaccagtacagatcactgaaccactttgtccgctgatagctacatggaacgcgaagcagccactacaaaaaaaaaaaaaaaaaagggtta

SEQ ID NO: 12722 - DNA, 878 bp, Zea mays
gggttttacaaaaggcactaggcaccacctttcgtggcttcctctgctctcctccacaaaggcagggaagcagcaacactgtagcagggaggagagggtaggcagtctgtccactgtccacgctgcagaagagagagatgggggtgcgggcggcggcggcagcagtggcgctggtggcggtgatgggcatgctggcgccccgagcggcggcgcagacgccgaactgcgcggcgaagctggtcccgtgctcgtcgtacatgaacacgacggggacgccgccggacacctgctgcggcccgctcaaggacgccgtcaagaacgacctcaagtgcctctgcgatctctacgccacgccggagatcttcaaggccttcaacatcagcctcgacgaggccctcggcctctccaagcgttgcggcctcagcgacaccaccgccgcctgcaagggttcaccatcaggtggtggcagtggcagcaactccggtcatcacactctgtcggtcggtttctcaggattcatgagcttcttgtcgctagccttgtggtctgtattagcataaagtttaggatgctgcagtggacattgcctgtcttatcccacaagatgatttgcacctacgacacaatcaacatttgtcttgctgtgtattgatatggccagccagtagactgatgtctctgaaccatgtgcttgcattagactgcacaattggtccttcgcccaattgttccaaagagtgcttccatgaacttagaccgaagagtgtctccaaggtcagctgtgggaaggttcttaagtccttcgcccaattgttccaaacctctgcaagattattggtaatgtgatcacattttatctcctcaaaaaaaaaaaaaaa

SEQ ID NO: 12723 - DNA, 984 bp, Zea mays
actcctatgggcgattgggaccctcgaggccggcccccacgccgcccgagactgttttacaaaaggcactaggcaccacctttcgtggcttcctctgctctcctccacaaaggcagggaagcagcaacactgtagcagggaggagagggtaggcagtctgtccactgtccacgctgcagaagagagagatgggggtgcgggcggcggcggcagcagtggcgctggtggcggtgatgggcatgctggcgccccgagcggcggcgcagacgccgaactgcgcggcgaagctggtcccgtgctcgtcgtacatgaacacgacggggacgccgccggacacctgctgcggcccgctcaaggacgccgtcaagaacgacctcaagtgcctctgcgatctctacgccacgccggagatcttcaaggccttcaacatcagcctcgacgaggccctcggcctctccaagcgttgcggcctcagcgacaccaccgccgcctgcaagggcctttcacctacccaatctcctccaggttcaccatcaggtggtggcagtggcagcaactccggtcatcacactctgtcggtcggtttctcaggattcatgagcttcttgtcgctagccttgtggtctgtattagcataaagtttaggatgctgcagtggacattgcctgtcttatcccacaagatgatttgcacctacgacacaatcaacatttgtcttgctgtgtattgatatggccagccagtagactgatgtctctgaaccatgtgcttgcattagactgcacaattggtccttcgcccaattgttccaaagagtgcttccatgaacttagaccgaagagtgtctccaaggtcagctgtgggaaggttcttaagtccttcgcccaattgttccaaacctctgcaagattattggtaatgtgatcacattttatctcctccaaaaaaaaaaaaaaaacccccttcaaaaaaaaaaaaaaaaaa

SEQ ID NO: 12724 - DNA, 4467 bp, Zea mays
ctgaaggggggcatgcacaaaaggactgggccccgacatgtgggcccagggacataacgaatatagagcttggatcctctaatgtttgttgccgaggcaatcttcttgtgctctgtcgctcgaggtgcgtatccttggcgtgcaggggaagcttcctgcggaagagaagacgagtatagggtgccgcctggcacgggcgcactgttcgccctgctggatgaacttgacaccgtctgccaacgaatgggacgggacgcattaaatgctgaaggggcacatcgcccgtcagcggggtagtcaggcggcacgtcttctccacaataaatgcaagggcagcgtggcccagtggtcttacgtcaggcccatcccgcaagctcacatcatgcatagtaggccgcttggctgcaccaggtcttcgcctagccagggaataggaacgttgtgtggacaggttcgcaccaagctgggtctggtcacatgtcgccccgggaccccttcctgagcagggtccgggtattctctgccccagaatcccgggatccggcggtgagtagtccggaccccactcagaagggtctgggactcatctcggaggtccgttcatcacgtacgggggtccggtgctttccttgcagtaggtccggacccactgcgtgtatcctggagcacgtccctttccctggccacgtggcaaccccggggcggtcgatgtggcgcggctgagaactgttctacgcgcaaccagagacttctccgctggcacaaagcctttaccttgtaacaaggggtacccctgtttaaaggtacctacaaaaagatattttattttttaaacatttaaagaatttctctaaatgtcaaaaaatttgaggtgttacgtaaactttcagttgatatcagaacacaacacttcatttaggatcgaacgacccgaagttacgtcgtggaaacaatttgtgaaaaacaaggcttactcaccggaggacaacaaggagaaaaacttgagttcatccactcgtgcccaaagaagtcccacaaggggaagggtttaagaaagctcaagaagaatattatgatccaaatacttttttataataacttaggacacttaaataattttaggtcaaaataaataaaaatagtgtccgattataatttaatttaatctttaaattttataatgtaaaatctagatcatattaccatctttaatctcataccctatatatcatccctatttaaacttcaccataaaccgtgtgagactgttttacaaaaggcactaggcaccacctttcgtggcttcctctgctctcctccacaaaggcagggaagcagcaacactgtagcagggaggagagggtaggcagtctgtccactgtccacgctgcagaagagagagatgggggtgcgggcggcggcggcagcagtggcgctggtggcggtgatgggcatgctggcgccccgagcggcggcgcagacgccgaactgcgcggcgaagctggtcccgtgctcgtcgtacatgaacacgacggggacgccgccggacacctgctgcggcccgctcaaggacgccgtcaagaacgacctcaagtgcctctgcgatctctacgccacgccggagatcttcaaggccttcaacatcagcctcgacgaggccctcggcctctccaagcgttgcggcctcagcgacaccaccgccgcctgcaagggcctaattctactttcgtttttatagttttacccaagtaaataaatgttcttcctctgtgtgttcacatgcggttttcccgcatcccattaacagcgatcagttgcaaaagtaagtaaaagcgagcatctttagcgatcaaactgtcttgctcagagcccaatgatcgatctgcgcaagtagaaaccagctgggcttggacccgatgcatgtgacttgcgtgtctgcgttagttgctagtggcgttggcaagttgggtacgtgttgccatctccatcaggtgaacggcaactgcagggaagcatctagtagatgccaacattgaaatgagatccatggtcggtgttgattaaaggctcagagccattaaattaaaattatagctgctgtatgcatgtttcctcagcctgacccgtgatgacgttagtttattaatctagctgtgtgccaggctgctagcttgtcctccattaaaataccatgacctgatgctctcagcccagtattggcagtagaaatcaaagcccattcagaaaatatgcagtgtcagtgtatgagcatggcacgatgtataagagacccatggttttgtttaggacttccgtactgtgtgggttgaacttcataggggttcagaaattctactctgaaagccaaataacggaaccccaaaaccgtgcgctttggtgttaggtgtgctgtatctatcctgtccaggtgttccgtgatcattctatacattaccggcgcgtagttttttcttcaaataactttgatgcgtatctgaaaatcccttgcgaaaagtaaggttgccaaactaaccctaaactttcattttacaggcctttcacctacccaatctcctccaggtaacctatagtgctcttcccctttctttgcttggttacaacactttgttgtgtggtatcttgctgattggaacctccgattaatgtgttcaaacttcaaagtgtgattttaggaaaaattgataaagtcgtatatattgagtcagaaactttcagagaatatgttacttagcaatgggtgaagcacatgcacatccaaatcaacccctaaccaaagttagagcacatcgattgcactagcacgcttaaggtttctgtatggttgggcatggtcccagggattactattgccaacaatgtagtgcatttatttgcagattggaatcgcttctgtatgtgcatacccatctaaaaccagtcattgctactgaaacagataataaatgcactgcgaagtaggaactttcgcctgtttatttgtaagtggtgatatgattgatacaaaacaaatactccgcagagaccagtggagcaccatgtcaggagcgtaattccatcgtaaatgatggtggcccaacactgcttcacatgaacagtctgttgggcctgcctaacagggtgatgctcgcaatgttagtgatgttgcttttactacatgctagtcaccaaacttgctcattttccatgaagtatctaccctgaacccttgtagtgagcatggttagttgttccacctcttaacttttaagttcgaagcagtggttcagtgcacaccacccatccagccaccaaaaaaaaaaagcatgtacacctgactgtttaggtggaactactgaattagctcacatcatatgtcaaccgcaacttcacctcaaatagcacctagaaaatgtaattcgtcatcacaaactccttgtacttgcaggttcaccatcaggtggtggcagtggcagcaactccggtcatcacactctgtcggtcggtttctcaggattcatgagcttcttgtcgctagccttgtggtctgtattagcataaagtttaggatgctgcagtggacattgcctgtcttatcccacaagatgatttgcacctacgacacaatcaacatttgtcttgctgtgtattgatatggccagccagtagactgatgtctctgaaccatgtgcttgcattagactgcacaattggtccttcgcccaattgttccaaagagtgcttccatgaacttagaccgaagagtgtctccaaggtcagctgtgggaaggttcttaagtccttcgcccaattgttccaaacctctgcaagattattggtaatgtgatcacattttatctcctccgaaaatttgcaattggtccatttcaaactatgatgttcttccaaccaacgcttcacgtatatacttgcttcatatatcttattcgttaggtactcatgatgttctagccggaaagtcctagctgcaggatacgttttcccataagcaggctctctatatgtgtgtttggttgtaatgacggaacggaacgatcgcttaaataaggttgttttgttcagtaccagaggtgtgataggattatcacagtgatgtctccagggccatataaacccgttacatgaaatgcaccaaagccaaaacaagccacccctgcaagaaataaatgaattccaaagatcttgggcaaatccaaagaaggttttcccgtccgctcatcacagaatatttctaggtcccaatatacccaatgccagatagctgccaagagacacaagccagaaaacacaatatgcgcacctgccacaccttcataactccaaatacccggattcgttacagttcctcctgaaatactccaaccaccccacgaacctcaaaattaaagggacaagaggagacgacgggagacgtgggtgtgtccgctgtccccaaccaaacacacccta

SEQ ID NO: 12725 - DNA, 1176 bp, Zea mays
ctcgaggccggccgggctctctgagtcgtctagtgtcatgtgatctggatcccattccggtggcttctgccaagtgctgaggatcggcatccggttcggttcgtcgtcctcgtccccactccccacctgcgcagctgcgctgcgccatctcgaatcctctccttccaccatctcgaacctctccttccatctcctccccggccgattcctccagtctccagccaccttcaactgccggccgcaagtggccccgcgtctcacccctaaccccagtgaagaatctaggcgtcgtctatccagccccgtcatcatcaccatggaggagcggggccagcgacaagaacaagtccatggttgagcagctgcagaggtacggggtcatcaggtcgaccaaagtcgcggaggtgatggaggccatcgacagggggttgttcgtgccacctgggggctcgccataccacgatagccccatgccgattgggtacaatgccaccatatcagcaccacacatgcatgcggcttgcctggagctactggagaagaatcttcagcctggaatgcgagctctcgatgttgggtcaggcactggatacctaactgcttgctttgcactgatggttggaccagaagggcgagcagttggtgtcgaacatatcccagagttggttgctacttctactgaaaacatcaagaaaagtgcagcagccccacatctaaatgatggatccctcagtatacacgtttctgatggcagggaaggttggccagaactggcaccctatgaagccatccatgttggagctgcagcaccgcagatcccggaggcgctgatcgagcagctgaagcccggcggcagaatggtgatccctgtcgggacagtcttccaggagctgaaggttgtggacaagaaattggatggcactgtcagcataagagacgaaacgtccgtgcgctatgtgccgctcactagcaaggacgcccagttgcacgcaagctgagtgatctatcatgtcaaaaaaaaagttatcctcacctgacaaggtgaggcattcaatcgaatcgctacccttgtaaatgtattaatcctactgtctcagtaaatgcgctggcttggaaataatgtaaatgatggaacatcatggaacgtttgtttcccttctaaaaaaaaaaaaaaaa

SEQ ID NO: 12726 - DNA, 1619 bp, Zea mays
gaacctctccttccatctcctccccggccgattcctccagtctccagccaccttcaactgccggccgcaagtggccccgcgtctcacccctaaccccagtgaagaatctaggcgtcgtctatccagccccgtcatcatcaccatggaggagcatgggctgtggtccagcggggccagcgacaagaacaagtccatggttgagcagctgcagaggtacggggtcatcaggtcgaccaaagtcgcggaggtgatggaggccatcgacagggggttgttcgtgccacctgggggctcgccataccacgatagccccatgccgattgggtacaatgccaccatatcagcaccacacatgcatgcggcttgcctggagctactggagaagaatcttcagcctggaatgcgagctctcgatgttgggtcaggcactggatacctaactgcttgctttgcactgatggttggaccagaagggcgagcagttggtgtcgaacatatcccatagttggttgctacttctactgaaaacatcaagaaaagtgcagcagccccacatctaaatgatggatccctcagtatacacgtttctggtaaatattagcttgttttgtgctaccataaaactcagccatgctggagcagcaaatttccaacaggtccgatgttgacttaggtgtacatataacaacttagttgctgtgagctgagttatagttcagatgaatatatcattttaatagcacttatcctttttcttttattgactgaataaaggaacctgattcagctaatgaggttgtccatactgctctactagcagggttttgttatattgcttgtcataccatgtggatctcccccatttgtgaggttcttgtcctcgtatgatgaaatttgctgcagctttagagcctgtttggttcgtggctaactgtgcacactttgcttaagtttagtcgtttaaattgaagaactaaccttagacagaaaagttagacaaagtgtgacaatttatgcagagaaccaaacatacctttagtattccttagtctggcactctggccttatgtgcattcagcattgttggttgttctatatacccttaacacttgatgcaccaagagatgtttaaaatggatgcagatggcagggaaggttggccagaactggcaccctatgaagccatccatgttggagctgcagcaccgcagatcccggaggcgctgatcgagcagctgaagcccggcggcagaatggtgatccctgtcgggacagtcttccaggagctgaaggttgtggacaagaaattggatggcactgtcagcataagagacgaaacgtccgtgcgctatgtgccgctcactagcaaggacgcccagttgcacgcaagctgagtgatctatcatgtcaaaaaaaaaagttatcctcacctgacaaggtgaggcattcaatcgaatcgctacccttgtaaatgtattaatcctactgtctcagtaaatgcgctggcttggaaataatgtaaatgatggaacatcatggaacgtttgtttcccttcagctgccccggtgttcttacttactatgcaacttgtttcttcagagcaaaaaaaaaaaaaaaa

SEQ ID NO: 12727 - DNA, 1122 bp, Zea mays
  misc_feature (1062)..(1062): n is a, c, g, or t
cattgggtacctcgaggccggccgggattccggtggcttctgccaagtgctgaggatcggcatccggttcggttcgtcgtcctcgtccccactccccacctgcgcagctgcgctgcgccatctcgaatcctctccttccaccatctcgaacctctccttccatctcctccccggccgattcctccagtctccagccaccttcaactgccggccgcaagtggccccgcgtctcacccctaaccccagtgaagaatctaggcgtcgtctatccagccccgtcatcatcaccatggaggagcatgggctgtggtccagcggggccagcgacaagaacaagtccatggttgagcagctgcagaggtacggggtcatcaggtcgaccaaagtcgcggaggtgatggaggccatcgacagggggttgttcgtgccacctgggggctcgccataccacgatagccccatgccgattgggtacaatgccaccatatcagcaccacacatgcatgcggcttgcctggagctactggagaagaatcttcagcctggaatgcgagctctcgatgttgggtcaggcactggatacctaactgcttgctttgcactgatggttggaccagaagggcgagcagttggtgtcgaacatatcccagagttggttgctacttctactgaaaacatcaagaaaagtgcagcagccccacatctaaatgatggatccctcagtatacacgtttctgatggcagggaaggttggccagaactggcaccctatgaagccatccatgttggagctgcagcaccgcagatcccggaggcgctgatcgagcagctgaagcccggcggcagaatggtgatccctgtcgggacagtcttccaggagctgaaggttgtggacaagaaattggatggcactgtcagcataagagacgaaacgtccgtgcgctatgtgccgctcactagcagggacgcccagttgcacgcaagctgagtgatctatcatgtcaaaaaaaaggttctcctcacctgacaaggtgaggcattcaatcgaatcgctacccttgnaaatggattaatcctactgtctcaggaaatgcgctggcttggaaataatgaaatgatgga

SEQ ID NO: 12728 - DNA, 922 bp, Zea mays
ctggccgggggcttccgcaagtgctgaggatcggcatccggttcggttcgtcgtcctcgtccccactccccacctgcgcagctgcgctgcgccatctcgaatcctctccttccaccatctcgaacctctccttccatctcctccccggccgattcctccagtctccagccaccttcaactgccggccgcaagtggccccgcgtctcacccctaaccccagtgaagaatctaggcgtcgtctatccagccccgtcatcatcaccatggaggaggcactggatacctaactgcttgctttgcactgatggttggaccagaagggcgagcagttggtgtcgaacatatcccagagttggttgctacttctactgaaaacatcaagaaaagtgcagcagccccacatctaaatgatggatccctcagtatacacgtttctgatggcagggaaggttggccagaactggcaccctatgaagccatccatgttggagctgcagcaccgcagatcccggaggcgctgatcgagcagctgaagcccggcggcagaatggtgatccctgtcgggacagtcttccaggagctgaaggttgtggacaagaaattggatggcactgtcagcataagagacgaaacgtccgtgcgctatgtgccgctcactagcaaggacgcccagttgcacgcaagctgagtgatctatcatgtcaaaaaaaaaagttatcctcacctgacaaggtgaggcattcaatcgaatcgctacccttgtaaatgtattaatcctactgtctcagtaaatgcgctggcttggaaataatgtaaatgatggaacatcatgggacgtttggttcccctcaactgccccgaaggtgcgccttactatgcgaacttgtttctcagagcgaaaaaaaaaaaaaaaaaggcccta

SEQ ID NO: 12729 - DNA, 3262 bp, Zea mays
  misc_feature (793)..(793): n is a, c, g, or t
  misc_feature (836)..(836): n is a, c, g, or t
agtcacgtgtctagacggcccggcccgattttctaaccgtgcctggcgggtcgggctttaccgggaccgggccggacggcccatttggacatctctaggtttcgtacgtgagctgcacggcaatcttgccgtctggccgagacgggcggtcgcggggagatagcctgcttgcctaggaacggaacctacctcgcgtagcgtggtccatgcacgtcaacaaccggacatcaaagttgagagcacctttgcgttgcttgaatcattgtggcggcctaatccaaaccctacgctaccaaattatcaaaacaaaaaaaatcatctaaaatacgtattgaagtatatataagcagtgcctgctgctgctgctactgaaactgaacaacgcacagctggaaatgttcacgctgaaaagcactttgcagccgaacctgaagacggggcagcagagccgagtttaatggaccgaacgatctgttgcgctgcaccaaataaaagtggcagcgggtacgtgacatttcggacgttggttggtgcgtaacgaggtggatccacaagtgtccagcagtcaacagttttgtcatgcacgtacactggagcgtaagttatggcttgcatgctgtacctttgtccgctggatggggcggagttatggggtgaaaatgtcggccatagcatgcagttcgagcttcgaccactgtatatatagatatagatagaggatgatgcaaatggaaaataaacgaagcaatttgaagtggtcaggcgtccgtgtcaaataatgggactgctatcnatcatgcatgctcttcaattcgaggacaataggactgatgtcnatttttttcctttttgctgggacaccaagtgccttgggtcgaccgggtacgaaaagttggtgcatgataatgggttaatggtctagctgctgcctgctggttggtgtagcattaacaatatggatccatgcgtccagcaggcagcgctccacagttttgtcatgcatgcacacagggacgtcgaaattgtggcctactacaacatgtcgttcgtcccattgtctgctgacgaaattattgcgatctacgtacggggcacgaatcgacgcgagattgaaaaaaaaacactcttggtcttggaagaggcgagagatagggctagctagggtaactggtgagacatttaaaacgaaaatcaccgtgcgtagtacttcgtacagcctttagcccactgatcattgcagccacacaaattggatcagcgtgctccgtctgttgaatagtaggtggatatatagtgacatttttatctgcaatacagtttacattgtacacacacagtcacacacacaccttattcactcattgcttgtgtcaccagtggtgcgcgtagacgtccgcgaaaccaggcaggcagctggttctgcccacgattaagttacaagtactcaatcgcatcgacccatgggagattactcggagatggagcacacgatagtaaccacgctagcaacacacgacgacgactgagtgtatctctgacgcatgacacacgatgcaagctcatggagtgtatcgtcgtccgttttggcctgcttcctcctggaaggcgccgttcgtgttctgatccatggctccgtccccgaactcctcgtcgttgccgtaccgctgctggtaacccgccgcgtcgccgtagctactgccgcgcctgccaccggcggggccgcggggtcggccgtacccggagccgaactctccctcgtcggggcgcgtccgcatggggttcgactcgcggccgtagccgtacctgccggcgtccacgtcgtagtagtagcggccgttctggtacagcctcgtgtcgctcatcccgaagtcccgctgctcctgctcctgctgcctgccgcggtggaaggccgtgtagtaccacggcgggcggcccctgccgctgccgttttccgggtacggccggacgccctcgaggtctcctccggcgcctcccccctcttcctcggtggcgcccggcacgtcggtgggcggccgacccctgccgctgtcttcggggaacgtcgtccggacgcgctcgccgccggtcgtcgtcgtcagcttctcggtgttgcggtgcacgccacggcggaagtagtccgccgggtacttctcctcgaggcggccgtagagcccgtacccgcggccgccgctgccggcggtcgaggggcgcgagaacgccggcgcggcaacggtgtccccgccggcggccttcttgtcgggctcagcagtggcttcggcacgcgtggtcttgctgaagaagaagcggccaccgccccacgcgtccgccgagcgaggcgccgcgacggccaccaaggcggcgagaaagaagaggtggcgagcacgagcagaggaacccatcgggtccgaaaccgtcggtggtgtgtttttctagcgagccacggtccggcactgctggcccccccgcgcccgcccactcatttataggcggtccggtccggtccgggtccagcgactaccagacagccggcggtgcgggacaatcaggtctcgcagcgaacagcggtagaaagctggtgggagcagaaaggcatcctagacagcgggtgactgatcactcatcagatcatcgggggcgcgccggtgatggcggggggttctggatcgagtgggggagaggagacgggccgggagagagcgtgcgcggcgcggtgtgcatgatggaatttggtgcacgctggctagccgagagcatgtgagatctaggagacacgcttgagggcctcgcattgatggaagtcatggctcgtgaggcatgaccatggagcaggcgattagtctgatttcttggttccggacgtgggcaccgggcgtgagattttaaatgcctactgctcgctccacatgatcatttatcactgcctccagctgctcatgctgctgcaaggtagaattgtgctctgaacctgtattgaattcaccttttgatgattgtagttgtccagccctgactcaagatcatccatcctcttcccgtttgatgaaatgtgtaacacatacctttttttacatataaaactgatcgtgtagggtggctaacaagaagcttgtccacgtgttcataggtaaaggacgcattaatctgaatggagctcgatgggtggagttagtaccaattgcacatccggtgtctcaagaagttcactaaggattatggtatgacattttttcttccgggcaaaaacatgtcaactttgtcgatt

SEQ ID NO: 12730 - DNA, 2161 bp, Zea mays
ccccgcacgtaagctcggaattcggctcgtgagagaagctcggtcagcgaggaattatcaaaggaaactatggagatgctggctgagattctcctactctttctttttactgctctgttcagaaggtgaatctcagcagtaaaaagaaagagtaggagaatggtgcatttgcttgtacagtttgttgtactatgccttgataattccaaggtttaccccttcctcccaaactttcctggccctggtggtttaactccgttgcatcttgctgcatccattgagaatgcagaggatatagttgacgccttgacagatgatcctcaacaggttggtttgacctgttggcagtcagctttagacgaagatggccaatctcctgaaacatatgccaagttgaggaatcataattcatataatgagcttgtagcacaaaagctggtggacatgaagaacagccaggttactataacggtcaatggcgatgaaattcatatggatcagttagggaatgttgatgaccgtaaaaaatctggggttcaggcattgcaaataagatcttgctcccagtgtgccattttggagtctggtgtgttaaggcagcctatgcggtcaaggggactgcttgctcggccttatattcattcaatgcttgctatagcagcagtctgcgtatgcgtctgtgtattcatgcgagctttgctgcggatcaattctggaaaatccttcaagtgggagaggctggattacggtacaatataattgtggggacacacctgagccttgtggtattattaagttaacaagcagttgttatggagctattttggagccttgaagggtatggagattgtttcatgcttcctcgaaactcgcccatccgtatggctgagtggaataatgtaatatttttgctggacaattcctttacttcctgtgaaatagaagtgttaataggtgagcagccggagatgttaggggggtggcaaaacttggtaccaaatgtggagcttgagcagagttggaacatgtcatggcaagggccgtagcaactgcgctcccacaacatgatatgcatgcaatgcacaaaatgtcgatatggatgcaatccgcaagatggatgtaatcacagttcggggagaatgagcaagtaagtaaccttggtttcctttttgctgctgtaagctcgactcttttggttcatgtatcccaagaatgatgtttaatttatcttgctcactgtttcatatttttgtgtgtgtgtgtgtattaaatacagtacgctagcatgaatgtaccctatatcgactttagatagtagcaggggtaaatgaaaagaggctttgcatatgtctgtgtcgaccattttgacttgtagctacatagaaatgaggcagatctgaagtgtacttggatcttttgttgttgttgttgttgttgacatccaccatatgttctcattctgatgaagcttagttaaaaaaaactcctatattgttctcttgatacctgccggctgctatcattatcttggttcactcgcactttccttctgacccaagttttcactgatcaaaatcctattgtatgacttgtttggaggctgaaattcatgttcgtttaagaactttgagcgcgttcggctgccctgcacggagcactgttgcagctgcaaatcactgttgcagctgcaatccctagagagaaaatactgtagaagccgcagccgcagtcggattaaagccgcagcgaacaaggcatttgtaactaggccacctactatccatgtattcctttcgttttttttgttcaagtgtctattgttatgtgaaaacagagtgtggcagcgaactttctgctggcattcggggtgccctgtctcacgttaaaaaaaaaacccgacgggacgcggcgttggcggcgcatcgtgcgctgtccctgttggagatagaggtggaggccggctggtccggaccacgacgatcatgcctggcttggcgccttttcgggcgtcgcggcgtgtggatctccccggggacacggcggcgagattctggccagctgagggctccatctgccgcacctatctgtccatgcgtgatacgcacaagtgggacgcagccactggcgctagctggccggcgggcactgcaggcatgcaagc

SEQ ID NO: 12731 - DNA, 2571 bp, Zea mays
  misc_feature (73)..(73): n is a, c, g, or t
  misc_feature (114)..(114): n is a, c, g, or t
cgacccacgcgggcgccctcatattacagattatggggaagatgctacgatgggtgaagttagcacaaatcanggatggttggcaccaccacttgggcgtcttcgaggattcanagcgtcccatcgagaacggatcgccaccaaatcctggttaccagtcctgctatgcctcaacatcttgttcagatcattcaccttcaacctcaaactcagatggacaggatcggactggtaggattatttttaagctgtttggcaaggaacctagcacaatacctgggaaccttcgtgatgatatagtaaattggctcaaacacagccctactgaaatggagggttacattcgccccggttgccttgtactatccatgtacctattaatgccgggtattgcatgggatgagcttgaagaaaatctcctccagagagtaaactcattagttcaaagttctgatttggatttctggagaaaaggaaggtttttagttcgaaccaactcccagttggtatcatataaagcaggaatgacccgtttatcgaaatcgtggagaacatggaatacccctgaattgacccttgtgtcaccaattgctgttgttggtgggcagaagacctccctcattcttaaaggccgcaatctatctattcctggcacacagatccactgtacaagcatagggaagtacatatccaaagaagttctgtgctcagcatatccaggtaccatatatgatgattcaggtgttgagacatttgacttgccaggacaaccagatcttattcttgggcgctgctttgttgaggtagaaacctggggcaccgcgagccccgccccggttattgttgctagttcaagcgtttgccaggagttgcgaaatctagaagttgagttcgaggattcgcaggttcttgatgtttcttcggatggtcagattcatgattctcggcagccaaagacatcggttcaagttctgcacttccttaatgaactcggctggctctttcagagggcttctgcctgtacatcgtccaccagatctgatgtgtctgatttggatttgattcggttttcaaccgcacggttcagataccttttactgttctgtagtgagcgcgactggtgctctcttactaaaacacttctggacattcttgccaagagaagcctggccagcgaggaactatcaaaggagactatggagatgctggctgagattcacctcctgaacagagcagtaaaaagaaagagtaggaacatggtgcacctacttgtgaagttcgttgtaatttgccccgacaattccaaggtttaccccttccttccgaacttgcctggccctggtggtttaactccgctgcatcttgctgcgtccatcgagaatgcagaggatatagttgacgccttgacagacgaccctcaacagactggtgtaacctgttggcagacagttctagacgacgacggccaatctcccgaaacatatgccaagttgaggaaccataattcctataatgagctcgtagcgcaaaagctggtggacatgaagaacaaccaggtcacagtaagggttaacggcgatgggattcgtgcggatcggttaggaaatgatgttggtgaccgcaaaagatctggggttcaggcgctgcaaataagatcctgctcccagtgtgccattctggagtctggtgtgctaatgcagcccgtgcggtcaagggggttccttgctcggccctatatccattcgatgcttgctatagcggcagtatgcgtctgcgtctgtgtattcatgcgagcgttgctgcggatcaattctggtaaatccttcaagtgggagaggctggattatggtacgatataaactgcccgcccgccggggaagacctgagcctcgtggtaattattgagttagcaagcagttggtggccttggacggtatggagattgttctatgcagggttcggtggcataaggtagtatcgtcgttggacagttccttttacctcatgtgaaatggaagtgttaacatgtgaggagccggagatgtcagatgttaaatactggtaccgaaggtggatgagcttgagcagagctggcacatctgatggagatgttttagacgtaatcacagcccggggggataagaggagtaagtaaaccttgatttccttttttttttcgctggtgcaagctcgtcgagtcttttaatttaccttgctcactattccgtatttcttttattttttgtgaattaaatacagtgctctagcatgaccgtatcttgtatctactttagatatatatatagtagtagaatggggtaaatgaaaaggaggcttgcgtatgggtctgtatcgaccattttgacttgtagctacaaagaaatgaagcggatctgaagtgtacctggatcaacggacgcggggttgttttgtttgggtggggctggactggacgtccagcataggttcccgttctgaagacctttttgtaccgtggtgttttctggtatcaaacgacggggcgcaacgctgaaggcggcgtcgtgccgtgcgctatcgttgtccgaggcc

SEQ ID NO: 12732 - DNA, 3160 bp, Zea mays
aattcggcacgagggttgcttcctgctatcgaggatgggatcttcagtgataattggcgtatccgacaaagttctgttgaacttcttggggatctcttatttaaggtcgctggaacttctgggaaggcaatccttgagggtggaagtgatgatgaaggtgctagtacagaggctcaggggcgtcccacgcgtccggtacttggaagggagaaacgcaacgaagttcttgctgccatttatatggttcgttctgatgtcagcttgactgtccgacaggctgcattacatgtctggaagacaattgtagcaaatactccaagaactctgaaagagataatgccagtacttatggacacacttattgcatctcttgcatcatcttcctcagaaaggcgtcaggttgctggaagatcacttggtgagcttgtaaggaagcttggtgaaagagttttgccctcgattattccaatcctgtcacaaggactcaaagacccaagtgctagcagaagacaaggagtttgcattggtttgagtgaggtcatgggcagtgcaggaaaacaccagctattaagttttatggatgaacttattcctaccattcgtactgctctatgtgacagcacccaagaggtccgtgaatctgctgggttagcgtttagtactctgtacaagagtgctggactgcaagccattgatgagattgtccccacattgctacgagctttggaagatgatgatacatctgcaacagctcttgacggtctaaagcagattttaagtgtcagaacagcagctgttttgccccatatattgcccaaattagtccagcctcccctctcttcattcaatgcacatgcattaggtgctctagcagaggttgctgggccaggtttgaattcacatatcggaactgttctcccagcattgattcttgctatggatgatgaagatgcggatgtacaaaactcagccaggaaagctgctgaaactgttctgttggttattgatgaggaaggagtggaaactttgatacctgagcttctaagagggatcaatgacagtcaggcatcaatgaggcggggttcagcctatctaattggtttcctctttaaaaacactaaattatatttggctgatgaggcttctgatatgatgtcaaccctaataattttgttgagtgatacagacaaggctactgtatcggctgctttagaagcattttcaagagttgttgcatctgttccaaaggaacagctcccgacgcatataaaactagtgcgcgatgctgtctctacagccagagataaagagcgtagaaggcgaaagggtgtgcctattcttgtgcctggcttatgtcttcctaaagcactgcagccttttcttcctatatatcagcagggtttaattagtgggtcggccgagacaaaagaacaggcagctgaaggtctaggagagttaattgacgtaacaagtgagaagactcttaaggaagttgtagtgccaattacaggacctcttattcgcatccttggtgatcggtttccatggcaagttaagtcagctatcctatcaaccctgacaatcatcatcatgaaaggtggaattgcacttaagcccttccttccacaacttcaaactacatttgtaaaatgtctacaggataataataggtctgtccgggcgagggctgcagctgctttgggaaagcttagtgctctcagcacacgggtggatcctttagttagcgatcttctgtccatgttgcagtcaggagatgaatctgtcaaagaaagtgtgctttctgcgcttaaaggtgttatcaaacatgctggtaaaagtgtcagctctgcaataaggtcacgtggatgcgctcttcttgaagatctgctgcaggctgaagctgatgatgtccgcagttgtgctgcaaaagtgattggcacattgtctcagtacatggaggagacagagatttcagatttggtgcaaatcctattgaacatgagcacttcatcagactggtgtaccaggcatggtgctttgttatcgttctcatacatatcaatgcattctccatcaaaattgtgtcatttggcatcctttccatctctggtcgatcttttgaaaggttctctcaaagatgacaagttccctgttcgtgaagttgctacaagaactctgggaaagatactctgttttgagctgcagccagaagctggcaccttgcaacttgttcagctgcttatcttggccttgcgtgatgattcaagtgaagttaggagaagatctttgtcgtgtatcaaagctgctgcaaagacaaatcattcagctcttgctacacatcactctatattgggcccggcaattgctgaagctttgaaggactctagcatgcctgtacgtctagctgcggaacgctgcgcccttcatgttttccagttaacgaaagggccagataatgttacagcagcacaaaagtacctcgggatgactggcttggaagtgaagaaaatcgcaaagcttgacgtggacagtgatggtagtgagagcagcgatgatgacaagaggacatagactctactcaacagcaatcttttttcggttcagttgttatgatctttacatatagttagctacattgatagcggaatgtggggtcattttttctgtctggcccattttgtgtacatcctttttgacaacaaacaggtaaaagtgacaacgtttgcaaatcgacaaacaatggacacaagttgtattgcaaccaaggactgattcgttagtttgagcacagcacaaccacccagttcaacgataacgcatgtcaatgtaagccacgcataccatatagtatcatatcgtcgagtattgttcgtaccacatcttcctcccagttgatctccttgggcaaggtaggcccttccctggacagctcgttgggcatcttgttgagcatgctctctgctctgtacctgaacgctggagtccacgaacagactgctctgagcggcgtcaatgtggataggaatgtaatcggacgtatattactggttccatgtttgttttcatattttctcattggatattaatgcaaatattatcgagttgggcatcggatattaatgcaaatattatcgagttgggattaaaaaaaaaaaaaaaa

SEQ ID NO: 12733 - DNA, 2022 bp, Zea mays
taaaaaatttagaaagaagtttgatttgcttggaatttaaacttaacaaacctcactcagggtgtgttcgtttcttcaggatcgaggttaagaatagttccaggtgatcaaagtttataaaaattaggtaagcatttatggttggattggttctaggtgatggttccagaacaactgaacacaccatcaatttatatagattgagagcgaacggaacatgctctaattgggttatgtgtaggaatctcggcctatatatgttgtgcagtactagatatctgcttgtgcggtcatttgtcgctgaagacgcaatgtgcatcttgagattgatcagtccagtatgctcaggtcttgctgtagtcactgtcaatggcctccggctggcgagtgttctagcagcctggcccagacaactcatgaagtcaagattcatccagcagccaaaggttctcacacaaggagagatgggatctggaatggaggctacgtgaaacctgcgaaataggtgcgctcctcgccgtggattcgcacgtcaccgttttgttgcaatgcaatgaggacgaagagctcctctatgccacaacaagtgtgcgccgatacctttgcccaggtgaaagtgtgtaaaccagcctcttagactcttattaccacatcgcacaactttatactacagctttgcacacttgcacctaaggcttgcttgcagccttgcacagcggtcgttacctcctaaattaggatttctggagcaaaggtctctcatatcctaaagctatttttcagagttctacatttttgattgaaaaataatgttttgaacacattgttcagtgattaaggccatcagaccatcaatcaaatatgttgaacgtacataacctcatcgtcaccaacccataccgttacaaaaagaatacaagctagtcgccaaaactgctgcagcataaataaaataaccaaaacttcatttaatctagtgtgatctctgttacgtaaagtacagcaattaaacagaccaacaagcaaatcatgcgatggcgcttctggtgctgctgataacttccgtcattcacatcgcatgccataatgtgacatgatactcttctcactgtcaaattgctggacctttgcgaccagactataaatgctataagttaccacttgctaacatgtgtgtactttgggagtgtattcgtgaatctgtcgtactcctttggccctttcctccgtttgctgcttcccgcttcccgcttggatgatctatcctttctgaacccatttgcaacatcactactgcctgaggcagtagccttcggcttctttcgcgatttccgtcttgattttggggacttccgttttttagatggtgacgaactagcggccgcgggggtcgattgactatttctgggcaatggttcatcctcgtctatcacatgccaattgtatactgcatcattctcggtgtcaaactgttgggtgatcggctcccagggttccgctaacatatcttcattgttccagcctttccggtcaaggagaactgaatctggtctcacaatggtacccagaatgctcctattatgtcccaaactaataaacaagtttgcatcagttaacacagagtacgccttggaaaatgctgatttcacctgaaagtaggggggggttttccttcgttttcttatgtcgaaatattccagagtaacagtatcatcaaagcaaaaggcaaaatgagttaaagcatcaaacagttccagtatcatttcgttcagaaatttcgggtagcaacttacaaaaccctaaattattttgggtaattcgggtatcataatcgggtatccaaattacccgaacttttatgtgtcaagtactcatgtcattcttaattattaacttgtacatctataattatgtgtaaatgtgcatgacttgtggttgtagattggttgtgttttttatgtccatctataaaaatattcaaactgtacttttataataatttaatagggtacatgcgttttt

SEQ ID NO: 12734 - DNA, 2573 bp, Zea mays
taaatagtaaatattatcgatgttaatgctacgattacatagacgggctggcgacggcaatgccagagagggagagggagagtgcgagagagggagagggggacggcaaggacgcggggtgagggaggaactaaataacattagagtgaaggagataaaaattattctgtatcgtgggttttaaaagttaaaaataaagatttagaaagttgaaaatatagattcaaacaaaaaaaaatcgttggcccgccggcccgccaagtgaaaatagcccgtttatccatcggattcgatccttccgtttgcagtatggatccccaccgccgctcaccggaatacaactccctcctcctcgccggcccgcgcctgggtcctctgaagcaagcccacgcgcgcctcgtcgtctccggccacggcgattccttgccgctcatcaccaagctagccacgctcgcggttgcggccggcgccgcctcctacgcccgcctcctcgccgcctcccacccggcacccgactcctttctcttctgctccctcacgcgcgccaccgcgcgccgcgggctccccgccgccgccctcgccttctaccgctgcctactcgccgccgccctccccttctccagcttcgcattcacctccgtcgccaaggcctgcgcggacctgtccgcgatccgcgctggtatgggcatccacgcccacgccgtcctcctcgggctcggctccaaccggttcgtgcagacgtcgctcgtcgtgctgtattccaagtgcggccagctggatgttgcgcgcaagctgttcgacgcgattcgtgacaagagcgtagtcgcttggaacgcgatgatttcagggtacgagcagaacgggctcgctggaagggcgatcgaggtgtatagggagatgcaaatggccggggaagctccagattccgcgacgtttgtggccacgctctctgcctgtgcgcaggctggcgctttggacttgggacgtcaggtggacaagctcattgtttctgagaggatggagatgaatgtggttcttggtgctgcacttgtgaacatgtatgccaggtgtgggcttgtgaacaaggctcgtgagtggttcaatatgctccaggaacgcaatgtggttacgtggacctccatgattgcaggatatggcatgcacggacatggcggcgaggcagtcaagctattcaatttgatgagacagcaagggccaccacccaatgatgtcacttttgttgcggtgctgtctgcgtgcgcacatgctggattggtaagcgagggccgggatgcttttgcttcaatgaagagtgtctacggattggtccctcgtgttgagcactattgctctatggttgatatgtatggaagggcaggacttcttgatgatgcgatgcgatttatacatgattcgatacccggagagcctggacctgaagtttggacagctatgcttggtgcatgcaagatgcacaaggatttcaatcttggagtggaggttgctgagcgattgatcgccctcgagcctgagagtccatctcaccgtgtgctgctttctaatctatatgctttgtctggtaaaatgaaccatgttgagaaggtgagggatacaatgatcaagagaaggttgaagaagccaataggatatagcttgattgagattgctggtgttgctcatttgtttcgcatgggtgagaagtctcaccccaaaacttcagagatttaccaatatttggagaaactgatccaaaagattactgatgttggttatgtgcctaaaactgactcagtgttgcatgagttggaagaagaggaaagggagtttgcattaagataccatggtgaaaaactggctgtagcctttggactcatgatgacttctgggtgcaccactccaatcaggataattaaaaacctgcggatatgtgaggattgtcatctagctatcaaatatatgtcagccgtggagaatcgagagataattgttagagatatgcaccggtttcaccatttcaaagctggaaagtgttcctgtcaggaatattggtgacgaggcctctctcgcaagctaaaaatctgaggaacaagagctgcaactcagcaacattgggagtgggacaccagcaacaacacctttactacccatcaaaattcacaagagcaagaggacgatgtcgaaaacatttcatttccaaaaagtttggtggagagcaactagattatccttttagttggagacttggagtaggactgatgatttttgtaatggattgttggatggagtctacatggctgaacctgaatggcctggacctgaatggacatcatggtcaattggtcatggctgaacctgaatggacatcatggattcatggtcatggttctcttatttgtatttgtttatgttctatttttggtggacaacaagcatggatgaactgttctgtaatctactttttagtttttggatgaagaaatgcaactatgcaaatgcaagtatctgtattaggtgcaatgaactatgcaaatgcaagtatctgttctgtttagacaaaaaaaaaaaaaaaaaaa

SEQ ID NO: 12735 - DNA, 792 bp, Zea mays
  misc_feature (647)..(647): n is a, c, g, or t
  misc_feature (707)..(707): n is a, c, g, or t
  misc_feature (729)..(729): n is a, c, g, or t
  misc_feature (761)..(761): n is a, c, g, or t
  misc_feature (773)..(773): n is a, c, g, or t
  misc_feature (781)..(781): n is a, c, g, or t
atgagttattggctcgccaactccaggagcagctctacaatgaatctgctcgttttgccccaacagaagagattgatgcaattgtagcaatgtcacttcaacatgaagaagatactcatcggacatctaggaccttaaggaggttccaaaaccatactagaggtgctcgggctactcgtttgagttcttatcgaaatgctcttagggctgaattagcaacagcaaacaatatgatttcccgtcagcggaatactgctccaataaatttgggattgagagctgctttagcaagatatcctggtgctttgcacattcaaccaaacattgacttaaatgactatgatgcactgcttgctctggatgaaaataaccaccagcacactggtgcttcagaaagccagatcaataatttgccacagtcagtagttcagtccaatagcattgaagatccatgttctgtctgccttgaaaatccttctgtgggagatactatccgccatttgccttgctttcacaagttccataaagagtgtattgacgagtggcttaggagaaagaaactgtgcccagtctgcaagtttgggattaactgaagtttgccgtacctcggccgcgaccacgctatacttggtagtggcagcgacgangtgctgcaatttctcatacggggatgccttttcctggcaaaagatttttttttttggtcntaaggttaaaaaaaccaatgtnattgccggtggaaccgcgccttttgggggcancaatttgggtangccccgcncggtttttggc

SEQ ID NO: 12736 - DNA, 1621 bp, Zea mays
cccacgcgtccgactagttctagatcgcgatctagaactagtctgaagatccatgttctgtctgccttgaaaatccttctgtgggagatactatccgccatttgccttgctttcacaagttccataaagagtgtattgacgagtggcttaggagaaagaaactgtgcccagtctgcaagtttgggattaactgaagtttgccgtaccagtctacagtggagttctacttggtagtggcagcgacgaggtgctgcaatttctcatacgggatgctttcctgcagagatttttttttgtctaagataaaaaaaacaatgtattgctgtgatctgcgcttttgggcatcattttgtatgcacgcacgttttcttgctatttttgttgtcgtaatccaccaattcccatgaattggttaccagcatcttgtcaatcatttatgtcgccgcatatatgatccatcaattggcatcaatttatttttattttacgttcttgtaccacgtaacacacgtgtttgcaactttgcaccatgtggattcgtccccactctaattacggtgtgcggagagatacgtaacgaaagtgtttgcaccaaggattcgtccccacgctaattatgttatccgcctccgagcgttaatatatggcagacaattcactgataaggttggccgtcggaaacgctgaccattcggtagacacgcagctggcgggtaaaatatgaaaagaaaaggagctagtgcatcctaaatctaaagtcttaaaacttgacccggtttcggcgcctccccgcacttcgcgcgggttcctggccacgtgcgtgtcggacgcgaaattttcttcgattcaacggagacattcgtcgtgtccgcggtctgcccttccctgtgcgactcggacccacgacgatctcccatccagattcccgcgccgtccctccctccacgccgctgcctccccctcccgacctcgataccgtcaccagtgttgagtcgggttcgcgcacgccatcgcctccacgtctccatcgccaacagcagcgttgctcaccggcgagcgcctcatggtcttcctcttcgcaggccgtgtggcgctcgtggcctcggcacacctcgctgcagcactcgcgattctcgtggcggccggtcggccttgtcgtcgagctcaccggtgacggctccggcttcgccttgcttcgccgcttcgggaccaggtgcgggcgggcagcatccctcccctctctctctctctcctggtgttgttcctttcctatatcactgttttttcctcctgtgctattttttgcaaatggaagcgtttcttcagattttgcgggatctacctgattgcacaaaagtcttgcaatatcaagtttttttgggtttcaaaacccatgatggtactgctatagtgctatttttgcttctcagacaactgaagcttcaagtttgtagtaccgtgatgggcatagtaacatgagtaagaatatcttagggatccaagacttggtgttagatctccaactatctctgggtttccttaccatacctcaggctctgggaaatttcgaagattccaaaaggtgttgcaatgtcaagaagtgtttggtcctttgcagtga

SEQ ID NO: 12737 - DNA, 1968 bp, Zea mays
ttgttctgaagttagcttatcaggcctcaacaacaatggaaaaggaattgactgtgatatcttggatagtgatcaaactggagaagctaatttgagggggtatgttctatctgttctcataatagctgtcttgatctcttttacgactggaataactagttcatttcatgctatagccgttttgagtgctgatatgagctgaaacattttaatattgtcttctcttataaaagtctaaaacatgtcaatatggcttatgtaagaaatgatagtgaatcccccgcgtcccgtacagtatagttagcttgattgacaaggattacgttgaaacccaactgattgctttacaaggcaattttttttgtccattcgactttgctcagcaaggtaccttatatattattatgaaatgaatactttgtttttctggtcaatatactgttggagaaccaacatgtcttacttctgttatatctgctgttgcagggttgatcttagtactgctggaacttatctaaacaaaaacttttctgatataagcacagagcaaggttggagaacaacacacaaccacacaagtaaattacccatttcgtttatgggtaatataactagcagttccggatgggaatctggatcttctaccacacgatctaatcaaaaccatggatctgctggaggcaatcatagctctgttagtggagcaaacataatagttcctgataagatagggaataaaacaataatgcttggtagagaaaggagaaaacaaacctcaacttcttcccatattggtgaaagctctagtgctgctgacgaacctagaggtgatcttcaatcgtcaaaaatatcagctggcccaaaccatagcagtcatcagcataatattcctgtaataaacattgatgacatatcccctgaagctaggcctagttcgagtggattcactaatagaactgttgatcctaccatagaagcacaattggagtcggatgagttattggctcgccaactccaggagcagctctacaatgaatctgctcgttttgccccaacagaagagattgatgcaatcgtagcaatgtcacttcaacatgaagaagatactcatcggacatctaggaccttaaggaggttccaaaaccatactagaggtgctcgggctactcgtttgagttcttatcgaaatgctcttagggctgaattagcaacagcaaacaatatgatttcccgtcagcggaatactgctccaataaatttgggattgagagctgctttagcaagatatcctggtgctttgcacattcaaccaaacattgacttaaatgactatgatgcactgcttgctctggatgaaaataaccaccagcacactggtgcttcagaaagccagatcaataatttgccacagtcagtagttcagtccaatagcattgaagatccatgttctgtctgccttgaaaatccttctgtgggagatactatccgccatttgccttgctttcacaagttccataaagaggttatccccctgattgttatgtttcagtcactttcgttgaattttgtcgcatttctgatgacaaactgtttgcaagctacagtgtattcgccacgggcttaggagaaagaaactgtgcccagtctgcaagtttgggattaactgaagtttgccgtaccagtctacagtggagttctacttggtagtggcagcgacgaggtgctgcaatttctcatacgggatgccttcctgcagagatttttttttgtctaagataaaaaaaacaatgtattgctgtgatctgcgcttttgggcatcattttgtatgcacgcacgttttcttgctatttttgttgtcgtaatccaccaattcccatgaattggttaccagcatcttgtcaaaaaaaaaaaaaaaaagggcggcccccgacttatagctcgtcgaccccggaaataattccgggccg

SEQ ID NO: 12738 - DNA, 2681 bp, Zea mays
  misc_feature (542)..(542): n is a, c, g, or t
  misc_feature (548)..(548): n is a, c, g, or t
aaccaaaatataaaaaaatgtacgacactctagaatttgtcatttttatctttatttcagcaagttccactcatgtagttgtttatatgtagttaaattaggtgattcttaagaagattcctatagataaaacgaaaccctttgtttccatcaagaattgttgaaatcaagtgttagaagtgcgaactggcaatggtaaatctgttaaattatagggtcaattaattcatccatcaaaacatatcatgacttattgttgcagaatttgtttattcttggtgaaatggtgatatctctgtgcatgtttagatatactcttacttttttgctttagtttccttgaattttgttcgtgaaactgatacagtcgataaagcttttatttgttattatgcattgtgatgactgatgacactagatgtggcagaaattatctcagtgaacttatccagttgatgtcaatcatacttgatcttcatcagaaagctgactattaggccttgtttggatttagtcaggttcgcatcaatccacatgtgtcnggatgnattggagcagaacttaactaaattccaccccaatccacatcaacacatgtgggttgaggtgaatccgacaacatgaccagagtcatatccatagtcagttcaaacatgccatctactcgggcatctattgcttgaacattttacacttttgctttcggcggtattaatcataaatattaaatatatgaatattctaggagtacaaattaaacactgtttcattgcttcctttcaaacagcattagtacttggtgttactgagtaatgacaattgactagtgtgttttggtactatagcttgcagatgtatggtcatgtggagttactctttttgtcatgcttgtgggagcctacccgtttgaagatcaggatgatcctaaaaatattagaaagaccattcaggtgacagctaggtgcctatgttatggatgctcttcacatatattgaagaaagaaatatgttttgccccctaacatttacacttatattctcagcgaattgcagcaattcaatataatatcccagacaacattcgcatatctgatgattgcagacaactcatttcacgtatctttgtcagcaatccattaagggtaatacaatgacaacattcgcatatctgatgattgcagacaactcatttcacgtatctttgtcagcaatccattaaggagaatcaccatgagggaaataaaaagccatccatggttcctaaagaacttgccgagggagctcacagaggcggtgcagttatcctacttcaggagggacaacagtgtctctgcattttcagaccaaacaaccgaagaaatcatgaagattgtcaaggaggcaagaaccttgccaaaatcgtcgagatcaggctatggttacagtgaagaatgctcagatgaggaggaaaaggaagtggagagcgaacccaaagaggaggaagaagaagctgagtgtgataagacagttagggaggttcgcgagagcggggagctggatatgacctcactgcacatctaaatgctgcctgtgaggctgtgacgtgtctgtagataattggctttattgtctgctgaatttggtagaacttatgcaattctggcgtcagatatagtggtctatataagccttttccatcctgtaatatatttgttttgttgaactgtatgtgtggtactccgtatatgggtttgttctaagggagcaaggctttgtacaggcacacctgattgtgtttttggataggaagttttaccgtctgtttgcacactgcagcaaacattttggagtttgtaagccatatgttgcggcatatccagtaaaaatggatgaaacgctgcaaattccgtcaaaatggcttgtataactttgcaaagattgaagataaaagattttgaaatctggtgtgcatttcttcccatgagaagtttacttgactatctgtttagtatcaccttcggcactaggttgctgttctagttagtaatacacaataggcatgtgactctgagttatcacccttggtacatatttatatttgattctagttggaattcaaattctatgttgaaagtgttgttcatacattatacatacaagttggttcctctgctgtagtgactatcgattcatataaatagtacttgttccattttcatttacatgtagtactagatttttttctaagtcaacatttatatatttgacaatcgattaaaaactatataagtttaagatataagattttttaagtttaatatgaaaaatattttcataatattcaatccatagtgtaaaaatataaaggtttttcaacataaatgatcaaagatattaatgtttgacttacgaacaactctaatgtgacacgtaaaaatttggaggacatttatttagggtttgattgggagcatggataatagaggggaatctctctgttatccttgctcccaaacaagtctttaggatagtagttggatctaattttagaatcctagtatttagacaactcctagtcactgtttatatcctttctaatttagggctagtttgggagccacaaaaccgaagtgtattggatgagctataatccccttcttatccaattttgaataataagtggattctagcccctctaaccc

SEQ ID NO: 12739 - DNA, 1650 bp, Zea mays
ccggccgggatctcctcctccccgtccctctccggccgggcttccctccccctccctgctcggtgctcgcacacgctggcgcggcttgcccccacgctgcgctcccaccaccaccactatataatccccgatcgcctcacgcacacgcaccgacccaccggccgacgaggggcgaccgccgcaacacaaatccacacgcccgccgccaccgccgccatacggacccactcctccttgccctggtgcgagcaggcttcggcagcaaaccccgcaggctgctcccggacgagggagaacgcgcggggctgggctagccgctagtcaggggaccgggggcggaggcagcgaggaggtacgtatggacaagtatgaggcggtgcgggacatcgggtcggggaacttcggggtggcgcggctgatgcgcaaccgcgagactcgagagctcgtcgccgtcaagtgcatcgagcgtggccaccggattgacgagaatgtgtacagggagatcatcaaccaccgctcgctgcgccatcccaacattattcgcttcaaggaggtgatacttacaccaacacatcttatgattgtgatggagtttgcagcaggtggagagctttttgatcggatctgtgatcgtgggcggtttagtgaggatgaggcccggtatttctttcagcagttgatctgtggagtgagctattgccattacatgcaaatatgccatagagatctgaagctggagaatgttctcttggatggcagcccagctccacggcttaagatctgcgattttggctattccaagtcatcagtgttgcattcaagacccaaatcagcagtaggaacgccagcatatattgcacctgaggtgctatcccgtcgcgagtatgatggaaagcttgcagacgtatggtcctgtggggtgactctttacgtcatgcttgtgggagcatacccatttgaagacccagatgaccccaagaatatacgcaagaccattcagcaaataatgcaagtgcaatacaagataccagatcatgtccacatatctacggaatgccagcaacttattgcccgtatctttgttgccaatccaatgaggagaatcacaatgaaggaaataaagagccatccatggtttttgaagaacctaccacgggaactcacggagactgcacaaggcatgtactacaggagggataacagggtcccttcttattcagaccaaacgtcggaagaaatcatgaagatagttcaagatgcaaggaccatgccgaaatcatccagatcaggctatgggtggagcagtgagtattcggatgaagaagaagagaaggaagaggaacacagaccagaggagcatgaggaagaggaagatgaatacgataggagggtgaaggaggtccatgcaagcggagaactccgtatggacgctcttcacatatgaaagctagtggaagagaaagttgcatgtagataactgggttgttgcggatctgaaggatccagtgggatgtatgcagttttggcttgagaatttgcttctgtttgtcaattttcatgtaacataatttaatacaccgagacaacagactaccatgttcttatattggtaaatatgaagcatgtaccttctgtctacaaaaaaaaaaa

SEQ ID NO: 12740 - DNA, 1590 bp, Zea mays
accctcgaggcctttgggtacctcgaggccggccgggagagcgacacgaccgcgcccgaggagaccacaccacaccgcctcctccgcccgccgattcgtcgagctcgccctcccgctcgcctagctcccctgccttttcccttcctccccacctcctgccccgcgaacgtgctcccgcatgccaccgcgctgacgcgcgcggcggacgacggggtcgggatcatggacaagtacgaggctgttcgggacatcgggtcgggcaacttcggggtggcgcggttgatgcgcaaccgcgagacccgagaactcgtcgccgtcaagctcatcgaacgaggccaccggatcgacgagaatgtgtaccgcgagatcgtcaaccaccggtcgctgcggcaccctaacatcatccagttcatagaggtgatcctaactccaactcatcttgcaattgtgatggagtatgcggctggtggtgaactatttgatcgaatcgtagatcgtgggcgatttagcgaggatgagaccaggtatttcttccagcagttgatctgtggagtgagctattgccatcacatgcaaatatgtcatagagatttgaagctggagaatgttctcttggatggcagcccagctccacggcttaagatatgtgattttggctactccaagtcatcagtactacattcaaggccaaagtcagcagtggggacaccagcatatattgcaccagaggtgctttctcggcgggagtatgatgggaagcttgcagatgtatggtcatgtggagttactctttttgtcatgcttgtgggagcctacccgtttgaagatcaggatgatcctaaaaatattagaaagaccattcagcgaattgcagcaattcaatataatatcccagacaacattcgcatatctgatgattgcagacaactcatttcacgtatctttgtcagcaatccattaaggagaatcaccatgagggaaataaaaagccatccatggttcctaaagaacttgccgagggagctcacagaggcggtgcagttatcctacttcaggagggacaacagtgtctctgcattttcagaccaaacaaccgaagaaatcatgaagattgtcaaggaggcaagaaccttgccaaaatcgtcgagatcaggctatggttacagtgaagaatgctcagatgaggaggaaaaggaagtggagagcgaacccaaagaggaggaagaagaagctgagtgtgataagacagttagggaggttcgcgagagcggggagctggatatgacctcactgcacatctaaatgctgcctgtgaggctgtgacgtgtctgtagataattggctttattgtctgctgaatttggtagaacttatgcaattctggcgtcagatatagtggtctatataagccttttccatcctgtaatatatttgttttgttgaactgtatgtgtggtactccgtatatggggtttgttctaagggagcaaggctttgtacaggcacacctgattgtgtttttggataggaagttttaccgtctgtttgcacactgcagcaaacatttggagttgtaagccataggtgcgg

SEQ ID NO: 12741 - DNA, 1089 bp, Zea mays
cagtctcgcacacgctggcgcggcaggcccccaccctgcgctcctaccacccaccagtccaccactataaaatccccgatcgcctcacgcacacgcaccgacccaccgtccgccgaggcgcaaccgccgcaacgcaaacccacaaaccctccgccgccgccgccgccgccgtacaacgtaccgtcccgcttctcctccgcccttgtgcgagcaggcaacggcagcagagcccgcacaggttgctcccggacggagggagaacgcgcggggctgggctagccgggggcggccggaggaggtacgtatggacaagtacgaggcggtgcgggacatcgggtcggggaacttcggggtggcgcgcctgatgcgcaacagcgagacccgggagctcgtcgcagtcaagtgcatcgagcgcggctaccggattgacgagaatgtgtacagggagatcatcaaccaccgctccctgcgccatcccaacattattcgcttcaaggaggtgatacttacaccaacacatcttatgattgtgatggagttcgcagcaggtggagagcttttcgatcagatctgtgatcgtgggcggtttagtgaggatgaggcccggtatttctttcagcagttgatctgtggcgtgagctactgccattacatgcaaatatgccatagagatctgaagctggagaatgttctcttggatggcagtccagctccacggcttaagatatgcgattttggctattccaagtcatcagtgttgcattcaagacccaaatcagctgtgggaacaccagcatatattgcacccgaggtgctatcccgtcacgaatacgatggaaagcttgcagacgtatggtcctgtggggtgactctttacgtcatgcttgtgggagcatacccatttgaagacccagatgaccccaagaatatacgcaagaccattcagtcactcttcgcctgcagcaaataatgcaagtgcagtacaagataccagattatgtccacatatctacggaatgccagcaacttattgcccgtatctttgttgccaatccagtgaggagaatcacaatgaaggaaatcaagagc

SEQ ID NO: 12742 - DNA, 1994 bp, Zea mays
tcgcaggatactgcagtatttatatcacaagcgtcatcgcccagagaataaccctataacatactggaggaaacttgttgaagagtacttcgcacctcgagcaagagaaagatggtgtgtctcttcttatgaaaacagagggaattcttcagctgctgctccacagaaagctttggatacgtggcgatgtggcatttgcaatacacatggtgggaaaggatatgaagctacctatgaagtacttcctaggctctgccaaattagatttgaccatggtgttattgatgaatacttatactttgactcacccaacgaattccggttgcctaatggacaaatggtgctggagcatgcaaaagtagttcaaaaaagtgtttatgaacatctgcatgttatacacgagggacatctgagaataattttcacaccagaactgaagataatgtcttgggagttctgttcacgacgccatgaggagtacaccactcgcaagactatagcaccacaggttaataatcttctgcaagttgcccagaaattccaagctgttgtcagtgaaagtggatcagctgggatatcaaataatgatgcacaaaccatctgcaacatgtttgttaatgcatcacggcaactggcaaaaaatctagagcatcacaccttaaatgaacatgggctttctaaaagatatgtacgctgcctgcagatatcggaggtggtgaatcacatgaaggacttgatcgagttcagccacaagagcaagcttggtcctaaagagagcctgaacagttattctaaaaccacggcaaagtttgagaatatgcatgattcgagacaggccatggctgccgctaaccttgccaacaaccagagcaacaccaaattgatgggggtcaaacaagagacaagcacttctgcgaacaaccagactcctggtgccggagccattggcaacaacaatctaccgattgccgcacctctaaacacctaccagaacatgctcagaagctcaggtgccagtacgatttcgctgcagcaggaggcgtcgagtgtcttcaaaggtcctacagcaatgcacaacggcatgcagctggaagcggccaggtccttcctgggacctaaccaagttcaattccagcaccacccaccgtcgtcgtcgtttcagcagcagcagcaaaacagtttccatggctttggtgtcaacccgcagtaccagcagcatgtcctcaaccagcttctgcaggaagttaagaacagtaacaaccgctcgaaagcgcagcaaccgcctctggatgcaccaccgccgaatgcgagcggcgggggtctcgcgccaggagttgctacccccaacgtcattgctgctactggggagcaggggcagcatgtcaataacagtagctctaaccataacggcacggtaaagggtgctgctggtactggccctagcaatgtcatcaacaatagcacagccagcatggcttcggccagaaacagcagcttcaagtcggtgagcagcagtccagctgctgctggcaatgccgtgagctcgaaggtcgatgactccttccatcaactggaggacctcgacgacatgatcgctaacgaactggtggagagcgggctgttcggtgcaggacacgggtggtagtacgctactgtggtaaagccaagcaatgagatataagcctaagcctgattggtgctggcaagtgcttttgccgccgccacccttctctttctgtagagctttatgtattgacagttttccgatgatgatcatatcatacactggcgtcgctccagatgtgtgtgagttgagatagtgggttggattggatttggctgatagttagcgtgtgtatggcatgttgctgaatcaaatgatgtgatcatcgcaaggtcacaaacagcctctttgtcatgtacatcgttttccatcatgctatagtgggtgtcagttataatcaaaaaaaaaagaaagagtctactgaattttt

SEQ ID NO: 12743 - DNA, 2227 bp, Zea mays
gccggccgggccgggaacagacaggcaagggctaggcaaggcgcaagaagaggaggggaagtcgaaaataatttagcagcggaagcggaagcagcagcacgaggtgggtggggcagcggcagcggggttctggctaaattattttaatgtctttattatcagagattccagtaatgtgccttgcctcttttatgtgattgtacaaatcgatgaacggaactcatccctggacctccatgtccgggggtgcatgttctaaccttggatatgccagggacatgaatggtaatgttccaattagcactacaaattcctctggaccaagcattggagttagctcgttggtgactgacgccaactcgtcactttccggtggtgcccagttacagccaagtactagcatgaatggtgattcattgatgcgtgttcctgcatcaccaatgtcattttcatccaataacatctctggctcttcagtcattgatggttccatcatgcagcaaagtccaccccaagaacagatgcagaaaaggaggtcttcaagtgtaacatcacaacatgtgatcgatgctggtggtgcattgcatgctcagaagaaatcaaggactgatgttagtcagggtgatatcatgcaacatcagctgattcagcatctgatccatggtcagaattctcttcatttccaggggcaacagaacccacagcttcaagcttttatccagcagcataaactagcacaacttcagcaacggcagcagcagcatttgttgcaaccattttctcagatgcaacaaccccaagttggtattcctcggcagccgcaacttaggccgccattgggagagctcactagtccccccccccccccccccaggactcctatcgagaggggcgtttgttctcgcaggatactgcagtatctatttcacaagcgtcatcgcccagagaataactctataacatactggaggaagattgttgaagagtactttgcacctcgagcaagagaaaggtggtgtgtctcttcttatgaaaacagagggaattcttcagctgctgctccacagaaagctctggatacatggcgatgtggcatttgcaatacacatgctgggaaaggatatgaagctacctatgaaatacttcctaggctctgccaaattagatttgaccatggtgttattgatgaatacttatactttgactcacccaacgaatttgggttgcctaatggacaaatggtgctggagcatgcaaaagttgttcaaaaaagtgtttatgaacatctacatgttatacacgagggacatctgagaatcattttcacaccagaactgaagataatatcgtgggaattttgttcaagacgtcatgaggaatacaccactcgtaagactatagcaccacaggttaataatcttctgcaagttgtccagaaataccaagctgttgtcactgaaagtggatcagccgggatatcaaataatgatgcacaaaccatctgcaacatgtttgtcactgcatcacaacaactggcaaaaaatctagagcatcacaccttaaatgaacatgggctctctaaaagatatgtacgctccctgcagatatcggaggtggtgaatcacatgaaggacttgattgagttcagccacaagaacggccttggtcctaaagagagcctgaacagctattctaaaaccatggcgaagtttcagaatatgcatgattcaagacagctcatggctgctgctaaccttgccaataaccagagcaacaccaaactaatggggaccaaacaagaagcaagtgcttctgcgaccaaccagactcctggtgtcggagccatcggcaataatgctcttcagcatgccacacctctaaacagctaccagaatatgctcagaagctccagtgcaaatccagtcttgctgcagcaggaggcatcgagtgtcttcaaaggtcctacagcaatgcacagtggcatacagctggaagcagccagatccttccgtggacctaaccaagtgcagttccaacaccctgcggcgattcagcagcagcagcctatgccgcagcagagcaatttccagggctttggtggtgttaacccacagtaccagcaccatgtgcttaatcagcttctgcaggaagttaagaacaataaccacgtgaaagcacagcaactgcctccagatgcacctaaagcgagcggcggtcttgcaccagg

SEQ ID NO: 12744 - DNA, 1455 bp, Zea mays
  misc_feature (1345)..(1345): n is a, c, g, or t
  misc_feature (1353)..(1353): n is a, c, g, or t
  misc_feature (1403)..(1403): n is a, c, g, or t
  misc_feature (1414)..(1414): n is a, c, g, or t
cattgggtacctcgaggccggccgggcccccagcctcgggcgccgcgaagctattagccccgtgggcgcggcggcggcggctccggctgccacaccaacagacaggcaagggctaggcaaggcgcaagaagaggaggggaagtcgaaaataatttggcagcggaagcggaagcagcagcacgaggttctggctaaattattttaatgtctttattatcagagattccagtaatgtgccttgcctcttttatgtgattgtacaaatcgatgaacggaactcatccctggacctccatgtccgggggtgcatgttctaaccttggatatgccagggacgtgaatggtaatgttccaattagcactacaaattcctctggaccaagcattggagttagctcgttggtgactgacgccaactcgtcactttccggtggtgcccagttacagccaagtactagcatgaatggtgattcattgatgcgtgttcctgcatcaccaatgtcattttcatccaataacatctctggccctcccgtccgtgatggttccatcatgcagcaaagtccaccccaagaacagatgcagaaaaggaggtcttcaagtgtaacatcacaacatgtgatcgatgctggtggtgcattgcatgctcagaagaaatcaaggactgatgttagtcagggtgatatcatgcaacatcagctgattcagcatctgatccatggtcagaattctcttcatttccaggggcaacagaacccacagcttcaagcttttatccagcagcataaactagcacaacttcagcaacggcagcagcagcatttgttgcaaccattttctcagatgcaacaaccccaagttggtattcctcggcagccgcaacttaggccgccattggcacagactggaatgcagttaggtggtcctgttaggactcctatcgagaggggtgtttgttctcgcaggatactgcagtatctatttcacaagcgtcatcgcccagagaataactctataacatactggaggaagattgttgaagagtactttgcacctcgagcaagagaaaggtggtgtgtctcttcttatgaaaacagagggaattcttcagctgctgctccacagaaagctctggatacatggcgatgtggcatttgcaatacacatgctgggaaaggatatgaagctacctatgaaatacttcctaggctctgccaaatagatttgaccatggtgttattgatgaatacttatactttgactcacccaacgaatttgggttgcctaatggacaaatggtgctggagcatgcaaaagttgttccaaaaaagtgtttatgaacatnctacatgnttatacaccgagggacatctgaaaaatcattttccccccagaactggaanaaaatatccgngggaaattttgttcaagacgtcatggagggaataccccccc

SEQ ID NO: 12745 - DNA, 1646 bp, Zea mays
ggcctgacattaggtctacaatgggttatggaacactgattttatttttgaaatttgtagtcttgacctctctaggaaggctaagcatcacagctttgtaggccaattttgctacttaggaggtgaatggagggactttccatctggatcttacatagtaccttctgatactctaacggacgactacatacctggattttgttgcttcaagttgacccaggcttctttatttagagcttgcagtttgattcagttttgttctcttataatcctctgttacttgccttgtttaccagtcaggaaacttaacctgtttaggttcacattttgctgagatggacacaatatgctacttgttcgcttatgtgaacttgatctgcttactatgagcacattttttttctgttacaaaacgaaggaaaacatatgatgcataatttctttgcatatctttaatgtcattgacacctactctctttttacgggcgcgggcgaaattattttaatgtctttattatcagagattccagtaatgtgccttgcctcttttatgtgattgtacaaatcgatgaacggaactcatccctggacctccatgtccgggggtgcatgttctaaccttggatatgccagggacatgaatggtaatgttccaattagcactacaaattcctctggaccaagcattggagttagctcgttggtgactgacgccaactcgtcactttccggtggtgcccagttacagccaagtactagcatgaatggtgattcattgatgcgtgttcctgcatcaccaatgtcattttcatccaataacatctctggctcttcagtcattgatggttccatcatgcagcaaagtccaccccaagaacagatgcagaaaaggaggtcttcaagtgtaacatcacaacatgtgatcgatgctggtggtgcattgcatgctcagaagaaatcaagggctgatgttagtcagggtgatatcatgcaacatcagctgattcagcatctgatccatggtcagaattctcttcatttccaggggcaacagaacccacagcttcaagcttttatccagcagcataaactagcacaacttcagcaacggcagcagcagaatttgttgcaaccattttctcagatgcaacaaccccaagttggtattcctcggcagccgcaacttaggccgccattggcacagactggaatgcagttaggtggtcctgttaggactcctatcgagaggggtgtttgttctcgcaggatactgcagtatctatttcacaagcgtcatcgcccagaggtgagtttctctatagtatttgttgtttgtgggattatgaggcacaatctcttggcaatacaatttattggagcattgttttctagaataactctataacatactggaggaagattgttgaagagtactttgcacctcgagcaagagaaaggtggtgtgtctcttcttatgaaaacagagggaattcttcagctgctgctccacagaaagctctggtagttaatacttcacacgtacttgtattttacttcccatcatatagtgctctttatttcatggccgaacatcactttctgtttgatgttcaggattaaattgattagcatcactgtaaagtttt

SEQ ID NO: 12746 - DNA, 1517 bp, Zea mays
  misc_feature (33)..(33): n is a, c, g, or t
ggccggccgggaataaaatacaaaaaaaggggnaagcgcccacccctttttacccctcctcatcctccgcccgggttcccctcccccattcgtcgcgatccaattccggcgccggagaagacgcgcgcaggccccacccagccgcctacaggcgctccgctcccacagacggacagcttgggctcgacggatgaacatgtgtgagaaagatcagaatttgccatggggatacgacctgttccgcgacccttttgctcctcccaacgggtactacgggcctcctcccggttactgtgatggccactgttgtgacctccatcattacggtagagcatcacatccagatgagactcagttgcattcttctcaactcgcatatgatatgtacaacccatcagtaggcatctaccatcctggaagcacccatgagcacgagcacgagacagtatatgtggaaccgtctagttcctctccagacacaggtggtgacggttgttttgagatggaggaggaagtagggaagaggttttaccccatggtcccagttccccatgtccccaaaattaatggagaaatcccatcaattgatgaagccactatggaccatgaaaggctgacagaaaggttgaggctgtatgagctggttgaaaacaaggtgaaaggagatggcaactgtcagttccgagcactatcagatcagctttaccaaagtccggatcaccatgaatttgtgaggtcgcagataattaaccagcttaaaactaaccgtgacgcctatgatggatacgttcccatggcatatgatgattacttggagaaagttgcacggaacggtgaatggggtgaccatgtgacgctgcaggctgctgctgacaagtatggagtaaaaatcttcgtgatgacatcgttcaaggatacttgctacatcgagatcctgcctaaggttcagaagtccaacaaagtgatactgttgagcttctgggcggaggtgcactacaactccatacatccgcagaacggtgagtaggcgtgccgttggcatgccgggccttcaccgccaacatgctccgaggtcgcagacgaccaagaggagaagatggtggccgttctcgcagcaccaccaccattgatggcgggttcagctctcttggggctggatggatgttcaggatcaggtggtggtcccggtcccggccatcgtccagatgatactacaagggacgtacgacattatgattaatatatatatacccagagcggagcagaaagacctgataagggaattagttgggatgaatgaaatggaataaacatgggatgggatgggaatcgtcgtcccgtatatagtttagagtggaggccggtgagcgccaactcaaactctttgtattgttgtttatatctacaaattttgccggaatgaggctagaattattggggaacaattatggtaataataaatcggttaagaattgagatgacaaaaaaaaaaaaaaaaaaaaaaaaaaagggcggcc

SEQ ID NO: 12747 - DNA, 1482 bp, Zea mays
  misc_feature (1458)..(1458): n is a, c, g, or t
gaacctttgagtctcaaaaaaaaaaaaaaaaaaaaaaagtcctccgcgcgttagtgcgagcttgatgaatcgaatcgctgatctctgttagcgctccgctcccacagacggacagcttgggctcgacggatgagcatgtgtgagaaagatcagaatttgccatggggatacgacctgttccgcgacccttttgctcctcccaacgggtactacgggcctcctcccggttactgtgatggccactgttgtgacctccatcattacggtagagcatcacatccagatgagactcagttgcattcttctcaactcgcatatgatatgtacaacccatcagtaggcatctaccatcctggaagcacccatgagcacgagcacgagacaggacgtatgtagaaccgtctagttcctctccagacacaggtggtgacggttgttttgagatggaggaggaagtagggaagaggttttaccccatggtcccagttccccatgtccccaaaattaatggagaaatcccatcaattgatgaagccactatggaccatgaaaggctgacagaaaggttgaggctgtatgagctggttgaaaacaaggtgaaaggagatggcaactgtcagttccgagcactatcagatcagctttaccaaagtccggatcaccatgaatttgtgaggtcgcagataattaaccagcttaaaactaaccgtgacgcctatgatggatacgttcccatggcatatgatgattacttggagaaagttgcacggaacggtgaatggggtgaccatgtgacgctgcaggctgctgctgacaagtatggagtaaaaatcttcgtgatgacatcgttcaaggatacttgctacatcgagatcctgcctaaggttcagaagtccaacaaagtgatactgttgagcttctgggcggaggtgcactacaactccatacatccgcagaacgatgctccgaggtcgcagacgaccaagaggagaagatggtggccgttctcgcagcaccaccaccattgatggcgggttcagctctcttggggctggatggatgttcaggatcaggtggtggtcccggtcccggccatcgtccagatgatactacaagggacgtacgacattatgattaatatatatatacccagagcggagcagaaagacctgataagggaattagttgggatgaatgaaatggaataaacatgggatgggatgggaatcgtcgtcccgtatatagtttagagtggaggccggtgagtgccaactcaaactctttgtattgttgtttatatctacaaattttgccggaatgaggctagaattattggggaacaattatggtaataataaatcggttaagaattgagatgaaaaaaaaaaaaacagagcgcccgtcatcatatcaccagaatcagaatggattccccagtgcatctagttttcctctggngggacagaacaacataaagaaaaa

SEQ ID NO: 12748 - DNA, 2167 bp, Zea mays
tatatatatatatatactacttaagacgttagtgtaggcgtccacattttttggtgcacggttctgccatctgtcgtcgcatcgccggctacaccacgcccccgctccatccctacagcgcgtccgcggccctccgccctcgccctcccccctccccgcaaatctcgcctcctcacccaacgccatcagcactgccctccgctccatccctgcagcgcagacatccgccaccgtcaccgcccttcctcaccaagcaatcatcgcccttccccacgcgcctcggccgccatccgcgacatcaccttccttacccatgcgccgaggctgccatccgcgccatcaccttccttccccacgcgcgcgccccctcctccgtgcgtgccccgcccccgtccttcgctcacccaatgccccgccacctccgccgcgatagcctcccccacgaagtgcccccatgatgtcttccattcccttcctccctcattcttcctgttgcagcgattgctcccagcggctcggcggcaatggaggcaccacctgacccggccgtcccatcccgctcgacgagatcgtcggcgacatccacggggcagttctagattttcctttgttgattgtcagggctgtcaatgcagctcggcgagctagccccactgccagcttagctatcgtgacagccattggggctgctaacgccgttagtggggtgaaggcgacaactgacgagatgttggccgaagcggagaaggcaaatgtcctggctgcaaaaaaaattgatcgcctgcttcgtcgttgacctcccatgatgtaaggttgaatcagttagtgttcatgtctaaaatttgatttttgtttccaactgttttgttgtgatgaattaaattgtacttgtttcatgtataagtataactgattgtagaaacctgcagcatatgttaacaggttggtttgtgctatgactttctgaaggagaagatgaagaacaggtcgacgatgaatttgatgaccggagactgtggagtgaggtattttgtgaggacatgtccaatttacctcctcctccaactctttctgaaatttgtgcagagtacgacctcgacatagatgagatactagatcgctcgatatgagtcagcttttgtttatgcttatggagccatttctgtttcactgaagtctatatcgtatgctttatgaactatagtgtattgcagtttacaaaagaaccaaaatataggaaactcagttacaagttagtccattcagattctgggcaacagttaacaggaccaactaatagttaacatgaacttactaggaaaccagttcacattttacagaatccagttctacaaattgcagatattaaagtgccataatactatgataacaccattgaacaactcacagttctacaagtgccataatacatcacttatatctttttcttcagagtaagcttcttcacacctctcctttcaattctaggtgcgaacaaagtagaaacaacttctgctgtagattgcacaggatccacaagttgctaaaaggaagatggcattgcaccaagctgctgataggaagtgcaagtggttacaagctactgtcagtgaagtcaatggtgatggagcagtctgcgttcgttggcgcaggggtagtcagcgaaggaaaatctggaaccgcaccgtggatgtcggcgacgatctcatcgagcaggatgggacggctgggtcaggtggcgcctccattgccgccgagccgccgggagcaatcgctgcaacgggaatcatgagagaggaagggaatggaagacaagaccgtgatcctttttcaccaacgagatatcaagcatgggggtaaaagaagttaatgagtggcaccttacgtttgatgacaatagaaagggtttcaaaccagtgatgataacaaaactacaaataaaagagtgttataatactataaatccaattgcatgatttggggtaatattttttaagaagcccagtgttcgggataccccagttcaaagaaaaactcatctgattatgcttccatttttctgctatggttcgatggaggcagaagtaaagacgatagtacccgatgacgtcctgggccaggctgaggtaagccctgctaatggcaaaaaacccaacccacatccaag

SEQ ID NO: 12749 - DNA, 895 bp, Zea mays
cattgggacctcgagccgccctaagtctgtgggtacctcggggccggccgggacagcaagtagtgtcgaacgagagccacatcccgctctccacccgggcgcgcgtgtcctccgtttcgccatgtccaactccaagcagcacgacgccgccgacgacggcggcatcccagcccccgaggcgccggcaaagcgcccaccgcttaacaagtacgccctcgcctgcgccgtcctcgcttccatgaactccatcctccttggctacgatgtgtcggtgatgagcggagcgcagctattcatgaagcaggacctcaagatcacggacacgcagatcgagatcctcgccggcatcatcaatatctactcgctcgtcggctcgctcgcggcgggccggacgtccgactggctcggccggcggtacaccatggtgctcgcggcggccatcttcttcgcgggcgcgctcatcatgggcctcgccccgagctacacgatcctcatgcttggccgcttcgtggcgggcgtcggcgtcggatacgcgctcatgatcgcacccgtgtacacggccgaggtctcgcccacgtcggcgcgcggcctgctcacgtccttcccggaggtgttcatcaacacgggggtgctcctcgggtatgtctccaactacgccttccacggcctccccgtgcacctcagctggcgcgtcatgttcctcgtcggcgccgtcccgcctatcttcctcgcactgggggtcctcgccatgccggagtcgccgcggtggctcgtcatgcaggggcgcatcggcgacgcgcgccgcgtgctggccaagacctccaactcccccgccgaggccgaggagcggctcgccgacatcaagaatgccatcggcatcccagacggcgtcggc

SEQ ID NO: 12750 - DNA, 1847 bp, Zea mays
ccggccgggagcaagtagtgtcgaacgagagccacatcccgctctccacccgggcgcgcgtgtcctccgtttcgccatgtccaactccaagcagcatcccagcccccgaggcgccggcaaagcgcccaccgcttaacaagtacgccctcgcctgcgccgtcctcgcttccatgaactccatcctccttggctacgatgtgtcggtgatgagcggagcgcagctattcatgaagcaggacctcaagatcacggacacgcagatcgagatcctcgccggcatcatcaatatctactcgctcgtcggctcgctcgcggcgggccggacgtccgactggctcggccggcggtacaccatggtgctcgcggcggccatcttcttcgcgggcgcgctcatcatgggcctcgccccgagctacgcgatcctcatgcttggccgcttcgtggcgggcgtcggcgtcggatacgcgctcatgatcgcacccgtgtacacggccgaggtctcgcccacgtcggcgcgcggcctgctcacgtccttcccggaggtgttcatcaacacgggggtgctcctcgggtatgtctccaactacgccttccacggcctccccgtgcacctcagctggcgcgtcatgttcctcgtcggcgccgtcccgcctatcttcctcgcactgggggtcctcgccatgccggagtcgccgcggtggctcgtcatgcaggggcgcatcggcgacgcgcgccgcgtgctggccaagacctccaactcccccgccgaggccgaggagcggctcgccgacatcaagaatgccatcggcatcccagacggcgtcggcgacaacgacgacgacgtggtggtggtcgcccgcaggaacaagggcagccatggcgaaggggtgtggagggacctcctcatccgcccgacgccgcccgtccgccgcatactcatcgcctgcctcggcctccagttcttccagcaggcctccggcatcgactccgtggtgctgtacagcccgcgggtgttcgagaaggctgggcttaggtcgaacaacaactctttgggcgccaccatggcggtgggcgcgaccaagacgctgttcatcctggtggccacgttcttcctcgaccgcgtcgggcggagaccgctgctgctcacaagcgcgggcgggatggtggtgtcgctggtgacgctggcctcggcgttgcgcgccatcgaccggctcccagagggacaggcgacgtcgctggcgggcgtgagcatcgcggcggttctcacgttcgtggcgtccttctccatcggcatgggcccgatcgcgtgggtgtacagctcggagatattcccactgcggctccgcgcgcagggctgcgcactcggcacggcgatgaaccgggtcatgagcggcaccatcaccatgtccttcatctcgctctacaaggccatcaccttcgccgggagcttctacttgtatgcaggcattgctgctgccgggtggctgttcatgttcttcttcctgccggagacgaggggcagcaacctagaggacaccgagaagctcttcggcggtggcgaccacgacgaggacaaggaagatggacacgatgcgcagaagtccactgagttgagtagtaaccaacagtgaccttatctgtatctgatagtatgtacgctagtaaaaaaaacagacttttttttacttagatcactgcactttaaagcaaaaaaaaaaaaaaaaaagcggccgagtttctttgtgtgttgccccgcgcccatccgtctaccgcgcgcagcgccagcgaattcccccggcccggctcggtttgagacgatcagctattcagcactacggcacacatcc

SEQ ID NO: 12751 - DNA, 2209 bp, Zea mays
ccgggaaacgggctagcgtgacgaggtcaccggccataaatcctcggccccctcgggcccgcccggggccccacactcgtccactcccccagtcacccccgcgcccgtctttgctctgcctctccgcgccgcagagcagagcagagcatggcgcccccacgccctctcctcgccgccgtcttcctcgccgcggcggttccgctcctcctttctccggcagaggcggggacggtgggcgtgaactacggccgcgtggcgaacaacctgccgaacccagcggcggttgtgcagctgctgaagcagcagggcgtggcgcaggtgaagctgtacgacgccgaccccaccgtgctgcgcgccctcgcaaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaacgtgacggcgcagctggtcccggccatggccaacgtgcacgccgcgctggccaggctgggcctcgacggggccgtcaaggtgtcgtcgcccatcgcgctcacggcgctcgcgtcgtcctacccgtcctcggcgggcgcgttccgggaggacctcgcgcaggccgtcatgaagcccatgctcgacttcctggcgcagaccgggtcgtacctcatggtgaacgcgtacccgttcttcgcttactccggcaatgcgggagacatctccctcgactacgccctgttccgccccaacgccggcgtgctcgacgccgggaacggcctcaagtactacagcctcctcgacgcgcagctggacgccgtgttcgccgcggtcagcaggctcggggagggctacaacggcgtgcgcgtcgtggtctccgagacggggtggccgtccaagggcgacgccaacgaggcgggcgcttcggcggccaacgccgcggcgtacaacggcaacctggcccgccgcgtgctctccggcaacgccggcaccccgcgccgccccgacgccgacatcgacgtgtacctcttcgcgctcttcaacgagaaccagaagcccgggccgacctccgagcgcaactacggcgtcttctacccgaaccagcagaaggtgtacgacgtcgagttcgtcctcggcggcggcggcgccagccagggcaacggcggcctcgggtggcaggagaacggcggcggggcgagcagcaccagcaccaacccgccgagcggggtgaaggtgacgaccggggaggcgtggtgcgtggcgaacgcgatggccggggagcatcggctccaggcggcgctggactacgcgtgcggccccggcggcgcggactgcaaggccatccagcccggcgcggcgtgcttcgagcccaacaccatggtcgcgcacgcatcctacgccttcaacgactactaccagcgcaagggccggtccatcggaacctgcgacttcgccggcgccgcctacgtcgtcaaccaggcaccgaagatgggcaagtgcgacctcccatcgacggtctgaactgaagcagcagcggcgaggaccgtaacgccagcggccatctcgaggaacaaaagaatcgatggcaggcaggaggcagcacagcagctcagctcatcagtcgccctagagactggactggactctgggggacgccggaatctttgcccaccctttcagactttctttaccgctgcagctttgactccagccccgcagcgacgccgtagaacgaacatcgctgtactaggctgtagctgtacgccttcctttttgcagctttggctaatggtgggtgtgtgtgtggatatgtttgtttagtcatgaccagcactactacttctactactagcatgctactattaaaatctgatgaccagtacgtatagattaattaatttaaatggtttagccttttgcgcccaaggcaaccacaaaagcggccctcgactcgcggccgcattttgactcttgttccgtcatcggctcaaatgtgcgtgccggaggcggaaatggtgcttagcgtggacgacaatgcacactactggcagcagcacccgcactcgagtagtgctactagtcaaacgtctgccctttggcgagcaattaaaaccttggaaatggaggatttgtgcat

SEQ ID NO: 12752 - DNA, 618 bp, Zea mays
aggcggcgctggactacgcgtacggccccggcggcgcggactgcaaggccatccagcccggcgcggcgtgcttcgagcccaacaccatggtcgcgcacgcctcctacgccttcaacgactactaccagcgcaagggccggtccatcggaacctgcgacttcgccggcgccgcctacgtcgtcaaccaggcaccgaagatgggcaagtgcgacctcccatcgacgacggtctgagctgaagcagcagcggcgaggaccgtaacgtcagcggccatctcgaggaacaaaggaatcgatggcaggcagcagcagctcagctcatcagtcgccctaaagactggactctgggggacgccggaatctttgcccaccctttcagactttctttaccgctgcagctttgactccagccccgctgcgacgccgtagaacgaacatcgctgtactaggctgtagctgtacgccttcctttttgcagctttggctaatggtgggtgtgtgtgtgtgtggatatgtttgtttagtcatgaccagcactactacttctactactagcatgctactatttaaatctgatgcccagtacgtatagattaatttattttttatattttattat

SEQ ID NO: 12753 - DNA, 2006 bp, Zea mays
tacctcgaggccggccgggatccccgcctccctcgaggccggccgggaaacgggctagcgtgacgaggtcaccggccataaatccccaatctccgcgctttccttccgccccacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaacgtgacggcgcagctggtcccggccatggccaacgtgcacgccgcgctggccaggctgggcctcgacggggccgtcaaggtgtcgtcgcccatcgcgctcacggcgctcgcgtcgtcctacccgtcctcggcgggcgcgttccgggaggacctcgcgcaggccgtcatgaagcccatgctcgacttcctggcgcagaccgggtcgtacctcatggtgaacgcgtacccgttcttcgcttactccggcaatgcgggagacatctccctcgactacgccctgttccgccccaacgccggcgtgctcgacgccgggaacggcctcaagtactacagcctcctcgacgcgcagtggacgccgtgttcgccgcggtcagcaggctcggggaggactacaacggcgtgcgcgtcgtggtctccgagacggggtggccggccgggcccggcgccaacgaggcgggcgcttcggcggccaacgccgcggcgtacaacggcaacctggcccgccgcgtgctctccggcaacgccggcaccccgcgccgccccgacgccgacatcgacgtgtacctcttcgcgctcttcaacgagaaccagaagcccgggccgacctccgagcgcaactacggcgtattctacccgaaccagcagaaggtgtacgacgtcgagttcgtcctcggcgctggcggcgccagccagggcaacggcggcctcgggtggcaggagaacggcggggcgagcagcgggagcaccagcaccaacccgccgagcggggtgaaggtgtcgaccggggaggcgtggtgcgtggcgaacgcgatggccggggagcatcggctccaagcggcgctggactacgcgtgcggccccggcggcgcggactgcaaggccatccagccaggcgcggcgtgcttcgagcccaacaccatggtcgcgcacgcctcctacgccttcaacgactactaccagcgcaagggccggtccatcggaacctgcgacttcgccggcgccgcctacgtcgtcaaccaggcaccgaagatgggcaagtgcgacctcccatcgacggtctgaactgaagcagcagcagcggcgaggaccgtaacgtcagcggccatctcgaggaacaaaggaatcgatggcaggcagcagcagctcagctcatcagtcgccctagagactggactctggtctctgggggtcgccggaatctttgcccaccctttcagactttctttaccgctgcagctttgactccagccgcaggcagcgacgccgtagaacgaacatcgctgtactaggctgtagctgtacgccttcctttttgcagctttggctaatggtgtgtgtggatatgtttgtttagtcatgaccagcactactactgctactactagcatgctactattaaaatctgatggatcagtatagattaattaatttaaatggtttagcctttgcgccc

SEQ ID NO: 12754 - DNA, 1453 bp, Zea mays
cgcagctggtcccggccatggccaacgtgcacgccgcgctggccaggctcggcctcgacggcggacgcgtgggcggacgcgtgggcgcgctcacggcgctcgcgtcgtcctacccgtcctcggcgggcgcgttccgggaggacctcgcgcaggccgtcatgaagcccatgctcgacttcctggcgcagaccgggtcgtacctcatggtgaacgcgtacccgttcttcgcttactccggcaatgccggcgacatctccctcgactacgcgctgttccgccccaacgccggcgtgctcgacgccgggagcggcctcaagtactacagcctcctcgacgcgcagctggacgccgtgttcgccgcggtcagcaggctcggggagggctacaacgccgtgcgcgtcgtggtctccgagaccgggtggccgtccaagggcgacgccaacgaggcgggcgcttcggcggccaacgccgcggcgtacaacggcaacctggcgcgccgcgtgctctccggcaacgccggcaccccgcgccgccccgacgccgacatcgacgtgtacctcttcgcgctcttcaacgagaaccagaagcccgggccgacctccgagcgcaactacggcgtcttctaccccaaccagcagaaggtgtacgacgtcgagttcgtcctcggcgctggcggcgccagccagggcaacggcggcctcgggtggcaggagaacggcggggcgagcaccagcaccaacccgccgagcggggtgaaggtgacgaccggggaggcgtggtgcgtggcgaacgcgatggccggggagcatcggctccaggcggcgctggactacgcgtgcggccccggcggcgcggactgcaaggccatccagccaggcgcggcgtgcttcgagcccaacaccatggtcgcgcacgcctcctacgccttcaacgactactaccagcgcaagggccggtccattggaacctgcgacttcgccggcgccgcctacgtcgtcaaccaggcaccgaagatgggcaagtgcgacctcccatcgacgacggtctgagctgaagcagcagcggcgaggaccgtaacgtcagcggccatctcgaggaacaaaggaatcgatggcaggcagcagcagctcagctcatcagtcgccctagagactggagactctgggggacgccggaatctttgcccaccctttcagactttctttaccgctgcagctgcagctttgactccagccgcagcgacgccgtagaacgaacatcgctgtactaggcggtagctgtacgccttcctttttgcagctttggctaatggtgggtgtgtgtgtggatatgtttgtttagtcatgaccagcactacttctactagtactactagcatgctactattaaaatgtgatgaccagtatagattaattaatttaaatggtttagcctttgccccaaaaaagcggcc

SEQ ID NO: 12755 - DNA, 1645 bp, Zea mays
agacaggtttacgcgctgacaagctgcccttccgcgaactacacgttcgacgaaatgccgccgcggccggccgggccgcgtcatcgtcaactgagattcgcctcgcatcttctcggattccttccccaactttcgtccccatcagcggacctactcgagatcgacgagactcgtcggagcccggttcctaggcgtcccagcgcccgactggatctcctggctcgggccgccttgatggtccctggggtcggtccggggtggagttcgaggcgatgagcaggcttgcgtcggggctccagcgcttgcggaggtcgtcgtcgcagtgggaggtgctgtggtcggcgctcgcgtcatgcggcctagtgcttttctcgcagctcgccgtggcgatggttccccgtctcttccctttcctctccctcctcgccatgctccccatcgcggggttggtgttcatcgcggctatcgtgctcggccgcctgtggaggaggttcatcggggtggcggcgtcggccccgctcttcgtgctcttcaacatcctcctattgtggggcgtttacgtattcgtaatccggagagaaacttcttctctgctggacatgctaataaatgcagagtgtgcacttcttctgtggggattctacaggattttatctggtgatcctggtattgttgcttgtgattcttcatatttggaagaagctggctgcaaggattttgtggaagctatatactcgagtgagaaactcccaatgctctcaagggtcaggcagtgtacctggtgcaaagcaaacattaggggctatgaccatcattgtcctgcatttggtacttgcataggacagaaaaatcatcgtctatttatggcccttttgacaggatttgttgttgctgaatcaacatatacgatgtgctcaacaaaatatattaccagatgcatcagttcagggactataagatcggagaatcctgtatctttaaacatagtaatcagtacaacgctcttctctatcctccaggtcctctggcagatcctccgtgctgttaccagattgtattcttgatgtggcacatatattgcatctgcttcaacatcaagacagatgagtgggtaatttcaaatttcccatgctttggagtcttcgttcatcaattgcaggtcgtcttctcgttagctgtttcttgtagctaaaaggtgagattttccagattaactggaagaaatatcctgaattccagatgaaggaacaacctcgatcagattctgaagtcaaatttgtgaacccatatgacaagggcatgctgtgtaacataagagaatttctaaagccggaatgatagatagccaattttgagtacgaagacctggaactagaaagatgggaagtctgaagtgcgttataactggatggaagcttgtttccttgttggctatagattttcaggaatctattctgatgttgtagccgtttagttgagattccagatttatgacagcgaatctggttcagtaaactgaaccaaacacactctgaggatcattgaactccctgtagtttaatgtgcaagtaacattcttttgtaaggttactttcacttatggaattcatatcgtggtcctgcattttcaaaatacaccaaaaaa

SEQ ID NO: 12756 - DNA, 1534 bp, Zea mays
aaataaaaaaaatcggacgacctacgcacacgctcagacaggtttacgcgctgacaagctgcccttccgcgaactacacgttcgacgaaatgccgccgcgagacctcttcatcgtcaactgagattcgcctcgcatcttctcggattccttccccaactttcgtccccatcagcggacctactcgagatcgacgagacacgtcggagcccggttcctaggcgtcccagcgcccgactggatctcctggctcgggccgccttgatggtccctggggtcggtccggggtggagttcgaggcgatgagcaggcttgcgtcggggctccagcgcttgcggaggtcgtcgtcgcagtgggaggtgctgtggtcggcgctcgcgtcatgcggcctagtgcttttctcgcagctcgccgtggcgatggttccccgtctcttccctttcctctccctcctcgccatgctccccatcgcggggttggtgttcatcgcggctatcgtgctcggccgcctgtggaggaggttcatcggggtggcggcgtcggccccgctcttcgtgctcttcaacatcctcctattgtggggcgtttacgtattcgtaatccggagagaaacttcttctctgctggacatgctaataaatgcagagtgtacacttcttctgtggggattctacaggattttatctggtgatcctggtattgttgcttgtgattcttcatatttggaagaagctggctgcaaggattttgtggaagctatatactcgagtgagaaactcccaatgctctcaagggtcaggcagtgtacctggtgcaaagcaaacattaggggctatgaccatcattgtcctgcatttggtacttgcataggacagaaaaatcatcgtctatttatggcccttttgacaggatttgttgttgctgaatcaacatatacgatgtgctcaacaaaatatattaccagatgcatcagttcagggactataagatcggagaatcctgtatctttaaacatagtaatcagtacaacgctcttctctatcctccaggtcctctggcagattgtattcttgatgtggcacatatattgcatctgcttcaacatcaagacagatgagtggattaactggaagaaatatcctgaattccagatgaaggaacaacctcgatcagattctgaagtcaaatttgtgaacccatatgacaagggcatgctgtgtaacataagagaatttctaaagccggaatgatagatagccaattttgagtacgaagacctggaactagaaagatgggaagtctgaagtgcgttataactggatggaagcttgtttccttgttggctatagattttcaggaatctattctgatgttgtagccgtttagttgagattccagatttatgacagcgaatctggttcagtaaactgaaccaaacacactctgaggatcattgaactccctgtagtttaatgtgcaagtaacattcttttgtaaggttactttcacttatggaatccaaaaaaaaaaaaaaaa

SEQ ID NO: 12757 - DNA, 2386 bp, Zea mays
cattgggacctcgagccggccgggataattgatgacttccgtaccgagagcacaaggcaattcagcataaacatgctagtcgaactgtgtcccatcttcagccagagccttgaaccccctgagtagcaaaaatggcacgcccgttgttccttgtataccagctcgtaagcctctgcctgaggcttaccaatctatgctccggcgacgaccagcagttcgtatactctggcttcaccgccacaaacctctcgacggatggcgttgcagcgatcacgtcggatggcatgctcgagctgacgaacgggacgctccagcgcaagggccacgcgttctacccggagccggtgcgcctccgcgagcctgccaacggcacggcgcggtccttctccacctccttcgtgttcggcatcctgtccgaccatgtcgagctaagcgcgcacggcatggcgttcgtggtagccggcagcagggacttctccggcgctcttcccagcggctacctgggcctcctcaacgtccagagcaacggcaactccagcaaccgcctcttcgccgtcgagctcgacacgatgcagaacgacgagttccaggacatcaacgacaaccacgtcggcgtcgacgtcaacagccttcactcggtgcagtcgtactacgccgggtactacggcggcggcggcttccgcaacttgaccttgattagcggagaggccatgcaggtttgggtggactacgacgcagaggtcgcacagatcaacgtgaccatggctccactcagcatggccaaacctgcgaggccacttgtgtcggccaggtacaatctctcaacggtcctgactgatgatggcccggcgttcgtcggcttctctgctgcgaccggtgggacgctgaaatcacggcactatgtcctcgggtggagcttcagcatcgaccgccctgctccggccattgacctcagcaatctaccgaagctgcctcgtgtttccgccaaggacaggactaggaccctggagatcgtcttgccggtagcaaccgcggcattcctccttgccgccggcatggccatcttgttactggtgcgacgacatcggaggtacgctgagctgcacgaagactgggagctcgagttcggaccacacaggttctcatacaaggatctgttccatgccacggacggcttcaagaactctaaccttctcggcatcggcgggtttgggagggtgtacaagggggtgcttcctgcgtccagaacagaaatcgcagtaaaacgggtgtcgcacgaatcgaagcagggcatgaaggagttcatctcggagatcgttagccttggacgcctgcaacaccgcaacctcgtccagctgctagggtactgtcgacggaaaggcgagctgctgctggtgtacgactacatgccaaacggaagcctcgacaagtgccttcacgaccgagagggacgacagcacgctttagactgggctttgagggtccaaattatcaaaggcgtcgcgtctggcttgtcgtacctccatctagactgggagaaagtggtcatccatcgagatattaaagccagcaatgtcctcctcgacggcgacatgaacgggcggctaggagactttggcctcgcgcgactctacgaccacggcggggcagacggcccaaagaccacccatgtggtaggcaccatagggtacatagctcccgagcttggtcgcaccggtaaggcatcccctctcacagacatatttgctttcggcatcttcgttcttgaggtcgcgtgtggacgaaggcccatcaacaagcagctcacgcaggacggcggcgccttgttattggtggactgggtgcttagtcactggcagaatggatcactcactgaaacagtggacatcaggtttcaaggggactacgacagtgacgaggcatccatggtactaaagctggggctactatgttcacacccattcgtggacgcaagaccaacaagcatgcgacaagtcacccagtaccttgatggccacgtagcattaccggactttatgccgccctgccatatactacccagcagcatgatgattccggagcaaagcgagggatttcttatgtacaacaatacgtcaagccaaatattcaaggcaagcaatgggagcatgtctagcctctcagggggaagatgacctagctgttatatgtgtgtgtgtctctctctcatgggatactgtaatgatccatagtgtatgtgagataggttagggtcttagggatgcaagttgcgcaccaactatttgattaaccttctaatccaacaacacaaaaaaatagcacaaatatggacacaaggtgctatttggtaaggaatatatcaaaaatgcaaacatcattggaattg

SEQ ID NO: 12758 - DNA, 1974 bp, Zea mays
actttaacttcacataacggctgtgtcctgttcctgtagctgctctcttttatggttgatggttacgacctgaacagatcgatcgtccttcctgtcgtttcgttttctcgccggcagggcactgggtacgccgccgccgcctcaacgccaccacgctgccgccgcgccagttcgtcaccgcgagacacaagacacgtgcctcgcttccctcgggccggttggccgtggccggccgtcgctgttctgttcctatttcttggcaactccgcccgtttcacctccggaggaccgacagcgacggcgccagtagatagatgcactactgacgccactggccacctcgagttcgagtgccaagggacgccacgagaccaaccgtgaggacaggacaacggtcgcctttgcccgcggatccgcggatttcgtcttcttgggtgccatggatccagtcgccggcacggcggagcatcggggcccgttggaagtgcgcgcccgcgcgcccggcaagatcatcctcgcgggcgagcacgccgtcgtccacggctccgccgccgtcgccgctgccatcgatctctacaccaactcctccctcctcctccgccccgcaggcccaggagatggtggcggcgctggctccggcgcggtggagctggacctcagggactcgggcctcaccttctcgtggccgtgctcgcgcctccgcggggcgctgggggaggagatcagcgccaaccccggggctccggcgccgtgctcccccgaccagctggccgccattgccaggctcttgcaggaccaggacatccctgaggccaagatctggctctccgccggcctctccgccttccttttcctctacgcctccattttgggatgcaggcctggcaaggcagtggtgtcctcggacctgcccatgggcgcagggctcggctcatcagcggcattttgtgtctccatgtcgggggcgctattgactgctgctggtgcagtaagtgttggagcatgcatgggtgctgagggttgggaggtgttggagaagggtgctcttgagctggtcaaccaatgggcgttccaaggggaaaagattattcatggcaagccttctggcattgacaattccgtcagcacttttgggaaaatgatcaaattcaagaagggggaactgacaaaccttgagtcctggaacccagtcaaaatgcttattactgatacaagagttggtaggaacacaaaggcattggttgctggtgtgtctgaaagggcgtctaggcatccagatgctatggcttctgtcttccatgcagtgaactctattagtgaagagctttcaagcattgtcgagttagcagccgaggatgagatagccatcacctctaaggaggataagctagcggagcttatggagatgaaccaaggtttgcttcagtgtatgggagtcagccattcttctatagaaactgtgttgcggaccactctgaaatatagcttggtctcaaagctaactggagctggtggtggaggctgtgtgttgactctaataccgacgttatcggccaatactgttctggagaaagtcaccacagatctcgaatctcacggttatcgctgcttcaaagttgaggttggtgggcgaggtctccaagtattccgtgtataacactcatcctatttcaaggagatgttgtaccaaacttagatggcttacctgcactgaagctgtttagattctcttcttgagttattccaagatcatgataggatattcttctcctaagcctagcggctagcaggttctgtatccagtacttgagttgctccaggattaggacattcttatgctatccctagcgatcttgtatcaaataagctcatagatgcatgatcattgctggtgtgattgttgtattaagtaaacagacttttaatcgctccaaatgttgtatcggcttcatgatgcctccacccggccgcgat

SEQ ID NO: 12759 - DNA, 1674 bp, Zea mays
gtaacataattccagattttatttaaatcaaggaatattttgacgttctattcctatatgaaacaaaatacttagaatttaatattttgattaattcttattatacaaaaaggtccacatagactgaacaaaaagggcttcatttctattttcgaatttagaaaatcacaaatttgttttcttcttatgaacagacaaatacaataactcgaagcccgaccgttttcaccgcgaactttgcaccgcgcccgaccgttttcactcttagcccacactacgttcttaataggagtatagatttcaacactttcacttcacataacggctgtgtcctgtagctgctctcttttatggttgatggttacgactgaacagatcgatcgtccttcctgtcgtttcgtttcctcgccggcagggcactgggtacgccgccgccgcctcaacgccaccacgctgccgccgcgccagttcgtcatcgcgagacacaagacacgtgcctcgcttccccccgggccggttggccgtcgctgttctgttcctatttcttggcaactccgcccgtttcacctccggaggaccgacagcgacggcgccagtagatagatgcactactgacgccactggccacctcgagctcgagtgccaagggacgccacgagaccaaccgtgaggacaggacagcggtcgcctttgcccgcggatccgcggatttcgtcttcttgggtgccatggatccagtcgccggcacggcggagcatcggggcccgttggaagtgcgcgcccgcgcgcccggcaagatcatcctcgcgggcgagcacgccgtcgtccacggctccgccgccgtcgccgctgccatcgatctctacaccaactcctccctcctcctccgccccacaggcccaggtactcccgccaaccctgactagttctactggttcttcgtgtcgtcgcggtcgctggtactcttctcacagctcctctcccttgttgccacgcaggagagggtggcggcgctggctccggcgcggtggagctggacctcagggactcgggcctcaccttctcgtggccgtgctcgcgcctccgcggggcgctgggggaggagatcagcgccaaccccggggctccggcgccgtgctcccctgaccagctggccgccattgccaggctcttgcaggaccaggagatccctgaggccaagatctggctctccgccggcctctccgccttcctttttctctacgcctccattttggggttggttgcttattccacctagatcaatcaatcttgcattgtctgtgtgatgcctgactctcgcccacattaactttttttttttcacacatgtaattggttgtgttcttgtgcagatgcaggcctggcaaggcagtggtgtcctcggacctgcccatgggcgcagggctcggctcatcagcggcattttgtgtttccatgtcgggggcgctattgactgctgctggtgcagtaagtgttggagcacgcaggggtgctgagggttgggaggtgttggagaagggtgctcttgagctggtcaaccaatgggcgttccaaggggaaaagattattcatggcaagccttctggcattgacaattccgtcagcacttttggtatgctgtgaaattgattagttttttttcattcagggctg

SEQ ID NO: 12760 - DNA, 1992 bp, Zea mays
cctcgaggccggccgcggccgttctaccaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcggcgctggagcccggggagaacgtgtgggtcgacgtcgacgtgctcatgacgcacgacgtctgcgggcccggcgccttcgacatcttcaagaaggagttcggggaggacgccagggtctgggaccgcgagaagctcgtcgtcatcccggaccactacatcttcaccagcgacggccgtgccaaacgcaacgtcgacatcctcagggacttctgtgcggagcagaacatcaagtacttctatgacatcaaggacctcagcgatttcagggctaatccggactacaaaggcgtctgccacatcgcacttgctcaggaaggccactgccgaccaggcgaggttctcttgggcactgattctcatacatgcaatgctggagcttttggtcagtttgcaactggaatcggaaacactgatgcaggttttgtgttgggcactggaaaggctcttctcaaggtgccacctactatcaggtttatattagatggagagatgccgccttatttacttgcgaaggatctgattttgcaaattattggagagatttcagtatctggtgcgacctacaaatcaatggagtttgttggatcaactgtagaaagtctaaccatggaagagcgtatgacactatgcaacatggttattgaagctggtggaaagaacggtgttgtgcctgctgatgaaactacatttaaataccttgagggtaagacatcagtcgattatgaacctgtctacagtgatgctcaagccagattttttagcgactaccggtttgatgtatcaaaactggagccagtagttgccaagccacattcgcctgacaaccgtgctccagcaagagaatgcaaagatgtgaagatcgaccgagtctatattggttcttgcactggtggtaagaccgaggatttccttgctgctgcaaaggtgttcttagcctcgggaaagaaggttaaagttcccacatttcttgtccctgccacacaaaaggtgtggttggacatatatagcctccctgtaccaggatctggtggcaaaacttgctcccagatatttgaggaggctggttgtgacacaccagcaagtcctaattgtggtgcttgtttgggtggccctcgtgatacatatgcacggatgaatgaacctactgtctgcgtgtccaccacgaacaggaactttccgggcaggatgggccacaaggaagggcaaatctacctggcgtctccctacactgcggctgcctcagccctgacggggtatgttacggaccccagggacttcctcatgtaaccgtcttgaaacaacaacagatttcatgatgtaacagagtggttgtactgctgtttttcgtgctgaacttttgtctaggcatgtccttcgttgagaaataaactgcactagaataagcagcgacttctcgggagccatagcagatgtgacctcatatttatttgtgcaactttttttgtttttggctctgaagtcatgcaaggaaaccacataaaagagtgatttatgtatgtgtcagaatcaaacaataattcgatgtcaaaaaaaaaagataaaaactagttctgtaataagaacacactacatgcagttggatgt

SEQ ID NO: 12761 - DNA, 2081 bp, Zea mays
cattgggtacctcgaaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatcttcaagaaggagttcggggaggatgccaaggtctgggaccgcgagaaggtcgtcatcatccccgaccactacatcttcaccagcgacgagcgcgccaaccgcaacgtcgatatcctcagggacttctgtctggagcagaacatcaagtacttctatgatatcaaggacctcagcgatttcagggctaatccagactacaagggtgtctgccacattgcacttgctcaggaaggccactgccgaccaggcgaggttctcctgggtactgattctcatacgtgcaatgctggagcctttggtcaatttgcaaccggaattggaaacactgatgcaggttttgtgatgggcactggaaaggctcttctcaaggtgccacctactatcaggtttgtattagatggagaaatgccgccttatttacttgcgaaggatctgattttgcaaattattggtgagatttcagtatctggtgcaacctacaaatcgatggagtttgttggatcaactgtagaaagtctaaccatggaagaacgtatgacactatgcaacatggttgttgaagctggtggaaagaacggtgtcgtgcctgctgatgaaactacatttaaataccttgagggtaggacatcagttgattatcaacctgtctacagtgatgctgaggccagattttttagtgactaccggtttgatgtatcgaaactggagccagtagttgccaagccacattcgcctgacaaccgtgccctagcaagagaatgcaaagatgtcaagatcgaccgagtctatattggttcctgcactggtggcaagactgaggacttccttgctgccgcaaaggtgttcttagcctcgggaaagaaggttaaagttcccacattccttgtccctgccacacaaaaggtgtggatggacgtatatagccttcctgtaccaggatctggcggcaaaacttgcgcccagatattcgaggaggctggttgtgatacaccagcaagtcctaattgcggcgcttgtctgggtggccctcgcgatacgtatgcacggatgaatgaacctacggtctgcgtgtccaccacgaacaggaacttcccgggcaggatggggcacaaggaagggcagatctacctggcgtccccctacaccgctgcagcctcggccctgacggggtacgtcacggaccccagggacttcctcatgtgaacgatcttgaaacagccacagagtgcctgcaccgctgttttttgtgttgaaccttagtttaggcgtgtgcccttcgttgagaaataaactcccatgtcgggaggctgccattgccatttatgttttttgcgttatatttattacagtgactgccgataacgtagttgagcgttacaagggaaatacattcattcttcccagtatcgatggcagtcactagactccgttcttacaaaaaaaaaggcatgtcgagagatcttgtagttcatacacttgttaaaacacttttttgtacaatgtatgggaaagaagctcagtcgatctttcttgttttgaaaaaaaaaaaaaaaaaaaaaaaaaaaaaaaaaagaagaaaaaggcgagacgatctaaaagaaccaaggtaacaaaaacaagcatgtaaacgg

SEQ ID NO: 12762 - DNA, 999 bp, Zea mays
acgcttggcagttggcaagcagcgagtggggggagacagccaactctctatcctcttcccccctcgtccatccccatcccaccgccttgctctcccctctccacttccagctgtccatggctgcagcagcgtgctcctctgcctcgccgctcctcctcccctcagggccgagacatgcgtcggcctccagggcgtggtttctcggcggcaggagcagggcgctgagatcagaggcgccgtgctgctgcaaggccgccgccgcccgtggaagcgctccgcaatgcgggacggtcggtggtggcagcagcagcacccggagggggctgctaggcgtggccctgggagcctctgccttggggctggccgcgtttgacgccgtcgccgccgggttgccgccggaggagaagcccaagctctgcgacgccgcctgcgaaggcgagctcgaaaatgttggttgagcctccgtgcctatggtaactacagaatccggactgcagtacaaggatatcaaagtgggcgaagggcctagcccacccgttggtttccaggttgcagcaaattatgttgctatggtgccaactgggcagatattcgacagttcgctggagaaaggtcagccctacatattccgtgttggatcagggcaggtgatcaaggggcttgatgagggaattttgtcgatgaaggttggaggactacgtcggctgtacatacctgggccattagcgttccctaagggtcttacttctgctcctggaaggccaagagtacccccaagcagccctgtcgttttcgacgtcaatttactgtacataccaggtctcgatgatgagtgaaggcattctgtggcaacagtcatctttttttgtatacttcattcgagagcaacatactgtacatctagagcacaattctttcaagctataaaatctatgcgaatatctatgttaaccgacaaaaaaaaaaaaaaagggcggcagctcgcgatctagaactagt

SEQ ID NO: 12763 - DNA, 1002 bp, Zea mays
tgggaccctcgaggccggccgggtactgtgcggtcgctcaggcaaggcagttggcaagcagcgagtggggggagacagccaactctctatcctcttcccccctcgtccatccccatcccaccgccttgctctcccctctccacttccagctgtccatggctgcagcagcgtgctcctctgcctcgccgctcctcctcccctcagggccgagacatgcgtcggcctccagggcgtggtttctcggcggcaggagcagggcgctgagatcagaggcgccgtgctgctgcaaggccgccgccgcccgtggaagcgctccgcaatgcgggacggtcggtggtggcagcagcagcacccggagggggctgctaggcgtggccctgggagcctctgccttggggctggccgcgtttgacgccgtcgccgccgggttgccgccggaggagaagcccaagctctgcgacgccgcctgcgaaggcgagctcgaaaatgtgcctatggtaactacagaatccggactgcagtacaaggatatcaaagtgggcgaagggcctagcccacccgttggttttcaggttgcagcaaattatgttgctatggtgccaactgggcagatattcgacagttcgctggagaaaggtcagccctacatattccgtgttggatcagggcaggtgatcaaggggcttgatgagggaattttgtcgatgaaggttggaggactacgtcggctgtacatacctgggccattagcgttccctaagggtcttacttctgctcctggaaggccaagagtacccccaagcagccctgtcgttttcgacgtcaatttactgtacataccaggtctcgatgatgagtgaaggcattctgtggcaacaatcatcttttttgtatacttcattcgagagcaacatactgtacatctagagcacaattctttcaagctataaaatctatgcgaatatctatgttaaccaaaaaaaaaaaaaaaaaaggccccta

SEQ ID NO: 12764 - DNA, 2747 bp, Zea mays
  misc_feature (46)..(46): n is a, c, g, or t
  misc_feature (2345)..(2345): n is a, c, g, or t
gtttgtgcatatgttgagacaatatgagtatacacccttttcatanaatctcgaggacgagatttctattaagggggtaggatttgtaagacccaaaatttatataagggaaaaatattaaaataaataaagaaagaaataaaatagtaaattcagatatctcaaattatacttgagctttgaattttgagggctgaatctcgaaaccaaggattaatttagaaaagaagtaataggaaggttttctattcaacttaatgattattcatttcattaaatgatatattataagcatttatttaaatgagtattggtagataaatgtagtgttaaatttagatgactcaaatctacatgggaccattaaactttatttttaaaactcagaaaaataaataaattggaggattttctcataaaagtgaatatatattagaaagtatgtcttcatgaaacgaaataagtaataaatattgaagctttggaaatgaatttctaatggactacacattcaaaatactttcatagagtgaatattatgttgcattttgaaaacataggctaaacaaataagtaaggaagtaagtaaatgaataaacttaattcatgtgccttccatttatgttggaatatttttgagtgaaaattagaacttcgtttgaatttaaatctaattggaatttagaaataagaaacaggaaattataaaagaaaggtaaaaggataaaactcatattgggccaaacctgtattaggcggctttaccaccccgttggcccacatgtccctctaatcggcccagctctcgtttccctaaatgtgtgcgcgtggcccagcatcaccgcacggtcgtcgcccatactctctaccgctcggggcccacctgtcaggctgtggacttctacctcgtgtatctctctccgctcgctggcacattggccccgtctgtcaaatcttcgttctgcgtcttgcccgggctgcgcgcaagcttcgcaacgggctcgccgtagaatccgcgtcgccccaacctcctgggcgcggactcgcccactgagccgctgcctgtgggcccctgtggccgggtcgtcgtctccataccgccattaccgcgcaccgcaacggcttggccgagtttggcggacctcgcctcaccaacgtgcgatccgcaatccaggctctactgacctcctctccttagtataaaggtggcctgggcatctcccggcccggcccccccgcacgagctttgcagcagccattactatgtagagagcgcagagggccgtcacctggtccgctcgccgttgtgtccattcggggcaaacacagagacctcgggagcctgccgcacctccatcgagcggaacggaagaatggtgggagaacagagaaactccaccgccatggcccggcgccgcgcctcctctggtgcactggtaccgctgccatgtgccgtgcagtgcgttggtgggatcctgtcgtcgtggtgggaatccagcggccctgggtaattcgggtgtgcgcccacatttggcctcggtgaccagctacaggattccgccgacatctccagtgcaaatcatgtggtcattccgggtggattgatgccgggggaccctgggattgttcaccggaaaatctacacagcggcaaagcgactctgagcggtgaccggagtgattacgccatcccatttggtaagaagcttacctgtcaattctatttttcctccgcaacgcatagatcgtctcggtgtggggttttaggctcggaatccgggcagggggtggtgcgtggcatggcgccgccgtgtctggttgggcgcgccccatggcctgccgttgggatgaagaagatggccccctgaccctacgatctgatacatgcggtcgggattagtcctgcgcatgccagttggctcgggtgagaagggtcgtccgatgcgagtcaaacgcgtaggatttaatctgcgacattttagactgcatccgtcgatcaccgatccgacggtcacgggcgcataccggttcatttatgagtccgggataatatgcgccgtaagctttagatccaacggcccacagttgccgataccccttcgccctggccgtcttttaaaagagcccctctattttgttagtattaacccgctgtccacgccaggggctctgtgtcttaggaaatgtttgtagaggcccctgtgttttctgtaaatggtgtgctcagtccagggaacagaaaatcaaaagaattcatttagaaaatacatttttgtgtgaaaataattatgggaacttaattaattcctagaaaatgcattttaactactttttagtccattccantttctataattttgtaatattattgtgtatcacctaatgtctctgttttaacatgaaagccactttaaactttattttctaattaatcttatatcaaatacataaaaccttaggaaattcgtaactctcccgttttaactccgatttgatccgttcaaattgcgttagtcctgtataaatatttactatgtaataacaacagttattataacatgtctcattcttttataattagatcattatttaactgatgttggttaatctagttaaactgcttatcattatggactactagaatatgatctatgatcaatttataacttagattaaagttgaattaattactactttaggttatctctcctctgcaattataacataaaaatagaacctggtgtaacg

SEQ ID NO: 12765 - DNA, 599 bp, Zea mays
gctctcaattgtggctggggtcctcttccacgggtcttcttccacaattcatggtaacagactccaatagaagatgccaatcacgcgcatgcctgcgatctggtgggtggggttgtgagattcctgatcccgcctctgcccatataacgtagacgcaaaaccccccaaccctcatcttaggcgccgccaaaccaccgtcaattgagcaagcatcgacgagaatagggaagaagtacatgaatcaccgcgggtccatgcggtggcatggttgggagctctgcgctgggtggattgcgtgcggacacgaggatctgaggaatcatcctggtacctggaatctcaagtcccaggagaagaacaggtggttcaagaggatccacacagtgaggagttcgatttgatctaggtggcgtctcccagttgactttatgacgccaaggatggactttagtttgatctatatttatattttattttggaagactaccactatgtaataagtactctgatgatattgtgacatttatctctatacactctgttactaaataaaatctcgcctttggcgcatatatgagatgcacccgactttatccttt

SEQ ID NO: 12766 - DNA, 733 bp, Zea mays
cactccctcctaagggcgattgggttcctcccggccgggcccgacccggccatgcttcgcagcagccattaccgtgtagagagcgcagagggccgtcacctggtccgcgcaccgttgtgtccgttcggggcaaacaccgagacctcgggagcctggcgcacctccatcgagcggaacggaagaatggagggagaacggagaaactccgccgccatggcccggcgccgcgcctcctatggtgcaccggtaccgccgccatgtttcgtgcagtgcgttggtgggagcccgtcgtcgtggtgggaatccagcggccctaggtaattcgggtgtgcgcccgcgtttggcctcggtgaccagctacaggattccgccgacatctccagtgcaaatcatgtggtcgttccgggtggattgatgccgggggaccctgggattgtttgccgggaaatctacatagtggcagagcgactctgagcggtgaccggagtgattacgccatcccatttggagaagaacatgtggttcaagtggagccacatatcaaggagttcgatttgatctaggtggcgtctcccagttgactttctgacgccaaggatggattttagatcctgttatatttatcttttatttttgtaagacttccgctatgtaatatgtactctgattatattgtgacatttatctctaaaaaaaaaaaaaaaaaatttgcggccaaaaaaaatttgcggcc

SEQ ID NO: 12767 - DNA, 4526 bp, Zea mays
  misc_feature (3136)..(3136): n is a, c, g, or t
ctcactgaaataacttgcacatgagtaatttgaagcgtttattcagcaagcctaacacaggaataccttcacccaattcgggaacccctagttctggcagcgcaacaccggcttgttgttgacgccccctgcgttggcgttctctacttttgtcgtccgccccctgctgtttttttttttggaatcctgctgctagcgagcatgaagcccatcgtgtggctctaattcaacggccgggttactcgctacaggctctcgacgggccatcccgcaccggaacccccaacccggcaagcctgcaaatcagagactgtagaagcgggtagtacctggcgtacgtgcgtggtccacagatcgagcgagaacaagaacaagcggtagtaggatcgctacaggcaggggcgccgggcgtggaaaaccgtgcgtgcgcagtaggcaaggaacatgtgagatctccgccatttccacttcaatttactttgcaactagcactgcctagggctgccacgggtgtttttttgaaagagttcagagtctgtctgaatattcaagaacgacgacttggtcctctccacatgcacacgatgtgcactatccatatgcacacgatatgatctgcactctctgcatccgcatgcataggatcgtaaacaagcgtgagccaagtctcaccgtatattgtaactctcctgcctgccactgcccgagcggcctatataaaccaccgatccgccgcccccccgggagcacaccagcccactcgcgccaccacctcacctcgcctccgcgcgcggtcgatcactccaccaccacacacatcctccgtcttgcacgaccagctgcacggtgtagccatggaccagctccccaagcgcccggccaactacgtgccgctgagccccgtggggttcctggcgcgcgccaatgccgtctacgccgaccgcgcgtccgtcgtctacgggggcgtccgcttcacctggcgccagacgtacgagcgctgccgccgcctcgcgtccgcgctgctgtccctcggcgtccgcaggggggacgtcgtctccgtgctcgcgcccaacgtgccggccatgtacgagatgcacttcgccgtgcccatggccggcgccgtgctcaacgccatcaacacgcgcctcgacgccgccgccgtcgccaccatcctgcgccactccggggccaagctcctcttcgtcgactacgactacgtgcgcctcgccggcgacgcgctccgcctgctcgccgccgccgccggcggcaccgtcccgctcgtcgccgtcgtcgacgacatcgactcgcccacgggggcccggctcggggagctcgagtacgaggccctgctcgcgcacggcgaccccgacgccgacctcccgccgctcgccgacgagtgggacgccgtcacgctcaactacacgtccggcaccacgtccgcgcccaagggcgtcgtctacagccaccgcggggcgtacctgagcaccaccagcctgctgctgcagtggggtgtggccaccgaccccgtctacctctggacgctccccatgttccactgcaacggctggaccttcacctggggcatggcggcgcgcggcggcgtcaacgtctgcatccgcgacgcgcgccgcgccgacatctaccgcgccatcgcgcgccaccgcgtcacccacatgtgctgcgcgcccgtcgtcttcagcatcctcctcgacggcgacggcgacggcgacggcaggcagctcgaggcccccgtccacgtcctcaccggcggcgcgccgccgccggccgcgctgctggagcgcgtcgagcggatcggcttcaaggtcacgcacgcctacggcctcacggaggcgacggggcccgcgctggcgtgcgagtggcgcgaccagtgggaccgcctcccgctcccggagcgcgctcgcctcaaggcgcgacaggggatcagcgtcctgtccctcgccgacgccgacgtcaagaacgtcgacaccatggccagcgtgccgcgcgacggcaagagcctcggcgagatcgtcctccggggcagcagcgtcatgaagggctacctcaacaacccggaggcgaacgacggcgccttcaggggcggctggttcctcaccggcgacgtcggcgtcgtgcacccggacgggtacatcgagatcaaggaccggtccaaggacgtgatcatcagcggcggggagaacatctgcagcaaggaggtggaggaggtgctgttccggcacccggccgtggccgacgcggcggtggtcgcgatgccgcacccgcgctggggcgagacgccgtgcgccttcgtcgtgcccagggacggcaaggcccacgggctcagcgaggacgacgtgctcgcgttctgcgccaggcgcatggcgcgcttcatggtccccaagaaggtggaggtcatcggtgcactgccgaggaacgcgctgggaaaggttgagaaggtcaagctccgggaggcggcacgtaagctggcgccaaccgtgccggcgcagataaagccaaaagggaagacgacgacctcaactgtggtcggcggtggtcgctgcgaggagcagccggtgtcgaggttataggtagcaaaacactacagaccataacttgtgttcaacttcttttatgtgcagtgatattgtaggtacttaattattacgtgcacaatgtaaaatacatgcatggtgtcgaaacgtgaaggaaataaatttcttttttgttctggttccagacaagagagattgtgataagagttcctgctttgcacttctttttatctcgttaacccggtggtagtgactgaaattccagtacgataactaattcgcgtattccaccggccaaacccttctccgtgatcaaattaatttctagaaattattatagaccaacaagtttttttttggtaactttggaaccaatttttacgtagaatagcactaacatccatagtacagtatggtaacttatttgagcaatttccgtatcatttatttggccatattaggcttccatagcatctttaatttgcgacaagtacatactacggaaattacaccgttacaaaaaatttggagacgattgaagttgtgaattagttttcatctccatctattatatgggtttccantacgtatattccaccgtatactctttaattaggtttttgtttgattaggagcggattaaaagagattaaatccttattagtcaaaatgaaatagaaatacttcgcaaagctaaattatagtaagataatatatgaaattgatttatatctctcacctctgaatttaagatatatctaaactttagaaagttgtgaaatgttaaataattttaaacgaaaatagcatggtctgtaaaatcgatctcaattcctcaaaaaaaaaaaatatacaaaagtccaaacaaggccttacatttgtcgcgtgcaaaaaaagaaaaagaaaaatattttgtaaaggaatcatatatagcacgcttttccggaataaagaaaccccaaagcccaaaggaattcaaaacacatttaccacttcgattaatccttgttttgtacgccaactgccgagagaagaggtccgcaacatgcacaaaacgtaaaggagtcaccgggagcagcagatttaccagtgaagcgaaggctcctccctgcttttaccaaaactatcacgaatggaatggcaccaccggcatgaaataataatatatattgctatatttatatatatctgtctctcgtttggtaaatggtaggttttaaacctttacaaaaaaaccatgacacgttttccatgctccaagcatcactatctccgtgcatcgtctaataaaactttatttgcttgtccacacctctgacccgtgtctcgtgtggatcattactttgctgtgctgatcacaggcatttcgagaggaaaaagatccgaccatcgataacatgatgtagatactccatttgtctatgaattaataactcaacttttagaactggcctcaattatttttttaaaagtttacctaagttttatagaaaagaagataaatgccaatgtatatagaattaatataattaggtataccacggaatatacttttatactacacccctttttttgtcacagatgttagtaaacttctatatagtaattagccgtacgtgtgcctatctcggtcctccccaagaaaaacaatagagcaacagacaccatatgcaagttagttgcgctttactactaccttacacagcttggataaaaagcaaaaagtgcagccactttaatttcatctcgcgaatttatttgaccctgacctgttttattttcctcaaaccgcatgtgtatcatggacagtagattccccctctatctccaatgagtcccaacaaaacaagcaccacgaaacaaacagtgacatgcctactgtccacacgaaacacatgtccaccatctaaaaaaaagattattaaaacgttgtctgatgcctacgtgaaagaagaggggggggggggggggggg

SEQ ID NO: 12768 - DNA, 1612 bp, Zea mays
ccccccccccccccgccgtcccaacgccgtacccaggggccaggggtgggcgggcgcaccgcaccgcacgtcgctgtcgcgcgtcggcccggagaacgcgtacgccgcccgtctcctccctccccgcgataaaaggccttcccctcctccccagcccccaccagctcaggccagccgtgcggcagcttctcccctcgcctccccccctcgtctccgcacagagagggctcctcgctgccgtgtgccgggcttcactttcccctctcgtctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgcctccgtctcgccgccgccgccctcctcctcctcctcgtcgccggcggtgctccagttcgacgagcagcagcagcagcaaaatccgaggccgcgtgcgccggcggcgtccgggcccacggaggaaccgcccaggccggcccgggcgtcagctccggctccggctccggcgtcgtcctcgtccgtccgccggtgccagacctgccgcaagcgggtggggctcacgggcttccgctgccgctgcggagacctcttctgcggcgcgcaccgctactcggaccgccacgactgctgcttcgactacagggccgccggccgcgacgccatcgccagggacaaccccgtcgtgcgcgccgccaagatcgttaggttctaggcgtctcggatccggccggaggagctagctagctagctaggggcgggcacacacacgcacacgcggtgatgggcgccgagatccgtcgccggtcctcatcgccctctatagtccgtccccccttcctctcctcctctccctctttgattgtcctctccttttcttcttgctgtcatctatttttattgcgagggggaaaaatgatttgatggtcaccgatcgatccgtccttggagggtgttggttatgtgttgatcgccatgctgttctagaaaattattccgtctacgaggacgacgatcgacgagaagcgtcgaaaaagagaggggagagagaatgaagacgaaaagaatagtgcgatgataacgttgttgttgttgtttgtagcggtggtggtggtggctggtggaagcgatatggttcggttcggttcggtgtgctcttgtcctgctgcgaatcacaaattcctgttgaattttttttatatatctttgtataaaacgaaattgaaaatgtttatatggtgtgccatgacagctataatactacccatttcattcgtaaaaaaaaaaaaaaaagtgttgtggtggtgaccggtgcggtgtgctctaccacaccatcatggttggttggatggatggatggatcagctcaccagctgctaggagagtagccgacctaaattattattttacatatcgtagagccagacgacagagagagagctcaaagctgtaccactcgagctggaaaaaaaaaggtcctccacccaataatctttgtgagcatccagacacaggcaa

SEQ ID NO: 12769 - DNA, 915 bp, Zea mays
gcacgagaccattacctagaacatcctaatcaaaaagctcaggccagccgtgcggcagcttctcccctcccccccctcgtctccgcacagagagggctcctcgctgccgtgtgccggccttcactttcccctctcgtctcctctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgtctcgccgccgccgccctcctcctcctcgtctccggcggtgctccagttcgacgaccagcagcaaaatccgaggccgtgtgcgccggcggcgtccgggcccacggaggaaccgcccaggccggcccgggcgtcagcgccggcgtcgtcctcgtccgtccgccggtgccagacctgccgcaagcgggtggggctcacgggcttccgctgccgctgcggggacctcttctgcggcgcgcaccgctactcggaccgccacgactgctgcttcgactacagggccgccggccgcgacgccatcgccagggacaaccccgtcgtgcgcgccgccaagatcgttaggttctaggcgtctcggatccggccggaggagctagctagctagctagctaggggcgggcacacacacacacacacgcggtgatgggcgccgagatccgtcgccggtcctcatcgccctctatagtccgtcccccttcctctcctcctctccctctttgattgtcctctccttttcttctactgtcatctatttttattgcgagggggaaaaaatgatttgatggtcaccaaaaaaaaaaaaaaaccaaaataaaaaaaaaaaaaaa

SEQ ID NO: 12770 - DNA, 893 bp, Zea mays
  misc_feature (879)..(881): n is a, c, g, or t
gcacgagaccattacctagaacatcctaatcgaaaaaccatcgctccgattgtctcgtctattcctcatctcgtggatggtggcggcgtcctatctctgttgctgttgatgatttcttgaacgcacgacgaacgcgagctatgtcgaaccctaccaaatcacagattccctcggtcggtccccaaccatagcggctgtcaaatccccagatcaaatgcttattcggtgggtgcagagataaaactgtcgcatgcttcctccctcgcaggccgggtccaaggaaacctgctagctgccatgtcaaaggaaggtgcaagggcgtcctggaactcaacatatgagaagggtttagtcgatgtactacatgacaacaaagataacccaaagttgaagggtcaaaatggatggaattcagagggatggaagtgtatcactgctaagtttaatgaaaggttctctttggctcatttcacaaaacaacaattacaagagaaggacaaagaacttaaatcaagttataaagcagtaagagattcaagaaaagaaagttggactggttggaatgactccctatgtatgatattagctgaaccagaggtttgggcaaggttgattagtgctcacccaaaggttgcaaggtttcgcaagaagccatttcctcttttctactctttagaagcactttatgaagagtgctaagtggaagcaacacttgaagctgacatggagaagaaaaatggaacaccaatccacatgaagcttgtaaaaaagaagttaaactaataatttattctagtgtcaaagttcataatgactggacttgtactctgttattatgctataataatttgttgaatattagaaaaaaacaaaaaccannntaacaacccaag

SEQ ID NO: 12771 - DNA, 1697 bp, Zea mays
cctcgaggcccggcggggtcgggccctatccctctggcctcgtctcgtcttctcttctcgcgaatggcggcgctgtgcgatctccgtcgctgccccctccgccagtgatttctgggacgcgcgacgaacacgagttggaaggaggtggtcgtgctttgggcggcgaaggacctgggcgctagcagcctcagaccctgacagatcacaacctgacagatcacagataatgggttcttgggaggagaatgttaggcaatttttgttggaggaggaggaagatgatgatgaactattctttgttattctccctgctataatcccatacctctcggaagagaaaagacccatccacacatcctccctcaccggtgctaaaaaggttaaagaaattcttgaagggcatgagagctggtgcaaatctgagtttagaatggaaaaggaaatattcaaagccacgtcaaattttcttagaagggagaatttactacgtgacacacgaggagttagtgttgagaagcaacttgggatgttcatgtatatgatctcccacaacgccagtaaccaaatgctacaaaaggcttttcaacacagtggagagactatccatcgaaaaatatctgaagtttttgagatagttcccatactaactcaacgatttgtgaagcttcctagctcagttcaaactcatgctaggattgcaacagattctaggttcatgcccttttttcagaattgccttggtgccattgacggcacacatgtatccatcactatcgcagaagatagggcccctccatatagaaatagaaaaggaactctttcacacaatgttatggtagtctgcgactttgatctcaattttacatttgtctcgtgtggatgggaagggtcggcatcagacgcaggggtgcttcgatctgctattagcaaaagatttagtgtgccagaaggaaagttttatcttgtagatggtgggtatgcaaatacaccatcatacattgcaccatacagaggtgttcgataccatctcagtcaatttaggaggagtcgttcatcacaaagtggttatgcaaactacaaagagttattcaatcatcgccatgcaattctccgcaaccatatagagagggccattggtgttcttaagaaaaggttcccaattctaaaagtagacacattccatcccatagaaaatcaaatcaagatcgcagctgcagccattacatttcacaacataattagagggcaaaatggtgatgaaggatggctggacaaccaactagattatatatctccaagccattacattggtgttacttggtacttgcagagtgctgagtggaagcaacatatgaagctgacacggaaaaggaaaatggatgatctccttggttatgtttccctgtcttgtgcatgctgcatttcctgctaccgtgaagaccggggtccaggagagtaggagactgaaagcactgtcgagaagactgaaattatcacattgacatgaagaccaaagccatctcttacctacttatctttgtagcttacgtttctattttattctgtcatgaaaactaaagtcttatgtatggtcattatgtactattttggttctgaaaatatttgtttatgttatgaaaactattggttgaaagaatggtgattacggttttggcttgaaggttcagaagtaaaaa

SEQ ID NO: 12772 - DNA, 517 bp, Zea mays
agcagtggtaacaacgcagagtacggggggcacgcgtcgggcagctctcccgagcatgacatcgtttctgttcacaactcttccgagcatgccgtcgtctcctttgtcatcatcatcagctcagatctagcaacttcgccttctcagagtgttaagtggaagcaacatatgaagctgacatggaaaaggaagatggaacgacactccacatgaagcttgtaaaaaaggagtcaaactcaatttagtctagtgtcaaagtttataatgaagggacttgtactctgtttctatgttatattatctatttgtacgtgtgaatggagatgatcttatgtgtgggatgatggatagattaactttgatggatattagatgatatttaagttaaactttatcggatattagatgatcaagtctggtgcatgatttttagatttttagcgctggtttattggggttttcaaaaaatccactcttctcaaaaaaaaaaaaagtactctgcgttgttaccactgct

SEQ ID NO: 12773 - DNA, 2718 bp, Zea mays
  misc_feature (2410)..(2410): n is a, c, g, or t
  misc_feature (2429)..(2430): n is a, c, g, or t
  misc_feature (2434)..(2434): n is a, c, g, or t
  misc_feature (2442)..(2442): n is a, c, g, or t
  misc_feature (2504)..(2504): n is a, c, g, or t
  misc_feature (2510)..(2510): n is a, c, g, or t
  misc_feature (2570)..(2570): n is a, c, g, or t
  misc_feature (2599)..(2599): n is a, c, g, or t
  misc_feature (2613)..(2613): n is a, c, g, or t
  misc_feature (2633)..(2633): n is a, c, g, or t
  misc_feature (2675)..(2675): n is a, c, g, or t
  misc_feature (2680)..(2680): n is a, c, g, or t
cactggggcccccgcggccccccccgggacggacccatcaaaagaggccccttcatctttggtggcctagctggattggatatttggactagtgttcttcttggcttggccacccgcctactccgtcttcttcatacgagacaagccgtgcgcttcttcttggcctagcccttcgagcagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtcccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagatggcggaaatggagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatctcagtggaataagtcaagtgctcttatgaaccaaaaaaaaaaaaaaatctggcccgtccccatcttctggcagataccgcaggacttcatcatccgctgcgcggaggtgtttacctttctggggcatttgtggtttttttttttcctttctctcttttcttttatgtttttttttctttttttttttttttttacctatttttttttttttgttttttttttttttttttttttttttttcttttttnttttattttattttatttnntttnctctctcnatttttttttcccttttcttttcttcttcttctcatatttttatttttttttttattttttnttatcnttttctttttttattttttttttttttttttttttttattttttttttttctttttattnttttttattttttatttttttatttttcntatttttttttatnttttatatttaataattttntttttttttttttttttttattttttttattatttttttttnttttnttttttttctttttttaatttatataatttttttttta

SEQ ID NO: 12774 - DNA, 2230 bp, Zea mays
gcacgaggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcctactatggcatgagcaccaacctggtgaactacatgaagacccggcttggccaggtgaactctgtcgcctccaacaacgtcaccaactggcaagggacgtgctacatcacgccgctcatcggcgccttcttcgccgacgcgtacatggggaggttttggaccatcgccatcttcatgatcatctacatttttggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacactatcagcgtcatcgtctgggtccccgtgtacgaccgcgccatcgtgcccctggtgcgctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtctcgggggcgaattggttgtttaaaaaacaaaaaaatatataaaaaagcggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12775 - DNA, 2247 bp, Zea mays
attggccggccgggctgcaaaaagggtttcgtcctcctcttcgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagatggcggaaatggagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatctcagtggaataagtcaagtgctcttatgaatcaaaaggtgttgaggatttgacgcgtcaaaaaactcgag

SEQ ID NO: 12776 - DNA, 2041 bp, Zea mays
  misc_feature (1440)..(1440): n is a, c, g, or t
ccgggagagtctagcggacgccccccctccccagttcccacgagatcccgactcggacgaagctctcctcgccggccaccgtcgcggcagcttgctacgcacagggagtctgcggcgcgcgaggaatacagcgagggatggggtggggcacagtggtttacgagggcgcggtcgtcggctcgtcgctggtggggctcggctgggcggggctgtggttcctgaaccggcggctgtacaaggagtacgaggagcggcgggtgctggtgcagatcctcttcggcctcgtctttgccttctcctgcaacctcttcgagctcgttctcttcgagatcctgcccgtcctctccaagcacgcgcgcttcctcaactggcacctcgacctcttctgcctcatcctcctcctcgtcttcgtactcccctactaccactgctatcttctgctccgtaactcagggatgaggagggaccgggcgtggctcgtcgcggcgctctttctgctggtcttcctatacgggttctggcgcatggggattcacttccccatgccttcaccggagaagggtttctttacgatgccgcagttggtcagtaggattggggtgattggagttagtgtcatggctgttctttctggttttggtgccgtcaatctgccatacagttatctgtcgctattcatcagggaaattgatgaaacagacatcaaaaccttggaacgacagttgatgcaatccatcgagacatgtactgctaagaagaagaaaattattttgtcccagatggagatggagaggattcaaggatcagaggagaagttaaaggccagatcgtttctgaagcgtatagtgggaacagttgttagatctgtgcaggaagatcaaactgagcaggatataaaaaacttagaagcagaagtccaggcactggaagagctttccaaacagctgtttcttgagatatatgaacttcgtcaagctaagatagctgctgcgtattctcgaacttggagagggcatcttcagaatctacttggatatgctttatcagtctattgtgtttataagatgctcaagtccttgcagagtgtagtctttaaggagtcaggctctgttgatcctgtaacaatgtcaataacgattttcctgagacattttgacattggcattgatgttgcactgttatctcagtacatatctttgatgttcatcgggatgttggttgtcatatctgttcgaggtttcttggcaaatgttatgaagttcttcttcgctgtttctagagttgggagtgggtcgacaaccaatgttgtccttttcctatcagagatcatgggaatgtacttcatatcttccattcttcttataagaaaaagcctggcaaatgaatatagggtgatcattactgatgtcttgggtggtgatatccaatttgacttctacncatcgctggtttgatgctatatttgtggctagtgcgttcctctccttgcttcttatatctgcccaatacaccaccaggcaaacagacaagcatccgattgattgatgcatcttgcccacaatgtgtgcatgttgtctttttaaccagtattcatccaaggttgacccattctttgtaccacagttttccagagcactgtttctccatacacttccatacacagttacaaaacataatacgtcagttaacttgaacaaagtctctattttgtaatatgtttcccgattgcattggtttatggtaaacagttcctccaacagcggctatctgagtcacgtctggtgatgcagtgacgggacacgggattcattgtaatgcagtctgcacgatactactttttgacttggacaattgtggaagcccatattaggaattgattttgactttgtaaaatagcttgaaactagtgtcctagcaccgtagcacggtatgttggtgtatcttatatatttttttggctgtttcatgtataacacacttcgcgacaactctgaatggtagatagatctgtttcttcatgtgacttcaggatgacgcggcc

SEQ ID NO: 12777 - DNA, 1308 bp, Zea mays
gggagagaacccctcccccccttttggggggtttttttgtgggggataaaaaggggtttttgcgattttggggcttttggggaaaaaaagaggggggttttttaaaaaaatattttggggggtttttaaaaaaaattatggcgtctaaaaatttgcctttcccacttgaagggggggaaaattttggagaaggaataatggggggggtctttttttttttttcccacaatgggaaaaagggggaatttttttcaaggggattaaattggggtaaccccggggttttccccatccaggaggttgtaaaaggggggcaggggattgtaatacgcccctttatgggggaattggggtaccgggccccccctcgagtcagctacggtaggccccccccccgctctgttgatcctgtaacaatgtcaataacgattttcctgagacattttgacattggcattgatgttgcactgttatctcagtacatatctttgatgttcatagggatgttggttgtcatatctgttcgaggtttcttggcaaatgttatgaagttcttcttcgctgtttctagagtcgggagtgggtcgacaaccaatgttgtcctcttcctatcagagatcatgggaatgtacttcatatcttccattcttcttataagaaaaagcctggcaaatgaatatagggtgatcattactgatgtcttgggtggtgatattcaatttgacttctaccatcgctggtttgatgctatatttgtggctagtgcgttcctgtccttgcttctgatatctgcccaatacaccactaggcaaacagacaagcatccgattgactgatgcatcttgcccacatgtgtgcatgttgtctttttaaccactattcatccaaggttgacccattctttgtaccgcagtttccaaaggcactgtttctccatacacttccatacacagttacaaagcataatacgtcagttaacttgaacaaagtctctattttgtaatatgtttcccgattgcattggtttatggtaaacagttcctccaacagcgactatctgagtcacgtctggtgatgcagtgacgggacacgggattcattgtaacgcagtctgcacgatactacattttgactaggacaattgtggaagcccatattaggaattgattttgactttgtaaaatagcttgaaactagtgtcctaggaccgtagcacggtatgttggtgtatcttatatattattttggcaaaaaaaaaaaaaaaaaagaattcctgcagcccgggggatccactaagtctagagcgcc

SEQ ID NO: 12778 - DNA, 2172 bp, Zea mays
aaaggttccgcccccggccttcctggcctggcctagctcctctcctctcctccggcttgattgatcgatcgatcgatcgatccagccagccatccacccatcccttccaagtttccaactgacattgccgcgccgcgcaggcgcagcgcacgacttccgccctccccaccctccgcctcacgcatataaacgcgcgcgcctgcctcccctacccccgcctgcctgcccacgcgctccgctcctcgccccctcctcttcccacgccgccgccgtacccacgggcagggggcacggctggtggctcatcgctcggcccgctccccctccgtcgcaaccggaacataccagcaccggcgctgcggtattattcagctccgtccgccggccggcgcggacggacgccaggcttccttcctgtctgcataacaaagccgccgccattatgatctccacatatgatgcttagcatttgtcgctcgcagctgtattgctcctctagctgcatccttgtactagagcatggcgaagctcgcatctattgctcgcagtatgcttagattcccaaacggaagcatgaggcttgttatggtaacggttattggagcagtccttggctttttcattgggatttcattcccttcggtcagcataacaaagcttcactttccagatagctttatttcgtacattgaagacaaagacgctggactcacgacccaagctatactcaatcatgcttggacttctgccagaaacgcaaggggaaatggtaccgaaccgacttcaaacagtaccttaaagatttatgtcccaacgaaccccaagggtgcagaggggctagcaccaggtatcgttgtatcagagtctgacttccatttgcgcaggttatggggagacccaagtgaggacctgcctttcaaaccaaagtaccttgttacctttactgttggagttgagcagaaagcaaatataaacagagctgtgaagaagttttctgacaattttgctattctgttattccactatgatggccgggtgagtgagtgggatgaatttgagtggtcccagcgagctatccatattagtgtcaggaaacaaactaaatggtggtatgccaagagattcctgcatcctgatattgtggcagcttatgagtacatattcatttgggatgaggaccttggggttgaacattttaatgcagaggagtacatcaaacttgttaagaagcataacttggacatctctcaacctggattagagcctgatcgggggttaacatggcagatgaccaaaagaagaggtgacagtgaggttcacaaggacacagaggagaggcctggctggtgctctgaccctcatcttccaccgtgtgctgcttttgttgaaataatggctccagtcttctcaagagatgcatggagatgtgtgtggcatatgattcagaacgacttggttcatggttggggcttggattttgcgctcaggaaatgtgtggagcctgctcatgaaaagattggagttgtcgattcgcagtggatcgttcaccaagtggttccttctctggggaaccaggggcagtcagaaaacggaagggcgccatgggaaggggtgagggcgcggtgcaggaaggaatggggcatgttccagaccaggatggcggaggcggagaaggcgtattacaagatgatgggcatcacccctccaaactccacgcgtgtctagccgcgcctctcttcttggttttccatccccgccaccctgacctttgtggtggcgggtgagctgatgatactatactatagcactacttgattatagggagttagagatggtgggtgtagctgcttttgatggagaggtccttctgtaagtaaatgcgaggcgaaactgtgatgagaaaacatgtacacgaggatgattacctgatgatgatgatgatctatctattataaaaaacatatataccgttaccgagcattgcgattgttctgcagcgcttttgtagcttgatccgaaacccactttgtttgctaatgctgggcgatccatgttgcctcgtgatgttcagaccaggtcggtgctgtaaccttgactgctgcgctggaatgaattttgctgccattaaatttgcagcggacagcatattactaaaaaaaaagtcgacgcggc

SEQ ID NO: 12779 - DNA, 2019 bp, Zea mays
acggttccaccgctttgttcgtattttgcctttgcttcgcttggcttcctccctccgaggttccccagacccccaaccaaccaaaaccctatccgccgcccccgcccccgcccttggctgaggacatgtatccaccgctcggggacgcataggttgtgttacgagtgggagaaagcttcttcagtacgtgctgatctctccgccacacctgcacaggagtggccatagatcgccggaacgcgcctccgccgccggacgcggcggcggagaaggatgagagcacccagggtctacaactcccggaggacatccgctgggagcggctcgacaaggcgcgcttctttgtcgtgggcgccgggctcttctccgccgtctcggccgcgctctaccccgccgttgtcctcaagacgcgcctccaagtcgcccctgcggcggccgcggcggctgagtcagcagcgctcccgccctccgccgtcgcggcggcgactgccatcctgcgccaggagggggccctcgccttctaccgcggcttcgccacctccctcgccggcaccatccctgcgcgcgcgctgtacatgggcgcgctcgaggccacgcgctccgccgtcggcccagccgcgctcagcttcggcgccgcggagcccgctgcgtcggcggcagcgggtgcagtggcgggcctcgccgccgccgtcgccgcgcaggtcgtgtggacgcccgtcgacgtcatcagccagcgcctcatggttcagggcaacccctgtcctgcctcccgctaccatggcggccttgacgccttccgcaagaccgtggcttctgacgggctacgcggcctgtaccgtgggttcggcatgtccatcctaacctacgccccctccaatgctgtgtggtgggcaacttattcactgtcgcagaagataatttggagtggaattggctgctacttgtgcgattatggtgttggtgtccaggaaattgatctcggtgatggggattctttgctgcagccaggttgcaagactgtcatggtagttcagggagtgagtgccgcgatggccggtggtgcatctgcgtttgtgaccatgccactggacaccatcaaaaccaggatgcaagtcatggatggggacggtgagccaattacggtggggaggacagtgcgtaggctgatcaaggaaggtgggttggctgcttgttacaggggcctaggcccgaggtgggcgtccatgtcattgtctgccaccaccatgatcaccacctatgagttcctcaagcggctctcagacaagggccaggggagtgatcttgcatgatgtttgataaccagtatagacaacaagtgatcaggtgcatttgctttgtttctttatcgtttcatttccagcatgttatgtgttgaaaaaaatggtgggctaatgtttgtagataatttttgtttgctcttataatcgagttttccgacatggtgcaatttatgttggttatatattgtagttctcatatcatgttgttctagttgcatttattggcatcaaattggtggttatggcttggtatgattcagttttgcttactcaaacctttgtttgtgctgaagtattgatgtttgtaatacagttgttgttaagtgcctttggacttctgtgaacgctaacaatgttgtccatgccccatgttagtagaactagaacattgtcatgtttgcttaggatgtctgtaaatttactggcacctggttgtgagcaagaatatagatttatactcacgattgcaaatattgtactgctgattctagtataattggtatgtgttttttctgtttatactagcaccatgcttaacagcagacatgtcaaatagatccatttttttcctattcgatgacaccaagcatcagatgggctttgtgtcaattattccgtctctattctgtttctgtttcttaaccaggtttatgacagaatctgaatatgcttgatagacattaatactagtttacagtgtagcctgatacttctgcag

SEQ ID NO: 12780 - DNA, 2565 bp, Zea mays
ttgggtacctcgaggccggccgggagaacagtggtacttgaagtcgaaggcagcgcagcaggtacgccaggacgccattagcagcggttggccaccagcccaccacccgacgccggaggcccggaggaggaggcggcgatggcggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcggcatcccgagctggcgttgtgatagaagagaaaaactggcctccctttttccccctcatccaccacgacatttccaatgaaatacctatccatctacaaaggatgcagtaccttgcattctcatcattcttgggattgatagcgtgtctcttttggaatgtcatagcaactacaacagcatggattaaaggggaaggtgttatgatctggctgcttgccattatctacttcatatctggtgcgcctggggcttatgtgttatggtatcgacctctttataatgcaatgagaactgagagcgctttgaagtttgggtggtttttcctattttacatgattcatataatattctgtgtgtgggcagctgtggctcctccattccctttcaaaggaaaatctttggctgggattttaccagcaattgatgtcataagcaagaatgctattgtcgggatattttacttcgttggatttggcttgttctgccttgaatcacttctgagcatcggtgtcattcagcaagtctacatgtatttccgtggaagtggaaaagctgcagagatgaaacgtgaggcagcacgtagtgctctaagttcagccttctgatgaacatagggcggtctgattagagcagtagatggataagggaagggaacgagatgtgccaattaagccacgcggtcttgtacatcactgcagtacgtggatttggatcgctgaaagcgtacagctgatcgtctttttgctcttctgtaaaatatgaacaatcatcatatggtccggatgcgtcagggtgttggtttcatttcttgccatggtttagatgtggttgatagggaaaacggtgaagtatttttttggagcagcgaatataatgtatcttcatcgtacttttacatgtgagtgtaatagcttatttcttgtggtaggaatacagctttgctgtgttttcgggaatgacatttgttgtgtaaggctattcacaatggctatttcataatactcttttcaatactgccacattatcaagagtgtcatgaaactaagaatgaaaaaatgtctctcaatacaaaatttcacttcactatttcataaattagcatactaattaaatgctgtaactaaatagccaataaaaatcagtaaaacatgtgaagataaaacaaatcacttttaatggttgtttcacatgatttctaagactttggaaacaggttaacatggtttcatctctatgaaaccaatttcatcccataaaactcatttatcttaaatattatgtcatgttatctaaaataataatgtgtcacactattaaatgtatatgaaaccatcataaaactaccattgtgaatagcctaataaaagtgaaaacgtacccggatacaagtaccaaaattatccaaactttttgagatgcgggtattttttgttatcgagatggatataattactatccggttaataaatatctggatatagttaggatacagatggttaatatatattcgggtacgaagttgatgacattcggtaagtgcctgcacggtcgggtagccggacgttgtggcaaacctgtcgccctgctatgtacatgaagcacacacgttctaatcgggtattggcagcaattttgtttctactggtactgtgagtcttcacgccccttgtttctatatcttcctagatgtatgtaaatccatttaactcttgcagtcatgatatcgttttttaaggtaaggcttactgtaggaggtctctatagtattttttatttcagatagagttgatctgaatttacaggttacacaaagtggggggaagaagggggagagatttacaacgttgcatctattgtctgacattctaggctagtgtctctcgcatcttatatgtgttgagcaacaactcttgcataaacgtagttttgcatgattgtgtcgttagagaagtattttcaaagatcacctatttctacatttctatatgcaatatgtcatggtgatcactatctccatggatcaaggttgcacaagtttccttcgtagatcacagaccacgatacgggggttcgaggtccttgtcgctatgattccgacaatctcccagcaccatttggcgaagctacactttaggaagaaattgtcctatctttcctctttcggttctatgcattttccacat

SEQ ID NO: 12781 - DNA, 837 bp, Zea mays
gccggccgggtcgggacttcatatctggtgtgcccggggcttatgtgttatggtatcggcctctttataatgcaatgagaactgagagcgctttgaagtttgggtggttttttctattttacatgattcatataatcttctgtgtctgggcagctgtggctcctccatttcctttcaaaggaaaatctttggctgggattttgccagcaattgatgtcataggcaagaatgctattgtggggatattttacttcgttggattcggcttgttctgccttgaatcacttatgagtatcggtgtcattcagcaagtatacatgtatttccgtggaagtggaaaagctgcagagattaaacgtgaggcagcacgtagtgctctaagttcagccttctgatgaacatctttttgtaaggtctggttacagccagtcgatggatagaagggaacgagatgtgccgattgagccacgggacggtgtcttgtacatcactgcagtacgtggatttggatctctgaaagcgtacagctgatacctgataatctttttgcacttctgtaaaatatgaactatcctcatggatgcgtcagtgtgctggtgccatttcttgtcatggtttaggtgtggttgatagggaaaacggtgttttttttttagtggcgaatataatgtatcttcacgtgagtgtaatagccagtttatttttgtggcatgaatgcagttcgctgtgttttttggccaagacaaaaaacaaccaaaaaaaaaaaaaaaaacccacctgtacctgaggcttgcagtcctacagttctagcaaacggtcggtatctacagtagactt

SEQ ID NO: 12782 - DNA, 961 bp, Zea mays
  misc_feature (926)..(927): n is a, c, g, or t
cccatttctctgacatgtgagccctgtaggagagggccttcactcgtcacatgcgctgacgcgcatcccccccggcgtggcgtgcgctttgatctagctcttcttctcgaatccagcccgaggcctttttcttctgcggtttcatccgtacccatcctgcacacgaagcctagaatagccctcccctgctccgccacctcctcggatcccgaccaccccacccccaccccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgcaaatgaggaacagaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttggattctacaggattggcgactactcaaaaagcaggcaacttgcagatcgttgtttggagattcaagcggattggcggcaggccatatcgctgaagaaggcaatagaagataaaattgccaaagatggtctgattggaataggaattgcgacaactgcggtcggacttctggttggtggaattgcagctgctgttgccaggaagaagtgaggtcaatatattggatcggcagctcattgaactaggggagctcccgtctctgtaattccaacttttctgttgttaccttggtgatattacagttgaattgccactctttatatgtacgaagtaatcgtatgataatgataacaccattgtgacattatagctttaaaaaaaaaaaaaaaaaaactcgnncaatggaccgcagtacaaatatcaccatttcctg

SEQ ID NO: 12783 - DNA, 6735 bp, Zea mays
  misc_feature (2890)..(2890): n is a, c, g, or t
  misc_feature (2955)..(2955): n is a, c, g, or t
gaacttgtgataaaaatatgttgagttcgatggatttgttatgttagacacaaagataatatgcaattttagtattttttcattattgatgagatatgatgcttcaatattttatacttgatacttatttttgtgattaaaataatcatgtttactataacctttgtgggtatgatacttgttacccgtggtggatatatgtgaggtaattttgtacacgtgatggacagaggatatggatagtagggtattttagtatagacatggtcttgtgtatctaccggatatcttactcgctgccaccatttattgtagatacatccctgtttgtgtattctccaatctggacctcctctcctgtttgtatatcctccattctggaccccctcttaagtttttaatgaaatgattccaagtgaggatcctcccctggtactccggtagtacttataaaaaatagcatcgtcatcttttcatttcttgattttgtttaatttcagtcagcattgtatcgatgtcaagcccagatagttaaaatttaaatatgacgagttttcggttgaccggaaatggtggcgatagcagcctgttttcgatagtttagcacttcagcaagctccatctgggccacatagagttgccatgttgctgggctaggctccggctttgccagtccaggcgggcctccaattctccaactaagcaactaacctgtggaacatccatatttgctttgccaactctacacgaacagaagcaaacatatttctgacgaggtgagaagtaaaaaacatccacaagggtactagtagtatggatacttgaaccatcaggtctttttttttaaggcgagcatatggatcaccagttcattacgccaaacaataaaaacagcttatccagcggtctatactctgtactttccaaattccaattcgtaccatttgaagtgttttcgtatttctgcagccgacacaaatggacgagtttgtacaaataaacaaagaacgactactgagcaaaacactcccagagcaaacaacaacatacccacgccagggttcacacgtgctcatcatcctgctggcggctggcacgatccagcgggagcacaaccaagccacggaacagaagaagcaggccggcgaggtcgacacaggcgatatattccttctcatcttcgcctccaaaaaagcgcaggattcccatccagctttgtcaacatcgcttttccttattcccttcccgcgggatcgcgtgcgcgctcgcctgcgaaaccgataattgtccaagagcgtttacagagaaagcaggagcatacgattccgggcacttaacaagcaacagctgaatgcaatccccgcgcaaagattaaagctctccgttcccctccccttgctcgctttcgtcggattcaaggcgaaagataaagctacggccagaaagagtttattccatgttccgacgcgcagtggtctcagcttatgcacctgacgaccggccataagtgaacacaattccccagccaatgctcacggaatcatgcacagggtgatttttggttttgggacgaaataaatgcacaggcatgcctcccttgaacaggaatgggggtacagatcatatcatatcatatcgggaggatggttttcttatcctaatggatggaacaatggcctataagcatagggatccctggaacaacttgagagaagactggtttaatcacgaaatggcaaggaaacttttattttcaaagaagatgctactgccttggaccactcgtactagttgcttttcaaagaatgcctgtcaagcttttattttgaaaaggcccgagaggatcttaatgcaatccattatatctgatttaccatgtcaatgatttcatttctgaggtacaacttaccaggtggcacaccttgcatttgtgactcgcaatagccataacaaatggaatcatggaaaaaaaatactagactattcccttgtggaaaagctggactacagaacaaatcaaccggaagggactcttacagcacaaaattgtagcacctcactatgtactgaaaaaaaacactctagataagacaaaggtaagcgccgcctattccatatcactggacttcatggcagttagcggtatcaaacattgacactgagccagttttgctcgagtatggaggggagaataaacaaggctaaccatgtcggttcagataagcatgtttcaaagcaaaagcaacatagagcagtgaagtaaaggaactaaccgtcatttttaagccccaactttctgcgccttatgtagaacagatagtagccaaactcagaggactccatacagatgcacagcccatcggattcgtctacccactttccgtttccctgatagccgaacaagtacaaaacttatatgaggagacaaaagagaatcatatgcttattccaatattccatgctttgcttttgtgcagtcccaaggaaggcatcactaaggaaataagttcctttcactttatttatatgaagaacttttattgaattcttcttctagatgaatctggtcaaaaagaaatttaaaacttgctctcgtatggatgataaaaattattctcctgtcgtctatgtgccatgcttgtataacctgaaggcatacatttgctattgaatccatgattgcttaacatacagaatcctaaccaatgctgtcctttgatttcatgatacaggtatggtggagagtggaattagtgctgaacatataagatatagtaggcctacaagtgcaaaggcattattacaaactacatctcaaaagttcttcctgagaacaaggttcccacttttatctgcaagaagaataaacttaacaaatatgtatgcttgnaaaccccttactcctcttaatatcaactatatttgttagtgctggaatcagaatactaatgtgtntgcagaattgacaaataaaaagattggtgcgcatagggtccacaggtaccttaaggaataaggataatatctttatacctcttttcagttgctgccaggattggtccaggcttgagtgtttgttctaacgattcgaaattctctcctcacttgtcttccttataaaaccagactctgcatatccgccgggaaagagtagccatagtttgttagagcattcccccaaggaatataacaccattgtgtgacgagcaacccttcaccaaaaactaaggactgataaactgcaagagaccgttcctatcaggattgtggagtctgcaaccagatatcaatgcataacagaattgaagagatgtatcatcatcaacaacagcttcagagccacagtcatttcctgtcttctaggcagacattccctccagaaaggcacatgcttctgcaaggagggagcattccagcagagccagggcttgtgctttccactgatgctaaacctaggttaaaatggacacctgaactacatgagcgttttgtggaggcggtaaaccaacttggtgggcctgacaaagctacaccgaagacaatcatgagactcatgggtgtccccggactaacactataccaccttaagagtcatcttcagaaatacaggctaagcaagaacatccatgcccaagctaatggtgtaaatgcaaaaaatgtgattggttgcaccatggcaatggacaaaccacttgaaggaaatgggtcaccagctagccacttaaaccttggaacccagacaaacaaatctgtgcacataggtgaagcccttcagatgcaaattgaagtacagcgccgactgcatgagcaactagaggtacaaagacatttgcaactccgcattgaagcacaagggaagtacctacaatctgtgctagaaaaggcacaggagacactttcaaagcagaatgcagggtcagtcggtgtagaaaccgcgaagatgcaactgtcagaattagtctcaaaagtatcgacagaatgcctccagcatgcatttacaggctttgaggagattgatggttcccaaatgtctacaaggccacaccatccaacttggcgatgggtcagttgacagctgcttaactgcctgtgacggctcacagaaagatcaagatatcctgtcaatcagtctttccgctcacagaggaaaggagataggaggcatgacctttgatatacaagagaaagaaagaggaagagaggatttgtttcttgacaagctaagcatgacgcctccaggccaactagacaggcgtgagagaggaagttttagtatgacgcggaaggcagcaaaactggatctgaacatcaatgataccactgatgggccacagaactgcaagaaaattgacttgaatgggttcaactggacctaggaagagttagcaaaagaccttgcaaattaaatctgacttgattcatcaagagtgacaagcttataagcttgagattggctccttctgccaagatagcagcaaagagaggaagtgaaaccgaatgagttattccaaagaccagcagcatcgacatatcctccatggcaggacctgggtgatcctcggaacagctgcgctgtcggcccatcacgattcagcgaaataagtgatgaaattacaataagtagggcatgtagattggtagagtgtatttgagagagtctagtgttctcctccggctataccttattgtgattctgtacacaagcatataaatacaacgatttttgtcacaagtgattgttgctgggattggcaaatgcccaggaatgttttgccatcagctaagcgtgcctacaccctgctgccaaatcatgaatctacaagacagcaactggtgcacaaaacataagggacggacggatgcatatgcatcgtacaaaacacctgcaccgtgtccttgttggattatacataatggtttcaatgtttcgtttcatgcggctatgaagcgggaatgggacagatttactcccaacacgcaaatccaataaggtatcacgaccgctcttcgatgacaaggcagataaatcgtaaatcagcggctaagctgcgaaggtaaataaatcgatcgtacctcccaactgatctaggtggcggcggccgttcgatgagtgcagaaggggatcttctcctgctaaacaatcaccgccgccgccgccgcctctttcctcacaaaagctaaacaacatttgctccaaccaatttgtcggtttgatatgaagttcgtgattcgccaacctgcaactgcaatagaagccgtcggagtcggacgatgaatgctcaagggctcaaggccaaggaggagaggcttcgtttctcggggtgcgaggactaaagcccatgtgcagtcgggccttgtagcttgcttcgtggcccatcattttatttggaccaaacatctcccactccatcgtcattcatcgagcatttcgagccgtatctccctggagaagtggactggagataactaagctgacgatggtggatgcgaatgcgatgcagcaaccggccgaacagttctgctgacctgatggttaatttgtcaaaaagcgaaccgagtgctatgcatgctgacctggtccgagaaaaacactgcaattgccatggccgcgactaattgatccccattcctcacgcagtgccttctcctacaaaccacctattatgtcattgctcatactacaggctagtaggttacatgcagcctatggcccctttttaagctagctaggtgtagcatgcaaagccaataatcactactgatgaagggattcggctgcctaattctgcactctgggcacagatgatctgacgttagcttctcattttcttcatatcctacttttagcatagagtaatcctacgagcttgaccctgggtttgcatcgggattaccccgtacgtcaagtgctcttatcctaagttgccttgtcccacgccattctttatgtatcaacatcgatcggtgcatgctgaggtcgtaaagctagctttatgaatcatcaagtactgaagtagtattaatttgaactttgcagatatattagagatggccgaggcaataatgctagcggtgacttgcgtgcgtttggttgcgccgctgaacgagtatatcttaatatcaccgggaggtctttaaggttgccaggctaacagatggtgtatacgaccgtgctaaacacattattacgctgtagattgcagtctttacaaagtagagtttgaaatatgagatggataagtttgctgtatacaacctaaggaagcttccatgttcattttctaaaacatgttataaacaatataaatcatcaagatacgcaagaaaaaattctaaaaaaactttagagtaaaacattttgcctttaatttaacaaactctatcatacacccaaaaatagtcattggatttaaagtgttttatagagaaaaaatattcactcacaccattataaaagatacataaagtaacccctaaaattacatctaaattatcagtgtatgtcattatgaaatataatttaaaacaactctataaaagtcatgtaaattatgcgcttgtgccattatgaaagataacgcaacataacccctaaatatgtatctaaagaccccacatttgcaattataaaaaataatacaaactaatccctaaatttgccttttgaacgatcaacacaccattataaagataatacagaataactctttaatttgtatctaatcacctcctctg

SEQ ID NO: 12784 - DNA, 941 bp, Zea mays
ttttttttttttttttcaaattccaattcgtaccatttgaagtgttttcgtatttctgcaaccgacacaaatggacgagtttgtacaaataaacaaagaacgactactgagcaaaacactcccagagcaaacaacaacatacccacgccagggttcacacgtgctcatcatcctgctggcggctggcacgatccagcgggagcacaaccaagccacggaacagaagaagcaggccggcgaggtcgacacaggcgatatattccttctcatcttcgcctccaaaaaagcgcaggattcccatccagctttgtcaacatcgcttttccttattcccttcccgcgggatcgcgtgcgcgctcgccgtcatttttaagcccagactttctgcgccttatgtagaacagatagtagccaaactcagaggactccatacagatgcacagcccatcggattcgtctacccactttccgtttccctcttttcagttgctgccaggattggtccaggcttgagtgtttgttctaacgattcgaaattctctcctcacttgtcttccttataaaaccagactctagcagttatcggcctccaattaagcttaatactgaatgccctttctgctcttcagtggttggttgcaccatgtcaatggacaaaccacttgaaggaaatggatcaccagctagccacttaaaccttacacataaacgacgcctttcaacaggtacaaagacatttgcaactccgcattgaagcacaagggaagtacctacaatctgtgctagaaaaggcacaggagacactcccaactgatctaggtggcggcggccgttcgatgactgcagaaggggatcttctcctgctaaacaatcgccgccgccgcctctttcctcccaaaagctaaacaacatttgctccaaccaatttatcggtttgattt

SEQ ID NO: 12785 - DNA, 2227 bp, Zea mays
cggacgactgggatcgaacatgaagatgacatggttagcacaaatcatgtggactgggtacagactattgaagagagagccatcgatcaggcacagaaaagccaatcaggctcttttgatcagatacatggtaatctggaaagcactttcagtcagttacagttgagccaagcagaccctgctaatggaatgcaggttatacaggcaaacactaccattcattcacaaccaagccaattggatactctgagtcctacacagaaaaaacaggaaaacagttccaaacagttacaatctgtggtcacagattcttcgattccaaaacgaaccacacagaaatgcactatagatcagccaagccagccagacataaatcatatacgcacagatcaggaattcactgggaatcagttcccctcgagcctaccagttgacactgttatttcattaggggatactgaagaattcacagcgggtcactcacagccaagaaatagtgacactgcaggacaaattcaggccaatgaggaaaatactgccgatcaagtacagttgagcctggcagagacagtcattctggtaccggctattcaagaatatgctgctggttattcactgctgagcaaagctgacactactgatcaaacacaggccaatcaggaatacattgctgatcaagtacaatcgtgcctaacagacgcactcattccagtaaaagctattgaggaatacacaactgattattcacatattagtaaagctgacattacaaatcaaatacaggtcaatcaggaaagcactgatgatcacttatatttacgtcaagtagactgtctcgctgaaatgcagataattgagcaaaatttgtccaagcaacctcagctgagccaaccagacactggggatcaaatacgaattgatctggaaagcactaccaatcacttgcaaccaaactacgatgaaaattctatgctgcaatctggtttctcttgggctcctgaacagaacagaggagcccctactacagatttctggaaaaatgttgaaagtcaggcgtcatcggtttccatgccaataaatggagcgcctctttcaagctttccagcaaatgtcagattccaaaatgcagcagcagcagcagcagcagcagaacctgctttgccaccacaggttgctccaaccgaaacaggttccgatcagtctgggttggccttccaatcccttttcggaaacatctggtcagatccttgcatcgagtttgctttcaagacccttacaggcgacattcctgttctcgacgacacaacggctgtcacagactacttcccagagcaacaagacttgaataaagacccagcgccaaactgtgcaggctctgtgtttgacagttcaagaaaccacacacaagtcgacgtcaaccttccaccgcctgctccggatggtttctacgatggcagctggttccctccccaatgaatttgagtgcagggaggggaaaaatgcaataacattttgtacctgtgaaaaggcaaatcagagaaggctagtggccgaaacataaaagcaatagtcgcactcttgttagggctctgatctgaatgtctaatcccacaggacacattttgtaaaaaggcggtagcttctttagccttattagactgttaatacactcaactgaatgatgtccagttccatcaacaaggcttcaccgagactgtcgagtgactgatcaggatcatgttttttttttcacgttttgcttctgtgcagttgcctaataaacccattcgttgtaaacaagccagttctaactttaaaaaaaagggcctgtgcatggcgctctaggttattgtgcagatggaactgttcttgatattttgaacacgcaaatgtagaagctttgctgtcacagttcttcagcggaattgcgaagaggtgatccgctgtttgtgtagtgtttgctgaatcttgattttgtagttggctacttgaatctgtgtatgttttggctcgcttgtagtaattgctgggctgctggctggtaaatgcgtcgagacattagagagaatggtagatagctgcttcgtaaccagagatagtacatagtagtacaatgtcaagcctgagaactcattttacacgaacctttttttactacattgggtagcaataacaccctccctacccataaacaagcatcaaatatacttaagagccaactccaaca

SEQ ID NO: 12786 - DNA, 3033 bp, Zea mays
ataatcctttctccttcatccatacgctgaacagagtatgatttggatcgcctggcctactgctgctgctgtcgtgtccatgccgtcggtgctgtcaacatccggatcattgcgcgcgctccaacgcaacgggggtgatcagataatttccccaatcccccccgcgcgccgatcgcgacaaacatgcatggcgaagccttccgcttctgcagcggcggcggcgctccgtgcctccctcggcgtcgccttcgcgctgctgctcctgctcgcttcctcccgcctcccgcgccgcgccctgtccgccgaactctcgtccccctcggtggtggcccacgagcgacgcggccacggcgcctgcgcgggcgtgcggacccccgacgagagataccgcgccatcgcggccgggtctgacggccgggaccgctacccgcgcggcggcgggcacgtcgactacctgtacctcttctactgcgtcctcggcggcgaccgccggcccgccctggggtacgccgcgatggcggcgtggctcgccgtgctcttctacctgctcgccgacacggccgcggtctacttctgctccagcctcgagggcctcgcgcgcctgctccgtctcccgccggccatcgccggggccacgctcctctcgctcgggaacggcgcgcccgacgcgctctccgccgtcgcgtccttcttcgccggagacggcggcgagggaggagggacggccgccgccgtggggctcagcggcgtgctcggtggcgccatgttcgtctcctcggtcgtgctcggggtcatcgccatccgcctcggcggccaggaggtcgccgtccaccgcgccagcttcttccgggacgcagccttcctcttcctggcgctcgtcgccgtggccgtcgtcgtcgccgcgggccaggtcacaatctgggccgccgccgggttcgcctcgctctacctcgtctacgtcctcgccgtcgccttcaccccggaccgctggaccagacgccacgacgcgcacgcggtggatgaccccgcctccgccgctgccttctcggagctccacaacgtcacggagaccaagttctacaccgaccaggaagcccgagatccactgctccccgacaccgcaccgctacttcaatactacgccggcgaagcaaacagcaacagcaacgacggctccactggcaacaagagcgtcttctggaccgtcctgcgcgtgctagagcttcccctgaatctcccgcggcggctgacgatcccggacgcgagcaaagagcggtggagcaagacggccgcggtgaccgcggccacgctcgcccccatcttcctgtccttgctctggagccaccgcgccacggggggcccgttcgttaccgtcctcctcggcggccttgctggtctcgcgctgggcctcattgccttcctcaccacggatcccttcgccccaccaacccggttcctcggcgcgtggctcgccggcgggttcgccatgagcgtggcgtgggcgtacgtgatcgccaacgaggtcctgtcgctgctggtctcggcgggaatcatcctttccgtggactcggcggcgctgggggtgaccgtgctcgcctggggaaactccatcagcgacctaatagcgaacgtggcggtggcatcccgcggcggcggcgcgcaggtggccgtgtccggctgctacggcgggccggtgttcaacgttctcgtgggcctgggcctgtccatgctgttagcgtgctggagcgggtacccgcagccagtggagatacccagggagcctgggctttaccggacgctggcttttgttgtcgctgggcttttgtgggccgttgtgatgctacctaggagaggaatgagggtggacaggacactgggcgttgggctcctagtcgtatacttttgcttcctctgtattaatgtttcagagcttaagaatgcacggtaatatattgggtttgttagggttttagggtttagggttttatagctctgctcaacaatcagaaaaatcaaactcaagcgatgctgattatttttcgaaatgaaatggttgttagacgatgaaattagttagtctttttaatcgatactggtagcttaaattaatttataaatgacttgtaataacataattgatattatggttgaatgcatcaatgattagtatgagtgaatgaatactatgatggaatggccgaacaaattgctgataatggttgaacaaccaaaaaccttcataaaaaaggttcatacccaaaatggggatggctaaaaaagaaactaaatggctcaaactgtagacagaaaaccacaaaaaaaaaaaaatttaaagacaatctgagtatgagtatacctgagtttgaccttgttcgcctacaattggatctctaccgtcatctcccacatttctagcaccagattcatccacaagcgcagttttggggggagacggatcacattgttctagcgatttggcattaggagacaacaatttattgttcctacatataaccaaaaatcaaacaacataaaaaatattatgataggaaattcaatggccaaaaaataaaatggttgagagtacatctaaagtattcttcttctaacgcttcccatgatgatctttcacaacagaagcagttgatgcctgttacaacagaaacaatggacaaaataaaaacatttaagacaataacgtgctgcaaaaatggctgaaataatatatggaaaatgcttagatgcatgagtatcatgtgccgaggggctagtttgcactctctgagaatcctggatgtcagaatggctgaaatttcatcaaccaacttcctctgcgacctcttgaaagacatatgacgtttctttatctcggcttaggcttcttcgatctttgactgttgggcttggtcgcttggatgttcgagatgcatttaaaacatctcgatcatatgctttaaaaagccttagaaacaacaacctgtcatctgaaaacgacacaatctgttagaaaaaatggctccaacttgggtagtg

SEQ ID NO: 12787 - DNA, 1283 bp, Zea mays
  misc_feature (2)..(2): n is a, c, g, or t
cnaccttgcagtgtacacacagacacagttacaccgaggaggtttcctccctggctccctgtgaacattgggtacctcgaggccggccggggatactgactctgccttcttcgttcagccagcgccgaaagagagggagagccaagtcgccttccgccgcggcgcacgatggatcgcgcgcagttgctcctcgtcggactcccggccttgctcttcttctccgacctcactcacatattcgcgccgccgcctccccacctccgccacccccatcaccaccctcctcaccaccaccatccgcatccgccgcatcatccccactcgcctcatcaccacccgcacccgccgcatcatccccacccgcacccgccgcaccaccaccagcaccccgacccctccacggcaatcatacaggagccacgtgtggatgaggctggattcggcagcacagtggagctgcaattctgtgcctcctgctcgtacaagggaactgcagtgaccatgaagcgcatgctggaaacctcatttcctggcattcatgttatcttgcataattatcctcctccattccccaagcgtgtactcagcaaagttatcccaattgttcaagttggagccgttgcaacaataatggctggtgaccagattttccccagaattggcatggttgctcctccatggtactactcgcttcgtgccaatagattcggaaccatggcaacaatctggctatttggcaactttgctcagtcctttctacaaagctctggtgcctttgaagtttactgcaatggagatttggtattctcaaaacttgctgagcagaggttccctagcgagttcgagttgcgggaccttgttggcagcagattgcctgggtctccatttgggaggaatccggggaaaaccctgacttgatgatgaccccggaaatcagagctcagaatgccacaatttattatgttgcttttaaggtattagtagatagtaactatttggtattgatctatcgaggctgcagcttgtctgtaaacacaactttccagcttgtataatggatcaacggatcacctgacatgtgacggtggccgaagtactacgaactctaatgacgttggaacggtaaggatattgtgatggcctgttagtttatgggaggtgtactgtttggcattgatctcgatgtaaacaaacaatgttagccttgccccatggggaagattaagcgagcaggatgttaaagatacaaaaaaaaaaaaaaaaggcggccgacgcggccgcga

SEQ ID NO: 12788 - DNA, 1280 bp, Zea mays
gccggccgggccgggccaccttgcagtgtacacacagacacagttacaccgaggaggtttcctccctggctccctgtgaatctgcgatactgactctgccttcttcgttcagccagcgccgaaagagagggagagccaagtcgccttccgccgcgacgcacgatggatcgcgcgcagttgctcctcgtcggactcccggccttgctcttcttctccgacctcactcacatattcgcgccgccgcctccccacctccgccacccccatcaccaccctcctcaccaccaccatccgcatccgccgcatcatccccactcgcctcatccccacccgcacccgccgcatcatccccacccgcacccgccgcaccaccaccagcaccccgacccctccacggcaatcatacaggagccacgtgtggatgaggctggattcggcagcacagtggagctgcaattctgtgcctcctgctcgtacaagggaactgcagtgaccatgaagcgcatgctggaaacctcatttcctggcattcatgttatcttgcataattatcctcctccattccccaagcgtgtactcagcaaagttatcccaattgttcaagttggagccgttgcaacaataatggctggtgaccagattttccccagaattggaatggttgctcctccatggtactactcgcttcgtgccaatagattcggaaccatggcaacaatctggctatttggcaactttgctcagtcctttctaccaagctctggtgcctttgaagtttactgcaatggagatttggtatgcttcctatgttagatgcaaccttatcttttttcttttgtgttgatttgatgcaaaatgctttatatatcaggagtgccctctgttttgaaatagggatgagttagttctatctcaagttttacttatgtctcaaattctattgtgaagttacagccgtttgtttcaccttttcttacatggcatcatccttttgccttcctaggtgacagcaggatttttaaacgtctgcaattcccttcattattttactgaaaccacttctacttttcaggtattctcaaaacttgctgagcagaggttccctagcgagttcgagttgcgggaccttgttggcagcagattgcctgggtctccatttgggaggaatccggggaaaaccctgacttgatgatgaccccggaaatcagagctcagaatgccacaatttattatgttgcttttaaggtattagtagatagtaactatttggtattgatcta

SEQ ID NO: 12789 - DNA, 1232 bp, Zea mays
cattgggacccgccgggccggccggggccttccgggggacacacagttacacagaggaggtttcctccctgcgaactgcgatactgactctgccttcttcgttccagcgccgaaagagagggagagccaagccgcctcccgccgcgacgcacgatggatcgcgcgcagttgctcctcgtcggactcccggccttgctcttcttctccgacctcactcacatcttcgcgccgccgcctccccacctccgccacccccatcaccaccctcctcaccaccaacatccgcatccgccgcatcatccccactcgcctcatccccatccgcacccgccgcatcatccccacccgcacccgccgcaccaccaccagcaccccgacccctccacggcaatcatacaggagccacgtgtggatgaggctggattcggcagcacagtggagctgcaattctgtgcctcctgctcgtacaagggaactgcagtgaccatgaagcgcatgctggaaacctcatttcctggcattcatgttatcttgcataattatcctcctccattccccaagcgtgtactcagcaaagttatcccaattgttcaagttggagccgttgcaacaataatggctggtgaccagattttccccagaattggaatggttgctcctccatggtactactcgcttcgtgccaatagattcggaaccatggcaacaatctggctatttggcaactttgctcagtcctttctacaaagctctggtgcctttgaagtttactgcaatggagatttggtattctcaaaacttgctgagcagaggttccctagcgagttcgagttgcgggaccttgttggcagcagattgcctgggtctccatttgggaggaatccggggaaaaccctgacttgatgatgaccccggaaatcagagctcagaatgccacaatttattatgttgcttttaaggtattagtagatagtaactatttggtattgatctatcgaggctgcagcttgtctgtaaacacaactttccagcttgtataatggatcaacggatcacctgatatgtgacggtggccgaagtacctcggccgcgaccacgcttggaacggtaaagatattgtgatggcctgttagtttaaaaaaaaaaaaaagtttggcattgatctcgatgtaaacaaacaatgttagcattgtcccatggggaagattaagcgagcaggatgttaaagatgc

SEQ ID NO: 12790 - DNA, 1302 bp, Zea mays
  misc_feature (1254)..(1254): n is a, c, g, or t
aaacatttctttccttttttttctctctctcttattcggcacgaggaaaaaattcgttctgctaatttcggagctcaagacgctcgccccacctcgccgcccgtcgtctttctcatcgatcctgccaaacaaaaaaacgaaaaaaaatactcttgctgttgatagagcgagtgaaaaaaaagaatagtctcagaaccatctagagacagcggcccgtggagcggacagcggagcgagcaagcctgcgccgccgccggcgtcctcccgaagtagaagctgttctgatccacagctctcgattccggaaggagttggtcaagaactggggatcctgagttgaatatgatatcaaatccggtggactggtatagtttcggacccggatagaattggtagggatgccagattggagggtgcgtgagtttgaaggtaaattcactgatgagtttgcccacagtaacaacaacaaacatgaaagtggagttgaggctcctggtgtcactagtagtaagaagttgaagcatgcagttgccggtgagaaaattcaaggtgtcatccctggaataaatagctcagatccacagaaatgtaattcagagaacatccaacatgagaacaggatagtatcccagaatataaacagtgctggtgactgcattggagactgcaaagacagctccaacgccttctcttcaagggaagaaaatacaatcgctgaaaccagatgtccaacggatgactggaactcctgtcagtttgcactgagcaatggttcatccattctcaataaccacattgctccacaggatagcctcacttatggagataatgatctaaactacattgattggcctggcattgacaatttttgaggatgttgacacattattcaggagatcgagatctgatttcacatatgatccgcagcagctggagaatacagatgggttatcttggcttccttcttcagatgctggttactcttctgatgttgctttgcagcaagggtttgactcgtcttattccgattatgatattctggatgatctctcagcattccaatgtgcaaaagataaatcactaccctcagttggtccttcatcggatttatgtgataatcaattcaatgatacctatctgttcagtgagcagaagaatgcaaatgcatatggtgaacagatataccaagaggatgtgatggagttgttgcccactgaccagatatgcagtggacatgaaaaaattgaatatggntgaaaaccagtattcatctgaacctacaattcaaggtattgaaaacaa

SEQ ID NO: 12791 - DNA, 912 bp, Zea mays
  misc_feature (815)..(815): n is a, c, g, or t
  misc_feature (892)..(892): n is a, c, g, or t
ccggccgggaaaaagatccttctggtaatttggtgctcaaggcgagacgcgccacctcccggcccgcatcggcgctctcatctcatccagcctgtgccaaaacaaaacgagaaaaaaaaaagtcttgctgctgctggtggtggagcgagaaaggaaaaaaaaagaaggggtaatctctggaaccatctagagacagcggcgcggcggtacgtggactggactggagcgagcaagcctgcgccggcgccgccgtcttcccgaagcagaagctgtagttggtcaagaattggggatcctgagttgaatatgatctcaaatccggtggactggtatagtttcggacccggatagaattggtagggatgcaagattggagggtgcgtgagttcgaaggtaaattcactgatgagtttgcccacagcagtagcaacgaacataaaggtggagttgaggcttctggtgtcattagtagtaagaagttgaagcatgcagttgctaatgagaaaatccaaggtgtcatccccggtacaaataggtcaggttcactgaaatgtaattcagagaacatccaacatgcgaacggggtattatcccagaatataagctgcgctggtgactgcaaaaatggctccattgcctttcctttgagagaagaaaatacaataactgagaccagatgtccagctgataactggaactcctgtcagtttgcactgagtcaatggttcgtccattctcattacccacagtgctccccaggatagcctcacttatggagataatgatctaaactacatcgaatggcctggcattgnacaattttgaggatgtcgatacatttattcaggagttctgattcaacatatggtcagcagcagctgggagaatgcangatgggtatcttgggattcc

SEQ ID NO: 12792 - DNA, 2356 bp, Zea mays
ccacgcgtccggatccatcccgttcttgggttcttctccccctctttctctgctcgttcctgaacgcgaattcgggcgacggatttgaggttctgatccacagctctcgattccggaaggagttggtcaagaactggggatcctgagttgaatatgatatcaaatccggtggactggtatagtttcggacccggatagaattggtagggatgccagattggagggtgcgtgagtttgaaggtaaattcactgatgagtttgcccacagtaacaacaacaaacatgaaagtggagttgaggctcctggtgtcactagtagtaagaagttgaagcatacagttgccggtgagaaaattcaaggtgtcatccctggaataaatagctcagatccacagaaatgtaattcagagaacatccaacatgagaacaggatagtatcccagaatataaacagtgctggtgactgcattggagactgcaaagacagctccaacgccttctcttcaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcagaagataaatcactaccctcagttggtccttcatcggatttatgtgataatcaattcaatgatacctatctgttcagtgagcagaagaatgcgaatgcatatggtgaacagatataccaagaggatgtgatggagttgttgcccactgaccagatatgcagtggacatgaaaacattgatatgttgcagggtggaaaccagtattcatctgaacatacaattcaaggtattgaagacaagaaattttctatagcatcaacttctcagctgagctcctctcagaatttactgaagcaaaggcaccacttagattccaattcaccaagcaacattacttatgaggcctatgaagaaaagttcggtccatctagtggttcttttgcacaaaggaatttaaaagtgcagaagaaaactatgaacatgcaaccaacacagccgataaatgataatgtcatgaacagacatcctcaaacattgacaagaagtgcttcttatccttgtgagaacaatgaatctgaaagaagaggattagggaaaagaactctgggggatcctcaagttacaatgggtacttcaatggtagtggatggctcatttgtatcatccatgtcctctgatatctctgttgaagaaagcagctttcgacaactgcagaatgctgttagtcagctggatgtgcaaaccaaattgtgcattagagatggtttataccgattggcacgaagtgcgcagcacaggcaagttattccaaatatgatgagcagcaatgaagacaacccggatataaaggatctgcagaatgcagaaactttgcgcaaattcgtcgatcctcggagcatcgagacacagacaaacccgatcgaccggtctatcgctctgctacttttccaccagtcatcggaccatgcggctgtggctgtcgacgatgcctcatcacttaaaccccctgctggtagcaaacaccaccagggccctgctgctaaccaaaaccaaggcctgataccagattcatcggtgtattcccctggagatggggcccccaaggatgtacagtccctggacaagttctgaatttatgtccctgctctccatgggcacgttcggttcccggggaatggtcgtctggaacgaatcctggtcggattgcttctctaattgatataagctttgatcggttggaacgattcttggtggaatttcgggataaatgaacaggccctaatgcgtctccgtgacctggttaaggcggcataatacggctttcacatgatgtttctaggcagatgtaaaaaacaagtatattgtgtacccaatagtctgtagcctgttccaatcacattggttttgacatgcgtgtatcctatgggtaggcggccgttgtgctctctagtggcgttgactcacatctgtgtaatctaaaaaaaattctttctttccgaaaaaaaaaaaaaaaacctttgaactgaaaaaaaaaaaaaaaaaag

SEQ ID NO: 12793 - DNA, 1414 bp, Zea mays
ccctcgagtctgccccgcggccgggatctcatccagcctgtgccaaaacaaaacgagaaaaaaaagtcttgctgctgctggtggtggagcgagaaaggaaaaaaaaaaagaaggggtaatctcaggaaccatctagatacagcggcggtacgtggactggactggagcgagcaagcctgcgccggcgccgccgtcctcccgaaacagaagctgtagttggtcaagaactggggatactgagttgaatatgatctcaaatccggtggactggtatagtttcggacccggatagaattggtagggatgcaagattggagggtgcgtgagttcgaaggtaaattcactgatgagtttgcccacagcagtagcaacgaacataaaggtggagttgaggcttctggtgtcattagtagtaagaagttgaagcatgcagttgctaatgagaaaatccaaggtgtcatccccggtacaaatagctcaggttcactgaaacgtaattcagagaacatccaacatgcgaacggggtattatcccagaatataagctgcgctggtgactacaaaaatggctccattgcctttcctttgagagaagaaaatacaataactgagaccagatgtccagatgataactggaactcctgtcagtttgcactgaacaatggttcgtccattctcaataaccacagtgctccccaggatagcctcacttatggagataatgatctaaactacatcgaatggcctggcattgacaattttgaggatgtcgatacattattcaggagttctgattcaacatatggtcagcagcagctggagaatgcagatgggttatcttggattccgtcttcagatgctgtttactctaccgatgttgctttgcagcaagggcttgattcgtcttattcagattatggtattctggatgatctctccgcattccaatgtgcagaagataaatcactacccttggttgatccttcatcagctttatgtgataatcaattcaatgatacctacctgttcagtgaacaaaagaatgtgaatgcatatggtgaacagatataccaagaggatttgatggagttgttgcccactgaccagatatgcagcggacatgaaaacattgatatgttgcaggttggaaaccagtatccatctgaaaatgcaattcaaggtaccgaagataagaaattctctatagcgtcaacttcccagctgagttctcggaatttactgaaccaaagacaccacttagattccagttcaccaagcaatattacttctgagtcctatccaggaaagttcggtccatctagcggttcttctgcacaaagaaactcaaaagctggtgtgacacttaagtgcgcaaatgcagtgcagaagaaaactgtcaacatacaaccaagac

SEQ ID NO: 12794 - DNA, 2253 bp, Zea mays
  misc_feature (15)..(15): n is a, c, g, or t
aaaaaaaacaatcgntctgctaatttcggatcttaagacgctcgccccatctctgctctcgtcgtctctctcatccatcctgccaaacaaaaaacgaaaaaaaaaaatactcctgctgtttgctagagcgagtgaaaaaaaaagaatagtctcagaaccatctagagacagcggcccgtggagcggacagctgagcgagcaagcctgcgcccttccgaagtagaagctgttctgatccacagctctcgattccggaaggagttggtcaagaactggggatcctgagttgaatatgatatcaaatccggtggactggtatagtttcggacccggatagaattggtagggatgccagattggagggtgcgtgagtttgaaggtaaattcactgatgagtttgcccacagtaacaacaacaaacatgaaagtggagttgaggctcctggtgtcactagtagtaagaagttgaagcatacagttgccggtgagaaaattcaaggtgtcatccctggaataaatagctcagatccacagaaatgtaattcagagaacatccaacatgagaacaggatagtatcccagaatataaacagtgctggtgactgcattggagactgcaaagacagctccaacgccttctcttcaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcagaagataaatcactaccctcagttggtccttcatcggatttatgtgataatcaattcaatgatacctatctgttcagtgagcagaagaatgcgaatgcatatggtgaacagatataccaagaggatgtgatggagttgttgcccactgaccagatatgcagtggacatgaaaacattgatatgttgcagggtggaaaccagtattcatctgaacatacaattcaaggtattgaagacaagaaattttctatagcatcaacttctcagctgagctcctctcagaatttactgaagcaaaggcaccacttagattccaattcaccaagcaacattacttatgaggcctatgaagaaaagttcggtccatctagtggttcttttgcacaaaggaatttaaaagtgcagaagaaaactatgaacatgcaaccaacacagccgataaatgataatgtcatgaacagacatcctcaaacattgacaagaagtgcttcttatccttgtgagaaccatgaatctgaaagaagaggattagggaaaagaactctgggggatcctcaagttacaatgggtacttcaatggtagtggatggctcatttgtatcatccatgtcctctgatatctctgttgaagaaagcagctttcgacaactgcagaatgctgttagtcagctggatgtgcaaaccaaattgtgcattagagatggtttataccgattggcacgaagtgcgcagcacaggcaagttattccaaatatgatgagcagcaatgaagacaacccggatataaaggatctgcagaatgcagaaactttgcgcaagtatgatatttctaacaaagatcttatatatacttacacaagcatgaatcagtatctctatggctttgaaaagtgtagtcgttagcattcccctcattgtttaattagaaacttcacattgttgtctaagcgctcctaatgcaccatctttcctctgaaacacccaatgcgatgtgttttgcacagcctgttatctctaaaatatcttggtccttaagatgctagttgattgaggtttaattgggtgtttggttcccctgactaaagtttagttcgtgtcacatcaaatatttaaatatcaattatgagtattaaagataggcttaattaggtttaataaatttgccttgccgtttactgtagcatcgtatgagtgaatcatagactatttaggcttaaaactcatcttaacgtttagtactta

SEQ ID NO: 12795 - DNA, 967 bp, Zea mays
atataacttgccgccttcgtatcttgttgcactttattttgagaacggacgtccaattacaaaaaaaaaacacaagctgtcaaataaagatgcataataaacaaacagtgggatgctgcattatgcgtggacacgactgacgacacaagctttaggatggatgatgcatgcatgcatcgtacatagagtactatatagaagctaagaaacatgtaacgtgcaaagcaggaagcagcagacacgtgtgtgcaagcagtcatgcacgctaagcttcacgttcacgatcacgggtgaaggcagccaccgccgccaccgagcccactgccaccgccaaggccgccgctgccgcccagacccgatcctgagccgccaccaaggccaaggccgccgccaccgccgagaccaccaaggccgccgagacctgacccgccaccaaggcctgatccgcctccagcaccaccaagcggtccaaaccctccgagtccaccaccgacgacaccgccgacaccaccgccagtcataccgccaatgcctcccgcaacgcctccgatgcccccgaggccggcgccggcgccagcgaaccctccgacgccgccgacgtagcccggcaggaaggtcttctggtcggcgttcacgccgggcgcagctgctctctgaccatgcttctgctggctgtcgttgctgttagtagtagtgccgcctatggccgccaccgtcgccgtcgtcgtggtggtcgtcgttggcatggctctgctggcctcggcgggcgtcagcgccaggatgacaaccaggagcaccaggctgctgcagcacgccacgattccggcggtgttgcgccacccgctaggcataccggatcaataataatgtgccttctcttatctctcgatcggcttttcttttttggtggctagggctcaggtctctctctgcaggtcgcaatgaagatgccggcccggccggcctg

SEQ ID NO: 12796 - DNA, 810 bp, Zea mays
agggctttcgccccaggcctcacaaggtcgggaagggtttccgcgagctcaccctctccactcgcgcacccgccgccgcttcctttatctcacgcacccgtcgtcgcctcctctccctcgcgcaattggggccagctgttgggacgacgttgaggacgagggcgatgacgtggtcggcctcctccactctgtggagacaaccaaggcggtcgcggtggcggtcgctagcatgcaaccccactgagtcgagctcatacggcagctcgacgcctcctgtgagacacgccgccacgagccgccttctccacccacatctgcacgcgcaacacaaatctcgtcgtcggcagcttccacaccgccactatggcagccagtaggagggccagcgacagccgcgtcgccgttattcctctgaccctcttgctgatcgagagaggtggctgagagaggtggaccggccgaccggatgagcttgtggctagctggaggaagaggtgaggagatgtatgatctgaatgggagtgggtagtggtggtggcctggcgacggacagcagtgcagagtgacgaccttgctgctgttgtgtcatggcgagagtgctttagtagcttctttatttgttttgaccagtctataaaataaacaaagaatcattagcaattatgtaaccacttgcttgtggattgtggtaattatgtcatatacgataaaacctgttagatatgtcacatatatgcttgttgcttgaaatactaacagcacaatgcatttattaaaaaaaaaaaaaaaaaagcggccaaaaaaaaaaaa

SEQ ID NO: 12797 - DNA, 7424 bp, Zea mays
atctaggaatatatgagtttagattacgtttgaataaatatcttagggttgtctaactatataatatatagaaatagtaggcaacaaactagttcgatttttaatataggaaaaattaacaggccgttaggtggcccatgggggcgagtggaaaccactgcatcggcggaccaggcaactgcaagccgagcccggtgtttgaagtttcaacaggccggcccacgaggcccgcaacaactgatcacttctccccccaacccgcagcccagcccgcaccccgccgccgcatcgtcctctaggtctttcttaccgagccgccaggagagcgggacccggacgcgtgggcggacgcgtgcggccgccgcccgcgcgcgggacgctcaaaacagccgcttccccaaccaaaaggcgcaagaaaactcgtccccgccgctcaaaaatctcccgcctcccgcggatgggatggcatccagtttcacagaccacacgcccacccgctccgccgctcgcgcccaaaaattttcgttcagccggctgcctgccccccaccaccacttccctcccgttccgaaaccccgattagccgccgacccgccgtctccccacgtatttgactggtgctagagccagcgcccagatcaaccttcctgagtccatcggcaccgcatctgcctcgcgatccgtctctctctctgtcccctcacggccgtagaccttttcgagggcggtatcggagggaggagagggggaggcgaaggcgggagtagtagaaactaggaagggccgttcgtgtcttgcggagaagatggagaacctgaggaggttcctgaacccgctggtgctcaacctgcagaagatggagctggagctcacctgccccgtctggtgggtcaagccatcccttgtgtgatcgtgtcctttgcttttgcctttctgtctagatgtcgaaatgtcattcttatcgtcgaagatctcggcgcgactaagattagcatggccgcaacagcgggaacgaacttaaacttaggcagagctagatccgtgcaaaatggcgaccttcgatccatttagagtaaaatgaggggataattgcatccgtatactgaacttcttggtcgtctgacggtgaaattttttgtttgtcagcctgaagttgctcacctcgcccacaacgctgccgtgttaccacacatcctgcaggtgacgcctcaaccgacgagcgctcatcaccctccactcatcttgccctgtgagtttcgactactgacaagtttgttcctttctttcagcaagtgtgcccttacaccgacttcaaaaggctacagctgtgccatttgcaaatcaggctattgttctcaaggtacatcacagcttaccaaattgtttcagagttctgtttgacaccttgattctttatttgaccccggtgttgtttgcagatttaaggccagcttctcaccttgagtcgatagtgagcattcataggagcctcagctctaccgtcagcaccatgattgaacaacaggattctcaaattaacattcatggtacatccattcttgcagaatatgaacttcaatcactgttaataactagtagtcggccaaagttttgactgatgtggtgaaatttctctttgttcagttgcaaaggcagcatctcatggaacaccagaatcaggaaacagaagtggggtggaggagaaatctgaccagatgaaatcttacaaccctgttgcttcaaagctagtatataaccaaccaactggacctgcatttgggaacattgatagtgttcaagcaaaagatcctgcatttgagaacaatgctggtgccgcagctgttgcaccaatggcttttgtacgaaagggccattctgggtcacaatcttctgatggccctggagatttggactgtgacagcaatgacctcgaaggagaactggtaaagttctattctatctagactgccttttgtccctttcacatttttttttcaaaagtttttcagaaaaaatatttatgtagacccactcttaaacgtgtgtattctatcagatgacaagcctatcacctcttcaaactgcattgaaacgagaggcaaatgcaatggatgatcataccagagaattgaagaagcaaaaatcaaatgatccagttcaaagtaagtcatcttgtacaatctcctttctgaatatttggaaatgcaagatgctaatgcgatcttgaacacaaacacaggacaaacaaacatggccagtgcttggaaatgtgagttctgtcattcttcccaagttactgaggttggtcttgcagaacttaaacaagagttggagtttatttactattatatggccagctgcttgtttgttgtatactcgaagaatctaatgtaaaatgttatttacagtgtactggccctttgtcacattatttgaatggggagccagtagaagctgatcaagcttggaaatcaagtgttcagcatgtccatgagaaatgcattgaatggtatgttcctggcaactttcatgataatatttctgagcgcatacttcattgcactgatttgtacacatactccatattctgagacaggaagtttgtgttttctggttctttttaggtgcaaagtttgattttttttgcattctgtacctgtgtagtgatcatttagtgtactatttccaaaataaaacttactgcactaagttataataccaatacagggctcctcaagcattctttactggtgacaccgcaaacaacttggggcctgagttggcccgtgcttctaagatcaaatgcagtgtttgtggcttaaaaggcgcagcacttggctgccttgtgaagagctgccgcaaaagttttcatgtcccatgtgcctacaacatcaaaggctgcaaatgggatcaagtaagtattgttccttaaatctgcactgtccattgtgtattaaacaaaaagtgcgtgcccttttgtggtaaagtatttgttgaccatatcactgaacaaatgtgatttgctccaggagaactttgttatgctgtgtcctacacattcgtcaaaaaagttgccttgtgagagattaaagccaaaaaagaaggccaagctgcagcagtacgccactgtgcctgttatacataactgtattttgctattacctgatcgtgtcttgtgatgacccctctttgaattttgcagaccatcttccgacattgatggtccgatttcaccctctccgatgcaaagggctgaactttggactgcctcaccttttctgactagtgaatgggtgatatgtggatctgcgctcgttggccatgagaaggtaattgctattttgatatgatcttcataaaaaaggtactttagtgcttattcaaatatgtaatgtgccctgaaatatccataaactacgcaggaaatcttggatcagtttgagtgtcacactggcatcacagtaaccaacacctggagttcagatgtgactcatgtgattgctaatacggatgaacgtggggcatgtgcacggacactcaaggtcctcatggctattttagctgggaagtgggttctcaatgtgaattgtaagtccattttccctgtagaccagtaagcaaacttagggaacgataattcaaccaagtgctgtatctagtatactgcctgcatctgccaggttgatttcgcttagatgccttattctaacgcaaatacccatttgatatctagggctgaaagcctgtatggaggctagggaaccagtcccagaagagccctacgagataaggtgtgatgttcatggctctgtcgacggccctcgctcaggaaggctccgagcgatgcagcaggtttgcaagtgaactccgggagtaaataagccaaaccatcaacacatccttttggtgtactgaccgcataacttttctcgtctgtaggcaccaggtctgtttgctgggttgaccttctacttcagtggccatttcatggcgggatacagggccaacctcgaagatttgatcgccgcagcagggggctccgttctggagaaggccgagctctctagcacgtccttgatcctctacagcatggaggcgccgccgccccacaacaacctagacgccctcgagaccatcaacaagagattagccgaggcccaggaactggcgaccacggctggctgcaaagccattcctcacacatggcttctggactgtatcgcgtcgtgcgcggttgagttgaacgtgtcgtgttctactgcctaggttcaaacataggaatgcgacatctgctgctgtttttttttgaaaaaaaggagattaagagacgattggcttgttgtcttgatccaaagtatctttagacgttgtagcatgaaagcggaatttagtcggaataagcctgtgtatcttagtcaacgttactgtcggtgatgtcatccacatgtttcacctactgacaggtgcagtttgtctgattttttttcttcttgatttctatctaaaaaaacataaaaggatgcactcaggtcaggtttactccactttttcttgaattgacgttggaaaaaaaaaagagatttaccagctcggtgtgatgtgtgcactctctgtctgttccagatccaacgctccagacggcgccatctgagaatttgcatatctgcctgtgggagtgaaatgattgtggagtgcattggaaacgaagcaaagcgggatggctgagctcaggtggttgcttcagaagtagttcaccagcaagcagccgggaggtcaggtccccctcacgcccctcggtatagcagtctcaccagtcaggcgtcctcctccctctggtctggtgtcccgtgaactctccttttttcggttcaccagaccatgatcctgatagcaaaccagttccccttttattcgatccatttataaggagccgctcctggtcctgagctagtgtgtgggtgtgcccacggcatggcgttcttcagcagcggatcccgggtgctggtcgaaatcctgacgaggatgcagaggtgcgttaattgcaggctgttactctcatgtggctcgatcgcttgccttttgcctggtaaaaacatgaaatcccaacgtgtgctgttgccagcgctgaaagaccaatgcctgtcgaccacaccttcttcgagtcgggatccattcgctaccatgtggaggcttcagcgtcggatcccgagaacgtgttcctatcgatatcgacgccatcgctctcctacgactacgaggaggctgcagctgctccctcgtcgagccgcctgcctgagctgaccctgcaggaggcgaggaagacgtatcacaggttcgccgagatggtggagccgccgagggaagggtacgtcctgacgctcaagctcaacttctccggcctcacccggcccaaaggtggttggcttctacccgtttgtttggtggcagctgggactgggagttatatatatgtacacatctgaacatatataaaatatagatcgcgtcaaggccattaaccaggtgtcgctgctgcaatccgtggtgctgagctcgcagctgaagcacatgctggggagcctcggctcgtcgggcacgatgaggctcgtgtacaacaaccagagggagcccttcttcgtcagcaagacggtgcgtcgtccggccagttgttcttgtgcatgcccggccgcgcagagcaaactagaactaacattcaggcagcctgcattattatatcaatgcaaaactgactggcccatatggccatatgcatgcatatgcatccatcttgtgttcgctaacaatggaacctacacgtaccacgtacgccctgcaggctgagaagataaacgctatcttccccatgcgtttcagggatgacacggacctggccatcgccacctccttcttccaggtgtgcctgcacgcatttgcatcgcatccacgtatacgtcacgcggcggcggatgaaccttttgttgttgttgcaggagctgcaggaggtcgggaactcgttcgcgagggcgcccaagtgcagctggtcgccgatcccaccgccggagctgcgcggggagaacgtgcaccacctcaccaccaacggcggattcgtctccttcggtacgtccagcaccgcaaaaaaaaaaatcttgtcagttgacacgcgtgcccacggccggccgtgcggctccagttaagtagtgggccggccgggcttcgcgtatatatctatccatctcatcggccacttgggcccgcacgtgcaggcgtcctgtcgcggcacgtgagggggaagcggccgccaagaccgcgtggatcctgctcaacttccagtcctacgtcaagtaccacatcaaggttctcctgctagtgccagccaccgacccgtccacgtccgtttccattactaccgtgggtggctgatggcggcggtggtgtgacgccttgcagtgcacccggagccacgtccagagccggatgcgggagcggctggaggccctgacggaggccgtccagaacgcgaggctgcgagggaatagcggcgacgacgacaagaagcggtcgtcacaaggttgtacatctcgctcgccagctccatcgatcggcgatggctctccgccattacggctacggattcggatacgtatatatataaagccaaaaatcctgatgcagttgtgaagaagaggagcaagagacgtctcgccagcctggcgaaagcgagcgacagggtgcgcaagggtttcagggccgtcctggacaagatgaagcggctgcggctgagggtcagggtgaagggcctggaccggctccggcggcagttccggtgccggtgcttcgccgtgcctaggctgcccgcgccatctcgcaccggcagaaggaaggagcactacagataccacaaactggccgagtaatctatatatataccgaactttggtcatcgacgacgtcgattctacgtactgtattaactgatgatgagcatggctgctagtttaatagcgatggcactccgctattatatctagcattggagcgcaaaaaagagtttagatcttttctcctcacacaggcttaaaaggttttagcctctgcctaatgtggtaggcttagagttagagatggacattgaagacgccttaagtgtccatgcttcagtgttgttgcatttgagctaatttgtacctgtacttttagtgcccgtttggcacagctccagctcctgattctaagcgaggatctggaggagccgtgccaaacgggtattttttaaaccgattctcgtgtgaagccgaaagattgggagtcgtttttgtgaagaaaggtgagatctaaaaaaacatgctcaaccctcccttaaaacagctcctcaaccaaaaccaaatatgaatcttcccttaaattttgatcgaaattacccgcaa

SEQ ID NO: 12798 - DNA, 2473 bp, Zea mays
taaaaactcccgcctcccgcggatgggatggcatccagtttcacagaccacacgcccacccgctccgccgctcgcgcccaaaaatttcgttcagccggctgcctgccccccaccaccacttccctcccgttccgaaaccccgattagccgccgacccgccggccccccccggatttgcctggtgctagagccagcgcccagatcaaccttcctgagtccatcggcaccgcatctgcctcgcgatccgtctctctctctgtcccctcacggccgtagaccttttcgagggcgatatcggagggaggagagggggaggcgaaggcgggagtagtagaaactaggaagggccgttcgtgtcttgcggagaagatggagaacctgaggaggttcctgaacccgctggtgctcaacctgcagaagatggagctggagctcacctgccccgtctgcctgaagttgctcacctcgcccacaacgctgccgtgttaccacacatcctgcagcaagtgtgcccttacaccgacttcaaaaggctacagctgtgccatttgcaaatcaggctattgttctcaagatttaaggccagcttctcaccttgagtcgatagtgagcattcataggagcctcagctctaccgtcagcaccatgattgaacaacaggattctcaaattaacattcatgttgcaaaggcagcatctcatggaacaccagaatcaggaaacagaagtggggtggaggagaaatctgaccagatgaaatcttacaaccctgttgcttcaaagctagtatataaccaaccaactggacctgcatttgggaacattgatagtgttcaagcaaaagatcctgcatttgagaacaatgctggtgccgcagctgttgcaccaatggcttttgtacgaaagggtcattctgggtcacaatcttctgatggccctggagatttggactgtgacagcaatgacctcgaaggagaactgatgacaagcctatcacctcttcaaactgcattgaaacgagaggcaaatgcaatggatgatcataccagagaattgaagaagcaaaaatcaaatgatcaagttcaaagacaaacaaacatggccagtgcttggaaatgtgagttctgtcattcttcccaagttactgagtgtactggccctttgtcacattatttgaatggggagccagtagaagctgatcaagcttggaaatcaagtgttcagcatgtccatgagaaatgcattgaatgggctcctcaagcattctttactggtgacaccgcaaacaacttggggcctgagttggcccgtgcttctaagatcaaatgcagtgtttgtggcttaaaaggcgcagcacttggctgccttgtgaagagctgccgcaaaagttttcatgtcccatgtgcctacaacatcaaaggctgcaaatgggatcaagagaactttgttatgctgtgtcctacacattcgtcaaaaaagttgccttgtgagagattaaagccaaaaaagaaggccaagctgcagcaaccatcttccgacattgatggtccgatttcaccctctccgatgcaaagggctgaactttggactgcctcaccttttctgactagtgaatgggtgatatgtggatctgcgctcgttggccatgagaaggaaatcttggatcagtttgagtgtcacactggcatcacagtaaccaacacctggagttcagatgtgactcatgtgattgctaatacggatgaacgtggggcatgtgcacggacactcaaggtcctcatggctattttagctgggaagtgggttctcaatgtgaattggctgaaagcctgtatggaggctagggaaccagtcccagaagagccctacgagataaggtgtgatgttcatggctctgttgacggccctcgctcaggaaggctccgagcgatgcagcaggcaccaggtctgtttgctgggttgaccttctacttcagtggccatttcatgccgggatacagggccaacctcgaagatttgatcgccgcagcaggggggtccgttctggagaaggccgagctctctagcacgtccttgatcctctacagcatggaggcgccgccgccccacaacaacctagacgccctcgagaccatcaacaagagattagccgaggcccaggaactggcgaccacggctggctgcaaagccattcctcatacatggcttctggactgtatcgcgtcgtgcgcggttgagttgaacgtgtcgtgttctactgcctaggttcaaacgtaggaatgtgacatctgctgctgttttttttttgaaaaaggagattaagagacgattggcttgttgtcttgatccaaagtatctttagacgttgtagcatgaaagcggaatttagtcggaataagcctgtgtatcttagtcaacgttactgtcggtgatgtcatccacatgtttcccctactgacaggtgcagtttgtc

SEQ ID NO: 12799 - DNA, 1497 bp, Zea mays
tggtgtccgtgaactctccttttttcggttcaccagaccatgatcctgatagcaaaccagttccccttttattcgatccatttataaggagccgctcctcgtccccggccagtgtgtgggtgtgcccacggcatggcgttcttcagcagcggatcccgggtggtggtcgaaatcctgacgaggatgcagagcgctgaaagaccaatgcctgtcgaccacaccttcttcgagttgggatccattcgctaccatgtggaggcttcagcgtcggatcccgagaacgtgttcctatcgatatcgacgccatcgctctcctacgactacgaggaggctgcagctgcaccctcgtcgagccgcctgcctgagctgaccctgcaggaggcgaggaagacgtatcacaggttcgccgagatggtggagccgccgagggaagggtacgtcctgacgctcaagctcaacttctccggcctcacccggcccaaagatcgcgtcaaggccattaaccaggtgtcgctgctgcaatccgtggtgctgagctcgcagctgaagcacatgctggggagcctcggctcgtcgggcacgatgaggctcgtgtacaacaaccagagggagcccttcttcgtcagcaagacggctgagaagataaacgctatcttccccatgcgtttcagggatgacacggacctggccatcgccacctccttcttccaggagctgcaggaggtcgggaactcgttcgcgagggcgcccaagtgcagctggtcgccgatcccaccgccggagctgcgcggggagaacgtgcaccacctcaccaccaacggcggattcgtctccttcggcgtcctgtcgcggcacgtgagggggaagcgggccgccaagaccgcgtggatcctgctcaacttccagtcctacgtcaagtaccacatcaagtgcacccggagccacgtccagagccggatgcgggagcggctggaggccctgacggaggccgtccagaacgcgaggctgcgagggaatagcggcgacgacgacaagaagcggtcgtcacaagttgtgaagaagaggagcaagagacgtctcgccagcttggcgaaagcgagcgacagggtgcgcaagggtttcggggccgtcctggacaagatgaagcggctgcggttgagggtcagggtgaagggcctggaccggctccggcggcagttccggtgccggtgcttcgccgtgcctaggctgcccgcgccatctcgcaccggcagcaggaaggagcactacagataccacaaactggccgagtaatctatatatatatcgaactttggtcatcgatgacgtcgattctacgtactgcattaactgatgactaggtatatgcccgtgcttcgctacggagtcaatatattatattaagatataaaagaactaactggtattttatactcttgtcagtatctttaaatattaaaaaggttatataccttaaaaacaaaaaaaaaaaaaaaa

SEQ ID NO: 12800 - DNA, 2200 bp, Zea mays
aggcccgccgggccggcctggcatctgtctgacccattttccccaaaacaaaacgactcgttctttcccgggggaggggaggactggagaagcctggccagccatggacccgcccaaccctaaccccaacgatgccccgtcgctcccagccgaatccgcggccagactcgccgccctctccctttgtggcaccagggaccttcccccggacttccacaccgccgagatcctcgacgacgacgagggctacctcacctccgcgtccagaggcgggagcagcacctccgcgtggaaggaggcgcccgagggactccacgacgatgacaaggatggggacgatgtctcccagcccagccccagaagcagcggatacgctggcgagcgcggaagcagccttgatgacgacgccgaccccgaccccgaccccgaccaggattgggcgcgcggcaagaagcatccccacgaggacgatgcttcctcttcgtggaggaagaggaaaaaacatttcttcattctgagcaattctggcaagccaatatattccaggtatggggatgagcacaagctagccggattttctgctacgctgcaagcaatcatttcctttgtcgagaacagtggcgaccatatcaaatttgtgagagctggcaaacatcagatagttttccttgtgaaggggccaatatatttagtttgtataagctgcacagaagagtcatatgaaggactgagggggcaactagagctcatgtatggtcagttgttgcttattttgacaaagtcagtcaataagtgctttgagaagaaccccagattcgatatggcaacattgcttggtggcactgatgcagttttcctatctcttatacatgcattcagctggaatccggctacttttcttcatgcctacacatgtcttcctcttgctcaatcaacaaggcaggcagctagtgcagttttgcaggacatcgctgattcaggggttctatttgcgttattgatgtgtgagcacaaggttattagtcttgttggagcacaaaaggcaactttgcatcctgatgatattttattacttgcgaatttcattctgtcctctggatcttttagaacttcagagtcttttgtacccatatgtttgccaagatacaatcctatggcctacttgcatgcttatgttcatttttttgacgaacatacatatgtgactttgcttactacacgatcagatgctttttatgatctcaaagattccagggcccacattcaaaatgctcttttaaagtcaaatgtcctcatcgaagtccaaagatctttacatgagaatgcattgcgtgttgaggatctcccaaccaacccgtcttctcaatctgcatcacaccctccagagtcctctcaagacattagttcacaatctttgtcttctgaaatggcaattggaggaccaggtggactatggcattttatatataaaagcatttaccttgaccagtttgtgtcatcagaatttccctcacccataagtaacaaaaagcagaagaagggattgtacaaagcttaccaaaaattgtatgcatccatgcatgataaagcaactggtccacacaaaactcaattcagaagagatgaggattatgttctattttgctggataacccaggatttcgaactatatgcagcctttaatccactggctgataagactcaagcaatcaagatgtgcaatagagtatgccaatgggtgagggatttagaaaatgagatattcgtgtatggagaaagcaccctttcctggtgatatgttgtcctgtgtgtaataacttgttatgcctatgttacattttttttgttgaaagttttttttgatgttacttgtaccgacacaggcagtaccatcgttgttggggaggtgtatgagggggctaagtttgtcgcacttttgacattttctcaggaatggtgctccttttttttatctgtctgatgaactggaggttttttttcttcttatcattatatgtctacggcaccatttcctatctgtttgtagcagcccgttaaatttattaatttgggaagggtctattctgagggaaggagtagagcaactccagcccgcctctgcccgcagttgctggtcttcaaatttatagagaagggggatgttgatgcaaaaaaaaaaaaaaaaaaggcccctagggcc

SEQ ID NO: 12801 - DNA, 678 bp, Zea mays
ggggatccagcatctggtgcgcacccagtacgatctgacgctcatcccacatcagtagtcgaccaagcacaagcagcagagccggccggaatatgtggacgatcaggaaggtggcgacgccgcaggtggccgtcctcctgctgctcctcatcgtcgttgcgcaggaggcggcgccgttggcggaggcgcgcgtgtgccggcgccggagcgcgggcttcaagggggtctgcatgtccgaccacaactgcgcgcaggtgtgcttgcaggaaggctacggcggcggcaactgcgacggcatcatgcgccagtgcaagtgcatcagggagtgctagctagctagcagctataccggcctttaattaaattaataaggatcgacgtcgcggtcggtcgctaaatatgtactactatacgtctacactacatgcaataatgcaccacatgtacgcgtacgcgcgccgagctgtgtggacgccgcagctagcacggccatcgttcctatacatcgtcgtctgtcgttcgagtactcatgagctgcgtcgtcgtcgtccacccatgcatcccatccgccaaactttgatgatggtcatatgacatcttgacaataaacacgtgcatgcagtattatatacaaaaaaaaaaaaaaaaaaaaaaaaaaaaaaacaaaaaaaccccccc

SEQ ID NO: 12802 - DNA, 731 bp, Zea mays
acgcgtcgccgctcttgcatgcgcgcgccgtccacggtccaccgccggccgcgcgcccggccgcgcctatatctgcgagccggacgcgtgggcggaccctccggcatacgatctgacgctcatcccacatcagtagtcgaccaagcacaagcagcagagccggccggaatatgtggacgatcaggaaggtggcgacgccgcaggtggccgtcctcctgctgctcctcatcgtcgttgcgcaggaggcggcgccgttggcggaggcgcgcgtgtgccggcgccggagcgcgggcttcaagggggtctgcatgtccgaccacaactgcgcgcaggtgtgcttgcaggagggctacggcggcggcaactgcgacggcatcatgcgccagtgcaagtgcatcagggagtgctagctagctaggctctaggatctagcaagctagctatatcggcctttaattaaattaataaggatcgacgtcgtggccggtcgctaaatatgtactactatacgtctacactacatgcaataatgcaccacatgtacgcgtacgcgcgccgagctgtgtggacgccgcagctagcatgcacggccatcgttcctatacgtcgtcgtctgtcgttcgagtactcatgagctgtgtcgtcgacgtccacccatgcatccggccgccacgctttgatgatggtcatgacatcttgacaataaacacgtgcatgcagtattatataca

SEQ ID NO: 12803 - DNA, 1121 bp, Zea mays
gcacgaggggaatcatgactgccagtttcagctacgtaggccccccccctttaacatccaaacctgaaactccgttttggatgattagcacttaccatctgcatccttttgatggtgttatcggcttaagtatctgctccttgcttgctatctttttcttccctcaaaagcctgttcagaaggatacatctgtgtgatgaggctcagaagagtaaaacataatgctggagtgagcttccaacaaggactaatcaccatgcgcatgctgcgagcaatgaagggtttttcctaccatacatgttaaaatgcaatgcactgcaacttgctggcagcaaagagtatgtgctcggttagcttcttgctcatctgactgagggtactgctgattggaatggcttttggatctataactagagtatccaggtcatttgtacttaggcaagtgtgtatactactctatgctggattatcgaaatgggggatggtttcttccctacgttgtaaggtggcggaggaacagatgatatgcctaggaagaggaactagtagatgataagagtttgcccctgatattaggcttcctttgaaatgcaggaagtctagaggaatatacaggaatttcacaagaatcagtctattttcacagaaaaaatgcaggaaactgaaaaaaaatccccgcattccaaagggggcctcatctaggatttcttcataccgaattatcgattgacttcgaccacataccgtgcttttgttcatgtctttgaacacaggcacacccaaatttcgaggtttacaagtaaaatcgccaggctgtaaaccttcaattcttatggctaggttttcattctgaaagtcatgtcttccgcgtcagcataatcctgtgttcctgtttaacctctgttcggacttagtagtgctcatttgagttctaattcggccgggcaactgtacattctgtagtgttcgagaaaaaaactgtaaattctgtaatattgccaagaaatatgaatttacatgaactttacaggtatttgctttaatttttaagaaaaaaaaaaaaaaaaaataattgcttattttttattaaaaaaaaaaaaaaaaaactcgagggggggccc

SEQ ID NO: 12804 - DNA, 2385 bp, Zea mays
agcctcagggatagaggccgccaggtaagagaggcccttggccccagccatctcccacatcaatctttcttccctagctaacctaagagctagagaaacattgggggtccagccatcaaagatacatttgtttcgatgattccaaatgatccatgcccccaaggcaatgagagaattgagccccttcttaataggtccattgactgacccagaagcttcttcccaccatatcatgaaggaaggcaaaccgggctgtggtgcgagcacttgcagaccaacttgtctcagctgcttgaaccagaaatcccttgagaaaacacaagacactaagagatggtccaaggtttcagcttcttgatcgcatagtgggcatttggatggatgatcaattcctcttttagcaagtcggtcagcagtccaacacctcttatgagcagcgatccaaaggaaaaatctacactttggtggagcccaagttttccacaccctgttgtagtagccaaaagaagttgatcctgaaaaggtccctcatatgcatctttagctgaataatttccatttgtttgcagcatgtttgttttataatgtgatgagtgggacagtgttgcatgtggttacttgttcttctttaatggtgaaatgacacgcaggtcttgcatgtttaggttgaaaaaacattgtatgccaaaagatctgatatcatgagtatgatatgaattttgttgccacactgttcacatgaaggagatgttggtttggaaggtcaagtagtacacaggtcggataccttgcagtatttaagatacctagaacatcctaatcgaaaaatcgacgaagatgttagccatgaaaccaaaggagggtggaggaagtggcaccaagcatctggagttctgtggcaaaaggatatcacagaagctaaaagacaagtcttataggacgacgattagacctgctatgttgtatggtgcaaaatgttggcctacaaaaaaaaactcatattaagcagataaggtgcagcggaaatgtgtatgttgtgttggatttatagccatacaggaagtgatcaagttcggaatggcctaagcttagtggttttcaggaagctgtgcaagaagcgtggaattctatcccagaaaataattgttccttctctactcttgacttaaaattaaaggctgcagcaaggatgcttcaaggttggagtcaaaagaaggttggtcattttgtttctcagctagccctggccagggacgtgctgcaccagttagaaattgcccaagatttgagacagctacaaccaaatgagcaatgcttgaagagctgtcttaccaagcactctttggaagcttctctcaaaagaaccattgctagatcaaggtctagactgaattggttgaaggagggagatgccaacactaaactctttcatgctcacacccgtcatagaaaaagaaaaaaaatcattgccaggttagtggatgataatcgagttctaaccaagcatgaggacaaggctgctttggttgatggtttctactcagatttactgggttgcaatttggatagagatcgttctatcaacctgcaggagttgaatatttctaggcatcatctctcgggcttggatgcccctagctctgaaaaggaagtgtgggaaaccatcaagcaactcccctcggacaaggccccaaggccagatggttttactggtggcttttataaagcttgttgggacatcattaaaacagatattatgagggcagtctctgcagtctggtgtagaaatttctgtaacttccataagctcaactcagcctttatcactcttgtgcctaaaaaggaaggtgctgatcttgtaaaagactgtagacctatcagtttggtgcatagttttgctaaaaaaatttactaagctgttggcaaatcgtcttgctagtcgattgcatgacttggtctctctcaaccagagtgcctttattaagggccgttttatccaggataacttcatgttagtgcaacaaaccgctcgctttctccataagcgaaaggctgctagtctattgttcaagctagacatttctaaagcttttgatttggtctcttggccatttaattggaagtcctgagaaaccttggttttggatagatttggagggatatcatcagtgggctcctctcttcatcatctatgcggattgtgttaaatgggtcaccaggggacactattttctacagtagaggccttaggcaaggagaccccttatctcctatgctatttattcttgtaatcgatgttctaggtcacttggtgatgtcagcagaagctgaagggctgctacaatccctaacaactatatctcttaaccaaaaaaaaaaaaaaaa

SEQ ID NO: 12805 - DNA, 3408 bp, Zea mays
  misc_feature (397)..(397): n is a, c, g, or t
  misc_feature (1089)..(1089): n is a, c, g, or t
  misc_feature (2118)..(2118): n is a, c, g, or t
gtagagagaaaatgattctttgttactatatggtgttgctgtccaaagttacatgatatgagaatcccgtctctattatagacagaaactagtgtttcgtgcatatgggccaaatgagtcttcttggcccaagaagaatttcttaacaaagtgcatccgcttagggcatattcggttacaccaatcctcccaatcctccgaacatgcccttggtggggagagaaacggtggtggtggaggtggaggtaggggcgggggcgggtccggttactaggtgtgccggatcgctgccggccggcgggacactcggcgaacgaggagactggatggcgcgggctgtggtaaattggtgcttgggagggagctcacgatctgatctagaggtcttggctgccgngaagggcaggcaggcggcggtggggcgggcggggcagcttggagcggcagtgggggagggctcgcttgccgtgggggcaaggcgggagggcgaaccggacatgctcagttctggctatatgagtgatgcagttgtgacttccttgaaagataggtcttgtttaatcagcagacagttcccctttgtgtatttcatggatggtgcaaagacttggtacgaacatatttgggtaaactagacctacataataaataatttgagtattagctattggactatcttgcactgtgaactggtgaagcatcatgatcctgactcctgagtggtcgcatgcttcttcacactaccaacctgacatatcttagttttcagatgcatatttttggtattacttagcactggtatcattagttctgactcatcaacatcctttagttcagatatattctggttcttctaaaattatactttcattttcaacagttcaaaccagtagtgaagaatcaagaggaggaagcatcccaaaaggtgtcaaaaaagaaactggacaaaggagctaacaaacttggtgctgcccaagctgcatcatgatcttcctgtgagaaatgttgccggtgccttcagttgcagtggctccagtctccaaatgtacaaagatggttaatacgaatgaggaatgcacttcatgacangaatcagctgattttttcttggcctattgatgttatcagcagatcctgtgcctcggcatattatttttcatagaatgcatagcatcaatttcactagttgtgcagaaatatgacatgctcaatcaaagagtttttgcataattcattcttcagttcttacaggattagcacgggcaggtacgcagaactctgaattaagcagcagaaaatatttactgagtacactaccaaaatccggcagaattctaaatttagcaggataaaatatttactgggtatcttactctttgcaacgatttattaagtgcaatttatcggacattcggcaaaacacacatgtcgagtgccattcttgatgaataatgacgggaacatttctcacacctgagaataagcaatatatcgacgaaaattagtaattctcgtcggttcttgagaaccgatgggactttgtggacaaggtttaattaatttctgttgaccaccgacgagaatcaattaattccgtcggcttttagtggcccacgagagttatgcaagctgcagcggacacggccgacgtgtgcggcacaaagccacagggtacaacaacatgagcctgtctgtctgtgatcatatgatgttgcggcatgttccgtcgcaggggtaggggcagtcgatcgccttgacttgagctcgaccgaagtaccagtcgcccactgacttggcaatcccctgcattcataatttgctttcgtaatactaatatatgtatggctgcaatgcaacggtttggttggtttattaccctgctttggatggcgggggaggcacctgccgcgtggctccagctccaggtggccggcagctcggactggcagtgcgcgaagcaggagttgatgaagagcccgttgttgctcctggagccggcgaagcgcccgcccaacacggacgctaccatctggtccctgaaacctgcacgcgctagctgtcgcactaattggtggatcggatccagtggtgtagaaacaaacaaaggcacgggtgggntggaccttgcaggaatttcatctgggtcgcgtcgcaggcagagtggttggacttgcaggctcgccaggctccgctggggtcagctccgctgggtgccaggctctcctgtatctgtagatcgcatagctagatcgttggatcgatctttatattaacgcaacgcaagtgtgcatgtagtatatatgtacctgccaggcgtcgtacgctgcgttgagcaggaagatgggggtgtttacgccatcgatcacgttctgagggaagaagcactgcattcaactcacaaggaaattaattaaggagcatgcatgcctgcctgccatttgctagctactggaactgcaagtgcgaggaggaagctaaagctagcaacagcggctagcgcggcgggcgtactacgcacgtaccgaggcggtgtccaaacgggcagtgcacgccggcggcaggttgggacccaccccctgcatggccacgatgtcggagtagtaggaccgaaggctgcgcccgccggagacgtcgatgctgcaccaggcaccagagatattgatggagcaatgcaacagatactgtaacaaacaaataaataaaaggttcgttaatttggtacgtctcccccacgtacgtacgcgtcgaggaagaggccggcgtcggcgaggcacttgacggtagtagtggtggtggtaccgcccgcggcggcggcgttgtgggaccgagggaagaaggcctggaactggtcgcagtgcagtatgaccgccagcccgccggcggagcagccagcgagcaacacctggtccgcagcggccatcccgatggagaggaggtgccggacggtggcgtcccagacgcgctgcccgcggaagtaaaacccgttcacctccaggttgacgatccagctgttgttccctgctccggagcccgggtgcaggtggtaagcaggcggtgttccgtccatgcacacggctcccaagtcgacggcggactcgaggatggtgatgggcaccatgaggggcgcaggcggcgacgtcactgccgccgcggcccgcctcctgcggctgcgacgaccagctcctctattcctgcttttctgctcgtccgcagcggcggcggcggcggcggcgaagtagctacctatgagaatagcgacgacgaggaggaggagatgctgcctgctgcagggtcgtttggcaacagccccatgcacccccatctatcgtcgaccctgatctctccctcggctctagctatcctgtcgtctctgtaaagaaagctagcagaagcagataggtgtatcct

SEQ ID NO: 12806 - DNA, 1616 bp, Zea mays
tgtcgttcttgaaataaaccctacctattgctgtagtgctgttgttgattacagaattatttactccgttctgaagttgaaagaatttctggacaacaagatatgcgacacaaatatttgacggtctcaaaccgtgctaaccacccaaagaagttcgaggtgctgccagtttatctctgttcgcttgcgccccgccccgtttgcgcctccctgactgatgatagaaagacaagagcattggttcatgctatggtggagattctttttttatgtggaactgggaaaagagctgttgtagcatctgttgcacgtgccaatcgtgggaaaattgatgcagctttggaagatctttctgtcgaatcagcagtggatctgcagaaagttcttaaaacaagtacatttacttcaaggaaggatgcattcaacacccttttggctaacattcatttgtttcaaagtcgactgggagccatgctatttcttatctctgctttgctttcacgaggattggaagatatccaagcagacagggatgatccaagccagccattggtcactgctccatttggtcatgcttcacaggaaattgtgaatttattactctgtggagaggctgttccaaatgtatttgatggcaagatggaccttggtggtggcatgtccttgaagggcataccaaacaatgttgaagttggttttcttaccctcctggaatcactaaatctctgcaaggttggtcagtacttgaagtgcccaaagtggccgatatgggttgtgggaagtgaaagtcactacacagtcctttttgccttgaaccccaacgttcaagaggagaatgagctggaagagcgcgaatcaaaaataaggagggcttttgatgcccaagatcaaagtggaggtggaggctttatcagcgttgagggctttccaacaagtcctcagggatactgacataaattttccttcggataaactcgaggacctatgtaatgctgggattatagtatggagtgaattctggcaggcattgctacagttggataaaagggctggaggcatgaaggatccaactggtcttatgggccggtagcaattcaccatcttccacttcaatggaggtgccaagtctgtgccgaatgggaatgcaagtgcaggtggttcatgtcctatacagagacccaggttatgcaagctaaatgtcactgtccccccaaggtggactcaagatgagtattctggctgatgttgtaagcgcatcaaccagcagcagcaaggacgacagtattctttctctagctcccccaggtcagactaatcagcacgcaccattggtggactgcattaggacacggtggccacgagctgtttgtagctgggttggagatgttccaagcattgtctgacacagtggatgtcgtgtgcgcactagtcgctctagctatgttgcttcgaacctcgttctgaagaatttgctcagagcaagccactttggaggcttctgattggtcatgccctggaaaaaggaatcgcccaattacatgggttgttcgtcaaaatgagtgatggttaaaatgcgtgtaataaataagggcctggatattctcttttttggttta

SEQ ID NO: 12807 - DNA, 1054 bp, Zea mays
cagacgcgtccgcccacgcgtccgcccacgcgtccgcccacgcgtccgtggactcaaggggagtatctggcatgatgttgtaagcgcatcaaccagctgcagcaaggacgatagtatcctttctctagctcccccaggtcagactaatcagcacgcaccattggtggactgcattaggacacggtggccacgagctgtttgtagctgggttggagatgttccaagcattgtctgacacagtggatgtcgtgtgcgcactagtcgctctagctatgttgctcgtaacctcgttctgaagaatctgctcagagcaagccacttggagcttcctgattgttcatgccctggaaaaaggaatcgcccaattacatggtttgtttcggttaaaatgagtgatgttttaatgcgtgttattaatcaagggcctggatattcttttttttttgcttttattgacattagatgtacacttgatttatggatatgttttgtgtcttgggttacattcttttctgtacacatatagtttcgtttgtgtttttcatttcatctgacacagtgagttgtctagccagaagccggttgagtaaacaaggatcaaacttcaacgatcatatcatgccgctgtactctttgattttatgtttgggttagtttgaatctgcttaggcactttccattgagacactatcttcttgggatgtgtgggtagaaataaagtcatgtattgaaacttatgaagtatttgatgttctattatcactgttcaaatttgttgattagttgaactgtagttcaaatagtttagttaaggtaagttgcttgccgaggtttaccataatgataaatttcgtgcacttgtttctaatctcaggtacatgagcttcagggatacttgatggactgagagtagtgtaccggtgtatgtttgttgatatatatatatcccataaataaacacatcttttgtaataatagagatggtatatgttggagcttatggtaatgcttgagttaagttttaggaacaataaattcagtctttatcatttac

SEQ ID NO: 12808 - DNA, 1542 bp, Zea mays
gattatcagacgactgaaaaacagtgttgttggctccaaccccatatccacactcacctagccaacagaacacacatatctctgtgttttatactctatacttataaatggaaattgtatcaacatacggacatggacactttgctagtaagatattatttgccagtaccatgtttatattacattatagtaacattttattctatatttattttgcacagctttcatcattattaatacaattgtggtcaaataagatatagtgacttaattgtcttatcaggaaattgtgaatttattactctgtggagaggctgttccaaatgtatttgatggcaagatggaccttggtggtggcatgtccttgaagggcataccaaacaatgttgaagttggttttcttaccctcctggaatcactaaatctctgcaaggttggtcagtacttgaagtgcccaaagtggccgatatgggttgtgggaagtgaaagtcactacacagtcctttttgccttgaaccccaacgttcaagaggagaatgagctggaagagcgcgaatcaaaaataaggagggcttttgatgcccaagatcaaagtggaggtggaggctttatcagcgttgagggcttccaacaagtcctcagggatactgacataaattttccttcggataaactcgaggacctatgtaatgctgggattatagtatggagtgaattctggcaggcattgctacagttggataaaagggctggaggcatgaaggatccaactggtcttatgggcaagaagcaattcaccatcttccacttcaatggaattgccaagtctgtgctgaatgggaatgcaagtgcaggtggttcatgtcctatacagagacccaggttatgcaagctaaatgtcactgtccccccaaggtggactcaagatgagtatctggctgatgttgtaagcgcatcaaccagcagcagcaaggacgatagtattctttctctagctcccccaggtcagactaatcagcacgcaccattggtggactgcattaggacacggtggccacgagctgtttgtagctgggttggagatgttccaagcattgtctgacacagtggatgtcgtgtgcgcactagtcgctctagctatgttgctcgtaacctcgttctgaagaatctgctcagagcaagccacttggagcttcctgattgttcatgccctgcaaaaaggaatcgcccaattacatggtttgtttcggttaaaatgagtgatgttttaatgcgtgttattaatcaagggcctggatattctttttttttgcttttattgacattagatgtacacttgatttatggatatgttttgtgtcttgggttacattcttttctgtacacatatagtttcgtttgtgtttttcatttcatctgacacagtgagttgtctagccagaagccggttgagtaaacaaggatcaaacttcaacggtcaaaaaaaaaaaaaaaaaaaaaaaaaaaaaaaaaaaaaactcgcgggaggggcccggtaccccc

SEQ ID NO: 12809 - DNA, 3465 bp, Zea mays
agttaagttggctggtctgatcactgagagatgtgcggggtctccattggcagcaaaagcaatagggtctgtactgcgtaacaagaccactgatggagaatgggaggatgtgttacaacgaagcaccatatgtaatgatgagactggaattttgcctatactcaagcttagttataatgacttgccaattgacatgaagcaatgttttgccttttgtgctctatatccaaaggattatcatattgatgtggacaaacttatccaactatggatggccaatggttttatctcggatcaagaaaatgaacctgctgaaaccataggtaaaaggattgtcaatgagttggtctcaaggtcctttttccaatatgaggagcaaactatgatcggatacaattctactacatttttgaagattcatgacctcatgcaggaggttgcactgtctgtttcggaaaaggagtgtgcttgtgtaacggataaattcattacaaatagtgagttgcttccaagtgctgcccgccacatacttattcaaacatggagtaacaaacggatacatggttatttatatggttttatgaggaaattgtctcgacctatccaaacattgatgtttgatgggtcttgtgaagatgccgttgtgcaacatttatcaagacatagttctttgccagtactttccatgccaggattttggtttcgttttccaataaaaccaaagcatatgtgccaccttaggttccttgatgtcacgggtagtagaatcaaagaacttccatatgacataagcatcctttataatcttcagacactcaaactttctggatgcaggaatcttattagacttcctgagcaaatgaagcacatgagtgcccttcgtcatctctacacagatgggtgcacaaggttggagtgcatgcctccagatcttggacaaatcacctcgcttcgaacaattacatggtttgtagtgggaagtggcttgagttgtagtagccttggagagctaagggatttaaatattggtggctcattaatgctaaagcagctcgaaaatgtgacagggagaagaaatgcagaagcagccaaacttgagaataagaaggaactgagacaactgtcactagagtggacaagtggtaagggaggaggaacaacagtgtcatgaggtgctagagagccttgaagctcatgatggactgttggctctagaaatatattcctaccaaggcacccgttttccatcttggatgggtatgttgaaaaacatactcgagcttcggttgttcgattgctgtaaagtagagcagcttccaccactatgtcaactagcagaactgcaactccttcatttgaaaagattgggaaatttgcggtccctgtgtagcagatgtacatcctccacatttggaaagcttaaggatcttaagctagttgatcttcacgtttttgaaggattttgtaagacaatgcatggatctacagtagcattccctcagcttgagatattgcacatcgagcgctgtggaaatctagcagctctaacagaagcatcgcattgcggtggagattatacagtggcccgctcaacatttccagaactgaagaggctcatattggaagatttgtgtagctttgagagatgggtggctggcctgcttgaaattgaagaagaacatgcactattccctgtggttgagattgttgttattagtaaatgcccaaagttaacaactgtgcctagggcaccgaaggtcaaagaactagttttgcgtgatgtacatgcacatatctctctaggagggatcagatgtatgacgtcattgtccactttgcttttggacggcgtgaagcttgatgttaaggagagatgggaccatccatcgtccgtggtagatatgcaactgtggaggtgcagtttgttcttccaaccacgcgcactagtgatgtgggtttgctattggcagctgcaagatctgacaatttatagatgtgatgagcttgtgtactggccggagaaagtattccaaagcttggtttctctgcggaggctatggattggcaattgcaagaacctaattggatatgcagcggcgaatgtccccgaccaggcaacttctggaaggagcgagcttttgccccatctagagtatctggagatatgggggtgccaaaatctggtagagttattcaactcctcccctgctctcaagagaatggaagttagagaatgttgtaagcttgagtccctatatggcaagcagttgttggatgaagctgctagtagtaccgatgacgtgacggcatccgcacatgttgaggagaagctatcaccatcatccctagaatctctaacaatattggactgtgacaggttgtcagaggttgtcaatcttccttcgtctctcagggtaatagatattcagggttgcttcaaactacggctcatgtcagggcagctggatgcactcaataccttagcaatcaccaactgcccggagttgcgatcactggaaacatgcatcgtagatctcacgtcactggaaatcctcgctctgtgtggttgcaaaagcttggcgtccttgcctagtgcgtgggcaggacgacaagaatattcatctctccgtcagcttacgattagggagtgcccaggtataaaatcgttgccttcaactctgcagcagcgactggacaacggcctcttggattttacgaacctagattcccgtcgtcgtgaaggtacgcaccaatcttgtgcttatccacagcatgcctctgaaatccagcatgcctgttaattccctatgttgctcattcaatagagtctgtcgacaactttggaagcaaagttcggccgaattagcacgtgtttaaagttttattgagatttaatcgatggctttttaattaactaacagatcggcctccacgacggctgcttgggtgtctcttcctcctgcctttattttgtctggtctcaagggccaaatgttgctttgtctctgattaacattatgagcggcacgtcaccgggtgatatgcagtgcagcagcaggccacgctgaagctgaagctgaagctgaacctcatctgcaggggcacaggcaaggagcagatggcagtagtgtagtgacgcttttttcatggaaaaaaggtagaacgatctgaagtagggaattaagttgttggtgtaagctgtagttgctttgttctgacccttggctacctgaatgagtgggttaaaattaagcagccactacgctaattaagtgctgaatcgtgtttggagtctgcacaggggtttgcaattttctgagacaagagggagtcgtcagctttcaggttcaggatcgattagtgaatagttagtgtttgtacagatggagtacatgctagcaatgcagagatgatggttccacgcattgtcgctggtgctaataatctgcatagtatttttctata

SEQ ID NO: 12810 - DNA, 1170 bp, Zea mays
aaagaaaaataaagaagaaaaaagtatcggtcgccgacgagctcatgtacaccggcacacgagacagccacccaaaaacgcgggacgcggattgatgatatcggtcgccgacgagcggggccggagcactctctgcttctccccctacttcccctacgtaccaggaagctaccactcccccagagtgaaggaagagagagctctccgcctctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcggcgccgagcgccgccgcagcaccgggaaggtgatgccggacgagtacgacgagcggtcctactgcctctacgacactgacgcctccacggtgtacggcgtctccgctttcttcgtgctcctgctccagcaggccattgtcaacgtcgccacgtggtgcctctgcttcggacccgtgctctcctcccgcggctgtgccgtaacggcattcgtcctctcctggataacattcctcgtcgcagaagcttgtctcataggaggatcggtgaggaatgcaaagcacaccaagtatttaggctactacatgaagcatgatttggtgtcgtgcgccgcccttcgcaagggagtctttgcagcagctgctgcaatgatgatcatcaacctcctggcgtccctggtgtactactggagttactcaaaagctgcgacgggtgggttcatgaagcaccaaaatgaggttggtgtgggcatgacggattacggccttgacaagggtgtttctgggccctgagtgagatggaatcttattggcctctgtgcggtattaatactatcgtcgaaatgtatgtggatgaagttgagttgtttctctacggtgtgctgtgaatgatataccataactgtacaatggcatgggtggtgatattgtagggttcgtgctgtgaaaaatgcggtagcactagttgtgtttggtgtgctgcacgagcacgacaccgacttcttcctgctcgctgctggcggtggttgttcgcaacacaaatgcgggacttcaatgttcttggctgtcattaaattatgcaaggtggtactgtactgattttgcact

SEQ ID NO: 12811 - DNA, 1689 bp, Zea mays
cccccagggagttggtactctcacctgtgcctcctgtttcctccctcagcctgtgatcacggtgcccaagcgccagccacagcctgctagcaactgcctgccagcccttgattcgtatttcctgcgccagtatcaccattgctcctgcttaatctttctgaaaattgagcaactcatggtacctgggtggtttttttattaggtcaggtgtagaaattgaattggaccattcaatttgatactttgtttggcactttggcatttttcaaattccatgagatcagatgttggtaacttgtcaaggttttgttggtcatcacattggttatataattccatgagatcgacccgtgctctcctcccgcggctgtgccgtatacggcattcgtcctctcctggataacattcctcgtcgcagaagcttgtctcataggaggatcggtgaggaatgcaaagcacaccaagtatttaggctactacatgaagcatgatttggtgtcgtgcgccgcccttcgcaagggagtctttgcagcagctgctgcaatgatgatcatcaacctcctggcgtccctggtgtactactggagttactcaaaagctgcgacgggtgggttcatgaagcaccaaaatgaggttggtgtgggcatgacggattacggccttgacaagggtgtttctgggccctgagtgagatggaatcttattggcctctgtgcggtattaatactatcgtcgaaatgtatgtggatgaagttgagttgtttctctacggtgtgctgtgaatgatataccataactgtacaatggcatgggtggtgatattgtagggttcgtgctgtgaaaaatgcggtagcactagttgtgtttggtgtgctgcacgagcacgacaccgacttcttcctgctcgctgctggcggtggttgttcgcaacacaaatgcgggacttcaatgttcttggctgtcattaaattatgcaaggtggtactgtactgattttgcactaaaatggcatctgttaggcctgcaggcgaggcccggctgcatctttattcgccacatatagttttcttttgggataattgcatggttgcccttgttcacgattctaactccatcttactttttcgaactttgcactgttgctcctttttttataacaaacctctgtttacccatatttcgttataagcacataatgatgtcagctcagcctaaaaaagacgcttatactcttgcaccattacctctcttattatcaactgcctgtaaatttgctctttgatatggaattctgaaaatatccgtaataatagagccgtttgttaaatttctaaaaatatccgcaatgaaattacacggcgtcatcagtccgtctcatccgctctcgtgaacacagccggctgacaccgtagccccacccccacatctgacggtggcaaatagattagtaaaaagacgtccaattaattcatcgccccttctacgaaaatagctaggatcacctcatgccttctctgttctaccaaaaaaaaacacagatcgttccatctcaaaaactggtatacgaccttcatatcccatgtaatctcaactaaactaaacacatgattagtcacttgttgaggaccaaattaggtacatggacagtctgacggcctggccttttgatccgaacggtccacacgaatg

SEQ ID NO: 12812 - DNA, 1045 bp, Zea mays
gcacgagaccattacctagaacatcctaatcgaaaatagtcgctggagatagagccgagaacaagggcaactgacgcggtcaccctcgcccccaacacagagagaaggtctgctctccaccggatggactcccacggcaagcccaagcccgccggttcgacgccgccgacgccgccgaagccgccgaagccgccgacgccgccgaagccgccgacgccgccgacgccgacgccgccgacgcccgaggcgaggaaggggttcatgcgccgcatcttccctttcctcctagccgccaacctctttgtcgtagcttatgtcctcgtgcgggccaaccaaaaggactcagcaaagaaggacccaacgactgatcctgctactgcaactgctgggaagcctgctgagccagtctctatccccagaaaggagctcccaccaatccctgaagatgaccagcgcaagctctacaaatggatgctggaagagaagcggaagatcaagccacgcaatgctgccgagaagaagaaactcgatgaggagaaggcccttctaaaagagttcatccgagcaggatccctcccaagcttctaaaagagatcaagccatttgggtctcttgtgtctgatgttcagccaagaagatgattgggcctgattggattgtgtacaaacacagtactgtgctatcttgtaaactgatgtctccatgatgtagcctcctcgagttcaaaggttgtgtggatgcaaactagtgttgtgtgcattggttctagagattcttcaaggctaaaaaaacttcagtgtgtcaaattcttctgttccattccatccgcaatttgctccgttgacaattttatgttctgtggctctcgtgtgatgagtgaactcatcgcgtgtgatgagctcatcgattgccatgtactgtattgttgagaccccaactgggccccaaccctatttagaatgttcttaaaaaaaaaaaaaaaaaatccgtaaaaaaaaaaaaaaaaaaaaaaaaaaaaaaaaactcgagagagggccgcggtacc

SEQ ID NO: 12813 - DNA, 1461 bp, Zea mays
cattgggtacctcgaggccggccggggaatatcatgtcggccggggccatctccaccgtacgtccactccatccgcacccagtctcggcgcctcaccccccaaaatcctctcgcggtcgcggatcgctcttccctccccctcttatccctttctcttctcccattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgctcgccgcctgccgctcgccccgctcgccgcctccgactccgccttcgagtcctccgtcggagttaactacgcggagcccgacgactcggagaaggataaggaggtggagttgttcggatcgggtgacgacgagggggcgggtgagttggtggatgaccattccgtagaggtctcagccgctgtcgaggacgaggtggaggaggaggtcggggagtacgttgagccgcccgaggaggccaaggtctacgtcggaaacctgccctacgacgtcgacagcgagcgcctcgctcagctcttcgaccaggccggcgtcgtcgaggtcgcagaggtcatttacaacagagaaacagatcaaagtcgtgggtttgggtttgtcactatgagcactgttgaggaggctgagaaggctgtggagatgttccatcgctatgatgtcaatggaaggcttctgactgtaaataaagcagctcctagaggctctcgtgtggacagacctcccagacaatctgggccttctctcagaatttatgttggcaacctgccttggcaagtggatgattctagattggtggagttgttcagcgagcatggtaaagtagttgatgccagagttgtctatgaccgagaaactgggcgttcacggggatttggttttgttactatggcatcgcaggacgaattggatgatgctattgctgcccttgatggacagagtttggatggccgtgccttgcgggtgaatgttgcagaggagcggccacggcgaggtttctaatgaggttgtatcgggtggactgcacgcttgttccatgggttgggagcatcatagcatgttctgatactggtttagaccttccattctctttccttgtgttgctgagcttctatcatcgtgtcttattgtgaagagggaactcttcactaatattttgttatgtacttgttgtgttcaaaagttcttgtactgtaggctactgttatgatgcgcctagctcaatttgtcgatgcaattcgaaattttgtctaaaaaaaaaaaaaaaaaacggcaaaagagaaccaggccacgaccagtaaggggaatccacctctgattcttgtgaacctactatccaaaaaaataacaaaagg

SEQ ID NO: 12814 - DNA, 617 bp, Zea mays
caggggaggcggctatggcgggggcggcggctacgaaggtggcaggggagggggctatgaaggaggcaggggaggcggctatgaaggtggcaggggagggggctatgaaggaggcaggggtggcagtgctcagggtggaaggggttacggtggccgtggaaggggtagaatgggtggtcgcggacgagggaactagtgcagttctggcgtttccttcaaaatgcatgcctcacctataccaggggaaacgacaagttatctgagcattttatgtttgaagccatgtgactgaggtctgttattttttcccctgagcgcgaggtttggttgtgagcataatgcatttgcaaagttttatcttgtacctgcccgggcggccgctcgaaagggttatcgatgtacgtcatccttcattcaatgtttctgctgccagaggttttcccagtgatcgttgagtgctgagcatgttgcccaatgttcatgcctgcagtattaacagatggccactctttccctgtgaaattgttaattgcatttgagcaaaaaaaaaaaaaaaaaaaaaaaaaaaaaaaaaaaaaaaaaaaaaaaaaaaaaaaaaaaaaaaaaaaaaaaaaaaa

SEQ ID NO: 12815 - DNA, 1044 bp, Zea mays
cccccgcaccgccgtcctgcccctctcccctcccacacccactcccttcctccatctccatgctcggcgccctcaccatctcccctctgcctccgctccacctccctaaccgcctccgacctaaccgcctccccccatagaccgaacgggatcttcgcgtccgacgcgcccatcgacgtggacgccgccatggaggacgagctacgggagaaggaggacggtagccccaggcacctcgaaggaggcaggggtggcagtgctcagggtggaaggggttacggtggccgtggaaggggtagaatgggtggtcgcggacgagggaactagtgcagttctggcgtttccttcaaaatgcatgcctcacctataccaggggaaacgacaagttatctgagcattttatgtttgaagccatgtgactgaggtctgttattttttcccctgagcgcgaggtttggttgtgagcataatgcatttgcaaagttttatcttgtacgtcatccttcaacgtttcaagttttatcatgtacgtcatccttcaatgtttctgctgccagaggttttcccagtgatcgttgagtgctgagcatgttgtccaatgttcatgcctgcagtattaacagatggccactcttttcctgtgaaattgttaattgcatttgagcagtttattttcctaaacgatgcatccatatctcctctctttggttcctttatagcttattactattagccgttttgattttaagcaaaaatgatgttcctgaacatgttcgtacgagtacattttgtaacaaaaaacgacattcacattaactcgattaaataaatcacaatattttccttttcagtgatttatggtagaggggatggaaatgaatagcatttgtttagacttgagagcatgaagatgttttcagtagtatcgtgggcttaagtggactaaaaaacaccaaaaaccccactgaacaagagactgaaatttgatgtttattcggtttttggtgttttgtgcgatttggattttagctctaatttgtgttt

SEQ ID NO: 12816 - DNA, 1965 bp, Zea mays
cattgggacctcgaggcggcgggaataaaataatatccccggcctccaggtcccccccccgagcggccccaggccaccctcctccggaacccaaacccaagcccagaccaatcgaccctgcatccaaatctaggttttcggttcccctccacaggatgtccgaccccgccgctggaggcgccatggttcctgctgccggacgcggcatcgcatgggcgaacggcggcccccggttcggcgacatggtctgggccaaggtgaagtcccatccgtggtggcctggccatatctacagcgtcagcctcaccgacgacgaggaggtacaccgcggccaccgcgacgggctcgtcctcgtcgccttcttcggtgactcgagctatgggtggtttgaccccagcgagctcgtccccttcgaggaccacttcaccgagaaggcggcccagggcggcagctcccgcagcagctttgccgccgccgtggccgaggccgtcgacgaggtagcccgccgcagcgcgctggcgctgctctgcccttgcgacattcctgacgccttccgtccccaccccagcgacggcaacttcttcctggtcgacgtcccggcattcgacaccgacgctgactaccaactcgaccagatccgggccgcacggcagcgattcgtgccgcggaaggcgctcaactacctgctggacgccgccgtgactcagcgagacgcggcggaaaaagccgcgcgcaccgtgcctgggatggagatggccgcgctgttcttggcgtaccgccgcgcggtgttttcgccgatagacaacacctacgcccaagctttcggggtggatcctgagctggctcttgctgccgagcagaaagccgcggcagagagagctcaacgaggtatcaacaacactcgcatgctcaattctagctgtactgttgttcttgttactgtgtacttgaaattgatgggtaaacaatgttcctactgctttatagatcaagcaacaattattttgatgtgaataacggagtggatctgattcaaatagtttctatttcacttctgtctaactgttggttgcattttttttatcaacgagagtgattattgaatttgggatgatattcatgcagaaacttgttgaataaattgtttgtttcacgggattcagtccatccaacctagtaaaatatgagacatgcacattcacagatcaatctgcatttgttctagaaattgaacggctgcgtgatatagtatcatatacgtgtctatacgatactatcctgatatgtatgctgagttaggtcttttctcattctagctttgccctaggaaaaaaaacaccatccatgatcttgttggcatgaaatgtttaaagttgtgactagtttgcatcatgaaggtttaaagccatgactagttagcatgagcctgttattggagtcttgagatgttttatttctatatgtccatacacttacatgactaggaagttttctctgcagtatatttggttcttttgcactatggtgacaattattatacatttggaacttgtgtttccttcctattttagtttttgttgttgcacatcagtttcctgtccatattaagttatgggttcacatataaaagctgcattttttttatcaaattgttaagtttgcttgtcaaggaggatacacctagattagacaagttgatccttacgcatgtagccagtacagagcaatgaaatccatgttttgtaaacagaagtgcgataaactgtgtgaaactgattctgaatgaacgcccatgcatatccaacctagtaaaatattagacatgcatacccacagatcgatctgcacttggtctagaaactgaaggcctttgtgatatagtatcatatatgtgtcattttttctttatgatgccatcctaatatgtatgatgagttagttcttttctcattctagttgtcttag

SEQ ID NO: 12817 - DNA, 2013 bp, Zea mays
tggggtccatcctgcagtagtggcaactgttctaactagacttgatctgctcaacattattgttacccaaataaaatatttgtaaggtataattgatgttagaccaattaccttcaattttatatttgagctagagtgagatcacttacatgaagctagacttattagttcaatttcatatttattttagtcaatcagtacaattgatttttggaacaactatttatgccttcttgctgatctttacaaaaaaattgtatatatgaaatgatgcttataaaaatgggagaaatattgcaccttcactcaacccctctgtctaaatttctcaaatatcaaccttattataatgaaagcatccttttctttattaacacccttctccaaatcctaaacctaaaccaagcctagatctacccaccttgcatctagattagattttttgtttttgttttgattagttcaattttatattttgtttcaattagccgatataattagttttttattaaaaaactattcatccttgctccaatcgtcatatcaatcctaacaaaagtttttacacatggttcttatggaaataggaggaaggccgtaccttcgcttaaactctaattttttttttcagatttcaaccttgttataatggaaaaccctattcctctgataataataaaaattaccaggaatgcccatcccccctttcctccgatcccggggtcacaccgtccgaagcccaaaccaagcccagaccgatcgaccctgtccaaagcttatctaggttttcggttcctccacaggatggccgatcccgccgccggaggcgccatggtccccgctgccggaggcggcagcgtgtgggcgaacggcgccccccgcttcggcgacatggtctgggccaaggtgaagtcgcacccgtggtggccgggccacatctacagcgtcagcctcaccgacgacgaggaggtgcaccgcggctaccgctacgggctggtcctggtcgccttcttcggcgacaaaagctacgggtggttcgagcccagcgagctcgtccccttcgaggagcacttcaccgagaaggcggcccagggcggcagcacccgcagtagtttcgccggcgccgtggcggaggccgtcgacgaggtagcccgtcgcagcgcgctagcgctgctctgcccgtgcaagagccccgacgccttccgcccccaccccagcgacggcaacttcctcctggtcgatgtcccggcattcgacactgacgctgactaccaccccgaccagatccaggccgcacggcagcggttcgtgccgcggaaggcgctcgactacctgctggacgccgccgtgactcagcgggacgcggcggaaaaagcggcgcgcaccgtgcctgggatggagatggccgcgctgttctcggcgtaccgtcgcgcagtgttctcgccgatagacaacacctacgcccaagcgttcggggtggatcccgagctggcgcttgctgccgagcagaaagccgcggcagagcgagctcaacgaggtatcaacactcacacgcccaatcctagctgtattattgactgcgccgttgttcttgttgctctgtacttgaaattgatggctaaacaacgttattactgcactgcttctatagatcaagcaacgaattattttgatgtgaatagcggagtggatctgattcaaatagtttctattctgctttttctgttgaactgctggttgcatctttttcatcagggagagcgattattgaatttgggatagtagtcatgcagaaagctgttgaataaatgataacttgtgttgtttcacgggattgaacccaacttagtaagatgagatatgcttatccacagatcgatctgcatttgttctagaaattgaacatctgtctgatagtatcatatatgtgtgtatacgatactatcctagtatgcatgcgagttaggtcttttcttgttatagctttgtcctcggataaaaaaaaacccatcc

SEQ ID NO: 12818 - DNA, 2026 bp, Zea mays
gggaccctcgaggccgtgccgggcaccacagtccacacgcacggcttccctctcctcgccgccggaggcgcgccgcggaagacgccacaatgagtttcgtcccgtccgttggcgcactagaggatgccctgcctgaccctgcactgcaatccgtcgccgggtgctgaccaggcgagctcctgattcggagccattttgcggggttcttttggggggccccatcgccgtgcttcgtttccctgcccgccttggccgtgcattaatacccgcttccttgtgatagtcctctccctccctccctccctccgccctcacttcccactcacctcgcgctcgtcgcctcggctggttcggttcttgggagtgtcagtctgctgccggttgcggtgaccggcaccggcacgtagacgcagcacttctcggagaccatctgtctgcgccgttccgatgggttgcttcgggtgctttgcgccggaggtggatgaggacctcaggccctccaagcacgacgattcgtcaggggctgatgcgaggaggaaggtcgcgccggatgtggccagcggctacgcgcacagcttcaccttcaaggatctgcttgtggcaactggctacttcaacgaggccaatttcatcggagaaggtggattcgggaaggtgtacaagggcaagatcaacggacagatggtggcagtgaagcagctcgctcgagacggcgtgcaggggaggaacgagttcttggtcgaggtgctcatgcttacagtgctcaaccatcgcaaccttgtcagcttggtcgggttctgcgcgcagggggacgagaggctgctggtctacgagtacatgccgttcggaagcctggagagccatctgtttgacgtgcctctcggcaagaaaccactcgactggaacacgcgcgtgaggatagccgtgggagtcgcggaaggggtttcctacctgcacaacgtagccgacccgcctgtgatctaccgcgacatgaaggccgccaacattctgctgggcgaggacttcagcccgaggctctccgacttcgggctcgcgaaggtcgggccggttggagacaggactcacgtgtccacgagagtcatgggcacctatggctactgcgctcccggctacgtcgtgagcggcaagctcaccatgaaatccgacatatacagtttcggcgtgctcctgctggaactgatcacggggaggaggatctacgacgcctcgaggcctaaaccggagcagagtctgttgacatggtcgaggccgttcctgcatgacaagaggaagttctacaggctcgctgacccggctctgctgggctgctacccgtcctcggcactgaaccagctggtcgtgatcagcatcatgtgcctccaagaccagccccacgtccgcccgatcatctccgatgtcgtcataggcctgaaccacgtcgcgagccagccatacaccgctgagcgcccgccgcccgcgtccgtgagctccccggtgggcagcgggtcgccgcagctcgtcaggacgccgtccagaaggagaggcggtactggtaggaggagcgcgcagtgcgcttagggcttaggcccacaggctgcattgttgcacgcatgtctcgaagagcagcaagatacgtcgtcagctcagtcagatcagatgaggccggctaggaggagggatgttgaaattgatgaagccggcaagttcagttccgtttagccggccggagcctttttgattggagcggcggggtctcgagtgagtgacctctgccttgacagggagatgtagcgaggctgatggttaggaaggagagttcaggttgactatgcatgactaatgctcttttcatatgcttcttcattgttgttgttgttgccagttttgaattctgtaggcagtgtacataggatcagtgtcctctgtaggggggtcgtgggatgttcatcatcaattcaccagccatgtacagagctgccatggctggcctgtagatgcaataagaagttcaccagggtttaagctt

SEQ ID NO: 12819 - DNA, 1012 bp, Zea mays
accgccatcaaaaccggcatgcaaccattagaagatatgcttcctcttccccgagaccatttcgacatcaggtattcagttcggttcttgggagagccaatctgctgctgcttgcggtgactggcaccagcgcgcaaggcttcctagagaccatctgcctgcgctgttccgatggattgcttcgggtgcttcgcgccggaggcggacgaggacctcaggccctccaagcacgacgattcgtcaggggctgatgcgaggaggaaggtcgtgccggatgtggccagcggctacgcgcacagcttcaccttcaaggatctgcttgtggcagttggctacttcaacgaggccaatttcataggagaaggtggattcgggaaggtgtacaagggcaagatcaacgggcagatggtggcagtgaagcagctcgctcgagacggagttcttggtcgaggtgctcatgctgacggtgctcaaccatcgcaaccttgtcagcttggtcgggttctgcacgtagggggacgagaggctgctgcctgctggtctatgagtacatgccgttcggaagcctggagagccatctgtttgacaatcctaaggtctaaggatacagccgggtggcgttatggattcacggccttatttctttctatgagatctttagaaatctttcagggaatagaatgcatatggagcttttcttccatgttaaatggcagtgactctgtcatatctttctaccatccactatttgtggacccatttatacactaaacacacttaaatgttttctagaccgcggagcgcacacaatttactagttaagatatagtttagtttcacaacatggccgatatagcagaagccaagtgttatgatgatttgtttttcaattctatgttatgttattggttcagcatgcacatatattgacatgatttatggcatggcctcaaaaaaaaaaaaaatatttatgacatcgttcttgaatgatgtgtgcgacatgaatgatgga

SEQ ID NO: 12820 - DNA, 1220 bp, Zea mays
gtgaggggcacgggccagatgcggggcctcccttcccttccctgcacgagaccattacctagaacatcctaatcgggagatgatttcttggcaaaccactcgcgccgttgcctcttaagccggggtcgccccctctctccagtctccacacagtccacacgcacggcttccctctcctcgccgccggaggcgcgccgcggaagacgccacaatgagtttcgtcccgtccgttggcgcactagaggatgccctgcctgaccctgcactgcaatccgtcgccgggtgctgaccaggcgagctcctgattcggagccattttgcggggttcttttggggggccccatcgccgtgcttcgtttccctgcccgccttggccgtgcattaatacccgcttccttgtgatagtcctctccctccctccctccctccgccctcacttcccactcacctcgcgctcgtcgcctcggctggttcggttcttgggagtgtcagtcagtgctgccggttgcggcgaccggcaccggtacgcagcacttctcggagaccatctgcctgcgccgttccgatgggttgcttcgggtgcttcgcgccggaggcggacgaggacctcaggccctccaagcacgacgattcgtcaggggctgatgcgaggaggaaggtcgcgccggatgtggccagcggctacgcgcacagcttcaccttcaaggatctgcttgtggcaactggctacttcaacgaggccaatttcatcggagaaggtggattcgggaaggtgtacaagggcaagatcaacggacagatggtggcagtgaagcagctcgctcgagacggcgtgcaggggaggaacgagttcttggtcgaggtgctcatgcttacagtgctcaaccatcgcaaccttgtcagcttggtcgggttctgcgcgcagggggacgagaggctgctggtctacgagtacatgccgttcggaagcctggagagccatctgtttggtaagctcttcattctttagcattttgtggttcttcgttgggtgtagctgctaattgcagacatcaattgaaacgcttgcccacctttttcgccttggatttatgacagctctctgcatttccccttttgatttgtaatagcaagttgctgaagtgtttaaggtggaaaagatttgggggcaactactaattgggcaaaaaaaaaaaaaaaaaaaaaaaaaaaaaaaaaaa

SEQ ID NO: 12821 - DNA, 2223 bp, Zea mays
agcaggcagccacggatcccgcagggcggggatctcgcagatcacgccgggcggggatctcgcccaagcctgatcagaagtttggggaccgatcaaagcgattcccagaagtggaggccgggcgatcgaagcggaggtggtggagatgacggaggcgctgaagtccgtccggaatccggtgacacagaaaaagatcagagtttctccttctacttcgtcgggtgaagtcccggtggtggacagcgcctcgacgctgatccctcgggaagctgcgtcaggcattgctggttcacttcgcaattcaccggattccggacggactgtccactttgcaattcacttaacactaaacatcttcgtcgggtgaacttcttctatcatagactcttcactttgcaattcacttttgcttctttccctgaagtcctatgtgttgcggctatacttgtactcaagatgtttagtgtttaccttgtatatatgtgtgtctaggtttgcgaggtctttcttgtatggcttctttcttctgttaaggcaatgataagcggttctcccatgtttgaaggtttattttattttgacatctgtgtttgaaggtttattttattttgacagaccgactttgatcattggtttctcacaaaatatattgtttgtagctacaaaaccaatttagtgtagaagaactttgacatatggatctaattgtatagtatatacactgaacatacttacaacttgattaattattggtcaaaacatgaagagtttgattttttttcccttcaaaacaagtacttcttgtccttttgaagtgagggagtaccttctaaattaaattgcacttgcaggttatgttggccactttgttaaaggtgtattataaatgtggtctctttgagaaggctaagggactgctaactgaactggaagccttaggttttgcacaggataaggcaaaacatgtggtctcacgcataaaattcggtcgcatttccgtcccttccgctgatcaaatgcctttgtttccctagtggttcttgtagagcggttgtgtcgtccgagcattgatctgaaccagcgcagtttatcagggacgtagcagtgagttggtgagctctctcggctcatagaagccctacttttttttcctgattttcttcgagcacaggctgaaatgtcaactattgggccaaaggttatagagaactcatagatttgatggctaaacttaaaagcgacttagaaggattcaagttatatgtatactgaagtggtgaggactcgcaagaagttcaatccactgccaggaggttagatttgagtctcaattattttcaagggaagggatcatgctgataattcactccatgggtacgtatcaaacaagaaacttcaaggcaattgtcaaagataattaattctgtattccactttttttgttggttactgatgctgccatttgttgtttgtatttttttttcaggtacgaggttttcaaaaatccgagcattagtgatgtcctgtgcacaactaaagcagaggctcttgcaatggggaaattcgtgatctgcgcagaacatccatcaaatgagtttttcatgtcatttccgaactgtttgacatacaagacttcagaggagtttgttgcgagagtgaaagaggcaatggatagagaaccccaaccgctaacccctgagcaaagatacaacctttcgtgggaggcagcgactgagagatcatggagtactcagaccttgacaaggttctgaacaatgaggctgctcagcctggacaaggtaggaaaagaaagaataaaagaacctcacagcctaatttgtccgacataatggatggcggtctagcgttggcccatcgatgcttaactggcaatgaggttctcaggctggcaaccggagccattcctggtacccgggactacgataagcagcactgtgtggatatgggtctcttgcctcctcaagtacagcaccctgtatatggctggtgatgactgatgagcacccaaagctaatcgtaggtatatatgtacataatacaccatgtcgctcttatgtcgactaatgtttggagtattgtaattgtagcatgcatgacgacctttgcccattgttttgtactctgtaataaggttctttctccttaaattggagttttatcgcagaaatgtgtagtacatggacagcaaaaaaaaaaaaaaaa

SEQ ID NO: 12822 - DNA, 1965 bp, Zea mays
gatctgcctgaaatactggcaaatcttgtaaggcagtctgaaccatctttggatcaacttggtgtacggagagatcagtgtgacaaactagtggaggcattgtgtaggaaacaaaatcattccctttcagaaaacacatccttgcctgtaaatgataagtcatcagacgaacttgacttgagaatcgcaagcgtgcttcaaagttctggttatcatgctgatgatggtttctggagtgaacctacaaagtctgaggtctcagacgataaaagacatgtggctatagtcaccacagcaagtttaccatggatgacaggaacagcagttaatccattgttccgtgcagcatatctcgcaaaaggtactagacaagatgtgacactggtagtgccttggctttgcaaatcagaccaagaactggtatacccaaatagcatgacgttcagttcaccagaagagcaggaaacttatataaggagctggctggaggaaagactaggatttgaatcaaacttcaagatatccttttatcctggcaagttctcaaaagagcggcgtagcatcattccagctggtgatacgtctcagttcataccgtcaagagaagctgatatagcaatattggaagaaccagaacatctcaattggtatcatcatgggaaacgctggactgacaagttcaaccatgttgttggtgtagttcatacaaactacctggaatatatcaagagagagaagaatggagctcttcaggcctttctagttaaacacatcaacaattgggtgaccagagcatactgcgacaaggtcttacgtctttctgcagcaactcaagatttaccaaagtctattgtttgcaatgttcatggtgttaacccaaagttcctgaagattggagaagaaataactgccaatagggggagtggggagcctccattttccaagggagcatattttcttgggaagatggtttgggccaaaggttatagggaactcatagatttgatggctaaacataaaagcgacttagaaggattcaagttagatgtatacggaagtggtgaggactcgcaagaagttcaatccactgccaggaggttagatttgagtctcaattttttcaagggaagggatcatgctgataattcactccatgggtacaaggttttcataaatccgagcattagtgatgtcctgtgcacagcaacggcagaggctcttgcaatggggaaattcgtgatctgcgcagaacatccatcaaatgagtttttcatgtcatttccgaactgtttgacatacaagacttcagaggagtttgttgcgagagtgaaagaggcaatggatagagaaccccaaccgctaacccctgagcaaagatacaacctttcgtgggaggcagcgactgagagattcatggagtactcagaccttgacaaggttctgaacaatgaggctgctcagcctggacaaggtaggaaaagaaagaataaaagaacctcacagcctaatttgtccgacataatggatggcggtctagcgttggcccatcgatgcttaactggcaatgaggttctcaggctggcaaccggagccattcctggtacccgggactacgataagcagcactgtgtggatatgggtctcttgcctcctcaagtacagcaccctgtatatggctggtgatatggccggtgatgactgatgagcacccaaagctaatcgtaggtatatatgtacataatacaccatgtcgcccttatgtcgaccaatgtttggagtattgtaattgtagcatgcatgacgacctttgcccattgttttgtactctgtaataaggttctctccttaaattggagttttatcgcagaaatgtgtagtacatggacatcaaaagttcatgactccagaagactgtcagcccaatatttgtctgcttttgccattgaattagagaaacatagtctt

SEQ ID NO: 12823 - DNA, 874 bp, Zea mays
agggcccctgcgccgcccctttttttggaatactacgtgctaaaacttctgattaagtgattataacagtctatggttatagttgcatttacaactatacgtctagtaaaaaagataagttttgggctatgtatgactatttcttgtaatcaattatgcactggttcttgcactgttcatgttcagaacacatctggggagggccggctgagcctctcgtcctccagtagctcgtatggatcaatgtacggtggcggcgacaccggcgtcttgcttgcatcgtgtacaaaactcggtccaaagtacacgtataaaacagcgaaaagggagacggtgacaagaatcaggggcccaaacgccagaaagaaggtgctgccaagtgatagcagtaacttcgcccgaggaacaagaccctcgaggccctcgctgttgagcgccatggagcgctcccgctggccgtccgccgcggcgccgcgctcgaactcggtggccgccaccccgcgcttggccccggcctccggcgccccctcctcggcctccttgctagcgcccgtgggcgcggcggcccccggcgccatcccacgccgccggagctccctggcgaagagcgactcgggcgcctcggcctccccttcctccttcttcttccctccgtccccgccggcgcggcacctcacgcggaggcgcatccgcgcgggcggccacagcgacggggacgcggcggaggaagaggccgacggcgggcggatggcggcgaggcggatcacggtcatggccatcgcggcgcggggctgggctgggtcgtcgcttggagcccggccggccgggggagaggccaagtcggaccgggctcgcttggcggcagctgtcccgg

SEQ ID NO: 12824 - DNA, 1983 bp, Zea mays
gctcggtaccctgtcagtaacagacgcatcgctgctccattctccatgactgttctggaagctccaagcgttggcgaaaaaagtaagatatttctgcgaggcaaggaatccctcccccgcttctactctttcggttcgccggttcgccgtctcgcacacccacttcctacaccgccaccgagcactcgctcagtttcatacccatcctcgaagtcgcctctgtctagttcctgctcttccaccaccgcctgtgatgtatccccgaggcccggatgggggacgagatgcctcgtctcgccctatgcttgccactcccgccggcaacgacacgcgcgaggaggatgagatcaccaccgcggaggctcatgtggagaaagacgccgcgcggatggacgctgccctcctcatgcggactacgcccaagatggacgagtttcacaccgggggcgatctggactcaagtggaagtggaagcggcatctcggggccaagcgcctccaaaagacagctacaaagaaggggatcgtggcggcaacgagtcagcaggtccagcatccatgcttatccttttcctttgtgtttctatttgatctgtttttttgcccgcgccagcaacagagaagaatgtggtcgtggctgtaatgggtcagcaggtacaccatccacgctcatcatttcctttgtgtttctgtttgatctatttttttaaaatttctttatcagtttgattagcatccacttgcatccgctcatagtttgattcgtgttcgttggatgggcctcaaaattaccagttgcttcgactacactctctgaatttcgcagatcaagataaaacccgacacaaaggaatgaatagcacaccaaaaatcacagtattatttagtcatatttggacacgaataagttaaaatttctttaattttagatccacatttttgtatttttggtctagactatcaaaaaaatcctagaaatgtccctctgcctctcgcgcgtgaattctcctctgccgaagggaagacactcaaaggcgagctactgatcttcaactgcttttctggattctctttgcaatatgctttgttggggctagatctgaaatcaatgtttttaataatctagcacaaataggaaatgttgcatgtgttgccgacagaaccatctcactctctctttagtttctgcaattttttggacgaccgagaggtgctgccgtttatgagtaactttccaggtaatgccacaacatcatggtcagagtttggacattgcatgaagcacttgctggacaattgagaagaactcatgcctacttgcaggcatcatctcaaccatacaatgggattcattgaaatatcaggagggttgttgtacacgtgagtggaggtcgaacccttcttgtagggctcttaatgtatgaagtacgccatgctagctattgaatcaagttcaatgggattcgttaaaatataaggagggttgttgtacaagtgagacaaggtcagcccttcttgcagggctcttaatataagcctgtactacacgttcatccacgtcgagctcgtcggctcccaacgcaaccccttcttctctcacgagatcagtggtgaggacgacactggggatagagacctagggttctccaagtgggcctagaaactccatggcaacgtctcaggtttcatgcagttctctaaatttattttgctcgattgtaagggaactgtgtcctctataagctcgcgctcgtgctgtaccgggagtaccccttcttcctgcaagtctggttcaattaaaaaattttgttctgtcgtgttgtaaagtacttggcgagctatgatatgtcattaccttagtgagaagactgcttctaatatattagtaatttttagctgtgcagatcatgtcatcatataaatgttgcaaacattataaaatagaggatccatttgaactcttgagattgtggagtgcgcaaaa

SEQ ID NO: 12825 - DNA, 1223 bp, Zea mays
aaaagtaagatatttctgcgaggcaaggaatccctcccccgcttctactctttcggttcgccggttcgccgtctcgcacacccacttcctacaccgccaccgagcactcgctcagtttcatacccatcctcgaagtcgcctctgtctagttcctgctcttccaccaccgcctgtgatgtatccccgaggcccggatgggggacgagatgcctcgtctcgccctatgcttgccactcccgccggcaacgacacgcgcgaggaggatgagatcaccaccgcggaggctcatgtggagaaagacgccgcgcggatggacgctgccctcctcatgcggactacgcccaagatggacgagtttcacaccgggggcgatctggactcaactggaagtggaagcggcatctcggggccaagcgcctccaaaagacagctacaaagaaggggatcgtggcggcaacgagtcagcaggtccagcatccatgcttatccttttcctttgtgtttctatttgatctgtttttttgcccgcgccagcaacagagaagaatgtggtcgtggctgtaatgggtcagcagtttctgcaattttttggacgaccgagaggtgctgccgtttatgagtaactttccagtgggaaaacagtatgccacaacatcatggtcagagtttggacattgcatgaagcacttgctggacaattgagaagaactcatgcctacttgcaggagggttgttgtacacgtgagtggaggtcgaacccttcttgtagggctcttaatgtatgaagtacgccatgctagctattgaatcaagttcaatgggattcgttaaaatataaggagggttgttgtacaagtgagacaaggtcagcccttcttgcagggctcttaatataagcctgtactacacgttcatccacgtcgagctcgtcggctcccaacgcaaccccttcttctctcacgagatcagtggtgaggacgacactggggatagagacctagggttctccaagtgggcctagaaactccatggcaacgtctcaggtttcatgcagttctctaaatttattttgctcgattgtaagggaactgtgtcctctataagctcgcgctcgtgctgtaccgggagtaccccttcttcctgcaagtctggttcaattaaaaaattttgttctgtcgtgttgtaaagtacttggcgagctatgatatgtcattaccttagtg

SEQ ID NO: 12826 - DNA, 3407 bp, Zea mays
  misc_feature (843)..(843): n is a, c, g, or t
cggtacccctgtacgagttgtgctggtcctcggggctagaaaaaatatcttcacatcataagaacgtgctcctctccaaccatctcgcttcacatgcacgcacgtcattcatggaagacgtcggacggccacgggctccattgtgctcccttcaaggctgccaccgtgcacgaaggcgacgcagccagattgattcaattcgattaatcgctgcgttcgtgactggaaacggatcgacgacatcatgatagattgatgaccttgtatcattaattcttactccctatatgtagggccggtatattgcgagccagtgcttccaatagttacagaaaaccccagccactccactggtccgtaccatagttacagaaaaccccagccactccactggtccgtaccaacgaccaggtgcatgcggtcgggcacgtcatcttatcatacaccaagtcaaaccttaccacgagcgtcagttaaacccctagtcaaacaacgaaccctcgcgtgggacacaaaacgtaaatttgcagttctgttttttgcgtaaattacgtacatagttcatataaatagcgtaaacagtttatagcgacaacataaaaactccgtctagacactggaccacgtccacacgcgtaggcgcatgcatgtagaacctatttttatggtagatctgataattatggcagatcgtgagagttttcattgcatgtgcgcaatttttgtataatattttcatttccactgcatgtgtgcaaaaattggatgacatgaatcgcacaaagcattaattcttgtataaagttgcataaatacctacaccgtgtatcataattaatgaanaacgtcctaatatgtggccaaccaacaacccatgcataaactatgatggagtaggttgtcgttgccgcactcgcctaggatggcatccttcgtggtgcatttggcacgaggccacttgtcatgccagtcgttgctatgaacggaagacatgacgtacgtgggtttgtgtcattgtgtgggtgacttaggcactcacacgccgtgcggggcgcgaatccgtcgaggacgaggagtggatagacgaattagattagatacgatcagtgtgaaaagaatgtgtcttgtgagttattttcaaataattgaaggagttatttgtaaaaatatgacgtgagacgaccgttgaaactgataatttaatagagagatatagaagagatagagaaatacagagtgaactggccgggattaaacacaaaatctcacactagtccgcggcactgctcaagtaaagaaaaccagctagacaggaaaaaaaatagggaacacaagtgcgtcgtggtggtgctggcggttttgagttttgacccaccattcccgcattccttctcttctgcagtggcggcagcggcagccaggaaacgcaaacgaggaagaggagcggtcgattcccaatctttatacgattgattctttaccaattgtatcgccattccttcctgttcattgggcgtggggtttcaacctaataaatcggtccttttccgcgcaactagtggggagtggagccgctgagaaatagcaccccttttcctgccccaagatgcctgtttccgcttcttttccacgccacaccttttgaaaatccttcgccgtcagctccccttttgcagcactagttgtttctcagcctgcttggagtttggagggggcagagaacaccatcctgtcgattcaagaaaaaggctgagccgatgggcagtaagagcggcgtgcgactgcaatgcgccgaggccaaatcggcgacggattggagctgctgcttcctggccctgccaccggcagcaccatccggtgttgatggcgatggcgggtttaacctctcgtggaacctccgcaagtccttccacccgccggcgggactcttcgccagcatgggccagcaggttggggttgggttcccggggacttcttctaggtccccgtcgccggagacacctcgggatccgtacatgaagtacgtctcgccggaggttgtcgagacacctccgtcgggggaaggggtggcgttgagggacaaggggaagaagaaagccgtgaagctcaggattaaggttgtgaatcatcacctcaagaggctgatcagtggagcactcgcaggcacagtgtcaagaactgctgttgcacctttggagacgatcagaacgcatttgatggttgggagtaatgggaattcgtcgacggaggtgttccagtctatcatgaagcatgagggatggactgggttgttccgtggtaactttgttaatgtcatccgggtagccccaagcaaggcaatcgagctttttgctttcgatacagctaacaagttcttgacccccaaatctggggaggaacggaagatcccagtccctccttcactagtggctggggcatttgcaggtgttagctcaacactgtgtacataccctctggaattgattaagacacggttaactatacagagaggggtgtatgacaatttccttgacgcgtttgtcaagatcgtccgcgacgaagggcctactgaactctaccgaggcttaaccccaagtctgattggagtggtgccatatgctgcaaccaactacttcgcctatgacaccctgaagaaggtgtacaagaagatgttcaagacaaatgagattggcaatgtcccaacgctgctcatcgggtctgctgcaggagctatctcaagctcagcgacattccctcttgaggttgcacggaagcacatgcaagttggagctgttggtggcaggaaggtttacaagaacatgctccatgccctcctaagcattcttgaggatgaaggggttgggggcctctacaaagggttggggccaagctgcatgaagttgatgcctgctgctgggatttcctttatgtgctacgaggcttgcaagaagattctgatcgaagaagaggatgagtgaagtgtgtgcggatgcattgcgtcattagaactcagttttgcgacatcctgaattcctgatagcaggcagcttctttcggtatttctttgagtcgactggtgctggagttggttgaaactcaagactgaggttactgctgcagtcagcataagttctttttttttgatgagtcgaccaaggggggagaggcccccaccagatccactgcattatgtagctcttcgagttcaaagtacacgccaagcacatattcttaacccccactttgcacccagtttgatcttataaattcacctgtttttttccagatttaaacttttacttttgggtacaagttgtgttgtcgaaactcatgactgcgatgtgtgaaaacgttcagatgccataggcaatcataattcacaagtggcaaagctgcaaaaaaaaaaa

SEQ ID NO: 12827 - DNA, 2759 bp, Zea mays
caggccggccccgccgggctgctctcgtggttctcccgtgcccctcgcgtgcgctctctgtctctcggggcgacgactaggcggctgctcgccggccgccgacgccgacgcccgccgccagattcccaggtatctatcttcgggaccttgaccggcgacgagcacccaacaggtactgattttgctgaagcaacagaataatgtattagccctcatgtgttaacacctacataaactttgagtatcctagtttcaagtgaaatcatggcacgaaaaggaaatcaaagtaagagtggccccaatcatgcttcacctaagtggaaaaatacaactgatggtgatgcactaagtacaccagaaagaggtgctgcagatagtgaaaatccgagttcacatgttcaaggcagatcaaagggtcctgaaggaagcagtgagaagaaaggaagaggcagcaaaaggaacagcacaaacaacggcatatcatcctctggaaaaaaacaacaaatggacaccggttgtgatataagcagttcagaagaaaaggagattccggtaagaggtactaaaaatagaagaggtagccagaaaccctctaggcgcggttttggtagaagttttttgattgagcaaacaacatcgtctggattggcaggaaatgttttggagaagaccaggtgcattgcttgcatggctgcatccattattagagcttccatgatatatctagttgaagaaggcaaaagatttatcgacaaaagaatgccaacaatcaacacttatatggcttttgtcaacaaagggcatgcatatgtcttaagcaaaattgcatacgtttatcccatagttcgagcttggatgcttaatgctggaagggtgatgctgctcttgtttacagtttggttagactgcaatgtaaggggctttgattctttgctacgattggggacaaactctctcctagcagtactttggtgcagcacgctgtcaacttttgcaatgattgggataaaaaagatgctcatattcatggcgattgcagcttctgcgtttgccttcataggtctaggttttgctatcctgcttatatcagtgcttgcagtggtaatcttatgggtttatggaagtttttggacgaccacttgtgtaatgattcttggaggtgttctctttttcttgaaacgcgaaagaataactcttcttgttgcctgtttatattcgatgtattgcgcgagatgctatgttggatggctcggattgcttttgggcctcaacttatctttcttttctagtgatattctagtgcagttcctaagggacaatgcagacaataaaaaattcaatggttcttcaaggtactcagagcgaagctcaggtagacaaggcaatatctttgaagaatttcagccatcagcagatagcacctcccaagccagatatgctcgagcttcagatcgagatcctggtgatccttcaacaagtggacctgagaaagagctgacctctgaagatgaagtggctcgtttactgaactgcactgaccactattcagcattaggtttccgtcgatatgagaacatagatgtatcatctcttaagagagaatacaagaaaaaggctatgttagtccatcctgataagaatatgggcaatgataaagctgctgatgcatttaaaaagcttcaaaatgcatatgagattcttcttgattcactgaaacgcaagacatatgatgatgagttgaggagggaagacctcttgaactacttcaggcagagtgtttctcaaaagaatggaagaaacagtactttccaacatgggttcagcccttcagaaggtgttgatgaaggtccttatggtctttccagaagaatagcttgtaaaaagtgcagcgactttcatctttggatttatactggaagagctaaatcacaagctagatggtgtcaggactgcaaggagttccatcaagctaaagatggcgatggatgggttgaacagtcctttcaacctgttctatttggcatgctgcagaagcctgatttacctcatgcatatgtttgcgcagaaagctacatatttgatgtcactgagtggttcaactgtcagggaatgagatgcccggcgaacactcacaaggcaaccttccatgtcaatgccaacatggcaaagcagagcagtggcaaggcgagtacctcaacgcagagggctggtaaggccccaagtggtgtaaacatggatggaggaggactcaacgaggaagagttcttcgagtggttccagaatgcagtcaactctggaatgtttgaaactacattcggggcacaaggcgacccgacttctcctggtaacggaagcaatgccaagagtagcggtagcagcagcagcaacaacaatagtaggaaaaagaagaaaggaaagaaacagtggtaatcaaagcaaagcaggctggggtctggtgatcactactcggggcagagaaaaaaagaaacaaacagaataagcgttttgggtatgtaaatacaactcggaaaaatcggtccctggcttaaatggttcctaacgagaggccactgtaaatcctggttcatcatggggtgctgacggctgttaaatggccattataaatcctggttcattatgttgtcggatcttaatatatcgtcctggccctcggtaacttgctagcaaaaaaaatgttataaagcaagttactatgaaacaagaatttgcaagattaaagatagtttttttttcctgtc

SEQ ID NO: 12828 - DNA, 975 bp, Zea mays
gcgattcctgctcacactgttgttgttctacagtaagcaaagcccctcccgcccgcccgcgcgtccggtttatgatcgaatcacttctcaagttgatacacctgccatttatgatgtttttcagttggagaaaacatttaagacaacattttcgttacttgttctccatatgtggcttgttctacgccgcttgaaggaagaagggaaggatggtgttaagtttggacagtacatctacgaaatgtacaaccacgatgtagagctcagagtttctaaagctggggttaacttgctgttgacaaaatggatgaaggagctagagaaaatattctatggaaacattgtgaagtatgatgctgcgataagcccagaggctcatcaagatgatcttgtaaatgtcatctggagaaatatttatgctgaggaaggttcagaagctatggatgttgctgctgcccctgctgtgcgggcattggcaagatacacacgacgagaggcaacttgtctgtcattgactgacagagattctatgttctctggaaacttcaaattcacaaccctggtgccggcaactctcagccccagcccaaagaagcatgggcgatgaactgccgtggtacatcaatatttcatacgaagatttttaaacagcaggatcagtggatatatgtcattctctcagcaatacaaataacaggcttcttccattgattgtttattccggggtcctcacgattcgaacccttttgatggaaatacttcgttctagataggatttttttatttaactcaagtgtatttgctctagtagaccacccaccagaatggaccctttttgtctcttttcatggtatcatagtagttgatagaatttacgttgattaaagtttatcaaatttagctggatttataaaagaaatatcaacaatatttgtatttttcaagtaaatttattatcacaataaatttaaggat

SEQ ID NO: 12829 - DNA, 1530 bp, Zea mays
aagcgcgccgcgtcgcgtctgctggtggactctgcgcctcgtgaccacggcctccagggacccgggcggtgagccagcatcttctttttccgtcccctcctgcagccgccgcccgccgagacgccaagcgcgagcgggaggagaccatgtcacggtggcgcgccgccgcctacagcatctccgcagctgccgcgtcccgcaactctgcggcggaggccggcgccctctccagggccttggcgaaggctccctcgccgccttcgcttcctctccaaaccctcacgagaaactttgccaagtccgctgccgccgccacggccacgtcgcccggccctggcgcttcctctccgcccgctgggccgaggcccgagattagactgaagtctatgttcttatccaagccctgttcattagcgttgccacctgactcccctcatagagcagtggatccacaatataagggcatcaagcgattcctactcacattgttgttgttctacagtaagcaaagcaagtccatcagaggagcaaatgttgtttatgatcgaatcacttctcaagttgatgcacctactatttatgatgtttttcagttggagaaaacatttaagacaacattttcattgcttgttctccatatgtggcttgttctacgccgcttgaaggaagaagggaaggatggtgttaagttcggacagtacatctacgaaatgtacaaccacgatgtagagctcagagtttctaaagctggggttaacttgcttctgacaaaatggatgaaggagctagagaaaatattctatggaaacattgtgaagtatgatgctgcgataagcccagaggctcgtcaagatgatcttgtaaatgtcatctggagaaatatttatgctgaggaaggttcagaggctatggatgtggctgctgcccctgctgtccaggcattggcaagatacacacgaagggaggcaacttgcctatcattgactggcaaagattctatgttctcggggaacttcaaattcacagctctgctgccggcaactcccagtcccagcccaaagaagcctgtgcgatgaactgccgtggtacgtccacatttcacgcgaagatttagaaaacagcaggatcggtggatacctgctgttctctcagcagtacaaataacaggcttcttccagcagttgtttactctggggtccccacgattcaaacccttttgatggatatacttcgttccagataggaagtttgttttgttaatctctagtctcgagtatttgctctaggagaccacccaccagaacggagccttcttgtcgccggaccaggcatcgattcgcacactgtatgaggcgatgctgaaagaaaaaaaaaggaaggcagcaccgatgttcggtcattaatatgcagtttctttcggctgcatgtgtctcttatgtagagtaaaactaatttattctcgcatatagaatgatactataccggacatcaattgatgatgtgaaccgtatgccagatcatcgccaaaaa

SEQ ID NO: 12830 - DNA, 1688 bp, Zea mays
acctcgagccggccaaacagcaccaccggtgtcctcgctgccaaggcgcccgcccgctcgtgtgacgagtggcgttcgtccaccgcccattccgcgctcagctctgagggcctcccgcccgccgcggcatcatctccggctcctctcgtcgccacgggtgtcacgaaatgatcctgacttgcttgagttgcttcttgacaccataagaagcgatccatctgtttccagttgtacacagaaaattagtgcctggaaaaataagaatggtaaggggggcgataggtgtcctaagatgaaactgcggttgcatctgttcgtcctgtgcgtgatcattatattcctggtgtacaacatggctaactttcaacataagcagacaacgttggaagcaaaatctcatccatttgatacagtgacggtgtctgacagagatgctgttaaggtgcctcaaaaggctgaggctaggattggttatttaccccatggtatagtggagtctaactctgacatggacttgaagccattgtggctgactacaagtgcacggtcaaagaagcctaaacaaaatgataattttttgattgctattgctgccggtataacccgccgggaaactgtggatgctattatgaagaagtttcttccagaaaattttacagctatattgttccattatgatgggaatgtcaatgggtggaatgatctaccatggagcaaaagtgtgatacatatagctgcctctaatcagactaaatggtggtttgcaaagaggttcctccatcctgctgttgtgtccatataccagtacatctttctttgggatgaagatctggaagtagataactttagcccgagaagatacttaaatatagttagatcagaagggttggagatatcacaaccaggtcttgactctaagctttctgaaattcatcaccggataactgttcgtaaaaaagcagggacctttcatagagttagccgggctaacaaaaagtgttcaagagaaggaccaccttgttctggatgggtcgagggcatggcaccagttttctcaaagtccgcttggcaatgtgtgtggcaccttatccagaatgatcttatccatggatggggcatcgattacaagtttgggtattgtgctcagggtgacaggacaaagaacatcggcgtagttgatagtgaatttatagttccccgaggagtgcagacattaggaggttctacaataacaaaggatggtattcgtggcaaaaatgccaagccactcggccagaaagcagctcaaatccaaagatcgagagggagggctccaggccttgatatgcgaacaaagatccggagaaaatcgcgatccgagctccgtgattttcagaagcgctgggaccgggctgcaagggaagacagaacatgggttgatccgtttgcccgcccccgaagaaagcggaagaataaaacccacagtagatcagcataatcttcactgttacacttgcacataattccgtttgcaccttggatttagagtgtataataattgcataatcaacattgtataaattctcacagacgaaacgagaaccacacacgtgaaattttccgatgggagttgtgggttcttgtatcgaggggcaggtccaggatttaaaggatgggcattcggaaaaaatattttatatatttttttt

SEQ ID NO: 12831 - DNA, 1299 bp, Zea mays
cattgggtacctcgaggccggccgggaactaaccacccaggtcaattcccaacagccaccatgtcgaggccaaccgtcaccgtcgtctctgccaagggcgaggtcacccaggacaccatccccgtccccaatgtcttcaaggccccaatccgcccggatgtcgtccacgcggtgcacactggcatgaacaagaaccgccgccagccctacgctgtctctgagaaggctggtcaccaaacttctgccgagtcctggggtactggtcgcgctgttgcccgtatcccccgtgtctctggtggtggtactcaccgtgctggtcaggctgctttcggtaacatgtgccgctccggccgcatgtttgctcctaccaaggtctggcgcaagtggcaccagaagatcaacctgaaccagaagcgcttcgctaccgcctctgcgctcgctgcttcaggaagccctgctcttctccttgcccgtggccacgctatcagcaccgtccccgaggttcctctcgtcgtctcatcgactgctttcgccgatgccgccatcaagaagacctccgctgccgtcgctctcctcaaggccgtcggtgctggtgctgatgttgagaaggcccgcaactcgcgcaagctccgcgctggtaagggtaagctccgtggtcgccgccacaagcagcgccgtggacctcttgtcatctacaaccctgatgaggatggcaaggagcttgtccttgctttccgcaacatcccaggtgttgagacctcatctgtctactccctgaacctccctcagctcgcccccggtggtcaccttggccgcttcattgtctggacctcttccgctttcagcgccctcgacaaggtctacggatccaccactgagccctcagcgctcaagaaggacttccttctcccatcccccatgatggtccagcccgacctcagcaagatcatcaactccagcgacatccagaaggtcctccgccccgtccgtggcggagccgttactaagcgcagccacacccagaagaagaaccctctcaagaacttccaggtgcagctccgcctcaacccttacgctgctaccttcgccaaggagaagcttggccagaagaagatcgaggctggcaaggccgagcctgccgccgataccttctacgagctgctccaggataactagatggttgttggttagcgttatgatttcctaaggtgttctctcttcggctgggatggactggaatgatgaatggctatgacaaatgtagctcttcacaaaatacctcatgaaaaggttgcttcc

SEQ ID NO: 12832 - DNA, 3358 bp, Zea mays
ccggggacgtccatcacgcagcctcgtggccggccgcgaccgtcccctcccctcccctttcgacgcgcgaggggctgtatgctgggcgccgtcgtccgtgtcccgggcccgatcctacctttcctgcccgggccgacgcgccctctcctccgccgccgccactacctcccgcccgagacgcccatggcctcggccaccccttgcgatggcggcaccgggaagcccgacgccgcgccggctcccacgcccgcgccaacgccgctgccgcccgagaagcctctcccgggcgactgctgcggcagcggctgcgttcgctgcgtctgggacatatatttcgacgagctcgacgcgtacgacaaggccctcgccgcgcacgcggcctcctcaggctccggcggcaaggacgactctgctgataccaagcccaaagaaggtgccaaatcctgaagtgcgcctctcatgtgtaatgacctcttctgctctgaactgaattagattgctggcgtctcaccagattcacatacgccggtaccaattcttagcactcgagacattacagttctcttgttttcctgctgtgttatatgctagattaagatgctttgtcaattcagcctccttgttgtgtaacaggaggaagttatgagttattacaaacaaaaaaaaaagccaactgccctcgcggcccagtttttttttttttttttttggaccccaaccaatcaccaatgccattagaattgggacaaattagcaggttacatcttatctgtcccaccgtcaccggtggtgagcgaaagttagtacacagtacacacaaacacccaccagctcatgaattggcatagaacttactgatcatcgtccgaaccacaagagggatcctcacggcgtgcacgccatcttcccatgtcaagctgccgaagtagtatctcccttgcaccttcagtttggcctggaatgtcaccttgaacgtcaactttctcaccgtcgagttgaaggtcaggagtgaggggctcacggtgacatccactcctggaggagcttccacacgagctctgtacttcgtcaaggctgagccaacgttggtgaccgttcttgacacagtgagcctgcccctcagttcgggaatactgatggatggcaggttcaggttcagctgcgtctttggtgtgtgctgacaggtctcatgctgttgagccagggagctgatggctgagacgttgtagcccatggagcaaaggaagcgcacatagtcagatgtccccatgtcatacacaagaccggggtgtgcagcgctgtttggatccacatgcccgcctccgtaatcaaatgggttcgcctgattgtagggcgccgcctcggatacaatctcaaacccatatgtgtcatggacactgttgtaacaagtgctgattttactgcagcaggactccaattgggatgcattgatttgaggagagcaacaactcctgagatgtggggacaggacatcgaggttcccgaatcgatcttgaacttcacagatccaatggctgatgatatggcagcagcaggagtccatgctgccaaaatgttgacacctggagcagcaatgtctggcttcagaacagcgggggacagagaacttggaccccgagatgagaaatatgcaacttctgggcccatcagttctccaagaatcgtttttgctgagccaaactggactgttggatttctcgtgctagtggtgtatgcgagtatagctgttccaacctggtagtctacttgaaaacagggaatatcgaatgaagacgcgatgtccttagttaagaactgggcgaagatgactccgacgccacgagctttcttgacagtctccactgccactgcagctgatctctgtgcccttgtttggaagcaaagtaccacagttcccttcactagagtcgagttcagagatcctgcagtgcagcttcttgcatctgtatcgtctgcgttattagatgcaacgtcttcagcatagaatatgcgcatgctattcccaggatgctttccagagtacagtgtttgacccacataggtgctattgttgccaaggatgatctttgcgaggaaagtcctatcaatggtgccagcagcgacggtcacgagccacggcgccgagttgatcaccgtctctgaataaggcccagaatttcctgcggagcagaccacgacaatccctctcgcgacagcatgaaaggacccaatggacaggacgtcgtcaacgtacgcggggagcggtggcgcttggcctagggacaccgaaagcacgtcaacgccatcatgtatcgcgtcgtcgaaggcagcgaggatatctgccgaagtgcagtctccggtggcccagcacactttgtagaccgcgagcctcgccctgggtgcccctccccttgcgacgccaccggcgagtcccctgaagcttgcaccggctaccagagcaccagcggcggtggaggctgtgtgcgtgccatgcccgacggcgtctctcgcggacatgaactcgtagatgtcggtggtgttcatcttcccgtactcggcttcgtaccctttgatgtaccacttcgcgcctattattttcctatcctgttgcagttggaaacattgaacctgtccccggcgacgcattgccctttccaccgccgcggagcctcgctcatgccgtcgtctctaaaactggccgactctggccagattccagtgtctagcacaccgataatggaatcctcaccgaacctactctctgggaggattccagccgaatgcgatggatccactcgcatgaagtcccagctcctggtggtgtgcaggtcaagaacacggttccgcaccactcgcacaaccccaggcgaaccggcgagccgcgccgcctggctgtccgtcagcacggcggcgaacccggagaagccgtgcctgtagctgtaaaggatggcgtccttggccgcctgctcgctgccgagaaggccggcgagcatgccgtggtgcgcgtcccggaccagcgccgggtgcagctcgggattcctcgcccccatgtacacaatgtacacattgttacaagaagagtggcccagctgaagaagaagaagcagcagcatgcagaaaaagcccagcggggcagccatggccaccgccaccaggcagtcaggcaccacgtgcgagcgagatagctagcagatcgccggcgggcgaaagctcaaagcaagacgaagctggcgcaggtgggatggggaccggagtggagtggtttggaaggggaggatgcggcggcctcctcctcgcactgcagtctacaggaacaaggaggctttcacccttcctcagctgtctggctagattttgc

SEQ ID NO: 12833 - DNA, 942 bp, Zea mays
gccggccggccccgatgcatctgtgtggctgtggcaaacagttctgaggtgtgagcaatggcggccggccagtttgcagcagcaggagtcctcaccggccttctcgctctcgcaacacttgcaagctgcaacactgatggcgacatactgtacaagcagaggctagcatgggaggatccaaacaacgtgctgcagagctgggatccaaccctcgccaatccctgcacgtggtttcatgttacctgcaacctgaacaactccgtcgtccgtgtggatttgggaaaggcaggcatctccggccccctgcttccagatcttggagcacttgagagcctccagtacatggagctgttcggcaacagcctgaacggttcgattccgtcaacgctgggcaacctgactgatctcatcagcttggatctctgggacaacctgcttaccggcccaatcccaactacgcttggttccatcagcacgctgcgatatctgaggttgtacgagaacaacctgacagggcctataccaccatcgtttggcaatctgactagccttctggaactgaagctccacaggaattcgttgagcggttcgattccggcctcccttggcaacatcaaatcgctgcagttcttgaaattgaacgagaatatgctgaccggcacggttccattggaagtcctctcccttgtcgttgttggcaacctgaccgagctaaatattgcaagaaacaaccttgatggcactgtgagatcatccggacttagagtgactgcggttatccaggacatgaggattgcatgatggcttgaagagtcctggatcaaggctttgttttaatttgcttcatgttttaatttgcttcatgtagacactgcaaataaatgaataattgcaatgggatacattggcctagattattcaaaaaaaaaaaaaaaaaaaaaa

SEQ ID NO: 12834 - DNA, 1470 bp, Zea mays
cctcgaggccggccgggacctgcggcgccccggcgccccccgggagctgcggacttgtccacatctattccttccttgttcggccgcccttcctcagttggggaaggacgacccaagggaggaggaggaggaggacagtgccgccatgaccggaggaggggaggagcaggggaggtcgctgttcggcgtgtctctgacaaacaggcccaggtggcagcagttcttgatctgctcctcgggcttcttcttcggctacctcgtcaatggcatctgcgaggagtacgtgtacaacaggcttcagttcagctacggctggtacttcacgttcgtgcaggggttcgtgtacctggcgctgatacggctgcaggggttcacggtggagcagatggtgaacccgtggcggacctacgtgcgcctctcggcggtgctcatgggctccaatggcctcaccaagggctccctcgccttcctcaattaccctgcacagatcatgttcaagtcaaccaaggttctaccggtgatggtgatgggagccttcatccctggtctgaggcgcaagtacgcgttccaagagtacgtgtcggccgtgatgctcgtcgtcggcctcatactcttcacgctcgcggacgcgcagacgtcgcccaacttcagcatggccggcgtggccatggtgtccggggcgctcgtcatggatgctttccttggcaacctgcaagaagcaatcttcaagatgaacccggacacgactcagatggagatgctgttctgctccactgtcgttggccttccgttcctagcggtgcccatggtgttaacaggagagctcgtgacggcttggacttcctgctcccagcatctgtacgtgtacgcggtgctggtgttggaggcgatggccacgttcgtcggccaggtctccgtgctctccctcatcgcgcttttcggtgcagcaaccacagccatggtgacgacggcgaggaaggcggtgacgctgctgctgtcgtacctgatattcaccaagcccctgacggagcagcacgcgacggggctcctcctcataaccatgggcatcgtcatcaagctcctgccggagaacaaggagggacgcccgcgccggtcgcccaagaatgacgacgacgacaagccccgggagggcagagaagcgggggaggaaacagcatgactgctatagacccgacacccgagcaaagcagaactgacgccagctcgatcagcaaccgcaaccctagaagaaattctcagtcctccaaaacagcaatcccaggaggacgatgggatatacatgcaggatagagcactacatacagacacagtaataataacctttttcctcgctcctcccctcgcttttctcatgtgttgtggttaatgttaattgtgcacttcgctctaacatcttaatctttttttaaaggcaagggccagaagtccgaaaaaaaaaaaaaaaaaagc

SEQ ID NO: 12835 - DNA, 3966 bp, Zea mays
cgggaagaccttccgagcagcacctcgtccgcttggcaatgctgtggcatacgtcaattcagctttcttggcaaggacttcagtggatgcagcatcaagggaccatctcattgaggatatatgtttggtgttcggtgcatatgggactgatcatgctattagagctagcaaggttgaggattacctgaagggcaaaacagtgagctcgactgttatacttgaagctgttcggttgcttaaagcgactgtcaaaccatcagaaggcacaacacatcctgagtatagaatcagcttggccgtcagcttcttgtttaccttcctatcttcccttgtcaacaatgagtcaacaaaggttaatggtcccaacgggtcatgtagtaatggagccacaaacggtgcccttgagcactcaccagagaagcatcttaagtttgacagcaacgatttgccgatacggtcaagacaagaaatatttttaactgatgaatacaagccagttggaaaaccaattaagaaagcaggtgcagagatccaagcttcaggggaagctgtgtacgttgatgatatccccgctcccaaagattgcctctatggagcatttatctacagcacccaccctcatgcccatgtaaaggctatcaactttaaatcatctttggcttcgcagaaggtcatcacagttatcaccgcaaaggatattcccagtggtggacaaaatattggttccaccttcccgatgatgggagacgaagcactttttgcagatccagttactgaatttgctggtcagaatattgggggtgcctcggcgccggcccggaagtatgcctacatggctgcaaagcaagccattattgagtatagcacagaaaatctgcagccaccaattctgacgatagaagatgcgatccaacgaaacagctacttccaagtccccccatttgtagctcctaagccagttggtgattacaacaaagggatggctgaagctgatcaaaagattctatcagcggaggtaaaacttgaatcccaatactatttctacatggagacacaagtggcgctagctattcctgatgaagataactgcataaccatctattcttcgacacaaattcccgaggtcacacaaaatgtggttgcaaagtgccttggcattccatttcacaatgtccgcctcatcaccagaagagtcggaggaggctttggtggaaaggcaatgaaagcaatacatgttgcatgtgcatgtgcggttgctgcattcaagctgcggcgtccagttcggatgtacctcgatcgcaagacagacatgataatggcaggcggtcggaatcctatgaaggtgaagtactctgttgggttcaagtcagatggcaagatcacagccttgcacattgatcttgggatcaatgctggaatatcaccggatgtgagcccaatgttgccacttgctaccataggtgctctcaaaaagtacaactggggcaatcttgcatttgacaccaaggtctgcaagacaaatgtctcatcaaaatcagcaatgaggggtcctggagatgttcagggctctttcatcgctgaagccatcattgagcatgttgcctcagcactttcagtcgacactaacaccataaggaggaagaaccttcatgactttgagagccttgtggtgttcttcgaagatgctgcaggtgaagcttctacctacagcctagttacgatgttcgataagctggcctcctctccagaataccagcgccgagctgcaatggtggagcacttcaacagaagcaacaagtggaagaagcgtggcatttcttgtgtgccaattacatatgaggtcaatcttcggccaactccaggcaaggtgtctatcatgaatgatggttccatcgttgttgaggtcggaggggttgagataggccaagggttgtggacaaaagtgaagcagatgacggcattcggattgggacagctgtgccctgacggcggcgaaagcctcctggacaaggtccgggtcatccaggccgatacattgagcatgatccagggagggttcaccggtgggagcaccacttctgaaactagctgcgaagctgttcgacagtcgtgtgttgcgctggttgagagactgaagcccatcaaggagaatctggaagctgaggcaggcacagtggaatggagttccttgattgctcaggcaagtatggcgagtgtgaacttatcggcacatgcatactggaccccagatccaactttcagaagctatttaaactacggagctggcattagtgaggtggaaattgatgtgctgacaggagcaacaacaattctaaggagtgaccttgtctacgattgcgggcaaagcttgaaccctgctgtcgacttgggccaggtggaaggcgcattcatccaaggagtaggcttctttacaaacgaggagtacacaacaaactctgaggggttggtcatccacgatggcacatggacgtacaagatccccacggtcgacaccatcccaaagcagttgaacgttgagctgatcaacagcgcccgtgaccagaagcgtgtcctctcttccaaagcatccggcgagcctccgcttcttctagctgcctcggtgcactgcgcaatgagggaggccatcagagccgccaggaaggaattctcggtctgcactggtccagcaaactctgccatcacgttcgagatggacgtgccggcgacgatgcccatcgtcaaggagctctgcggcctggatgttgtggagaggtacctggagagcatgtccactgccggaccaacaaccactgccaaagcatagatccagcaggtgcaccgcccatggtgagagagcttaataggtctgtgtaaaacactgaacagcatgacatgccaagcttacatgtgttagctctgatgtacagaagacgaggtagcaatgggagctgtggtcttgtgaatcaggatccatgaacattagaggaaaaaataaagtaaataagtgtcgggcaggcaaatgtgtggatgaaatcatgtggttttgattggattttgaagaaatttttgcaatgaatctccgttcatactacaaaaaaaaaaaaagcctactgggtacatgggggataggattgtaccatccagctaggtttggccttgctgtctcgttgtgaccttcaccggtagctactccctgcgcacctatttgaactagcagagcagtgttgtgaccttcaccggtagctacttactccctgcgctgcgcacctatttgaactagcagagctaaaattactaaggaagacatatcaactagtaatgctatgggctaaattgctccaacctgtttgaactcagcctaaactaagatgggcactacatgtaaatagtactccatctgtttcgtttcaaaatagtagtcgttttagctctagatttttatttttatattcatatggatgataacgaatctagacacatatatagaacacatatattaattattgtatgaatctactacaagagtaatgaattttaatttgagacggagagagtaatgtactagaaaccataggcacggcgttgccgcaccagcttgggctctcccatcggagaacctgtaggagtgtaggtacagatgtacagtattttctattggtcaatttgttcttgtcattaatttttaaagtcgtatctgtaatggttgacgactgataagcagaaaagtgccaaaagtaaatggattgcacagcatacaactaatcatgtatgcatcgctctaaatctataatatagaatagggagagtgacgcatggaaatctcaaccatgcacctgatgataattacagttagtccttgcttatattatagaaatttgcctactgtcctcttaaagcaacacaaaagaagaataacgtttagctattgaatttaatagaccaaaggggagaactgagcaaacaaaa

SEQ ID NO: 12836 - DNA, 587 bp, Zea mays
gccggcacatggacgtccaagatccccccggtggataatatcccgaaggagttcaatgttgagatgtttaacagcgcccctgacaagaagcgtgtcctatcttccaaagcgtcgggcgagcccccgctggttctcgcagcctcggtgcactgcgcgatgagggaggccatcagggcggcgaggaaggagttttcggtcagcaccagccccgcgaaatccgccgtcacattccaaatggacgtgccggcgacgatgcccgtcgtcaaggagctttgcggcctcgacgtcgtggagaggtacctcgagaacgtgtttgccgccagtgccggcccaaacccagcgaaagcatagatccagcaggcctcagggtgcagtcggcgccctgccaaaaatgatgtgtgctgccctgatgtacagacagtccagtacagaggagagagaattgggggaactcaggaactgcgaggagcgatgaacagtatatagagtgaaaaataaaagtgcttcgttctaataaaaaaaaaaaaaaaaaaaaaaaaaaaaaaaaaaaaaaaaaaaaaaaaaccgaggaagggggccggtccccc

SEQ ID NO: 12837 - DNA, 758 bp, Zea mays
  misc_feature (720)..(720): n is a, c, g, or t
cacaaacgaggagtacgcaaccaactctgacgggttggtcatccccgatggcacatggacgtacaagatccccacggtcgacaccatcccaaagcagttcaacgttgagctgatcaacagcgcccgtgaccagaagcgcgtcctctcttccaaagcatcgggcgagcctccgcttctcctagcttcctctgtgcactgcgcaatgagggaggccatcagggccgccaggaaggaattctcggtctgcactggtccagcgaactccgccatcacgttccagatggacgtgcccgcaacgatgcctgtcgtcaaggagctctgcggcctggatgtcgtggagaggtacctggagagcgtgtcggctgccagcccaacaaacaccgctaaagcatagatccagtaggcgctctacccatggtgtgagggcttaatcaatctgtaaaacactaagcggcgtgacatgccgagctttcagtgttagctatgatgtacagaagaagaggtaccaatggcgagttgtggccatgcgaatcaggattcaggaatcatgaacaatagagggggggaaataaagtaaataagtgttgcgcaggcgaatgtggggacgaaatcatgtgatttcaactagaatttgccagcccaacaaacaccgctaaagcatagatccagtaggcgctctacccatggtgtgagggcttaaatcaatctgtaaacactaangcgcgtgacatgccgagctttcagtgttagctatgatg

SEQ ID NO: 12838 - DNA, 4441 bp, Zea mays
aattcgggtgctgtgttgtgctgtgctgcgtgctgtggagggggaggaggagatggggaagggggcaggggcagcggagccgtcgacggtggtgctggccgtcaacggcaagcgctacgaggcggccggcgtggctccgtccacgtcgctgctggagttcctccgcacccagacgcccgtcagaggccccaagctcggctgcggcgaaggtggctgcggtgcatgcgtggtcctcgtctccaagtacgacccggccacggacgaggtgaccgagttctctgccagctcctgcctgacgctgctccacagcgtggaccgctgctcagtgaccaccagcgagggaatcggcaacaccagggatggctaccaccccgtgcagcagcgcctctccggcttccacgcctcgcagtgcggcttctgcacacccggcatgtgcatgtccatcttctccgcccttgtcaaggccgacaacaagtccgatcgcccggaccctcctgctggcttctccaagatcactacctcggaggcagagaaggctgtctcgggcaacctttgtcgttgcaccggatacagacccattgttgacacctgcaaaagctttgcctctgatgttgacctcgaggacctaggcctcaactgtttctggaagaagggcgaagaacctgcagaagtcagcaggctgccggggtacaacagcggtgccgtctgcacctttccagagtttctcaaatccgaaatcaagtctactatgaagcaggtgaacgatgtccccattgcagcctcaggtgatggctggtaccatcctaagagcattgaagagcttcacaggttgtttgattccagctggtttgatgacagttctgtgaagattgttgcttcaaacactgggtctggagtgtacaaggatcaggacctctacgacaagtacattgacatcaaaggaatcccagagctttcagtcatcaataaaaacgacaaagcaattgagcttggatcagttgtgtccatctctaaagctattgaagtgctgtcagatggaaatttggtcttcagaaagattgctgatcacctcaacaaagtggcttcaccgtttgttcggaacactgcaaccataggaggaaacataatgatggcacaaaggttgccatttgaatcggatgttgcaaccgtgctcctagctgcgggttcgacagtcacagtccaggtggcttccaaaaggctgtgcttcactctggaggaattcttggaacaacctccatgtgattctaggaccctgctgctgagcatatttatcccagaatggggttcagactatgtcacctttgagactttccgagccgccccacgaccatttggaaatgctgtctcttatgtaaactctgctttcttggcaaggacatcaggcagccttctaattgaggatatatgcttggcatttggtgcctacggagtcgatcatgccatcagagctaagaaggttgaagatttcttgaagggaaaatcgctgagctcatttgtgatacttgaagcaattaaactactcaaagataccgtttcaccatcagaaggcactacacatcatgaatacagggtcagcttggctgtcagtttcttgttcagtttcttatcttcccttgccaacagttcgagtgcaccatcaaatattgatactcccaatgggtcatatactcatgaaactggtagcaatgtggactcacctgagaggcatattaaggttgacagcaatgatttgccaattcgttcaagacaagaaatggttttcagcgatgagtacaagcctgttggcaagccgatcaagaaagtcggggcagagatccaagcatcaggggaggctgtgtacgttgatgatatccctgctcccaaggattgcctctatggagcatttatctacagcacacatcctcatgctcatgtgagaagtatcaacttcaaatcatccttggcttcacagaaggtcatcacagttataaccgcaaaggatattccaagcggtggagaaaatattggaagcagcttcctgatgcaaggagaagcactatttgcagatccaatcgctgaatttgctggtcaaaatattggtgtcgtgattgctgaaacacaaagatatgctaatatggctgcaaagcaagctgttgttgagtatagcacagaaaatctgcagccaccaattctgacaatagaagatgccatccaaagaaacagctacatccaaattcccccatttttagctccaaagccagttggtgactacaacaaagggatggctgaagcagaccacaagattctatcagcagaggtaaaacttgaatcccagtactacttctacatggaaactcaagcagcactagcgattcctgatgaagataactgcataacaatctattcctcgacacaaatgcctgagctcacacaaaatttgatagcaaggtgtcttggcattccatttcacaatgtccgtgtcatcagcagaagagtaggaggaggctttggtggaaaggcaatgaaagcaacgcatactgcatgtgcatgtgcccttgctgccttcaagctgcggcgtccagttaggatgtacctcgatcgcaagacggacatgataatggctggagggagacatccaatgaaggcgaagtactctgttgggttcaagtcagatggcaagatcacagccttgcacctagatcttggaatcaatgctggaatatcaccagatgtgagtccattgatgccacgtgctatcataggagctctcaaaaagtacaactggggcactcttgaatttgacaccaaggtctgcaagacaaatgtctcatcaaagtcagcaatgcgagctcctggagatgtgcagggctctttcatcgctgaagccatcatcgagcatgttgcctcagcactcgcactagacactaacaccgtcaggaggaagaaccttcatgattttgaaagccttgaagttttctatggagaaagtgcaggtgaagcttctacatacagcctggtttccatgtttgacaagctggccttgtctccagaataccagcacagggctgcaatgattgagcagttcaatagcagcaacaaatggaagaaacgcggcatttcttgtgtgccagccacttatgaggttaatcttcgaccaactccaggcaaggtgtcaatcatgaatgatggttccatcgctgtcgaggttggaggaattgagataggtcaaggattgtggactaaagtgaagcagatgacggcctttggactgggacagctgtgtcctgatggtggcgaatgccttctggacaaggttcgggttatccaggcagacacattaagcctgatccaaggaggtatgactgctgggagcaccacttctgaaactagctgtgaagcagttcggcaatcgtgtgttgcacttgttgagaggctgaagcctatcaaggagagtctcgaagctaagtccaacacagtggaatggagtgccttgattgctcaggcaagcatggcgagtgtgaacctatcagcacaggcgtactggactcctgatccatctttcaagagctacttgaactacggagctggcaccagtgaggtggaagttgatatcctaacaggagcaaccacaattctgcgaagcgacctggtgtatgactgcgggcagagcctaaaccctgctgtagacttgggccagatcgagggctgctttgtccaaggaatagggttcttcacgaacgaggactacaagacgaattccgacggcttggtcatccacgacggcacatggacgtacaagatccccacggtggataatatcccgaaggagttcaatgttgagatgtttaacagcgcccctgacaagaagcgtgtcctatcttccaaagcgtcgggcgagccgccgctggttctcgcagcctcggtgcactgcgcgatgagggaggccatcagggcggcgaggaaggagttctcggtcagcaccagccccgcgaaatccgccgtcacattccagatggacgtgccggcgacgatgcccgtcgtcaaggagctctgcggcctcgacgtcgtggagaggtacctcgagaacgtgtctgccgccagtgccggcccaaacacagcgaaagcatagatccagcaggcctcagggtgcagtcggcgcactgccagagatgatgtgtgctgccctgatgtacagacagtacagtacagaggagagagaattgggggaactcaggaactgcgaggagcgatgaacagtatatagagtgaaaaataaaagtgcttcgtactaataatcactagaaaaaattatgcacatctcccacgcactaccggcacgactgttgaatattttgtaaaataagatgtcataagctatttattttctgtatgattagatcagcaaataatttaattcaagtataaaaaaaaaaaaaaaaaa

SEQ ID NO: 12839 - DNA, 4351 bp, Zea mays
aattcggcacgagtgcttccggctctctcggtgcagacgtccgggactagtacgtggatcgggccgggggcaactcgagtcgtcaagaaggctgctacctgctagaggatggagatggggaaggcggcggcggtggtgctggcggtgaacggcaagcggtacgaggccgccggcgtggacccgtcgacgacgctgctggagttcctgcgcacccacacgcccgtcagggggcccaagctcggctgcggcgaaggtggctgcggtgcatgcgttgtgcttgtctcgaagtacgacccagccaccgacgaggtgaccgagttctcagcgagctcctgcctgacgctgctccatagcgtggaccggtgctcggtgaccaccagcgagggcattggcaacaccaaggatggctaccaccctgtgcagcagcgcctctccggcttccacgcctcccagtgcggtttctgcacgcccggcatgtgcatgtccatcttctctgcgcttgtcaaagccgacaaggcggccaaccggccagccccaccggccggcttctccaagctcacttcctcggaggctgagaaggctgtctctggcaacctgtgccgctgcacagggtacaggcccatcgtcgacgcctgtaagagcttcgcagccgatgttgatcttgaggacctgggcctcaactgcttctggaagaagggtgatgagcctgcagatgtcagcaagctgccaggctacaacagtggtgacgtctgcactttccctgactttctcaaatctgagatgaagtcctcaattcagcaggctaacagcgctccagttcctgtttctgacgacggctggtaccgtcctaggagcattgacgagcttcacaggttgtttcaatctagctccttcgatgaaaattccgtgaagatagtggcttcaaacactgggtctggagtgtacaaggatcaggacctttatgacaagtacattgacatcaaaggaatcccagagctttcagtcatcaacagaaacgacaaaggaattgagcttggatcagttgtgtccatctctaaagctattgaggtgctgtcagatggaaatctcgtcttcagaaagattgctggtcacctgaacaaagtggcttcaccgtttgttcggaacactgcaaccataggtggaaacatagtcatggcacaaagattgccattcgcatcggacattgcaaccatactactagctgcaggttcaacagtcacaatccaggtggcttccaaaaggctgtgcttcactctggaggagttcttgcagcagcctccatgcgattctaggaccctgctgctgagcatatttatcccggaatggggctcaaatgatgtcacctttgagactttccgagcagcacctcgtccacttggcaatgctgtctcatatgtcaattcagctttcttggcaaggacttcattggatgcagcatcaaaggaccatctcatcgaggatatatgtctggcgttcggtgcttatggagctgatcatgctattagagctagaaaggttgaggattacctgaagggcaaaacagtgagctcgtctgtcatacttgaagctgttcggttgcttaaagggtctattaaaccatcagaaggctcaacacatcctgagtatagaattagcttggctgtcagtttcttgtttaccttcctatcctcccttgccaacagcttgaatgaatctgcaaaggttagtggtaccaacgagcactcaccagagaagcaactcaagttggacatcaatgatttgccaatacgatcaagacaagaaatatttttcactgatgcatataagccagttggcaaagcaattaagaaagctggggtagagatccaagcttcaggggaagctgtgtacgttgatgatatccctgctcccaaagattgcctctatggggcatttatttatagcacacaccctcatgcacatgtaaagtcaatcaactttaaaccatctttggcttcacagaagatcatcacagttatcactgcaaaggatattcccagcggtggacaaaatgttggttatagcttcccgatgattggagaagaagcactttttgcagatccagttgctgaatttgctggtcaaaatattggtgtcgtgattgctcaaacacagaagtatgcctacatggcggcaaagcaagccatcattgagtatagcacagaaaatctgcagccaccaattctgacaatagaagatgcaattgaacgaagcagcttcttccaaaccctcccatttgtagctcctaagccagttggtgattacgacaaagggatgtctgaagctgatcacaagattttatcggcagaggtaaaaattgaatcccaatactttttctacatggagccacaagtggcgctagctattcctgatgaagataactgcataaccatctatttttcgacacaattacctgagtccacacaaaatgtggttgcaaagtgcgttggcattccatttcacaatgtccgtgtaatcaccagaagggtcggaggaggctttggtggaaaagcattgaaatcaatgcatgttgcatgtgcatgtgcagttgctgcattgaagctacaacgtccagttcggatgtacctcgatcgcaagacagacatgataatggcaggcgggcggcatcctatgaaggtgaagtactctgttgggttcaagtcaaacggcaagatcacagccttacatcttgatcttgggatcaatggtggaatatctccagatatgagtccaatgattgcagcacctgtcataggttctctcaaaaagtacaactggggcaatcttgcatttgacaccaaggtctgcaaaacaaatgtctcatcaaaatcgtcaatgagagctcctggagatgcgcagggctctttcattgctgaagccatcatcgagcatgttgcctcggcactttcagccgacactaataccataaggagaaagaaccttcatgactttgagagccttgcagtgttctttggagatagtgcaggtgaagcttctacatacagccttgtcaccatgttcgataaattggcctcctctccagaataccagcaccgagctgaaatggtggaacaattcaaccgaagcaacaagtggaagaagcgtggcatttcttgtgtgcctgtaacatatgaggtgcagcttcggccaactccaggaaaggtgtctatcatgaatgatggttccattgctgttgaggttggaggggttgagctaggccaagggttgtggacaaaagtgaagcagatgacggcattcggactaggacagctgtgtcctggcggcggtgaaagccttctagacaaggtgcgggtcatccaggccgacacattgagcatgatccaaggaggggtcactggtgggagcaccacttctgaaactagctgtgaagcagttcgtaagtcgtgtgttgcactcgtcgagagcttgaagccaatcaaggagaatctggaggctaaaactggcacagtggaatggagtgccttgattgcacaggcaagtatggcgagcgttaacttatcggcacatgcatactggacccctgatccaactttcacaagctatttgaactacggagccggcactagcgaggtggaaattgatgtcctgacaggagcaacaacaattctaaggagtgaccttgtctacgattgcgggcaaagcttgaaccctgctgtcgatttggggcaggtggaaggtgcattcgtacaaggagtaggcttcttcacaaacgaggagtacgcaaccaactctgacgggttggtcatccacgatggcacatggacgtacaagatccccacggtcgacaccatcccaaagcagttcaacgttgagctgatcaacagcgcccgtgaccagaagcgcgtcctctcttccaaagcatcgggcgagcctccgcttctcctagcttcctctgtgcactgcgcaatgagggaggccatcagggccgccaggaaagaattctcggtctgcactggtccagcgaactccgccatcacgttccagatggacgtgccggcaacgatgcctgtcgtcaaggagctctgcggcctggatgtcgttgagaggtacctggagagcgtgtcggctgccagcccaacaaacaccgctaaagcatagatccagtaggcgctctatccatggtgtgatggcttaatcaatctgtaaaacactaagcggcgtgacatgccgagctttcagtgttagctatgatgtacagaagaagaggtaccaatggcgagttgtggccatgcgaatcaggagtcatgaaccattgaggggggaaataaagtaaataagtgttgcgccggcg

SEQ ID NO: 12840 - DNA, 1094 bp, Zea mays
gcacgagaccattacctagaacatcctaatcgaaaaaggagatacttgaagcctcaccagagaccacaaggagggatattcgcaggacccggtttttgcagcacgaggtgtggaggctgctctgccataccaaaaagcagacagaggaccaaggaaggaagcagggatccggctttgctctgcaaccatgagctccctgtacgacgtctcctgcttcgcggctggccttgctgggaacgtcttcgccctcgccctcttcctgtcgccggtgccgacgttcaagagggtcctcaaggccaagtcgacggagcagttcgatgggctgccctacctgctgtccctgctcaactgctgcatctgcctctggtacggcctcccgtgggtctccgacggcggcagggccctcgtcgccaccgtcaactgcaccggcgccctgttccagctcgcctacatctcgctcttcatcttctacgccgacagcaggaccactcggctcaaggtcgcggggcttctggtgctagtggtcttcgcgttcgcgctcatcgcacacgccagcatcgccttcttcgaccagccgctccggcagctgttcgttggcagcgtcagcatggcgtccctggtctccatgttcgcttccccgctggctgtcatgggtgtggtggtccgcaccgagtgcgtggagttcatgcccttctacctctctctgtccacgttcctgatgagcgcatccttcgcagtgtacgggcttctcctgcgtgatttcttcatatacttcccgaatgggctcggagtcatcctgggagcaatgcagctggtgctgtacgcgtactacagccggagatggaaaagcagcgactcgtcagcaccgttgcttgcctgatcatgtagccgagttcgtcagtccaattgcccgtgccgtgctttctgttgttctctgttctgccatcctgtaattctaggagaggagctaggcggtgttttggaacagattaatcgtactgctacgaaatatattttttgagatagattattttaaatagagatggtcataaagtttattcgtcttctaagagaattttgaatacgatcatttt

SEQ ID NO: 12841 - DNA, 904 bp, Zea mays
  misc_feature (834)..(834): n is a, c, g, or t
ccggccgggcggtgggcccctcgaggccggccgggaggagaacttgaagcctcaccagaccacaaggagagggatattcgcaggaccagcagcacccggtctttgcagcacgagggaggacgaggtgtggaggcttctctgccaaaaagcagacagaggaccaagggaaggaagcagggatccggctttgctctgcaaccatgaactccctgtacgacgtctcctgcttcgccgctggccttgctggcaacgtcttcgccctcgccctcttcctgtcgccggtgccgacgttcaagagggtcctcaaggccaagtcgacggagcagttcgatgggctgccctacctgctgtccctgctcaactgctgcatctgcctctggtacggcctcccgtgggtctccgacggcggcagggccctcgtcgccaccgtcaactgcaccggcgccctgttccagctcgcctacatctcgctcttcatcttctacgccgacagcaggaccactcggctcaaggtcgcggggcttctggtgctagtggtcttcgcgttcgccctcatcgcacacgccagcatcgccttcttcgaccagccgctccggcagctgttcgttggcagcgtcagcatggcgtccctggtctccatgttcgcttccccgctggctgtcatgggggtgtggtggtccgcaccgagtgcgtggagttcatgcccttctacctctctctgtccacgttcctgatgagcgcatccttcgcagtgtacgggcttctccctgcgtgatttcttcatatacttcccgaatggggctcggagtcatcctgggagccaatgcagctggntgctgtacgcgtactaccagccggagatgggaaagcagcgactcgtcagcaccgttgcttgcctgatcat

SEQ ID NO: 12842 - DNA, 1138 bp, Zea mays
gccggccgggccggccggcggggagatacttgagcctcaccagaccacaaggagggatattcgcaggaccagcagcacccggttttttgcagcacgagggaggacgaggtgtggaggctgctctgccataccaaaaagcagacagaggaccaaggaaggaagcagggatccggctttgctctgcaaccatgagctccctgtacgacgtctcctgcttcgccgctggccttgctggcaacgtcttcgccctcgccctcttcctgtcgccggtgccgacgttcaagagggtcctcaaggccaagtcgacggagcagttcgatgggctgccctacctgctgtccctgctcaactgctgcatctgcctctggtacggcctcccgtgggtctccgacggcggcagggccctcgtcgccaccgtcaactgcaccggcgccctgttccagctcgcctacatctcgctcttcatcttctacgccgacagcaggaccactcggctcaaggtcgcggggcttctggtgctagtggtcttcgcgttcgcgctcatcgcacacgccagcatcgccttcttcgaccagccgctccggcagctgttcgttggcagcgtcagcatggcgtccctggtctccatgttcgcttccccgctggctgtcatgggcctggggtggtccgcaccgagggcgtgggagttcatgcccttctacctctctctgtccacgttcctgatgagcgcatccttcgcagtgtacgggcttctcctgcgtgatttcttcatatacttcccgaatgggctcggagtcatcctgggagcaatgcagctggtgctgaacgcgtactacagccggaaatggaaaagcattgtctcgtcagcaccgttgcttgcctgatcatgaaaccgagttcgtcagtccaattgcccgtgccgagctttttgaggttcactggtctgccaccctgtaattctaggaaaggagctaggcggtgttttggaacaaattaatcgtactgctacgaaatatattttttgagatagattattttaaatagagatggtcataaagtttattcgtcttctaagagaattttgaatacgatcattttatttattgagttggcccaaaaaaaaaaaaaaaaaaaacca

SEQ ID NO: 12843 - DNA, 1955 bp, Zea mays
  misc_feature (1949)..(1949): n is a, c, g, or t
accaccgtttgaaagaagatcatctcagatcgctcctctcccctcgtgcccctctcccctcgtgctcctcttcaaatagcactcgggtacaaaagggaagtacaacgaaggcacttggctgccttctgaggctgagagaggatcactcttcttacaagttgcagcgtaggggcggccaccacaccacatggctttcttcctcgctgtagcttgcatctacatcgtctccctcactctgctggtgctgctgctcgacgcgagcagacgacggagaacaaccggaggtggcagtagcagcacggaggagcacaagctgcctcctggctccctgggtctgccgttcctcggcgagactctccagctctactcccagaacccgaaggtcttcttcgcctccaggctgaagaggtacggcgaggtgttcaagacacacgtgctgggttgcccctgcgtgatcttggcgagcccggaggcggcgcggatggtgctggtgtctcaggcgcacctgttcaaaccgacgtacccaccgagcaaggagcgcatgattggcgcgcaggccctcttcttccaccagggcgactaccacctccgcctgcgccgcctcgtgaagggctggcttggcccggacgcgctccgcggcctcgtgcccgacgtcgaggccgccgtggcgtccacgctcgacgggtgggaaggccgcgtcaccagcaccttccataccatgaagaggctcaccttcgacgtcggcgtcatcgccatcttcggccaccggctggccggccacgtgaaggaggagctgaggaggaactacttcaccatggagaaaggctacaacagcttccccatcccggtcgcctgcaccagctacagccaggccatcaaggcgaggcagcggctgggcgcggtgctgagcggcatcctggcggagcggagggcgcggcggagcgacgacgacgacgaccatggcctcctgaacgccctcatgcgctcccgtgacgacagcggggcggcgccgccgctctcggacgaccagatcgccgacaacgttatcggcgtgctgttcgcggcgcaggacacgacggccagcgtgctcacctggatcctcaagttcctccatgacaacccgaagcttctggaagccgtcaaggtggagcagatggcagcctacgaggagaacgatggcgggaggctcccgctgacgtgggcgcagacgaggaagatgtccataacacacctggttatcttggagagcctgaggctggcgagcatcatcgccttcacgttcagagaggccgtcgaggacgtgcactaccaagggttcctgattcccaaagggtggaaggtgatgcccctgttcagtaacctgcactacagcccggactacttcgaggacccacacaagttcgacccttcccgattcaaggtggcgccgcggcccggcacgttcctgccgttcgggagcggcgtgcacgcgtgccccggcaacgacctggccaagctcgagatgctcgtcctcatccaccgcctcgtcaccacctacaggtgggaggtggtggggtcgagcgacgacgtgacctacagcccgttcccggtgccgaaacgcggcctcctggcgaggctcagcagggccaccaccggcagcgcggtcgtcggccgtgcgccgccgctggacattggaggacctgcaggcgctagctatagctagctcctcggaccaaaaggcaatgcatgcacccaagcacccaggagatagataggcccggcaggcggcaggggacgacgacacacacatccagacatcgtccagtcacgtggcagtagcaagctagtactactactactgtgtgtgctgccattctgcatgcatgcgtttcctctcattctcgtgttccttcatggcatgtgtttccttcccttcgtttcccctcgatcgcttatacagatataaattnctggtc

SEQ ID NO: 12844 - DNA, 1549 bp, Zea mays
tgaaaaatttctggttgccatctctacttataagccactccgctcaggcacatgtgcagcatgcacgcatggcaaaccgacgggccggccgggtctattctgccgcgcggtgctggtgcggcgaagattgaaaggagtcccgcccccacgtacgggtgctgtcaaatactctccatatatatataaggctgcccctaatcgaaaaagctagcttggcgtttgccagcacgcatagcgattgcgactattggcgattgtgtaggtgtagtgtgcctgtcgaggaacgagagcctcaagacccgagcgtcttcagatatggaggaggcggcggttgcacggacgaccagcgagacccaggtgggcgacctgccggaggtgtgcctggcgcaggccatcgcgcggacctccccgcgcgacgcctgccgctgcgccgccgtgtccccggccttccgcgccgccgccgactccgaccaggtctggcgcgccttcctccccgagcagctcgaggcggctgaggaccacttggacagccgccgcgtgtctccgccgtcgcaggcggctcacccagcggcgaccgtgctcggcctcagcaagaaggacgcctacctcagcctctgcgacgctgccggcgccgtggccgtcgacggcagcgggtgcagggtgtggctggagagggccagcggcgccacgtgctacgcgctgtcggctcgcaggctcagcctgccctgggacgacggcgagttctcctggaggttcacgcaccacccacgctccaggttcgcggaggtggcggagctggtggactgcacgtgcctggacatctacgggagcctgccgctggccgcgctgacgccggcgacggtctacgcggcgttcctggtgtacggcaccgcgccggagggggcctaccgcggcctgagctacccggaccaggagacggccgtggccgtgggcgggcgggtcgtcgcgcgccacgccgtgtgcctccgccccgacgacgccgaggcgcgcaagttcaggggccgcggcgccggggaggaggcgaggaggccgagcctgcgggctgacgggtgggaggagatggagatgggacgcctgcgcacgccgcccgtggaaagcggcggcggcggcggcgacgtctgcgtggtgcaggcgagcttcgaggtgctcggctggtaccccaagcgcggcctcgtcgtcgagggcatcgagttcagggccctccacgatgcttcatgactggttgagagttgagaccgcatgaatatacgttgtaaatgagatgtaaactcgattggtaaattgtaacaatcatttacagtgttcttgataggtaaattcatcggagacatgatcaaaaaaaaaaaaaaaatttctagagagagagagagagagagagagaaaacccacgtgtcgataatttcggttttgcagtacgtgggcagtctgtccgtgcacgtcgtcgtcgtcgatcgtgcggcggtcttcaagcaattgagcgcgctatccttaccgtgtggaccatgtcaaacgaagggaaccaaaacag

SEQ ID NO: 12845 - DNA, 1337 bp, Zea mays
acccttcgaatctcggtcaactcgttgcacccggcgagaacctaacatctgccaactctgccgcatctcgcagtcgcgttcgccgctcttcgctcctcggtcctcagccctcacacgccgcccgcccgcgacgaagcccgcatagccgccgccgagcgccggagttgccacctaccgcgcgcccatctgccgccgatgctgcgcactcatctgctacccgaggcttggcggcggccactgccccaggaggcaggagcgcgacaccaaagtccgcgcatttccttccaccgagccgcaccaagatccgggatccaaggtggccaagttcgttgcggcggccctgaacttcgatggctgtcctcgtcacggaattcgtcctcagattcacagccatggactacaatgtgcgtgaatgcagactataccactcctgctgattctgtcgccacctcggagcaagcaggtggtgaagctgaggccaccttagaaacaggtggtgaagctgcggccaccttggagcaaacaggtggcgaaaccgaagagccgaccattgtagcacctgctaatgaatatacagagcaggaggctgctcctcagcagaagtgtgcaaagatacacgacttttgcctagggataccttttggtggacttttactctccatgggccttattggatttctcttctggaggagccctgcgagtcttacctttggcgttgcacctggccttgccatattggccctggctgtacttagcctcaatgtctggaggagcgggaagtccagcttaccgttcatactggcgcaagcaggcattgccgctgcggtagcatggaagcacggccaggcgtacaccactacgaggaagctgcttccgtggggcttctacgtcgcgctgagtgccgcaatgatctgcttctactcctacgttcttcttgccggagggaatccgcctcctaagaaggcgaaggcgaaggctgctgcttgatttgatgttgaaggcattcaccggagcgtctcataattgcactacctttctctggtaaatagggttgtggtatggcctctgtttacttagtaaaagactgaggagataagactgtcccccctatgctgcataactgttgttgtttcctttatatatacatgatcaataagggctgggttggttccattccatcccactacccatctcatttatggtggtaaatagggttggcctttcttttttggctttggtttgaagtgtttgacgagattttgtacatttcctttttagagagaagcacattctatcacaagaggctcgacatgctattgccaaaaaaaaaaaaaaaa

SEQ ID NO: 12846 - DNA, 1330 bp, Zea mays
attgggtacctcgaggccggccggggcgttcgccgctcctcggtcctcagccctcacacgccgcccgcccgcgacgaagcccgcatagccgccgccgagcgccggagttgccacctaccgcgcgcccatctgccgccgatgctgcgcactcacctgctacccgaggcttggcggcggccactgccccaggaggcaggagcgcgacaccaaagtccgcgcatttccttccaccgagccgcaccaagatccgggatccaaggtggccaagttcgttgcggcggccctgaacttcgatggctgtcctcgtcacggaattcgtcctcagattcacagccatggactacaatgtgcgtgaatgcagactataccactcctgctgattctgtcgccacctcggagcaagcaggtggtgaagctgaggccaccttagaaacaggtggtgaagctgcggccaccttggagcaaacaggtggcgaaaccgaagagccaaccattgtagcacctgctaatgaatatacagagcaggaggctgctcctcagcagaagtgtgcaaagatacacgacttttgcctagggataccttttggtggacttttactctccatgggccttattggatttctcttctggaggagccctgcgagtcttacctttggcgttgcacctggccttgccatattggccctggctgtacttagcctcaatgtctggaggagcgggaagtccagcttaccgttcatactggcgcaagcaggcattgccgctgccgtagcatggaagcacggccaggcgtacaccactacgaggaagctgcttccgtggggattttacgtcgcgctgagtgccgcaatgatctgcttctactcctacgttcttcttgccggagggaatccgcctcctaagaaggcgaaggcgaaggcgaaggctgctgcttgatttgatgttgaaggcattcaccggagcgtctcataattgcactaccttcctctggtaaatagggttgtggtatggcctctgtttacttagtaaaagactgaggagataagactgtcccccctatgctgcataactgttgttgtttcctttaaatatacatcaataagggctgggttggttccattccatcccactacccatctcatttatggtggtaaatagggttgccctttttttggctttggtttgaagtgtttgacgagattttgtaaatttcctttttagagagaagcacattctgccacaagaggctcaacatgctattgcaattcgatatgggctgctaaaaaaaaaaaaaaaaaaaaaaaaaaaaaaaaaaaaactcgaggagggg

SEQ ID NO: 12847 - DNA, 1356 bp, Zea mays
cccacgcgtccgcggacgcgtgcgtgcgttcgccgctcctcggtcctcagccctcacacgccgcccgcccgcgacgaagcccgcatagccgccgccgagcgccggagttgccacctaccgcgcgcccatctgccgccgatgctgcgcactcatctgctacccgaggcttggcggcggccactgccccaggaggcaggagcgcgacaccaaagtccgcgcatttccttccaccgagccgcaccaagatccgggatccaaggtggccaagttcgttgcggcggccctgaacttcgatggctgtcctcgtcacggaattcgtcctcagattcacagccatggactacaatgtgcgtgaatgcagactataccactcctgctgattctgtcgccacctcggagcaaacaggtggtgaagctgaggccaccttagaaacaggtggtgaagctgaggccaccttagaaacaggtggtgaagctgcggccaccttggagcaaacaggtggcgaaaccgaagagccaacaattgtagcacctgctaatgaatatacagagcaggaggctgctcctcagcagaagtgtgcaaagatacacgacttttgcctagggataccttttggtggacttttactctccatgggccttattggatttctcttctggaggagccctgcgagtcttacctttggcgttgcacctggccttgccatattggccctggctgtacttagcctcaatgtctggaggagcgggaagtccagcttaccgttcatactggcgcaagcaggcattgccgctgcggtagcatggaagcacggccaggcgtacaccactacgaggaagctgcttccgtggggattctacgtcgcgctgagtgccgcaatgatctgcttctactcctacgttcttcttgccggagggaatccgcctcctaagaaggcgaaggctgctgcttgatttgatgttgaaggcattcaccggagcgtctcataattgcactacctttctctggtaaatatggttgtggtaattggtatggcctctgttgtttacttggtaaaagactgaggagataagactgtccccctatgctgcataactgttgttgtttcctttatatatacatcaataagggctgggttggttccattccatcccactacccatctcatttatggtggtaaaaagggttgtccttttgcggccctttggtttgaagtgtttgacgagattttgtacatttcctttttaaaaagaagcccattttatcccaaaaggctcgacatgcttctgcaaaaaaaaaaaaaaaaaaaaaaaaaaaaaaaaaaaaaaaaaaaaaaaaaaaaaaactcgaggggg

SEQ ID NO: 12848 - DNA, 2397 bp, Zea mays
ctgcccctcgctcgatctacccccctccttcctcggctagctccaagaacccgtcccacttctccacttcttggcaggtcgatcggccgtgaacgatttcggatcctgtcgcgcgcgcgtgtccatggcgtcgacggcggccaggcggctgcttctgccgctgctgctggtggcgctcatcgcggcgcaccgggcggcggcgcggttcgtggtggagaagaacagcctgcgggtcacgtccccggccgtgctccggggcgtctacgagtgcgccatcggcaactttggcatgccgcagtacggcggcaccatgcacggcgttgtcgtctaccccaaggccgacgccaaagcctgcaggcccttcgccgactccggcctctccttcaagcccaggtccggcggcctgcccgtcttcctgctcgtcgatcgcggagattgctacttcacaaccaagggatggaacgcacagaacgccggagctgcagcagttcttgtggccgacgacagagtggagcctctgatcacgatggactctccagaatccagcggcagcacatagagaacatcacgatcccatcggcgctcgtgaccaagagattcggcgaggacctgaggaaagcgctgcagagcggggacatggtgaacgtcctcctggactggagggagtccctgccccaccccgacgagcgcgtggagtacgagctctggacgaacagcaacgacgagtgcggcgccaagtgcgacatgcagatgagcttcgtgaggagcttcaggggcatcgcgcaggccctcgagaagagggggtacacccagttcaccccgcactacatcacgtggtactgccccgaagccttcgtcctcagcaagcagtgcaggtcgcagtgcatcaaccacgggaggtactgcgcgccggacccggagcaggatttcagcaccgggtacgacggcagggatgtcgtgctccagaacctggtccagatatgcgtgttcagggtcgccaatgggactcgcaggccgtggatgtggtgggactacgtgcacgacttcgctgtgaggtgcccgatgaaggagaagaagtacacgcgtgagtgtgcgaatggtgttatcaattcacttggactggacatcgagaaaatcaacaagtgtgttggagatccagaagctgataaagaaaatccagtccttaaggcagagcaggacgctcagattgggcatggttctcgcggcgatgtaactatactgcctactcttgtcgtcaacaacagacagtacagaggtaaactggaaaaaacatctgtgttaaaagcagtatgctctgggtttgaggagacaactgaacctgatgtctgtttgcgcgaagatatcgagacaaatgaatgtttggagaacaatggtggttgctggttagacaaggctaccaatgtttctgcgtgcaaggataccttccgtggtcgtgtctgcgaatgccctattgtgaatggtgtgaagtttatcggtgatgggtacaaccactgtgaagcttctggccttggtaggtgccagatcaacaatgggggctgctggaatgagactaggaacgggaagagtgtgtctgcctgctcaaaccaagaagctaaaggctgcaagtgcccagcaggtttcaagggcgacggagcgaacagctgcgaagatgtggatgagtgcaaggagaagcttttctgccagtgcaaggactgcgcttgcgagaacacgtggggaagctacgagtgcagctgcggcggcggcaactcgctgtacatcagagagcatgacacttgcatcagcaaacattccagctcgacgccgggctggggcttcctgtgggtggttttcttgggccttgccttggccggagcaggagcgtacgccgtgtacaaatacaggctacggagctacatggattcagagatccgcgcgatcatggcccagtacatgccccttggagagccaagacatgccgagccaacaacaccacctcgtccccgtcgaccgtgcagacgtctgaaacggcaggcaaggcttgtttgcatgacatggatccagcataaagagctactgagtagcatcgcatcgtcggcagagaagagaagtcggcggcaccggcatcttcctcccttggtgcgcagaatatggatgctgaaaaatcacagtttcacggagcagattaggatctctctccgcagtttagagcccgtttgtcaggtttagagctcgcagtcgtgctgtgcgttgctgcgtaatcgtcgagtgttctgtaaatattcctgttgagacccaacgctgaagcgcgcgcgtgttgctgtgctgccctgaataaaaggagcccaggaagatcatttttagtattactagtgtttgcatccaaaaaaaaaaaaaaaa

SEQ ID NO: 12849 - DNA, 1819 bp, Zea mays
gtcgacccacgcgtccgcccccgcctccgccctgagttccgacgttgcccgggaggggtggggaggggagcggcccatttggatttggaagcatcctcggcggcgagcggcggcgtcgcattcactctcatctctctctcacacagattccggctccttttccctctcccccaattcaaaatcaacccccctcgtcgcaaggccacaaccactccactcctccccatccctagctagccactagggtttgccagcctttgcagcgtcgcgctcgcgtctcatgcccttgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaaatggcccgacggcaggctctctttcctggtgactcggagttgcaacagttgcttcacatcttcaggttgctgggaacacctactgaggaacagtggcctggagtgagtgatttaagggactggcatgagtttccacagtggaagccccagggtttggcacgtgtcgtcccaacactggaacctgaaggagttgaccttctatcgaaaatgcttcagcttgatccttcaaacaggatatcagctttagctgcgatggagcatccctactttaacagccttgacaagtcccagttctagccgttgtactatgtggttcagaaggcgctaccctcgtacagagagatttccaatggtgttatgaatctcaattgccatctaggcaactggttcatgattttaccaatctgttagtgagtgaaaatcgtgcgagggtcatatgtgttccccttgtcttaaaaatctggtgtggtgtagaacaagagttacctgtgggaggcctgtgataatgccctttatgtctcaacatccattttcgtgcattccatgttcttcaatacggacttgaaacaggaattctgattttcttattactaccttcaaaaaaaaaaaaaaagaaaacaaaacaaactaacatacatatactaaaaaataaactaatcttccttcgatctagacaaccctaccttacgaccacgtccttatgcacaacaatatatctttttcatacccactattatatttgcattcaccacttgcacaaactttgttgcttactaatacctttttttgcctacttactaaatttttactctaaattgttatctttcaaattttcaatttgtt

SEQ ID NO: 12850 - DNA, 915 bp, Zea mays
  misc_feature (674)..(674): n is a, c, g, or t
  misc_feature (762)..(762): n is a, c, g, or t
  misc_feature (830)..(830): n is a, c, g, or t
  misc_feature (839)..(839): n is a, c, g, or t
  misc_feature (873)..(873): n is a, c, g, or t
atttggatttggaagcatcctcggcggcgagcggcggcgtcgcattcactctcatctctctctcacacagattccggctccttttccctctcccccgattcaaaatcaacccccctcgtcgcaaggccacaacccacaaccactccactcctccccatccctagctagccactagggtttgccagcctttgcagcgtcgcgctcgcgcctcatcccctcgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaacggcaagcccgtcctctacctcgtcttcgagttcctcgacaccgatctcaagaagtacctcgacgtctaccgcagggggcccagcgccaggccgctccccgcgacactcatcaagaatttcccgtatcagttatgcaaaggagttgcacactgcncatagccatggtgtccttcaccgggatttaaagccacaaaacctgctggtggacaaggagaagggtatactgaagattgctgatctgngacttcggtagggctttcactgtgcccatgaaaagctacacccatgagattgtgacactttggtacgnagcttctgnaagttttgcttggagcacacttactcactggggntgatatgggggtctggtggatgcatcttgctgaatgcccgac

SEQ ID NO: 12851 - DNA, 4315 bp, Zea mays
tgggcgaattttctgtagttcggtactttttatcgtgttatgttttaacaagtcgtttgactattaagaatggtatttatataagatgtattattatgatccgtacctaaaaattatcggtacatttggtatgtgtttacatatgcatttagattgtggctctaggcataaaaatcgctagctccaccattgtgtaacactcttcaacacatagacaaaccaatgatagatgtggaaagacttaggtgcaagtatatacgtcagcgcagcatcctagacatttagatcgtgattcaatcgtagagttgatcaagtggtttttggtaaagttgtacgaggtggtgggaaatttaagagctaaatatgctcaggtcgggatttaaagacccaagcaagagacatgttttcacgtttgcacctaaggtttgcttacatccccgtaagtacagatttgaggaaattttttctctgacctttttttttcaaaacatcatggtatagctagagaaatgatgacccccccccccccctaatctcggactcgatccgatcgatcttatggcgcattcttttcgctaacataaaaggtggcaaaagcatgcatggccctcgacgaaaggccgtctccactctccatctactacgggcgcggccgaccgagccttctgggcgtcgaaatcgccacccatccatgctgtcgttctacaacatgctgtggcggattccttcctggtgcgcgcgcgcccaagcccgttcctcctcttcttgcccatccacccacaacacatgcttataaaaaggccgtcgtcgttgccgccatgtaactcactcatcgtcagtcagtcgtcacagtactcgatcgagcgcgatctgatctctttccgagcaatcatccgttctagcgtagtagagcgcatggacatggcctcgtcctctgcatcagcagctctcctcctggctgtctccctcgccgctctgcacttgtgctgccgccatgggcacggtgccggcgacgccgccggcaacggcatcactgccatctacagcctcggcgactccatcactgacaccgggaacctcgtcaaggaggcgcctccgggcatgttcgagaccatcaagcacctcccctacggcgtcacgttcgggtacccgaccgggcggtgctccgacggcctcctcatgatcgacttcctgggtacgtgtgcctgacgtcactaatttacagaggtctaagcggcagccagtacgcatacgacgcggtcggtcgtgatcgtgacatgcatataaatgcatatggatgatgatgcagctcaggacctgggtctcccgttcctgaacccgtacctgggcaagaacaagagcttcgaccacggcgtcaacttcgccgtcgccggagccaccgccgtggacccggccgaccagttcaacctccccgccgtccccgtgccgttcgcctccaagtccctcaaggtgcagctccggtggttcaaggacttcctcaagtacaccttcggcaccgatgaaggcaaacactttacacttcccttcctcctctcgatcaaccaaaaccgtctcatcctccctccatggatatcgatatcgacgcgctgctaggcaggcagcaggctcaaacccttgcactgcgtgtggctgcgcgcatgcatgcgtgcgtgcagagattcgcagacggcttcaagcttctctggttttggtcggggagatcggcgggaacgactacaactacgccttcttccaggccaagcctgtggccgaggtggagaagctcatcccaggggtcgtgaagaccatcgtcggcgccgccaaggaggtgctggacatgggcgccaccagggtcatcgtcccgggcaacttccccatcggctgcgtgccgggctacctggccatgaacgccgcctcgtcggagccggcggactacgactcggcggggtgcctccgggagctcaacgacttcgccgccaagcacaactcgcggctccggcgcgccgtcgccgacctgcaggcgtcgtacccgggcgccgccgtcgcctacgccgactacttcgactccttcctcaccctcctccacaacgcctcctcgttcggtactccttcgtcactcgatctctcacgcatgcgggactcgaatcatccaagtccgtgccgtttgacgacgacgcgtctctctctgtgtctctgcatcaggtttcgacgccgcgagcacgcgcaaggcctgctgcggcgccggtgccggcgagtacaacttcgactggcggcggatgtgcggcttcccggggacggcggcgtgcgctgacccgtccacgtacctgagctgggacggcatacacatgacgcaggcggcgtacagggccatgtccaggctcatctaccacggcaagtacctgcagccacagatactgagcttcccggagaaaaacgggcagacataaactcacgtcgtcatcatatatagaacttagttagaaaatatactcgaaacaccggctacaaataagctgtcagtagtcagctgtatcggtaagtacatgcgcgctgttcaactaatgctatcatcaagctgtgagccacactgagtgtgagcaaaatatacacgttgcatgcagtgcagtcagctgcactgaatccacgatgaacgcgccccccccccagtcgcgtgttcctgttcggttgcagaggaagaaggctgtcgacaaggcatgagttgttcattaccttgtccagctgcctctacaggtactagatttttttttaaaatggatctgccacaagaatcaaggctgatttccttcagcagatgagagtggcagaataggcagtagtgaaatattcagtgacaggataggcgatggtgaaatatttacactgataacacatgtagttgaactcaacatcacggtgaactgttttttatacaaagcttattgaaagtggacagcagcatcgtcaagtctgggtctagttcatgtttcttccaagcttcctcaaattgatgtcccttgcagttctgaagcagtacaagtatctccaggatatgatctcgcatgatttcacggttgctccttgtggctgattctttatataatagaacaagctcgtccaccagcctcaaagtataaggtgacttcctgatccaggtaagcttgataatggcatgtatttgctttaaagtcagaagaactgtcttattatcatcagtgtgcatccattggaaaaacagtgagaaaaggcggcgaaaatgtgccaacaggaagaggcccatagcatcaaaaactggcccaataagggtcaaccatgcaacacgacgctctttatttagtggctgccgttccaggtggcccaacatctcactaagcattcgatcataccaggggctacgaggattgctccgctgggtgaatgtcagcaacatcacagatacctcaataacctggtaccataactcatcatctgcaggaatgttctgacagcacgcatcaagtatggcatcttcatacaaacttaattccgttgctttcacattcttcgctatgtgtacaaagcttaccattccctgtaccttaacttctggtgaccaatgatctaaggttgtcagggcacatggaatgactaacgaacacaaatccccgagcttagggtagcttacctgagacaccagccaccggaactggtgcgcggcgactgctgcgtgctccttgggcggcttcacagccccaatctcgtcgctgtcagcatcgacgcacgagtccttcaccacggccttgagaggaggcaccacctccggtgccacggccaccaccatatccccaacgctgccccaacctcccgccgccgccagctcgttcaccgcggcggcggccgcgcccacgaggctcgccgggacccagtgcagcgcggggtactccggggaggccgcgagtacggcagcgcagaagaggaggaggtccccagactccttacccgccggctcctgaagctggggctggggaggggaaggcgaagggaggagagaggcgaggagggacttgacggaggcggatgcgcccgcggggggctcgtacggcgccgcggcgagggagtcgcggagcggcgccgagataacgagcagagaggcacgcgggagcgccgcagcggcggtggcggcggcgtgaggcatggcggactccggactggagggtcgtgccgcctcgtcgccggttgccgcgggcgtgagtcaaggcactgaaggggtcgggcgatcggtattttgttgatgatgtgaaactctacatgccatttttaaagttgttaattcgggcag

SEQ ID NO: 12852 - DNA, 1450 bp, Zea mays
gattgggaccctcgggccgaactcactcatcgtcagtcagtcgtcacagtactcgatcgagcgcgatctgatctctttccgagcaatcatccgttctagcgtagtagagcgcatggacatggcctcgtcctctgcatcagcagctctcctcctggctgtctccctcgccgctctgcacttgtgctgccgccatgggcacggtgccggcgacgccgccggcaacggcatcactgccatctacagcctcggcgactccatcactgacaccgggaacctcgtcaaggaggcgcctccgggcatgttcgagaccatcaagcacctcccctacggcgtcacgttcgggtacccgaccgggcggtgctccgacggcctcctcatgatcgacttcctggctcaggacctgggtctcccgttcctgaacccgtacctgggcaagaacaagagcttcgaccacggcgtcaacttcgccgtcgccggagccaccgccgtggacccggccgaccagttcaacctccccgccgtccccgtgccgttcgcctccaagtccctcaaggtgcagctccggtggttcaaggacttcctcaagtacaccttcggcaccgatgaagagattcgcagacggcttcaagcttctctggttttggtcggggagatcggcgggaacgactacaactacgccttcttccaggccaagcctgtggccgaggtggagaagctcatcccaggggtcgtgaagaccatcgtcggcgccgccaaggaggtgctggacatgggcgccaccagggtcatcgtcccgggcaacttccccatcggctgcgtgccgggctacctggccatgaacgccgcctcgtcggagccggcggactacgactcggcggggtgcctccgggagctcaacgacttcgccgccaagcacaactcgcggctccggcgcgccgtcgccgacctgcaggcgtcgtacccgggcgccgccgtcgcctacgccgactacttcgactccttcctcaccctcctccacaacgcctcctcgttcggtttcgacgccgcgagcacgcgcaaggcctgctgcggcgccggtgccggcgagtacaacttcgactggcggcggatgtgcggcttcccggggacggcggcgtgcgctgacccgtccacgtacctgagctgggacggcatacacatgacgcaggcggcgtacagggccatgtccaggctcatctaccacggcaagtacctgcagccacagatactgagcttcccggagaaaaacgggcagacataaactcacgtcgtcatcatatatagaacttagttagaaaatatactcgaaacaccggctacaaataagctgtcagtagtcagctgtatcggtaagtacatgcgcgctgttcaactaatgctatcatcaagctgtgagccaaaaaaaaaaaaaaaattggttctgtggactaag

SEQ ID NO: 12853 - DNA, 1335 bp, Zea mays
ataaatccaattggcacgagaccattacctagaacatcctaatcgaaaaaaccacgccgccgccggccggccacctttctccattctccgtcaatcgtcatcctatccgatccccaactaggcaactactccgtctcacgcctctcctgtcccctctcgccgctctcgccccgcctctgcctccgcctcctccatcgcacccagctttcctccccaccccaccaccactcctaccccgccacgtcgtgtagtcgcggcggcggatatgcaggccgccgccgccttcaaccaggcagccttcaccgcccgctcgctgcatcgccccccgaggcccctccacctagctgttgcggaggatgcttttgcggggataagaggcgcgccccttacacggccccggtgctgcgggagcctctctgtcggcgtcggcagctacgacagcgagcacactccagtatttccaagacaacaatcatgggatccctacaagcttcttggtgttgatcaagatgcatctgaagaagaggtccggagtgcacggaattttcttctaaaacaatacgccggatatgaagaaagtgaagaggccattgaaggtgcttatgacaagataataatgaatagctacacagaccgtaagaaatccaaattcaatctgaaaagcaagctaaaagagcaagttgaaggatccccatcatggcttaaggcactgcttggatattttgaggtgccatcactagagatcatttcaaggagatttgccttttttgcgttctttgccgggtggagcattgcaacttctgctgagactgggcctgcctttcagcttgcgatgtcactcgcctcatgcatatacttcctcaatgagaagatgaagaatcttgtcagggcgtccaccacagggttcggaatctttgtgggtggctggatcttgggttctcttcttgttccagtgatcccagctttcgtcatcccgcctacatggtcccttgagctccttacttcgctgacagcttatgctttcatgttcgtgggttgcactttcctcaagtgaaacttagcagcagttcaccaagtggaaattcctgcggtcatcacgaaggaaattgctcttgctaacatctccacagcagatcccaacttactgataagcggcctgcttcacaatttttttttgtccgagagagtatgatgatctttacgttattgttgttgttgttacatgtataatataacattttagcaaccagacaatttcgatggatattgaaaagggatacacgttggattcttccgaaaaaaaaaaaaaaaagcggccgaaaaaaaaaaaaaaaa

SEQ ID NO: 12854 - DNA, 1422 bp, Zea mays
cccacgcgtccgcccacgcgtccggcggaaggcaggtcgcttgttctacttctacctggcctcgcaggcttcgcaaggcggccacacgccgatacctcctccttcacccgctccgtcgtcccccacagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgattccccggagaacaagccggacatgaaatgggagttctcacaggcgaatatgaagaaggtcaatgagattctgtctcactatccaagcaactacaagcaatctggtattattccgctgcttgatcttgcacagcagcagcatggtggatgggtgccagttgcagcaatggatgctattgctaaaatcgtcgaagttgcaccaatcagggtttatgaagttgcaaccttttataccatgtttaacaggactaaggttggtaaataccaccttctggtgtgtggaactacaccttgtatgattcgtggttcacgtgaaatcgaagagacgttgttggagcaccttggagttaaacgaaatgaggtgaccagtgatggtttattttctgttggagaaatggagtgcatgggttgctgtgtgaatgctcctatgattgctgtggctgactactcgaaaggctcagagggttacacatataactactatgaggacctcactccaaaacgagttgttgagattgttgagatgcttagaagaggtgaaacaccccctcgaggtacacagcacccagagcgaaaaaactgtggccctgccggggggaacaccaccttgcacggagagccgaaacctcctccatgcagggatctggatgcctgctaggtttgcttcggagcattacgagcacgcgcataacttggctcgtactgtaaggtgtgcaaactgcacacagcggaggctgtgttatttgtattctgaagctttcttgtgtttcgtcaagaaagcttctctaacttttatcctgcactatcagataaacggtaaattgatagagaataagatgttttcgagctcatgtttagtggcaaacgctttatatttttggcaagctgtgaaggagctgaaccagtgacaactcgaagaattcattttgttgtattaagtcttcttgttagcccattaaacgatgagatcgtatacttgaaattctcgaattttacaaatcaacattggattctctgcgcaatgacagatggttgttatcgtacaaaaaaacgaaaaaaaaaaaaaagaaatgtaagaaaagagatgatgta

SEQ ID NO: 12855 - DNA, 691 bp, Zea mays
gccggccgggtcgggcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttaataaaaaaaaactgagctgttatttttgaacgctatccaaataaatttgaaaccagattgctgatgcgtaaaaaaaaaaaaaaggcccctgtggatggaagtggaaccgatatgcttcagctattggctctatcgtgtatgccatgttctgtacgcgagcctgatatttgattgaaatgctggttctatgctaaaaaaaaaaaaaaaaaaaactcgactcgtgc

SEQ ID NO: 12856 - DNA, 3958 bp, Zea mays
  misc_feature (1101)..(1101): n is a, c, g, or t
  misc_feature (1156)..(1156): n is a, c, g, or t
  misc_feature (1307)..(1307): n is a, c, g, or t
  misc_feature (2645)..(2645): n is a, c, g, or t
ctaaggagagtgccatcaacttggaaggactagacatattttgaaaagattcaaaatgaagtccatgttaatcgtctcaaagctcttgaaattgcagggaagattaatatcgacaagatggagacaacaaaaattgctctcgaaagagcaaaggaggagaaagaagctaaattaattgaaacttattctagcctgctgaaacaagacacgtcggtaatgcctgatgacgttaggattgaacatgttactgcactaaggtgtttgaggaaaaagttatttccggagttaccttaatttttctgtagtctagtgagtaatatccatagtgtatctggtgttgtgctactgtcgtggctaatcaatcgatgtgcagggtattctagtgttgacgttatatgtactagtatacaccatgttttgcagatgtgcttcgaagaaattcagaaattcaagacaactcaaagcatattgagctcaagaaagatttagttgaacatatatggcatcaatatggtccaaagtagtatgaatattgtaattttaatttcctcttacctaaattatatattatttatgtaaatattatgagttcagaaacaatacatctttgcatatgaaattcacatgcacaattgatcaagcatgttttaattcaactacatgtgatgcatttattaaaagacacgatcaagagactgtccattgtactatacagtctcttagttgtctcttctgctaagagacgtctctgggttgtacatgcccttatggagtgagggtaccaatttttcatagcaactttgaccaggattttttgtttggatttgtcctgctctaatgctgcatgaatcacaggccaactgctccctcttagggcttgttcgttttgctctcaatccatgtggattgggtgggattgagtgagtttcaatcccgaataagtcaaaatctttcatatttttttccaatctcatccaatccacatgccatagaaataaccgaacaagcccttatccggttgtatcttgaggagcgaggatatagtccacgcggggcgaaaacggccggagcgcaccctggtcgctcgatccggtttttttncgagccaggtccgttcttctctggcgcggatggatcgtcatggccacgggggctnagcgcagaagccatagtttcctctcgcgggcggcactttcttcacgcgcaccgagtgccgccagccgcggcccacgtgggcgcaacgagcactgttggcctcgagcttggtacatgatgtagggttgggtcttagaactctttctcttgtntattccatatgagatggtacatgttattctcttgtaacccgttattagggtttcaaggtccattggtcttggtaaaatgatgtcgctgctatttgaattatgttggcctacaaaattaggcccatacgactggagcttcaactcaactcacaacacaaatggaaggccgtctcaggcccaaacactggtaacaaagcatgaggccaatgtcacaggcagcacgtcaatctccgccccaccggccacgagcccacgagcgaccttccagcgtctctgcccgcacgcggtcacgcctataaagccttgcctcctcgctagggtttctttcttcctcccttcttacagccgccgccgccgcatcccagcctccatcaccgtttccgtctcgttgccatgggtaagccacactctcctcttcaccgttcgctgcctccttgtgcgtaagctgactgggtatgtcgcgtgcgttgctattctgcaggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcccgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgtcttttttgaacgctatccaaataaatttgaaaccagattgctgatgcgtatgtactaggttcaggtagttgtggatggaagtggaaccgatatgcttcagctattggctctatcgtgtatgccatgttctgtacgcgagcctgatatttgattgaaatgctggttccatgctaaaaaaaaaaaccacaaaaagcacgccgcgcggccgcacttcattctacaattgaaccatgaatgtcaagatggtgtttggtttccctgactatagtttagcctatgtcatcggatgtttgaatgctaataaagaatatcaaatacagtttaattgcaaaactaattatatagatgaggactaaaaggcaagacaacctattgagcctaattagtttataaatcgttcatgcgatactacagttaacattgtgctctatatattgctcttttacttaaanggttctctatatctcattcatcccaatagcatagagaacactgttcatgtgtctaaatctagactcgcgggttctgttgtttttttaactctagtctatcccaactttcagtactaaaagacttagttgtattttgcttgaatatgacggttgagtctttgttcttctacatgccgtgaatttcacactataattatctttttttattcactgtaaaacggaaacatgaatggcagcatgttatagtttctggtgagtctgacctgtgtatcagtgtatgtgacaacataatttgttgttgtatgcagttattgatctcatggtctgacttttatccatttgtagggatgaaaacaggtacccaaactattaggataaatctaatatttttaaaatagatatgtatgaaatgtgatgttaatgttttcttgtgttatctagcatattattacggataagaatatttttgcataaattattttatatattatttgctttctaacaaaaaattgaaaagttatttgtatccgaattgtataaaaaggattgaggatatgagaaattatatatatagaggattgagtagtgttccctaaatttagacgagcgtttagagttgctgtttataggtgctgaatccgtagagagatgacgagtctctaaaatttagtgtacaggagtctcatccctattcagtcgtaggtacattacttgccttgaggatactggtacttgagttagggtcgttttggtttgcctgagtcgtctgttctgtactgtcgttgacggtcagcattcagccccctagctaattgctggtttctacgatgtgtcgttgtttgttaaacgttcaaccataagctatttcccatactgtagccccgatgctacggtttcaatatatcatgatgatatgagctacaatttaactctctaagctcggtttcaatatatcatgatgatatgagctacaataaaacaattatttgctgctttaaatgctactagaattctttttaaaatagttggttttgtcaactttgggtatttcaggtaaaacccgaatccaaactcgaaatatcgtgtactcaaaattttaggtaatatttttgggacaaaaattgggtagcggtttttaatacctggatgccggatttgtatttactcaaattacctgactccgaatatttcagtaaccccccgaatgccgaggcctaggtacaaagcttcttgccttagccacaagatcacccacttggcgcccctttgttaggcaacagccgagccaaagccaatatggcttgcctagtgcc

SEQ ID NO: 12857 - DNA, 670 bp, Zea mays
ggaccctcggccggcccggccgggctcctcccctcttacagccgccgccgccgccgccgcatcccagcctccatcaccgtttccgtctcgctgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaaacgcgggcccaactcctccgagaagtaggcgccgctcggctcgtaccggttcctcatccttcccgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgtcttttttgaacgctatccaaataaatttgaaaccagattgctgatgcacaaaaaaaaaaaacacctaggggcccatggaagtggaaccgatatgcttcagctattggctctatcgtgtatgccatgttctgtacgcaagcctgatatttgattggaatgctggtgc

SEQ ID NO: 12858 - DNA, 1834 bp, Zea mays
ggtaccctcgcgggccggccgggacgcgtccagcgcgagccaggcgtccttcctttccttctccccgccgtcgtcgtgtcctcatccagccgtgcaggcagtggcggtggaccggagatctccgctccagctccgattgagcccaagagaagtcgttggtgcagacagccttggattggatgtggaatgaggcgatggcatctgacggatcatcatcctctaccttcctggggttgtacggcaacgtccacggcccggcggtgctcactggcgcggcgttcgcgctcgtggcgctcctcatctcgctctggctcatcctgcagcacctcagatcctacagcgatccagctgaacagaagtggatcatagctgtgctgttcatggtgcctgtttatgcctgcgaatcgataatctcactgtggaactcgaagctctctctggcctgtgatatattacggaattgttacgaagcctttgctctgtacgccttcggacgatacttggtggcttgccttggctcacttcttgttacatgactactacacttgaggcggggaacggcaagtgttccgtctgcttgagagcaggaagagggacgagctgagccaggagttgctagacaaggcacgagctcgtaaccgcggcggagcgtacagtttcttctgtgaccctgacgctctgggagagaacctgtacacgattataaagttcggccttgttcaatacatgattctcaagacactatgcgctctcttggcgttggtcttggagccttttggagcctatggagatggcgaattcaagtggaattacgggtatccttacattgccgctgtcataaacttcagccagacatgggcgttgtattgccttgtgaagttttacaacgcgacgcatgaaaagctacaggcgataaggccactagccaagttcataagctttaaggccatcgtgtttgccacttggtggcagggagtcggcattgcgatcatctgccaaactggactcctgcccaaagagggcaaagtgcagaacgcgctacaggacttcctcatctgcatcgagatggctatcgcagcggtagcgcatgcctacgtcttcaccgtggagccgtaccagcacgtccctgctctacctcctgatcacggggaagtcatgtgtcaggaaagcaaaatggaggtggaggtggatgtcgtcgacgacgatacaggcggtacaccagcttccattgcgcagcaggagacccatgtcgaagctccaggagggacgagcatcaaggagagcgtgcaggatgtcgtcctccgcggcggccagcatgttgtcaagggatgtcgcgcttacgatctcacaagcgatcgggcccgtggagaagggcgtcgggaagatccaggagaaattccaccacatctcgctgaagccaggggacaagaaagagcctcaagttgctgtggaggagcacgtaactgagaacgtggtggatgccaaacctgctgttgcggtcaacgcggaggttgaagtccaacagaaggcgcaggatcgtcgtggcgaggaagaaggtgtgcaactcaaaagaacagagaaggacgattgtcacacctgagagtgccatggtggaagatgcagaggaagcgggagcaagcggagtcgaaggctgaagctgtgcgagggccggacgatgaacaggggtgagtgtgttggcctgcacctgaatgggctgtaagtggtgtgtggatgaattgtgtagtgtgtcggcccaacagggtcagttctggtgtttaaaggagttgtaacagacttaagggagaaattaagaagaaaatagagaaaacttact

SEQ ID NO: 12859 - DNA, 930 bp, Zea mays
gccggccgggccgggctggcccggcccgggctcccaactctagtatatattgctgttttgctaccctaccctcgctctctctctcctctaccccttttcctctaacctttagctttcctccctccctccctctcctctctcctctctccccctcctctaacaagaactacgcccagccattcagatcctaagttgctgaccttgctgctgcttgttggagatagatttgttggttctaagttcgaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaagaacactggcagatccaagggctacggatttgttaccttccgggatccggacgcggcgatgagagcttgcgttgatcccgcaccggtgattgatgggaggagggctaactgtaatcttgcttcccttggggttcaaagatctaggcctcctacaccccagcatggaggagctagaaactttagagtaatgaaatccttcaaccagcaggcaggaatccaaggtggactcggcgcagcttttccttctcatgccaccttccctcattatgccatcccacaaggccttcccttccatgtctatgggtactctccatataccccagactatggttatccaacaaacttctacaatatatatggaggagctcagtacccgttttatggaggagcaacagctggcatggtgacaggaacaagtcccttttatccatatttccaatttgggcagtcaggaaacactactaccaactataccagtggacaagggctacaacttgcaacaatacccacaaaatgtccacttctca

SEQ ID NO: 12860 - DNA, 3072 bp, Zea mays
gatcctctatagtcgggagagaggaacagctgacgaaagaaaacagtattcagaatattattcttcatgccttttgcctgactttgtactatattaacaccgaccactacagttcaatcgttccagcttccagggaggataacttcagtactgcaatcaccaccaactatataaaaaaaatgaacgggaccacatttctggagaaacatcacatgacattgttcgtttcaccaagcattaattcttcacggggattctggacaaattcagggcacacacagcaaaacagtgcgccttgtccaaaatggaagctaatcgacctaaaccgcattcacacctcagtctgctaaattagcaggcaatagccgccccacacagcgatactatcctctgagaactttcaacagattagactgggacattccatccttcttgatttacgactgtctctaatcacacaacaaaactataaaaaattgtaacttaacttatttgtccccaatacaatccgttggagcccactcacccatcgcagattggctatattatatattaataacaaaaaatacggcaaatgattttatgcataatcacccataggtatgcacttccactgttagtaatataaatataataaagctttcgtgccatataccttagcataatgttctttttgtatattctcctatattcgccaggtaagaaagggacgcctattattagtcagcagcaagacattgcatggataggtacgtatactacgtacacgtggccacaccgtcaaaaaggttatatcgttgctgtttttgagggatgatcgagctatggaggatgttattatcagagatggcttataatataaacaacgagaggtctagagttaggagctaggaggcaaaagctatggggctgagtccttatcaagcgattgagcagatcccaaccacaccaaatgggcaagcgtctccagccgtccatctccagatcagacctgatgacacatcacgcatctcccttctgtttaccagtgctaggcaacccatatcaaatatcttcacttctaaagaatgcctttgtgcattattgatgatgtactatgcaaaagtctccggcctccaccacagcatgtcgcactcactcaagtggactaggatcacaaatgctcacaataacatcagatcattgatctagcctctagcgtttttattcgctgtaataaatggcttcaaaacattcaaatttcacagatgggccatggtattttctaggctataagaaacaagggtataaaggtcaaatttaatcagctaatcatcaaacttttttgcacagcaaatacaggtggtctcttaaccacctagagatatggtttactaacagtatatagtgccttaaaaataccgtgctatcaccaactatgccccgctacaacagcaatagaaataagaaccgtgttaataagtaaaaattcattaaatatttttcctcacgttataaagccgtggaactgaacaattagcaaagctcaaatgacaatcaaaatccaaatgcaaaaagaacaacacatgttaagatccagataagttcggaaagaatcctcctaagctccataatcccgttggactaatccccagtccccgccatccgttgtgtttctaccactctacagacaaggacagcccaacaccaccctgtaactactgttcactctgataggggcagcacggccatttttacctactattggcgggccggccgggctcccggtgcatggtattttaatatgagcgtgctttggaccaaaaggacctcgctggtgcattatagcaaacactagtatatattgatgtttctgtacctcgcccccgctctcctctaccccttttcctctaacctttagctttcctccctccctcctctctttctctcctctaacaagaacttagtcccggcagttcagatcctaagttgctgaccttgctgctgcttgttggagatagatttgctgcttctaagttggaaataccatgagtccaccgagtgtgatggggcagtttggggacacgacctacaccaaggtttttgttgggggactcgcgtgggaaacccagaaggagactatgaggaagtatttcgagcagtttggagagatcctggaggctgttgtcatcactgacaagaacactggcagatccaagggctacggatttgttaccttccgggactcggatgcggcaatgagagcttgcgttgatcctgcaccggtgattgatgggaggagggctaactgtaatcttgcttcccttggggttcaaagatctaggcctcctactccccagcatggaggggctaggaactttaaagtgatgaaatctttcagccagcaggcaggaatccaaggtggactgggcgcagcttttccttctcatgccaccttccctcattatgccatcccacaaggcctcccctaccatatctatgggtactctccatataccctagactacggttatccaacaaacttttataatatatatggaggacctcagtacccattttatggaggaggagctggcatggtgacaggaacaagtcccttttatccatatttccagtttgggcaatcaggaaacactactaccaactatacaagtggacaaggctacaacttgcaatacccacaaatggtccacttctcaactgtatcatctacagctgcagctgtgaacggctttgctcagcagtatggaggaccattgtcactagcagcaagtcctcaagcccaagcagtgtgtatccccattaaacaggcatgactatggcactcgcagctccaaccatgccaactccaacacaggctgctcatccttaccggttgattccctcagtgtccactgctccagagcaacccttggcctaaccatggtctcccttctcgtcgttgctgtactgtctcggttccaacttgtcgagtccatgcatccatctctaacaccaaaaggcactattgtagatcatgtttatcagccaaagtgctcacatccatatcccacatggtcatgtggtaactgg

SEQ ID NO: 12861 - DNA, 1070 bp, Zea mays
  misc_feature (1018)..(1018): n is a, c, g, or t
gcggcgctcgaggcggccggttccaactcgcgggtgcattatagcaaactttagatacattgggttccgcccgcccggccgcgctctctctcctctacctccttttcctctaacctttagctttcctccctccctctcctctctcccccctcctctaacaagaactactcccagccattcagatcctaagttgctgaccttgctgctgcttgttggagatagatttgttggttctaagttcgaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaagaacactggcagatccaagggctacggatttgttaccttccgggatccggacgcggcgatgagagcttgcgttgatcccgcaccggtgattgatgggaggagggctaactgtaatcttgcttcccttggggttcaaagatctaggcctcctactccccagcatggaggagctagaaactttagagtaatgaaatccttcagccagcaggcaggaatccaaggtggactcggcgcagcttttccttctcatgccaccttccctcattatgccatcccacaaggccttcccttccatgtctatgggtactctccatataccccagactatggttatccaacaaacttctacaatatatatggaggagctcagtacccgttttatggaggagcaacagctggcatggtgacaggaacaagtcccttttatccatatttccaatttgggcagtcaggaaacactactaccaactatacaagtggacaaggctacaacttgcaacaatacccacaaatgttccacttctctcactgtatcttctacagctgcagctgtgaccggctttgctcagcaatatggaggaccattgtcactagcagcaagccctcaagccccagcnaggctggtctccccctctcacagctttcaccctgccaactccaacacaggct

SEQ ID NO: 12862 - DNA, 4044 bp, Zea mays
  misc_feature (1047)..(1047): n is a, c, g, or t
  misc_feature (3533)..(3533): n is a, c, g, or t
ataaagataattcaatttacaattgtttctattttcatgcaaggacaaattttttatatctattgatataaagacaaataacaaattaaaaagtaacaatttacttgtattgttggtggtataagagtgttgcatggaattatgttaaaatccagacatctaaaataatagaaagatgtgctattttatagccacaattaaacataccgtgcattgtttaaatttttacggtgtcattttagtaaaaactattagagctggtttgatgatcatagaattgaaggtaattgacggggaggaaatctcttactattcaatattttgaatagcaaaggatttcctcccccacaatcttcccaattctctagtcaccaaacaaatccttatatgaatctctccacccttcgacgacttttattagctctgttgtatactttttatgagggagaaaagaaaggtgaatgagaagttctaaaaatctagttagaaaactgttggataagtcttttcactaaaatctctatcattatcattaccataaaacacgagtttattcgtgtgtctttcgctcgtccaccaatgaaatatataaaaaatatcacttgttgaggtttaaaccgtgatcactagtaatagagcacgcatctaaactacagatcatgttggtttgtgttatataaagaaactgtatatgatatatagaaatcttagtgatgcacgaacaactgacaatttaaagtacattgaactactggtaagcgttagcgcccgtctaaccagccgccgaacattgttatcccagccaagaaagctctgcgacgtcactgatgacgttctacagtctaagcgatgcaagaccttacgtcatgaggacaatttggacttacagaaaagagaagttaatattccacacgtactgatcttctcgtggtagacaaattctgcttcatcgtcatctcccgactcccattggtgtgcagcagtgacagtcatggtaccattgtctcatggaccagtctgcatcagactgcaacaaatgtcgtgtanacgtgtaggcatacgcagtgcacggtcactgcacctgcatatacaggggctaccgcgcggccgcccgggacaaaagctcatcaacaaagcctgatacgtaactactaggccgatcggccatccacagacccgtcttaactctacctgcctgccactatactatcagcctgtgcgagcgagaaatggacagagccgccaagcctcacttcgcgctcatcccattcacaggaaccatcagccacgtgatccccatggcagacctcggctgcctcctcgcggcccacggagccgaggtcaccatcatcactacgcccgtcaatgcagcgatagcacagagccgtgtcgaccgcgcacagtcacacggtgccacgactacgatcacggttaccgcagtcccgttcccggccgcggacgccggcctgcccgagggctgcgagaggatggacctgctccggtcccaggccgaggtgcctcgcttcttcgtggccaacaaaggcttcggtgaggcagtgtcgcggcactgcctcggcgaagcgctgcgccgtccgagctgcgtcgtctccggggcgtgccagacgtggacgctgggcctggcgcgccagcttggcgttccctgctacgtcttccacggtttcggcgccttcgctctgctctgcatcgagcacctgtacaggcacaggccgcacgaggctgccgcgttggccgacgacgagctgttcgacgtcccagcgctgccgccgcctttccggctcaggctgtcgcgtaggcagctcccgccgcatttcatgccgaccacttccgtcgccgggaaggcgctgcaggggatccgggatttcgacgtggccgcggacggcttcgtggtgcacaccttcgaggagctggagagcggctcgacggcgctactcgcggaggcgacgggcaaaaaggtgatcgccgttgggcccgtctcgctgtgctgcgcgccaagcctggatcctcggctcgtgtcgaacgatgatgcgaggcgatgcatggcgtggctggacgccaaggcgcccaagtccgtggtgtacgtgagcttcggcagtttcgggcgcatgccacccgctcagctcatgcagctcggcatggcgcttgtcgcatgccgctcacctgtgctctggctcgtcaagggcgccgactccctgcccgacgacgtcaaggattggctaagagagaataccgacgcagacggcgtcgcaggcagcaagtgtctggtggtgcgcgggtgggcgccccaggtggccatcctggcccatccggccattggcggcttcgtgacgcactgtggatggggctccatcatggaggctgttgcagccggtgtgcccatggcaacctggccctttttcgcagagcaatttatcaacgagcagctcatcgtgcacgtgcttggcgttggggtgtccgtcggtgtgacgaagccaacagaaaatgttttgaatgctactactgacgccgccggtggcagccaaggggaggctgatgccgaggtggggatggaacaggtgaagaaagccatggatacgctgatggatcaagggcctaaaggggaggagaggaggaggaaggcccatgagctgaaactgaaggcgaagagtgctttggagaagggaggatcatcctacactaatctggataatttgatcctgtcttttctttgaatgtcaccatgtcttacttttgcgtcccagcatacatgttttgtttgcctctgagtgtcatactatggagatttatttactctttatttattattactatggtcatttgtttctgtcgagtaaagttattgtattctagaccaaccggtgctcctcgatgagcatgtaattctaagtgatatacggaatatgggttcgtggataaatttaaggacaaataaattaaaggtttttcttatctatgactctcccctttttattcataatctgatatttagctggcataaagggtgaagggaactatgcagttggctttaattattccaaaaaaatggactagcctaattcatacccctcttggacatcttttcaaccttgagactatatgattttgttttcctctttcttctttttcaaaaaattgaacacttgattatcacatctggccatctgttatcatctccatgtgttgccatttttcttaaccttgctgtggacttcacctatctaaatcaaaataatagagtaaaagttagcccactattattcaactacgaaaaccaaatatagggctttcagggaggtgtcatgtggcattccgtgagtgggcgagctagaacaaacttttgtgcgctttaagttgagccccgaagaatagggtcattgtggtagccttgtgcgcgcacccaaatttggatgctgaccctatttgagtggtgatttttttcatcaacacatacatttacctatggcgggtcaagtagggtcctactagagttgctcttacaaataaggattttaggntgtaaggtgaaccattaaattatgcaccatggtgctcaatattgactctagagtttcatgtgagatctaggagaggaccaatgttgctaacctcaagacaatattattttttctaagcataataatcactttttactctaaaggaactttaaaaaccagggggcattagcagatttagtctatactaacctcctctattgccttagatgttgaaattcacctacaaattaactctactagatcaggaggcgcacttcgtgcgccctgcagtaatcatggctattatgaggcaagtggtttgtcgatcaattctttttattataaccagaaccagcagactctgaatgatatattcttttttctctcagcacacattttattaatctaagaaattactgtctcgaccatttctctggtcaacatccggagtgagattaaattctgtatctgtgttgccatatgcaacatcagcaggacgacaaaaacgccatgaacaagtaccagcaccgtt

SEQ ID NO: 12863 - DNA, 904 bp, Zea mays
cattgggtacctcgaggccggccgggatctacgaacgggggccgggaaaagatcggctacagacagatgaggctctgtctccggcaagcggcggccaccagctcacccctcgcagctaccctccgcggcaagacttctacgagcaccctcgccccccatggccggctcagcttcagccacaccacgtcgctgcagacggcgcccgggcaccgcgggctccgagcagggtgggcggtgcgcgtgctcccgctgacggaggagaacgtggagaaggtgctggacgaggtgcggccgagcctgatggcggacggcggcaacgtggcgctgcacgagatcgacggcctcgtcgtcgtgctcaagctgcagggcgcgtgcggctcctgccccagctccaccatgacgctcaagatgggcatcgagacgcgcctccgcgacaagatccccgacatcctcgaggtcgagcagatcgtcgacaccgagaccggcctcgacctcaccgccgacaacgtcgacaaggtgcttgatgagatcagaccgtacctctccggcactggaggtggaagcctcgagcttctccagattgacggatacgtcgtcaagatccggatcggcggacctgcagccggtgtaatgacagtacgagtagccgtgacacagaaactgagggagaaaataccttccatcttggctgttcagctcacagaatagaaatgcgagagctcacttgtgcatcatcacgacgaaactctggctttcaggcgaatgtgcagtgttcatcagtcttatatttctgtccttacagtacgtacagtgagttgcagaactgattaatacaattttcatgcaagaattctgccttgaccaaacaaaaatcttagctctgaaagataatcaatagcttcta

SEQ ID NO: 12864 - DNA, 2301 bp, Zea mays
  misc_feature (2291)..(2291): n is a, c, g, or t
  misc_feature (2298)..(2299): n is a, c, g, or t
gattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttgggcctagttcctattggagatcagtgaaggttggttgggatgaatcaaccgcaggaagaaaggccacctagagttttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtacttcaaaaaaaaaaaaaaaaaactcgagggaaaaaaaaaaanaaaaaannag

SEQ ID NO: 12865 - DNA, 2992 bp, Zea mays
  misc_feature (1189)..(1189): n is a, c, g, or t
  misc_feature (2809)..(2809): n is a, c, g, or t
  misc_feature (2826)..(2826): n is a, c, g, or t
  misc_feature (2829)..(2837): n is a, c, g, or t
  misc_feature (2850)..(2851): n is a, c, g, or t
tctctttccccccaacagaactccttgttctcctttatgtcacaagctcataaaatcataataacctctaccgtcttacacattgggttactctcgtcattctttcagactgaataattttgataccacaaagtgtcccctaaccactatgtcactgatattattagcacaggttggctgggatgaatcaacagcaggagaaaggccacctagagtttctctgtgggaaattgagccactgacaacctttcctatgtatccatccctcttcccactgcgagttaagcatccatggtattcaggagttgctgctcttcatggtacacttcaaatactcatgcttgttgctatcacgctgagtgcagcacctctggtgttgtggctatttacatgcgttatttctgttactgctacaaagtaggtactcatagcgctgccagattacactgaaagcagccagcaagaacaatagtttttttttttggagtagaagcctgtttatatcagctactagggaaaaaagttacatagatgcttttagatccaacaattggctcaggaaacttgatatgatgatgagttgttgacctcagccgaagtaatctggcagttcagtgactgaggttttgttatttccatcttgcttcaatggaaactagaagtaaaactgctgtacaactaaaatatggatatcttccaagggcctgtttggacccacagagatagtagtttgctgctaatattagctcctttggatacaaacaggcctagctaatacttaagtttattgttagttgaatacccaactaacatatattttactagttgaaccaaactagctagtagcaggtaatattagctaaaaaaggacggaccagtgcccggaggctcccactttgtgtgggtcatggggaaggacaggaccaaaacatctatgccaaattggcagcattgagggaggcaccatggtagaacgtgctatttcatttatttgctgaagcttttcatttatgtgttagacaacttgtgtcattattgtcattgcctttcattctgttattatgcctttattgattgtaatattacacttaagatgacagcaatgctttgatgtggctgagaggagttgctggtgaagggggctttcagtctttaaacttccagtcacctggtgtaggttcctggggancaacagagtctccatccttcctttcccagcaatgaccatgatcagtcctcactagtccccccccccccccccgcttcccaatcggatggttatccgaagcagcaattcctacaccttcaacaacctatgcagtccccacaggagcagtgcaatctcaatccgctgttgcagcagcaaatactacagcaagggagccaacagcagatggttagtcctgatgctcaaaatatccagtccgtgctcaacccaaatgctattcagcagcagctccaacaactccagcagatgcagcatgctcataatgaccagaagcagaagattcaaccagatcagccgtatcaagttcctagcagtgcggttctctcgagtccaacatcattaccaagccatttgcgggaaaaatttggcttttctgatcctaatgtcaactcttccagcttcatcagctctagcagcaacgagaatatgctggaatcaaacttccttcagggaagctcaaaatctgtggatttgtctagattcaaccaacctgtagttagcgagcatcagcagcaacaggcatggaagcaaaagtttatgggctcacagtcgatgtcttttgggggctcggtttcacttaactcacccactaccaaagatggtcctgttgacaacaaaattggtcgtgatgtgcagaaccagaccctttttagccctcaagttgactcttcctccctactgtacaatatggtacctaatttgacctcaaatgttgcggataataatatatcaacgattccctctggatcaacatatctgcaaagtccaatgtatggttgtctggatgactcttctggtttattgcaaaatacaggagagaatgatccgacaactagaacattcgttaaggtttacaagtcaggatcggtggggagatccttggacatcacccggttctctaattatgctgaacttcgagaggaactgggtcagatgttcggcattaagggtcagttggatgaccctgatagatcaggctggcagcttgtatttgtcgacagggagaacgatgtgcttctccttggagacgacccatgggagtcatttgtgaatagtgtatggtacatcaaaatactttcacctgaggatgtgcataagatgggaaagccaggaaacgatccacgctacctatcttaaattgatacccagagctctttcgggctcccgtgacgattctgtggcacactgtagcactgtccatggcggtccggtgtgctgtgctcgcatgttcgccggtgtcacctctagcatgtgcaccgtgcgcgtcttcagaactcccccgttacttgtatccggtgcaggccaccgctctggactgatgtcttgtaggttccacttaggaatcagtatcagcgactctatcctagttggtttgtagctcgcacggcactcgttcttgtgtcgcatcgaaatcttcaggctaaatgcttagttgaaactgttcccgtgattcttaagctatctatgtatttgaggattcccctgcatgctttcgacgatgaactgcaataattcgaatgcaggaggattgtttgaatgcggggggaaaggagtttaaaaaaaaaaaaaaaaaaacccccnaaaaaaaaaaaaaaaanaannnnnnnnnagggaaaaaaaannaaaaactcgagggggggccggaaccaattcgccttaatcccggcgggggccccgcacccccggcccccttaggggggggattaaaattcggggccgggttttaaaacgcggggaggggaaacctgggggttcccaattaag

SEQ ID NO: 12866 - DNA, 750 bp, Zea mays
  misc_feature (23)..(23): n is a, c, g, or t
  misc_feature (44)..(45): n is a, c, g, or t
aacttttgttaaggtttacaagncaggatcagtggggagatccnnggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtacttcaaaaaaaaaaaaaaaaactcgagg

SEQ ID NO: 12867 - DNA, 3210 bp, Zea mays
aattcggcacgaggcttccttctcctaccccccacaccctcgcccccccccgctcccgcccgccgccccctcctcctcccagtccgccccacccttccggccctccccctcttttatatccagtaccatggtgatctccgagctcgggtgagctgatgagaatgcggccgatttgaggaaggcggtgggcgcgatggatgcggtttcgggcggattcgcgaggaggctgtagaggttaggttccggtgtcccccggcccggccggtcgtgggagatgagctcctcgtccgcggccagcatcgggcagccgccgccgcccgcgccgccgccggaagaagagaagaagtgcctcaactcggagctgtggcacgcctgcgccggcccgctcgtctgcctccccaccgtcggtacgcgcgtcgtctacttcccgcagggccacagcgagcaggtggcagcgtcgacgaacaaggaggtggacgggcacatccccaactaccccaacctgccgccgcagctgatctgccagctccatgatgtcacaatgcatgcggatgtggagacagacgaagtgtacgcgcagatgacgctgcagccgctcaatccacaagagcagaacgacgcgtacctgcctgccgagatgggaatcatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttccgaggccagcccaaaagacacctgctgacgactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaatgctcactagtccccccccccccccccccgaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaaaaaaaaaaaaaaaaaaaaaaaaaaaaaaaaaaaactcgagagggg

SEQ ID NO: 12868 - DNA, 970 bp, Zea mays
  misc_feature (17)..(17): n is a, c, g, or t
  misc_feature (24)..(25): n is a, c, g, or t
  misc_feature (30)..(30): n is a, c, g, or t
  misc_feature (933)..(933): n is a, c, g, or t
  misc_feature (941)..(942): n is a, c, g, or t
cccactcaatacctccntaggcannggtanctgcagtacggtccgattcccggatcattatgcggcactgctggtggctcaaggccaaagggcaagcattggagatgtattcctgggcatcagatgtttcattccatgacaggaggataccaatacctgtttttgacatgtatggaattggagcacggaaaacttctgcagttcctaatatcttgaaggaactcaatttgaagattggcaaattgtcgactggggattctctggatatgtctccccaggatgagaaggtgatactgagcaatgatgctacagtaaaggatatggagggagctgctgtggcatatgtcgccgacatgttttcaacgccagcgatctttgtgaaagccgtgactgatatcgtggatggggagaagccaacatctgaggagtttctgcagaacctgattgccgtgacggcggcactggacctggcagtcaccaaagtggtggatttcatcagcgggaaacgcatctctgatctttgaaggctgtcatgaaatccgacacccccactgctctgatgcacgatgctaggctacgaacaatacaacattgggtcaacgattttttgtgaggtgttttctatgtgaggttaaaccttcttaaccctgtgtacaaaattcctgccaattgctatgggccggccatagcgtggaattttgtagaataatttgcaaaatgtattttgtggtgcaaatatcgatatataataatatgctgggggacgggatccccgtgggattagatgaaaaaaaaaaaaaaaaaaaaaaaaaaaaaaaaaaaaaaaaaaaaaaaaaaaaaaaaaaaggcttgtcaaaaaaaaaaaaaaaaaaaaaaaaaaaaaaaaaaaaaaaaaaaaaaaaaaaaaaaaaaaaaaaaaaaaaaaaaaaaaanaaattttnnaaaaaaaaaaaaaaaaaaaaattttttt

SEQ ID NO: 12869 - DNA, 970 bp, Zea mays
tgcaccccctgcaccaggcaagctgccccacctccgatgggagcaaatccaccaccaccaccacccccagcagctccaatccctccaccaggcactgctccatcaaggatggagctcagaactatccacctggtgtaacaccaccaagttctggctcatccactcaccctgttgcaacatcagtatatgcatcatctggtgcaccaaatgcaccatcgatataccctccaccaccttatagttattcctcatactaccctccaccatttcagccaccacctccaccaccaccaccaccggctagtgttgatccctctcagagtattgcaactgcaccttggctaacccacagtgtggtggtgccaccacccacccacgagtgttgatccttctcagagtatttcaactgcaccttggttaacccacagcgcagtgccgccaccaccaccacctttgtcctccacaaccgaccagtctactgcttcctatggtgccgatgcagagtatgacaagtttatgtcagagatgaagtgatacgagcgaagctggatgattcttccaatgaagggcaaaaggcttgatctttcttggagcttataccaacctgatttatttcttgttggaagtttcggactcacatcttaaccttgctgtgtgctgttgtgaccgttgcagaggttgcatgcttaagaaggcatcaagtattactggctcagctggcatcagaatatttgctcatcttcttggaactattttaaggaatcttttactaatgcttttgttgtgatgtctattcttgttattatttgagattactctgtgttttcactttaatgctctgttctttgtgacatgtgttaatctcactttattattcatataaaaaaaaaaaaatcttgatttggtagtgcaaaaaaaaaaaaaaaaaaaaaaaaaaaaaaaaacaaaaaaaaaaaaaaaaaaaccaacc

SEQ ID NO: 12870 - DNA, 4885 bp, Zea mays
agcttaacaaagcccttaccaccggcttttagatttatattttatagaattagaatgagcttttataggtcaaatctgaaaaccggtctaaatattacttttttgttttattactttccgaaatttgtttaagttttcgtttgaaatccgttgcagcgttttcacatttcgtttcagcgaaaactcgtcaaatagaaaaattggcatcaaaatttttcgaaatctcacaattgggccttctccgataagcgataaccgtgccgaccccgtggcccgcccccgaactttccatcgaccttttcacccctaaaaaaaaccgagcgattccaaatcagactgccttccggttccccatctcccctccctcagcgcagactcagccatggcttccgccgaaaccctagcccgctccccctcgcgcgagccttcctccgacccgccccgcgccggctcttccgagccccaccacaacggcgccggtgactcgtctcgccgccgccgccgcagccgctgggagcagtctaacgacgactccgccaacaactccggcggcgagggcggggccgtgggccggaagcgcaaaacgcggtgggccgaggaggagccgcgcccagccatcgcgctgccggacttcatgaaggacttcgccgccgagatggaccccgaggtgcacgctctcaacgcgcgcctcctcgacatctcgcgcttgctgcagtcgggcctcccgctcgacgaccggcccgagggcgcgcgctctccgtcccccgagcccgtctacgacaacttcggcatccgtataaacacccgcgaataccgcgccagggagcgcctcaaccgcgagaggcaggatattatctcgcagctcatccgccgcaaccccgccttcaagcccccctccgactaccgcccacccaagctccagaagaaactctacatccccatgaaggagtaccccggctacaactttatcggcctcatcattggccctcgtggcaacacgcagaagcgtatggagaaggagactggtgccaagattgtcattagggggaagggtagtgtcaaggaagggaagtttctgcagaagagggacctcaagccggatcccagtgagaacgaagatctccacgtgcttgttgaggcagagacgcaggaggcactcgatgcggctgctggtatggtggagaagctgctcaccccggtggatgaggtgctcaatgagcacaagcggcagcagctccgggagcttgccgctcttaatggaacaattagggacgacgagttttgtagaacatgtggtgaggctggtcacaggcagtatgcttgccctaacaagatgaacacgtttaagagtgatgtgcagtgcaagatctgtggggatggtgggcacccgactattgattgtccagtcaagggcacttctggtaagaagatggatgatgaataccagaacttcctggctgagcttggtggcggcagtgcacctgagtccatgaacaaatctggtggtccgatgttggctcttacaggaagtggtggtagcggtggtgcttctgctggaactgggagtaacccgccttggtcggccggtggtggtgccgcttccactgggctcaatggtatcaagaaagattatgacgagacaaatctttatattggatacctgccacctacaatggacgatgcaggtttagtcagtctgttttcgcagtttggggagattgtcatggctaaggtgatcaaggatcgaaacactggacagagcaaaggatatggatttgtcaagtattcagatgtgtcacaggccaatgcagcgattgctgcaatgaatggtcaccatcttgaagggcgagttattgcggttagagttgcaggaaagccgccacagacagcaccagcagtgtcagcacccccatcatatcctcctccggatcctacttcaggtggctattcctcccagtcctacatgggggcaccaccacctcctcctccagggagttatgctccagttccttgggggcagccgccaccatatgcttcatatcctccgccaccaccaggctctggtgtctacagtcctgcaccccctgcaccaggtcaagctgccccacctccgtatgggatgcaatatccaccaccaccaccacccccagcagctccaatccctccaccaggcactgctccatcaagtgatggagctcagaactatccacctggtgtaacaccaccaagttctggctcatccactcaccctgttgcaacatcagtatatgcatcatctggtgcaccaaatgcaccatcgatataccctccaccaccttatagttattcctcatactaccctccaccatttcagccaccacctccaccaccaccaccaccggctagtgttgatccctctcagagtattgcaactgcaccttggctaacccacagtgtggtggtgccaccaccacccacgagtgttgatccttctcagagcatttcaactgcaccttggttaacccacagcgcagtgccgccaccaccaccacctttgccctccacaaccgaccagtctactgcttcctatggtgccgatgcagagtatgacaagtttatgtcagagatgaagtgatacgagcgaagctggatgattcttccaatgaagggcaaaaggtaacttaacatgatctgtctctgttctattaatttcggtaggttcagttgggtatggtttgctattttattgacaaggaaacccatgtttcaattattccgtgtgttttattatttatattctatatactactgtacttatatttgatcattgtgctgatgtaccatatagttatatcttacacgttgtttggttttgacttagggggtgtttgggactgctccagtttcctgcttcatagtggagctgtggtttataatataaatttaaatagtttaaagatattttaaatgttaataataaacaaaatgacttatctaaatgtcctttataggttcatagctccaactccatggtttcctggagcactaatgacctgctccaccaactctaccaaattttctggagctgtagcagtccctaacacccctttaatgagtctacactgcaagagtttcttggagtctatattgtgccatagttatttatttttctttcaatatcttatggtgttatggattttcatccttttgctagaggtattgtttttgtattaactattaaagcaaacacatgtattgtctcactgaggacgcttatttatgataatatcttattgttaaaatgaggtcaggactaacatgctcatgcttgtcttagatggtaaggaagtcagtagaactcgaagacaacatttcttttgatagcatatgatattatcagattatttttattgagaatgcctggattttttgggggatctgatatatgatgcactttctcaggcactgcggtttatacagaattgttttttagactatgtgctttatgctcccaccccctctcttttccatacaaaatgcttggtatacttattatacctcaccttttctatgttgtcttgacttcttgacaggcttgatctttcttggagcttataccaacctgatttatttcttgttggaagtttcggactcacatcttaaccttgctgtgtgctgttgtgaccgttgcagaggttgcatgcttaagaaggcatcaagtattactggctcagctggcatcagaatatttgctcatcttcttggaactattttaaggaatcttttactaatgcttttgttgtgatgtctattcttgttattatttgagattactctgtgttgtcactttaatgctctgttctttgtgacatgtgttaatctcactttattattcatatatattattcttcatcttgatttggtagtgctagcactcctctccatctggagcagaaaagcctgctgctccgtgctggttggtataacttcaaaaatttaaatgcttgtttggtatcttctgataatctgtcatgcttttctttcttacgtcttcaccttagttggttggcagttgtcgtgacagcttggcacaggcagccagagtttttagcacgtgatgaatgaatatcaggtataatggaggtgctgtgaattgttctgtgaacccaatgttttcatttggtttctgcacaattttctactgacaaacagtaacgagtttcccatttggtagttgatgtgtgtgcattagggtaaccaagcatgcacgcatgctggaaaaaaatctttgatgaagagcttacatatatattttgcattgctaatgctcttttaacatcattggaatttttgtttgcggttcaagtaggacatgctggcgtgcagatctagtctggagtcctatgctcaaggtgcatactgtcacaatgatatttgtgagatgaactgaaggtttggaggttggctcagattagattttgctaagtaaagtaggatattaccataatcttgtcctagtgaaataatgcgatagtcagtccacaaccagcattaagtacctttatcacgttgcatatatatcagtttgatgtgacctcgtatctagcattagccacctcaatttgcactacaaattttattaagccttcgatttcttgtatgaaaatgcttgagccaacctggattactggttgcagcaatgaggaatcctaaatcaagtttgtcagctgagtgcacacaattattatggattaatatactttattctgggcttgtttcactgttttcaattcatccaattaatcgtgattaatcgtccaagtcagtttggacaaatcgcgattaattgcccaagtcatctgactaatcgtgattaaacgttcaagtcggtcagctagaatgacca

SEQ ID NO: 12871 - DNA, 1908 bp, Zea mays
aaaaaaaaaaaaaaaaaaaaaaaaaaaaaaaaaaaaaaaaaaaaaaaaaaaaaaaaaaagctgactggcggaaacacaaataatagaggcagaggcagagccaagacggttccgttcagtggctggcggcgcatagatagatagccatggcgaagaagctagtggaggaagcgctcctcgcagcggcggacgagcacgaggaggagaacctgagcgtgcgcgaggagctgaagaagcagctatggctggctgggcccatgatcgccggcgcgctcctgcagaacgtgatccagatgatctccgtcatgtacgtgggacaccttggagagccgcccctcgctggcgcatccatggccaactccttcgccaccgtcaccggcctcagcctgctgctaggcatggcaagcgctctagacacactgtgcggccaagcgttcggcgcgaggcagtactatctcctgggcatctacaagcagcgcgccatgttcctgctgaccctggtgagcgtccctctgtccgtggtgtggttctacaccggcgagatcctcctcctgttcggccaggacccggacatcgccgcagaggccggcacctacgcccggtggatgatcccgctgctgttcgcgtacggcctgctgcagtgccacgtccggttcctccagacgcagaacatcgtggtgcccgtgatggcgagcgccggcgccgccgcggcctgccacgtcgtcgtctgctgggcgctggtgtacgcgctcgggatgggcagcaagggcgcggcgctcagcaacgccatctcctactgggtcaacgtggccgtgctgtccgtgtacgtgagggtgtccagcgcctgcaaggagacgtggacgggcttctccacggaggccttccgcgacgcgctcggcttcttcaggcttgcggtcccgtccgctctcatggtctgcttggagatgtggtcgtttgaactcattgtgctcctctcgggccttcttcccaacccaaaactggagacctccgtgctgtcgatcagccttaacactgctgcgttcgtgtggatgatcccctttgggcttagctcagctatcagcactcgcgtgtcgaatgagctgggtgccgggcgtcctcgagccgcccgccttgcggtgcgtgtcgttgtgttgctgtctgtcgccgaagggctaggcgtgggcctcatcctggtgtgcgtgcgctacgtctggggccatgcctacagcaacgtcgaggaggtggtgacgtacgtggccaacatgatgctggtcattgcagtgtccaacttcttcgatggtatccagtgcgtgctttcaggtgtggctagaggctgcggatggcagaagatcggtgcctgcatcaaccttggcgcctactacatcgtcggcatcccctctgcttacctcatagcgttcgtcctgcgtgtcggtgggacgggactctggttgggcatcatatgtgggctcatcgtacagctccttctgctcgcgatcatcactctctgcaccaactgggatagcgaggcaacgaaggcaaagaacagagtgttcaattcttcctctccagcatccggaacgtgaacgcattggcggtgaagtaaacggcgagcaaacacggaaactataggagttatgcctgtagttttggaaacttcagcacctctgatcctctctgattttctggctcccacattaactctaatggttagcattgacacttgcagtctggattttgaaacataaatgcgttccttgaacagagtagaggaagggaccaatggaaaacttatacaatagcgttagatcgcaaaaaaaaaaaaaaaaaaagcggccctcatcacacaacaaaacgtgggtaattccaagaccactttttcggtgcaaaaaaaaaaaaaaaaaagcggcc

SEQ ID NO: 12872 - DNA, 1542 bp, Zea mays
gcacgagaccattttgggtacctcgaggccggccgggaagagctcgagaccgacaggacgagactcgcagctagctgacacggccgagaagcagcttgcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatcccccacgcgcccgacgtcgcctccaccctgctccgcacccacttccacgactgcttcgtcaggggctgcgacgcgtcagtgctgctcaacgcgacgggcggcagcgaggcggagaaggacgcggcgcccaacctgacgctgcgcggcttcggcttcatcgaccgcatcaaggcgctgctcgagaaggagtgccccggcgtggtgtcctgcgccgacatcgtcgcgctcgccgcccgcgactccgtcggcgtcatcggcggtccgttctggagcgtgccgacggggaggcgcgacggcaccgtgtccatcaagcaggaggcgctggaccagatccccgcgcccaccatgaacttcacccaactcctccagtccttccagaacaagagcctcaacctcgccgacctcgtctggctctcaggggctcacacgatcggcatctcccaatgcaactccttcagcgagcgcctgtacaacttcacggggcgcggcgggcccgacgacgcggacccgtcgctggacccgctgtacgccgcgaagttgcggctcaagtgcaagacgctgacggacaacacgacgatcgtggagatggaccccggcagcttccgcaccttcgacctgagctactaccgcggcgtgctcaagcggcggggcctgttccagtccgacgccgcgctcatcaccgacgccgcctccaaggccgacatcctcagcgtgatcaacgcgccgcccgaggtgttcttccaggtcttcgcgggctccatggtcaagatgggcgccatcgaggtcaagaccggctccgagggcgagatcaggaagcactgcgccctcgtcaacaagcactaggcggcggaattcatgcgggagatggctccattgctcgcaaaaaatccttgtgagacacacaacatgctctgcatctgcaggcgttgtcgtcaccttggtggacgtagtacatcggtgcatggattatctgttgtttaatttgtacgttcagttcattctgtttcttgtattcttttggttcctttcctcttgtttattcatggatgatgaggtgtttctgttttattctctggttcagctgtaaccatgtaacatgtaaggtgcgcgttttgtcctcgtgatctctgcaactgtatttattttaatggatggtatacatggagatatgatcatgataataacaataaggtgattacaatcaaaaaaaaaaaaaaaaaaaaaaaaaaaaaaaagggtta

SEQ ID NO: 12873 - DNA, 1270 bp, Zea mays
atcccaacccaaacccctcagggcctcaggcagcccgcagcccgcagcccgcagccggtcagtccttccttctcctgttcgcgtccacgatcctgccgccgccgctcgcacctccacgatcctgcccagcgccgtgcgcctccacccccgccccgtccgccgcccgcccggctggccggcggcgccaccccgggacccgcgcgcgtggagccccggcctctaccagccgcacgtcgcaaccggcgaggacgcgcgcgcctgcagctcctgcccggtcccggctggccggccgccggcactccggctgcccctcagcggctcagcccctgagcttgtctgcttgactgcttcagtgcgggtgcagcacagcggcagtgccccctgtcagtgccagccgccttagctactgcttactacgttgcattttttcccctgttttgtggactgtggtaattgactgtgtatcgagcaggcataccctgttaaaaatcctggttccactactagtcaggccatggctgcagcagaggcatgggtgcggcaggagaaagttaggaagtttgaggagttcgtggaccaacggttgaaacccgacctcgccaatgccatcgcacagcgtaacaaggtgtttgagcagcagaagaccttcttggatttgaagaggaacattgaaaatttggagaggaatggtgttaccagcatgcggtccatggtcaatcttggctcagaggtgtacatgcaagcagaagtaccagatacaaggcatatttttgtggatatcggtctaggttttcatgtggaatttacttggcaagaagctttacagttcatatctgtaagagaggcaaggttgactaggcaaatagacgaatacacacatctcatcgcaagcataaaagcacagatcaagttggtatgtgaaggtatccgcgaagtgctgcagctgcctgcggagaaagagttatcgcccaggaatacgtggtagaatttggttctcaatggagcagggggtggtgttctgtaaacgtggttccgtttcaactcttgcagttgaaattattgtggtgccgacagtattttagagcagagaatgaggttccccttcgtataacaatctcttcgacgacaccacgtacaactcatactgatttctatgttttcattatgttttcatactgatttgcagtatccaatgatttcacgatcgattatatcatttaccgtcatcctgtaacttcctgttttgtttttacaaaaaaaaaaaaaaaaa

SEQ ID NO: 12874 - DNA, 2253 bp, Zea mays
tggacttatagttgtatggtgatatgtatatgaatctgattatgtaatgtgaagctagacttgtattagattttgaattgtgacttacgtatgaatctggattatgtattgtaaatctagacttgtttcaggctattagacggctcggccttatctgacctatcgtactcacgggctcacggcacgaaaaagacttgattataccgaacctaagtcgaagagacgacacgacgtggcagaggcgcagaggcagagcacatcggctaagccccgccgcccgcagccaatcacactcctactaccaccagatcccggccggccgggtcccaatttcccattccatcctagggctcgcgagtcgcgtcccccaaagtgaatacagaaacctccagccccaggccaattcctcgaccgcatcgccacccaccccatctccatggctacctccgccctcgctgctctgtccgccaccgcggccgccgccggtaagcgcatcctcctgtcgcgccccgcctcctcctcctccctctccttcgcctcccgccgcctggccgccggggcacccctccgggggttccttggcgcgccaatccgggccgtggcgtcgtcggcgtcggcggcccccgcggcggcggccaagaccatcgcggtcggggaccggctccctgacgcgacgctctcctacttcgacacgtcctcccccgacggcgagctgaagacggtgacggtccgcgacctcaccgcggggaagaaggtggtgctcttcgccgtgcccggcgcgttcacgcccacctgcacccagaagcacctcccggggttcgtggccaaggccggggagctccgcgccaagggcgtcgacaccgtggcctgcgtctccgtcaacgacgccttcgtgatgcgcgcgtggaaggagagtctggggatcggggacgaggtgctgctcctgtcggacggcaacggcgagctggcgcgcgccatgggcgtcgagctcgacctctccgacaagcccgtggggctcggcgtccggtcccgccgctacgcgctgctcgcggaggacggcgtggtcaaggtgatcaacctcgaggagggcggcgcgttcaccaacagcagcgccgaggacatgctcaacgcgctctgaactcgcgacgccatggttggttcgtctcttccggcaagagttggtttcttttccctgaaaataatcgtgacggcaacggtggcttgtgttactgccgccactgttgtgaccggcgctgttactagtgcactgcagagatgcaagtttcttgcgaacatggctttataggtctagcttcatgcaattgttgacgccctctgtttcatgacttgtcatggtatgcaactcttgtctgagaattgatcatctgcatagtaccactactatcacaggcgttctctattattatcaaaggagagaaggggccgcccagccgcaaaatggctccattttgactggaaggttgatgctgtgatgctcaccatgccaaacaaatactaggctcttgatattaggctgtgcactgcagctgcggctaattgctatggttatctagtttaattggggattgtcagcgttgcagtgtccttcaaagtttctttatgcctgctgtcggtctggtatcacataagttgctttcttaatgaacgctgaagctagtttaattggggattcagattctcaggttttggcgagcaagagcaagggtcagatgcctcttggggacgagcaaaggttctttcgtttgccttgctggtaccccagcatctcttgctgttggtcaattattaatcgtgtcgtcactggtaatcaacactgtaaatagaggtaccgtttggttcacgaaatgtaacgtaaatgataacaataatgattcacactcaattattaactcaattatcaatggtaacaagtttaaataacacactatcagtttctcagtttctagtgttgtatctaattacaatgggatttaattaaatatggtttaacattatcgttactattcacattttgtaaaatgtgaatcaaacaatacaagagtttcttggtatgaccatgttagaaaattagagctagagacgaggatgacagagttgaagagcccatcagagaaatatctcggaagggtactaggttggaaaattaaggccatgtttggtttctttagtctagggactaaagtttaattaggggactaaactttagtccctaacatgtttggttctagaggc

SEQ ID NO: 12875 - DNA, 1397 bp, Zea mays
  misc_feature (1246)..(1246): n is a, c, g, or t
gcacgagaccattacctagaacatcctaatcgaaaaatcacagaccgaaaaggaaaatagaggcgagacaaacgagagcgagcgagagagaacagttcgagctcaccccggcgagagccgactctcaagcgataaggggcgtgggcgtcgtcggcatggagagcgagatggcggaggagtcaccggccgcagtctcagcggcggcggcgcgggcccggccactggaggcggtcgcggaggaagggcaggaggtggcggagcagcacgaggtggcagttggctccaccaagaccatggagcgcgtggcggccgcgaagaagttcatcgaggaccactaccgcgctccgcgcatcgggcgggctagactgcctctgaccgctgaccgcactgctcccttctcctgttctctctccccacttcgagacttcctccattcgcggtttgcctctctgcctgccctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacacagactctgaggaggagctcaaggaggccttccgcgtgttcgacaaggaccagaacggcttcatctctgctgctgagcttcgacatgtcatgaccaacctaggtgagaagctgacggacgaggaggtggatgagatgatccgtgaagccgacgtggacggtgatggccagatcaactacgaggagttcgtgaaggtgatgatggccaagtgagatgatgtgcctgttttgaagctagttcctctcttgatggtagtagctagtctagtgttggagactgactgcatttggtccgccttgttcctctcgctgcatcaatggacatatccgtttgttttctcccaagggattttaccatgtcggtaatttcgttcaaatttgtttatggttgtattaacatttgtgttatcttggtacaatgatcatgcctttcccttctaaaaaaaaaaaaaaaaaaacgccccgaaaaaaaaaacaaaaagcgggcaaaaaaaaaaaaaaaaaaaaaaaaaaaaacccaaacngcccgtcgcgcgccgttgctttaacccaaggcgcaagggaaacctccacctcagttcccgtcttcttgttcttcgcggcggcggcgggcttcttcttgttccccggttcgttgggggggaaaagaagaaattgtgcaccgggcgcgcccgg

SEQ ID NO: 12876 - DNA, 907 bp, Zea mays
gtgggacacacgagtacacgaccacgagagactggtcggtctgcgactgtctctgaccgctgaccgcactgtcctctgcttctgtctttctctctctcccctgtcccccttccagatttcctccattcgcggtttgcctctctgccttcctgcctgcttccctccctccgtcagatccccgctcgggttgccatggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaacggcttcatctccgctgctgagcttcgccatgtcatgaccaacctaggcgagaagctgacggacgaggaggtggacgagatgatccgtgaagccgacgtggacggtgatggccagatcaactacgacgagttcgtgaaggtgatgatggccaagtgagatatgcccgccgtttttaagctagttcctctcctgatggtagtaactagtctagttttggagactgactgcttttggttgtgtcttacgcctatccttgcgtcaatggacatatccgtttgttttcaaccaagggattttaccatgtctgtaatttcgctcaaatttggttcttgttgtattacatttgtgttatcttggtacaatgatcatgtctttctctttcaaaaaaaaaaaaaaaaagccccaaggccgcggccgctct

SEQ ID NO: 12877 - DNA, 2381 bp, Zea mays
cccatttttctcaccgaacaatttatcaaaatattatcgccatcggtgtttgatcttattctagttcaccatgacctgctccatttcattcttaatgcactttaacttgtttggaatctcttgtcttcctcttacagatcctagctatcctatatatatatccttctctcctactcaaacaccgggtctgcatggatatttatgtctgcagttctgcactaatgttattgaaatcatggagttcacgttgtagtttgtattgcagtataatatgaaccaaatctcttcacagcttatcaacaagtgctcgttaaatttgggtttgtgtttttagggagtcttaaccatattaaaatccattttcatgcatttgaacgcctgcaaattataactcaaataattactccatgggtgaaattcattcctagaaattcgtggttccatttgggtttgcttttcttcccttgaacatttccttccattctgataaagaaaagcttagattcctacgttgtgtaggttgttgactaactccagtcctctgattgtgttagcgaagttctgttggatggcactgttaatttcttcatgtttgctgtcaattgttatatagctgcctacttgtagaacaatagaggtgttctctacctctgagatacattcatttaacatgtcagataaagaaaactcggacatttatccttataatatcgttgatacccctgtttgtcagtttgtagaggtgtcatcctgtagcaccagtagtctggtggtacttttttttttgcatgtgggcaggtacatagattaaacattctaggtatttctattttccctcaactgtaataactcccagatcacattgaggattaatactttttgacatgtttgttaatttttatagtataagataacatgttaaagctcgaacttctagttgattgcatgattgctattactgttgagtgttcgcaccatatcatgattggaatgccgcctcaaaatggtttaaatctttaagctgtcttcctcggatattttccagttgaagtgatttgagatagtagtgagtaatgtttggctgacataacaggctgcatcaccaccaaggaacttggaactgtgatgcgctcggtggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaggaggccttccgcgtgttcgacaaggaccagaacggcttcatctctgctgctgagcttcgacatgtcatgaccaacctaggtgagaagctgacggacgaggaggtggatgagatgattcgtgaagccgacgtggacggtgatggccagatcaactacgaggagttcgtgaaggtgatgatggccaagtgagatgatgtgcctgttttgaagctagttcctctcttgatggtagtagctagtctagtgttggagactgactgcatttggtccgccttgttcctctcgctgcatcaatggacatatccgtttgttttctcccaagggattttaccatgtcggtaatttcgttcaaatttgtttatggttgtattaacatttgtgttatcttggtacaatgatcatgcctttcccttctaaatttaggtgttgaatttcttgtagaaatacgtggcatgcatgtgcagatatatccgattttgtttggttttctcgttacttgtgctgtaattctttcgcagcattattacccaacgatttctctgcactgcctaggcggaccgttgacccatgttggccacccaagtgaacaagagtgttgcttttaggggtagtacccatgtattgcttcttctattgttctaaaagctgaccgagatctagtgattgtaggtagggatggtaatggatcatgactcaaatgacttttttaatttgtttaagtccttaatcaagtccagttaaaaaataaatggaaatagagtctggttctaatccgattcttaaatttttagtgtaaaatttagagtccattgtccctaattgttggccatctagttcgacataagtgcaagtacggtcttacccttcatctattgcttgttagattcttgctgttgttggatcacaaaccaattaaaactagattgtctaagttaccgtggaccgaaaaaacacaatgaataactatcacgctttcatggtgaagagtggctaagtttataagcaaggataactagtcgagcttactaccgaagaacaaaataacaaagggtatagtttctaagtaaactagcaaaggaaccatcgaagcttccgtccgaagg

SEQ ID NO: 12878 - DNA, 2320 bp, Zea mays
ttgggtccctcgaggccggccgggaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggtccccaccgcggtggcgcccgcggtctctgccagcgggacaccgcggcccaggttcgtcgccgtcgcggctggtgcctaccacagccttgcgctggacgatgaaggttcactctggtcatggggttacaatctctatggtcaacttggctatggggaccagaattccctttttccatgtttcgttgagcaatttcaggatttaggttctcctgaaacactgaatgatgaagaccagaacacacgtggtcgcacttgtttgaagctgtcttctgtcacagctggtggcatgatgtcgcttgccatagacagtttggggagcctttggatgtgggggagttgcccacagcagactgatgccggagagttttgtatttcaagtagctctatcccactacctgtgtgggatttccatggacacaccgttgttaaggttgcctgtggtaacgagcatgtagtagctgcagttagtgctggggagacctatactggaggtgaccttgtttgttacgcttggggaaataacaaccatggtcagttgggtctaggtgacaaggaaagtagatctcgtcctgtgcttatttcagcatttagtgaaggatcttcctgggaggtgtatgaaattgcatgcggagcttcccatactgcagtcctcgccaataagaagtccactgaccagatagaatctcggtgctggacatttggccttggtgacaaggggcagcttggccatggaaccacagccaccatttgctcaccacaacctgtcgatggattaccaaccggatccttccttatttctcttgactgtggattgttccacacaaccgtagtctcctctgatggagaggtgtggtgctggggaatggagagaggtcttggattgtgcccagatgctagcttttcgggagttgatgaaggggatgctttatatccaataagagttcagtctcctgagaccaatgggttcaagtttcttggtccagtgcagatcgcctgtggagctgcccacactgttcttgttgctggtgatgggtataggatgtgggcatggggcagaggccgcagtggtgtgcttgggagaggccagactgctgacagttacataccatgcgttgtgatgtggcctcctcttgatgagaactttcatgaggaccaaatgggaggatcaacatcaagagtgaatgatcacactagcactgagttggaacagaagctatctgctgcctcggaggagttacaattccttaggtcaaaactgacactcatggagagatatgccaatatacttcacatctcaatcttccgtaagccacttgatgaacgggcgctaccacgttcacttcaggaatcttccgtctttgatatcagaaaggaatttgagaacattttggatgcagcagatactgatgaacttaatcgtttagagatcttctaccgcagcatgctttctggcgttaaagacaagcttctgaagagaagagtacgagaaatggtccaacaatgcattatttcactcagcagggaggccaaaccctaaagataagtgaattggattattacacttgttaccggactgcaagtgggtacagtatcacctttggtctcactaaaattgcaaaaaaaaaaggtcaacccagtgtcttatctgtttcttcaaacatagtgagtagatctgtcctggcatcaagatcatcacctggccgaccattgcacgaagacagcattactcatactgacatgtaagcatatatgttgtttatgaaattctttatatgataaatgcatcctagataaattgaatcctgtgtaaaggatgtttctgtggattgtcatagacggacaagaatttatggacatatggttaaagtgtcaaaaaaaaaaaaaaaagcaagtagcagtttaaattatcaaaaaaaaaaaaatgcataaatagcggccgtagtaaggcttttttttatcatggtgacatttgagattttttatttgaatatttttgcaaatagtttctcttacatctatttttttcaaatatctttgaaaaatactcccgtttacttt

SEQ ID NO: 12879 - DNA, 615 bp, Zea mays
ccgcccgggcaggtaccatctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctccatttgcatggcttcgctacaacaaggatgatattgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctactacaaggatgaccgcgttctagatggaacaatcaatgctttggaaagcttaataatgttttatgttgttgaataattccgtgtgttttcgggtatgttgtgtaatactcaatgtcaaatcctatgcttaatcgatgttgtggtccatcctgttatcagcatggccaattattcaaaaaaaaaaaaaaaaaaaaaaaagcttgtactcccccct

SEQ ID NO: 12880 - DNA, 4578 bp, Zea mays
aacgccccgttaaggtattactcgtaatttttctatagcatttaaatgtgttggataatcttttgcatggatatgtgttgtgaattcgcaccatgtgcccacgaaagcagcatggggatcgccccaccaatttttttttaccagctctaactctcaaccagaaaacatgcaaatttatttgtcattgcacaccagcaacctagggatggtaatcccaaaatgcaatgatttttagagcatagatgtgggcgaatttacctaactatggatatgttaattgacaataaaacaccataaccactgggttcatgggtacgagtatggttttgtacatgaaagaataaacttatgagagtgtgtatatactcaacatacaagtataattcccaaagccatctccaacctattgtagtccaaaatatgcatggtccaacaagcacacctattgacatgcatataagccatcacatatatatatacactaatttttactattacatatgttatatatttatagatatatgttatttgtttatattgtcagtgtttactgcgtgtgttatattttttttcttaggtacggtgtaggtaaccaccgtgtctatctcgacacgcgtacgggcacaaaattacatcaacacatggtatgagatttttcatgtgtcaaataaattttgatggctagtttaaaaacttaaatcactcatgagattaccggagacgattgaggggaaaatttcctagtattacggacggaatttaagtttttcaaactatccctaataaaataaatatgggtatgtaggtatgagcgcgataccatagggtagatccctcttgcggcgggacctgcaggtcttggtgacagcgtagaaaacatgcatttaggtgttgaatcttgattatttgcagttaatcgtgcttgctgtgttgccgcaaacacgagattcacaccctgatgagcggagccaggctgcccttgcttcgattcacggtggccgtcgtcccggccaggccagcacaccagtccaatccacatagcaacaaccgcgcctcggtcagttatagatgcgtggccttctgaaacaaaccctcatatggggtcacgccgcactcacacatgcatccataaaccctcagcagagccttgtgtcgcgtcctctcctcgataacccaggccacatcgtccttccgcgccgcgccgccggcgacctaacaacccagaggcctcagcaccgcacgcttgcacgtacgtccaggcgcgctcgccgttacgcccacggggatccaggctttccttcgctgccgttgctggtcgagtgcgccacgccgaaaggtgatcgagctgacgagcgctagacgccaccggccggcgcggcgtggcaaggcaagacgccgtgcgggtctcgccctcgtcagctataagaccgcatccccccctgcggagggaggcacacacacagacacagcgctctcactagcctcgcattccgtccctgcagtgcaggggcaggccggtgaggtctgggagaggaggaggaggaggagggaggagaggaggaggaggagatggccggtagggagagcggcgggatggcggcggcgctgcgctgcgctggaaggatcgggatcctggccaccgtcgcagtgaacctcgcgtggatcgcgacgtacatccgccggcgctacttcggcggcgggaaccgatccgacaacaacggtggcggcggggaggtggagccgtcaagagggaagccgccggtcacttcggactccatcgtcaacctcgatcagtgagtgatatgctttgctgcctggggatccgatccatcatcgataaatcactcgttattatttttaccgtctgtactgtatgtattggtctctcccactgctcgtccatcgatctattctgtcctgctggagtcactagtgaaggtccgttccatttggggaaccagatcgagccctagctatgcatatatgtgagtgaggcatctggaacgaagacgtacactagtgaagtcccgctcagggtcctgccctctccatctagcaaggacatgtgcatcgatccttgttgcctgattagttgttgattattagcagctagtgtttgtatacttttcctgattaattgcagatatatagtagtatttgtttatttcgtttgattattatatatatcgtgcttttgttctgtttgtttgtttggttggttaattatttaggaaatagtgcgaagttaaaatagagatgggttggaaaagatcgaaatggcatatatagtggccctaaaccaaaatatacatactgttagtttcagacaaaacagtacagccttgcaattaccaaccccttatacacatatagatgcatggacgagtactcttatttgaatcttaactttgttgactgttctctgtatgctatgaacttaatcgtcgtcgtccatgcaaagcatgcatgctactgtatgtttttgacttttggttggttggttgcagtggcgacccgactatgtacgaggagttctggcgcggcacaggagatagcgcctcgatcttcatccctggttggcaaacaatgagctacttctccgacctcggcggcatctgttggttcctggagcctggattcgagcgcgaggtgcggcgtctccacaggctcgtggggaatgccgttgtagacgggtaccatgtgctcgtcgggacaggctccactcagctctttcaggccgtgctgtacgcgctctcacctgcaagtgacggcacacccatgaacgtcgtctcaccggcaccgtactactcggtaagaatacgttcagccatcaaccaatcaatcaataaaattgtggttcgattgattaatcatctgctagctgatgatcgattttgaacacatgtgcagtcttacccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgacatcatgctgttcaccgtctccaaatgcaccggccatgccggcaccaggctggggtaaccatttcttggtcatcagttgttaatttcatatatatacacgtagtaattacgagatatgatatgaagtacggtggtttgtttgcgtggagatgcttgtaggtgggcattggtgaaggatactaaggtggctcagaagatgatcaagtttatagagctcaacacaatcggtgtatccaaggactctcaacttcgtgccgctaagattatcggggcaatatgtaatggctatgagccggtaccatcctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctcgtaaggaaccacacattttaaatgtccattcttacatctacgactagtgcaattatattggtgcttttatgcttttatttgtaaataacatcgtcgaggacaaaaaaaaactcattattttccttggttagcatttgcatggcttcgctacaacaaggatgatattgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctactacaaggatgaccgcgttctagatggaacaatcgatgctttggaaagcttaataatgttttatgttgttgaataattccgtgtgttttcgggtatgttgtgtaatactcaatgtcaaatcctatgcttaatcgatgttgtggtccatcctgttatcagcatggccaattatatatggatgaccgtcactgctcagtctttactcctaattacatggcaagtgtttaatggtgcttcaatatcagttgtaccgagctacttcgtgctactaaagcaggatggtacactaacgtgtcactaattttttacagtgacatttttttaaaacaaatcactaacgactgtgcacatgtgatatctattgtaaaaacgtgtcaataatatcgaaatatggtaataacccagtgacatcttttattttacgtgtctctattgtgatctgtttagtgacatgtacatataaatatgtcactggctttagacgtcaaatttatttagtgaagtgtatatagaaacatgtcactgacttcagatgtcagatctgtttagtgacatgtatttaaatgcacgtcacaaatacttataccttagtgatgtgtattaagaaacatgtcactggttttaaatg

SEQ ID NO: 12881 - DNA, 2031 bp, Zea mays
cacgccgcactcacacatgcatccataaaccctcagcagagccttgtgtcgcgtcctctcctcgataacccaggccacatcgtccttccgcgccgcgccgccggcgacctaacaacccagaggcctcagcaccgcacgcttgcacgtacgtccaggcgcgctcgccgttacgcccacggggatccaggctttccttcgctgccgttgctggtcgagtgcgccacgctgaaaggtgatcgagctgacgagcgctagacgccaccggccggcgcggcgtggcaaggcaagacgccgtgcgggtctcgccctcgtcagctataagaccgcatccccccctgcggagggaggcacacacacagacacagcgctctcactagcctcgcattccgtccctgcagtgcaggggcaggccggtgaggtctgggagaggaggaggaggaggagatggccggtagggagagcggcgggatggcggcggcgctgcgctgcgctggaaggatcgggatcctggccaccgtcgcagtgaacctcgcgtggatcgcgacgtacatccgccggcgctacttcggcggcgggaaccgatccgacaacaacggtggcggcggggaggtggagccgtcaagagggaagccgccggtcacttcggactccatcgtcaacctcgatcatggcgacccgactatgtacgaggagttctggcgcggcacaggagatagcgcctccatcttcatccctggttggcaaacaatgagctacttctccgacctcggcggcatctgttggttcctggagcctggattcgagcgcgaggtgcggcgtctccaccggctcgtggggaatgccgttgtagacggataccatgtgctcgtcgggacaggctccactcagctctttcaggccgtgctgtacgcgctctcacctgcaactgacggcacacccatgaacgtcgtctcaccggcaccgtactactcgtcttacccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgatatcatgctgttcactgtctccaaatgcaccggccatgccggcaccaggctggggtgggcattggtgaaggatactaaggtggctcagaagatgatcaagtttatagagctcaacacaatcggtgtatccaaggactctcaacttcgtgccgctaagattatcggggcaatatgtaatggctatgagccggtaccatcctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctccatttgcatggcttcgctacaacaaggatgatattgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctactacaaggatgaccgcgttctagatggaacaatcgatgctttggaaagcttaataatgttttatgttgttgaataattccgtgtgttttcgggtatgttgtgtaatactcaatgtcaaatcctatgcttaatcgatgttgtggtccatcctgttatcagcatggccaattatatgtggatgaccgtcactgctcaaaaaaaaaaaaaaaaaaaggccggcctggatgaacgtcactgctcagtctttactcctaa

SEQ ID NO: 12882 - DNA, 1143 bp, Zea mays
cggacgcgtggggtacagcacggcctgaaagagctgagtggagcctgtcccgacgagcacatggtatccgtctacaacggcattccccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgatatcatgctgttcactgtctccaaatgcaccggccatgccggcaccaggctggggtgggcattggtgaaggatactaaggtggctcagaagatgatcaagtttatagagctcaacacaatcggtgtatccaaggactctcaacttcgtgccgctaagattatcggggcaatatgtaatggctatgagccggtaccatcctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctccatttgcatggcttcgctacaacaaggatgatattgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctactacaaggatgaccgcgttctagatggaacaatcgatgctttggaaagcttaataatgttttatgttgttgaataattccgtgtgttttcgggtatgttgtgtaatactcaatgtcaaatcctatgcttaatcgatgttgtggtccatcctgttatcagcatggccaattatatatggatgaccgtcactgctcagtctttactcctaaataaaaacaaaaaaaaaaaaaagcgcccccctgcccgggcggccgctcga

SEQ ID NO: 12883 - DNA, 1664 bp, Zea mays
cattgggtacctcgaggccggccgggaaataaaaaataaaacacagcctcacgatccccgcactgcccggtgccccgcgagctgctcctctacacacgccagcgagaaccagcccaccccacctgctcgatcggcgcaccgtcccgcaggccgcagggccgtcgtcagccatgatccagctcctgttctcgctgctggccgcggaggcggcgctggtgctggcgctgctcttccccacgcccgtgcgccgcctggctctgctcgccatcgatcgcgccaagagggggcgcggacccgtcatggccaagaccatcgcgggcaccatgctcctcgtactagtctctgctttctacagcgtcgctaagatccgccgccgcgagggggagctcggacagctcacgcccaccgaccaggtgctcgccagtcgccacctcctcgaggcgtcgctcatgggatactctctgtttcttggattaattattgaccgattacatcactatattagagagttgagaatgttgaggaaagacatggaggctgtaacagagcagggccggacactagaagcagcaaaatccggaagcactgacgagattcaaggataccagaaagaggttgcgagtttgaaggaacaagtgcaagagctccagaaccaatcacaaaagaaaacagagcgactaaaaaccgccgaagcaaattctgtagctttacagaaacaatcggaaggtttactcgctgaatatgaccgtctcattgcggagaacagggatttgagggaccaactgcagtcaattgacctccgcctgtcccattctggcggaaagaagaactcgtaaagcaagttctgcaattttgaagagcatgattttctgtagattttcttccaataggttaactgtactcggttttctctattatcataatcgcccatgtaattcagtagatggatttgcctatgtaattcagtagatgcgtgcgtgtatgtatgagtggaccatttaatgctttatggactgggtggcatggactcagacccggcatttggccatagtttatggcctaacgtcttggttcagtgagatcaaataagaacctgcatcttcaaagacaaaaaaaaaaaaaaaaaaaaaaaattcgtgcggccgccttcgccgccgcgacgctcgagtcccacctcttcaacgcgccctacctgtcgctgcccatgggcgtcaggagcgtggtcaggacggcggactgcctgctcaaggcgctccgctccggcgtcgccaccgtcggcaagtggcacggcaaggcgctccggaacgtggcctacgccagctgcgtcctcggatacaccaggctcgagagcaccaggaagttgtgaggatcgatcggatcgaatgcctccgccacctcgcgtcctcctcgatgctgcctctggcttcaacggttgaaccgtcctgccagtgccagccaaactgtatctatgctcgatcaccttgtagtaggaagtactggaaattaattcaattctagcaggagacgaataagcatctgaccggaggatgcaaggccttgcgtgcatatgctttgctttgcatttgtacaatctttttaaatgtgaattactgtagctataaattgatctccgttcatcatgaaaaaaaaaaacccaacacaat

SEQ ID NO: 12884 - DNA, 1162 bp, Zea mays
acgacacaccaacggcaatggcgcagcaagcgagctccccggcctgcccggacgactgctactactactactacatggacagagctcaccaacacgagctggagggacgacgactacaggcggatggtgatggcgtacctgatcgaggcggtgtacctgctggagctggagcggcaggagcggcgcgacgcggcggcggtggcgcagcagtggtgggagccgttccagttccgcctggcgcacgagctggtggacgaccgcgacggctccgtgttcggcgccgtcttcgagcgcgaccaccaagccagcccgaccccgagcccgagcggcgcgcccagcgccgtcgtcgcgttccgcggggcgctgctgcgcgcccccaccatccgccgcgacgtcgaggaccggctccgcctgctggcccggtacagcctccgcggctccgcgcggctggcgcgcgccgcgcaggcgctcagcgccaccgtcgaccgcttcggctccgagaacgtctgcgtctgcggccactccctgggcgccggcttcgcgcgccaggtcgtccggatgctcgtggcctcctcgccgcgccaccaccagccgcagcagcagcaggccgccgcgtccctcgagtcccacctcttcaacgcgccctacctgtccttgcccatgggcgtcaggggcgtggtcaggacggcggactgcctgctcaaggcgctccgctccggcgtcgccaagtggcgcggcaaggcgctccggaacgtggcctacgccaactgcatcctcggctacaccaggctcgagagcaccaggaagttgtgaaggatcggatgcgcgatgcctccctccacctccaatcctatacgatcgacgctgactcgaacggttcaaccgtcccccgcccgcgaaccaaactgtacctatggaatgcgaatgcgagccccgtgtccgtgtgtgtgatcgattaccttatagtagaaactagaaacaagttagaaattaattcaattctagcaggagacgaataattaagcttccggcgaccggaggatgcaaggctttgcatactttgctttgtacaaatctttaagtgtgaattatgccagctatatagcatagcattgttctccattaaaaaaaaaaaaaaaacaaggctatcttgttttcccat

SEQ ID NO: 12885 - DNA, 1238 bp, Zea mays
  misc_feature (1225)..(1225): n is a, c, g, or t
acgacacccaacggcagctgcagcacagcagaggaaggcaggaaggaagaagatatcagaccagtgtgaagccaagccaagccgtctctctctctctctctctggtcgcttggtcggtccatcggaggatcagctcggcggtggccatggcaatggcgcagcaagcgagcctcccctgctcgactgccaccacatggagagagctcacgaacacgagctggagggacgacgactacaggcggatggtgatggcgtacctgatcgaggcggtgtacctgctggagctggagcggcaggagcgccgggacgcggcggcggtggcgcagcagtggtggaagccgttccacttccgcctggcgcacgagctggtggacgaccgcgacggctccgtgttcggcgccgtcttcgagcgcgaccaccacggcgccaggccggggccggggccgagcccgagcggcgcgcccagcgccgtcatcgcgttccggggcacgctgctgcgcgcgcccaccatccgccgcgacgtcgaggacgagctccgcctgctggcacgcaacagcctgcggggctccgccaggctggcgcgcgccgcgcaggcgctgcgcgccaccatcgaccgcttcggctccgagaacgtctgcgtctgcggccactccctgggcgccggcttcgcgcgccaggtcgtccggacgctcgtggcctcctcctcctcctcctcctcctcgccgcggcaaccgcgccagcaggccgccgccttcgccgccgcgacgctcgagtcccacctcttcaacgcgccctacctgtcgctgcccatgggcgtcaggagcgtggtcaggacggcggactgcctgctcaaggcgctccgctccggcgtcgccaccgtcggcaagtggcacggcaaggcgctccggaacgtggcctacgccagctgcgtcctcggatacaccaggctcgagagcaccaggaagttgtgaggatcgatcggatcgaatgcctccgccacctcgcgtcctcctcgatgctgcctctggcttcaacggttgaaccgtcctgccagtgccagccaaactgtatctatgctcgatcaccttgtagtaggaagtactcggaaattaattcaattctagcaggagacgaataaagcatctgaccggaggatgcaaggccttgcgtgcatatgctttgctttgcttttgtacaatctttttaaatgtgaattacagtagcnctaagttgatctc

SEQ ID NO: 12886 - DNA, 1620 bp, Zea mays
cttttttttttttttttttaccttctccaggtacaaaattgggctggtttcttgtacacttccacgttcgaggcgcgcggcgagccgggttctcaccaattcgtcttcttccacaaactccaaaaccctagcgccgccgccgccatgtcctcgtctccgtccccggcgaaccgccgtccccggggcccgcttgcgctggggctggagtcctcggcgaacaagatcggcatcggcgtggtctccctctcgggtgacatcctctccaacccgcgccacacctacgtgacaccgccgggtcatggattccttccccgggagaccgcgcagcaccacctcgcgcacctcctccctctcctccgcgccgcgctcgctgagtccggtgtggcccccgctgacctcgcatgcgtctgctacactaaaggccccggcatgggcggccctctccaggtcgccgcagcagccgcccgcgcgctctccctgttatggaggaaacctctcgtggcggtcaaccactgcgttgcgcacatcgagatgggccgcgcggtcactggggccgtggaccccgttgtactctacgtctccggcggaaacacgcaggttatcgcctacagcgaggggcggtacaggatcttcggggaaacgattgatattgccgtcgggaactgccttgaccgattcgccagggtcctagagctctccaatgaccctagccccggctataacatcgagcagcttgcaaagaagggagaaaaattcattgatgtcccttatgttgtgaagggtatggatgtgtcattcagtggcatattgagctttattgaagctgcggcgattgaaaagcttaaaaataatgagtgcacacctgcggacctatgctactcattgcaggaaactatctttgccatgcttgtcgaaattactgaacgtgccatggcacactgtgattcaaaggacgttcttattgttggtggcgtcggttgcaacgaacgtttacaggagatgatgaagattatgtgctcagaaagagggggtaggctgtttgcaactgatgaccgctattgtatagacaatggggcaatgattgcatatactggtttactggcgtatgcacatggcatgaccactccccttgaggagtcgacatttacacaaagattccgaactgatgaagttcatgcaatttggagagagaaggagatgccggtgctaaataatacccattcagatgcaattgctgaagtttctaaagatgaaacctccatggcaacaccaatcgttatagattactgagatcatggacactggatacgcttcttgatgcaaatctgattcggcaaggatagatcttgttcgtaggtgtgttgtacgttgtctacggatcgggtgtcattcatgtaagacagacatgcgactggtaacgggccgttaatattttgtgacattctggtagaagatgcagatctgatttggaaagaaagtgggtcttgctaagtgtgttcggctgttgggtacgacttccgtatcatatatgttatgacagtttgacagaagatttgaagtcttcatttttttgttgactcaaataaaaatggatatttattcacaaaaaaaaaaaaaaaa

SEQ ID NO: 12887 - DNA, 8281 bp, Zea mays
  misc_feature (1864)..(1864): n is a, c, g, or t
  misc_feature (2248)..(2248): n is a, c, g, or t
  misc_feature (5989)..(5989): n is a, c, g, or t
  misc_feature (6102)..(6102): n is a, c, g, or t
tttgagagctacttagtgtgattggtctcatgaagcggaatagcactatgagaaatgttctctcccacaaccttttgatggatgctttcaggaagaatggactgaacaataaaacacaaacttgctttatgaaagataaaacaaaaatgtcatcaacatagcgcttaggatactctttgtaacgacatgtataggataggtccaacgctagacattacaaaccgttgcagaccggtcagtactgattggtccgactcgaacgtgcggtcaaccatagtaggtccatggacctatcggtaccagccatgttagagctaaacaaggtggtatcaattgacacgctagatagtctacttggcattgattcgacccaatcgctacagaccatctttagcgatgtggcgcattctatttggttcacacgctcgccacattcactacatgttttcaaccaattaaagtataaaatttcaaaaaatatttatgaattatgtatttttacttcacgatgtgtgtgtatatatattattatgaattgtataatttttatttggcaataattctctgcatgttattataactttgtttgtcacttatttgctatcataaatattttaatcttttatatgttcttgctctttccatgctatcattgttagtctttaaccctaatgaattaggtaaaataataaaattataaatatcttaatctcttctatatcatttgaatgcaaatttttaatatttttattacatggctatttagtctacagttagcgcggtgatcttgcagtgtcgacagcctaaactatgctcttcttccgaccaaagccattccgtgtccaccgaccatgcaccgtgtccatccaaggtcaagattcaacaccgaagcgaaatacagcgcgcacgagcccctacatctaccacaaactaactttccactgctattgggccctcataccgggccccggtgccattctcaccgttctcgaaaccccgtgtacacgtagcagggccacgggccacctccctacggaggagacgaccccccatcccagaggtcgagggctcctctctctctaccatctccgttcgatcccatcgccccgccgccgccatggcgtttctcgcgcgggcgctgcggcagtccaactggcgcctgtcgtcgcgctgccccgccgtggctgcctcctgccgttggatctccccgaccgccgccgcgggttcgccggaggccggcgcagcggtggcgcctgccgacctggagctgcctccgccgcgggagcccgttggaggcgcccgcgtggagcttcctcccaacccggaggacgcgctcgaggtattcgtggatggccatgcggtgcggatccccaaggggttcaccgtgctccaggcctgcgaggtcgccggcgtcgacatcccgcgcttctgctaccatagccgactctccatcgctggaaactgccgcatgtgtctcgtcgaggtcgagaagtcgcccaagcccgtcgcttcctgtgccatgcccgcgctcccaggtcagctggctcctctgcattccgtcggcggcggttttcatgttcttgcgcgctgttctgatattgaaatgtggttaatgttggtctgctgcgcttctttattagctagtgttgtgtgcctcaaatgctcagactcatcattttcctttgcgcctaactgcctcagcaacttagggttctgcgtagatgtctttgtttgatttccataccatcagaaatgtttggagaaactagatacctcaaattgatgtaccttaggtctgtggatttttggagcactgagttatcactgttgctggattagggatgaagattaagacaaacacccnagtggcaaagaaggcaagggagggtgtcatggagttcttgctgatgaaccatccactcgactgcccaatctgtgatcagggcggcgagtgcgacctccaggatcagtctatggcatttggtgctgaccgcggtcggttcactgagatgaagcgttcagttgtggacaagaatttgggtcccttggttaagacagtgatgactcgttgcatccaatgtacaaggtaatgcctttttgcttcttgataaatattaattgttatcgtttcaggtattttttcaggcatatcctgtttgtgtgtatcctgcaagggcttcattcttcaagcattctatcttatctattcatgcctcattctattggtttcttacattgcattgacatnatgtgctaaatggttctctctacttgtgcaagctctgtatcctggctgatatgtgatgctattttattttcaaattgcaggtgtgtaaggtttgctactgaggttgctggagttcaagaccttggtatgttaggtcgtggcagtggtgaagaaattggaacatatgttgagaaacttatgacaagtgagctatctggaaatgtcattgatatctgccctgttggtgctcttacatccaagccatttgcatttaaagctcggaactgggaacttaagggcacagagactattgatgttactgatgcagtgggatccaacataagaattgacagcagaggacctgaagttatgcgcgttgttccacgtctcaatgaggttggtttattctccatttctgttacaattttgacttttgtgtttgttttgttggtggggtattcatgtgtcctaatgcttcgtggtgtatcattgacttcatttagtccgcttctatatctttgataaaaaggttattatcatataaattatgtcaatatgtttagttaacaccactttccctgttcattgcaggacattaatgaggaatggatatcggataagacacgattttgttatgatggtttgaagaggcaaagactaaatgaccctatgatccgtggtcctgatggcaggtttaaggctgtgacgtggcgtgatgctcttgcagttattgctgaggttttgcatcaagttaagccggaagaaataactggagttgctggaaaactttctgatgcagaatccatgatggcactgaaagattttgttaacagaatgggttccgataaggttctctgtgagggaaatggtcccaatcctccagcagacctgcgatctaactacctaatgaataccagcattgctgggcttgaaaaggctgatgtgttccttttggttggcactcaggtaaattactcctcaatgcctagtgccattttcttggttgctacttgcattctctgaaatataccattatatataatcactatatcttgtgctggtggcatgctttttgcaacagcaatgtggtgcttaggaactaaaatggggctgatgttcgtgaaacaagtgttattgttgagttcaattttctagcatatggagataccattattgtactaatttatcaggaacagttgtaaattgaactggttggtttggtgtgtcatgtttataattgctgctattgaaccttttgtttcctccatatactgccttttagtcacgtgatgctgttatgaagttttattgtgaatataatattataatggcacgttctttttgtgccgtggaacagccaagggtggaagctgctatggttaatgccaggattcggaagactgttaaagcaacacaagcaaaggtgggctacattggtcctccagctgacttcaactatgatcatgagcatcttggcacaggaccgcagacccttgttgagattgcagaaggtagtcaccctttctgctcagtattgcaatccgctaagaaccctgtcatcattgctggagctggattatttgaacgagaagaccaagttgccctattctcaacgattgagactgtagccaagaagttcaatgtgatgagaccagactggaatggccttaatgtcttgttgctccatgctgcacaggcggcagctcttgatcttgggcttgttgctaatcctgccgagagcatcaagtcagcgaagttcctgtatctgatgggagctgatgatataagcctggaaaagcttccagatgacgcatttgttgtttatcaaggacaccatggtgacaagggtgtctatagggccaatgttatcctgccatcttcagcattcagtgagaaggaaggcacctatgagaatactgaaggatgcacccagtggaccatcccagctgttccgacggttggtgatgctagggatgactggaagatcatccgcgctctttctgaggttgctggggctcagctgccttatgacagcctctcagctgtgagggaccggatcagtacggttgcaccaaatctagtacatgtagacgagagggagacacccacaatctctgcggaggttaagccgcctgtgaagcaacaagtcagctcgacaccattcaaagctgttgtggagaacttctacatgactgatgcaatcacccgagcttcaaagatcatggcccagtgcagtgcaaccttgctgaagaagtgaggttttgcacaccatcaagctaatcttctgcaaacagcttcttagtccctttttttcctttgctgagtttcagtgtttcaccacccgttgcttgttttcttgagaggtttgtgtataatttggactgcctctaggtttccagagcagcaaaacttgttcagtacatttccgcgttgtgtgtgagaagcagagcatactcaataagcttgttgctcacattgaatcatacaagtgccacaagcaaatgatttttgccttttgaatatgggaacatttgcccctctgattggttgcaatatgcaacttgcgaaagctagcataacttgcgaaagcaaatgatttgtgacagtctttgaccataactgaaagatgtgtttcttaacaaaaactcagttccagtttcgtaccttgtcgcaacgtctgaaaagtcttcgagaggacttgagttttcttaacgggagtttgccagccgaggtcgctctcaagcacgtataaatatacagctaatttcggtcctgtttgaaaacaaacctaatttttaagaatctagtttttggaaactgacttatgggaaaaaaaactagttaatggtgtttagaactacctctgtttctataaattgtctttagcgttagatgaggtgctgagaattcagtttctataaactatggtaaattgagacataaactaatatgtttagaaccatctcacagggcttctcgtcaaacttgagcgcgggaacggccgcggatccgacgaggagcttcctgcaggagagggcgatcatagagtcggtcgcgaaggggggacgggccgttcgacccccaacaacgtcgagtactcggacaagggagtggaatgggacgacttcaaaggctaatttgggagccacaaaaccggagaggattggagaagctaaaatcctctccttattcaattttaaataattttagatccttcaatcctcttcagtatttggactaacaaactagccccaagagccacctcctaaaaggacgaggggtttaccacgctcgccgcgcggaaagagccacctgtgagcgctggcaggaaagaaatgcactgcaagcattgttctcttgttcttttaagaccgtttcatctgcgtccgactgttcaggagcatgcagtagttgtccgaacccaaatatattgagcccacttaaaaaatattttattttagaacttgtttggatgttgttcatgtatctacctcaattcatgtgttgtgggatagattgatgtgaaatttgaattaaattctacaccaacaaatatgcatttaagatgagatggatccacggacatctaaacaaagccttagggaaggaaatacccatctgaaccccgtgcaccgcaaaaggctaccaggattttttttggaatacaaacgtcccaagcaagtaaagcacttggcggaaatggagccctcgtctcgcatatacaaatacaaatggtcatgtgacctcgcacaggcggcaacntgcgccgccgcaattcgaagaaatagcagcgaagcaattcgctccgatccaccccgaaatttacatattctttagcaaggcttgggagttaggatacatactcgtgagcacgnaacggaaggaaaagaaagcccaagcagctgaatctacctttcctttacttggccagctagatcactcccatctcattagtcgaccgtctcgtgatctcgtcaccaccttgctttggttgcttcctccataataacagaacaagaaaacccaacaaaaaacactgccacggttttcttccgaaccgaacgcattccaagcccgcccacgcccagggcgccacagctcgcgcggctcctctgctacctacagcgactgtcctgtcccatggggctctgcgcgtccgtgttgcaatggacggccaagcggcggcggcagcggcagcggcagcggcagcagcagcagcctgagccaaggcgcagcacgccgaaggccctatacgtcgtcaggaacggcgccggccagccgtccaggccagaggcgctcgtcgtctacggcccaccacacggctctggcggctcggggttacagtcacagaaggccggcgacggcgaggcggggagccggaagcgcgggcacgagtgctacgactgcatggacgtgctgggcaggaggctccacgcgccgccgcccaggctcccgtgcggcagcaccagaagcgtcgcgacggtggagccggtggtgacggccgggacgatgccggcgccggtgtccgggcccaggggcggcgccacggcggacgggaagaaggcggcaccggcggcagaggggtgcaggacaccgatgacgccacggaggacgccggtgtggcagcggaggatactgatggggacgcgctgcgagctcccgcggttcagtggggtcatactctatgacgagcacggccggcccctgcagagcagctcccagaacagagcaggccacctgacgagcagagcaagcagacacgaaaccaaggtaatggatgcatagcgctttgcgaactcggttttgaatagcgcatgcgtttttcagacgtctcaaaaatcaaatcaaatcaaatcaaatcaatcctgtttttttgacttacagggaaaaaagaaggctgccaggacaaccacaactctcagggatctcctgtagtcagttacctctcacatcacatgctattgcctcatttactggtagctaaaaatcgcgcctttgcaagtgctcccaggctcccagcaaactactgcgtttggtgttcccctcatgtaaagcgtgaaccattgaaggcatgcagattcagatactgaagcgttaatttctatccaaattacggtcagcccctcatcctattccaaggcatgaatgtttatgccaaagcatgagttgcttcacagattcaggacacgggactcgtcccaccctttaaaagtatagacatcatcaaggcagtaaaagcaacaaaagaatgcatatatactcttctatatcaaccggagaccagaacatcctcccgtaaccgtaacacgatcgtgtgaaaggccaagacggcctagcatgttcggcaaaaggctggccaaaatcacgtacaagggccaccagcgtaataaacccagttgctaaatcgctctaacaccgtcatgaacatcattagcacataaacatggccaccattggtatttaaatgggcatttgaatttttggagtatgtttaaatggtactttgtgaagtaactcaaaattttgcaatatgaccgtgctatgtttttgttacattaaaatacagcgtaagaagacatgttttttgacaatatttattcttatttttggtgaattatttaatcaacctaaaagttggcggaagatataaaattgagcactttgcttttttaaattgtcattgaatgaactgtattttattccttttccagggtgtaatgatcaaattcaaaaccaaatggcatttgatatcagcagagaaacggctgacatgagtaataattccagcaaaaacctttaaaatattgagccttttgttgctatggaattagtcagaggtattgtatagacacattgttgcgccaaggtacttaccatgcgttgtgcaactcatttgtacgacatggttatttatcgccacattactggtagctaagttgcaattttgcaagtgcttccagtaaatttatgcattaagcttgagtgcttgtaaagcgttaaccatcgaagacatggagattctcaaattcagatttcattttgttgcagggggat

SEQ ID NO: 12888 - DNA, 2704 bp, Zea mays
  misc_feature (2687)..(2687): n is a, c, g, or t
cggtccggatgcccgcgcgaccccgcgtccccccgcgcggccgcgggccacctccctacggaggagacgacccccatctcaaggtcgaggtcgagggctcctctctctctactctctaccatctccgttcgatcccatcgccccgccgccgccatggcgtttctcgcgcgggcgctgcggcagtccaactggcgcctgtcgtcgcgctgccccgccgtggccgcctcctgccgttggatctccccgaccgccgccgcgggatcgccggaggccggcgcggcggtggcgtctgccgacccggagctgcctccgccgcgggagcccgttggcggcgcccgcgtggagcttcctcctaacccggaggacgcgctcgaggtattcgtggatggccatgcggtgcggatccccaaggggttcaccgtgctccaggcctgcgaggtcgccggcgtcgacatcccgcgcttctgctaccatagccgactctccatcgctggaaactgccgcatgtgtctcgtcgaggtcgagaagtcgcccaagcccgtcgcttcctgtgccatgcccgcgctcccagggatgaagattaagacaaacaccccagtggcaaagaaggcaagggagggtgtcatggagttcttgctgatgaaccatccactcgactgcccaatctgtgatcagggcggcgagtgcgacctccaggatcagtctatggcatttggtgctgaccgcggccggttcactgagatgaagcgttcagttgtggacaagaatttgggtcccttggttaagacagtgatgactcgttgcatccaatgtacaaggtgtgtcaggtttgctactgaggttgctggagttcaagaccttggtatgttaggtcgtggcagtggtgaagaaattggaacatatgttgagaaacttatgacaagtgagctatctggaaatgtcattgatatctgccctgttggtgctcttacatccaagccatttgcatttaaagctcggaactgggaacttaagggcacagagactattgatgttactgatgcagtgggatccaacataagaattgacagcagaggacctgaagttatgcgtgttgttccacgtctcaatgaggacattaatgaggaatggatatcggataaaacacggttttgttatgatggtttgaagaggcaaagactaaatgaccctatgatccgtggtcctgatggcaggtttaaggctgtgacgtggcgtgatgctcttgcagttgttgctgaggttttgcatcaagttaagccggaagaaataactggagttgctggaaaactttctgatgcagaatccatgatggcactgaaagattttgttaacagaatgggttctgataaggttctctgtgagggaaatggtcccaatcctccagcagatctgcgatctaactacctaatgaatacgagcattgctgggcttgaaaaggctgatgtgttccttttggttggcactcagccaagggtggaagctgctatggttaatgccaggattcggaagactgttaaagcaacacaagcaaaggtgggctacattggtcctccagctgacttcaactatgatcatgagcatcttggcacaggaccgcagacccttgttgagattgcagagggtagtcaccctttctgctcagtattgcaatccgctaagaaccctgtcatcattgctggagctggattatttgaacgagaagaccaagttgccctattctcaacgattgagactgtagccaagaagttcaatgtgatgagaccagactggaatggccttaatgtcttgttgctccatgctgcacaggcggcagctcttgatcttgggcttgttgctaatcctgccgagagcatcaagtcagcgaagttcctgtatctgatgggagctgatgatataagcctggaaaagcttccagatgacgcatttgttgtttatcaaggacaccatggtgacaagggtgtctatagggccaatgttatcctgccatcttcagcattcagtgagaaggaaggcacctatgagaatactgaaggatgcacccagtggaccatcccagctgttccgacggttggtgatgctagggatgactggaagatcatccgcgctctttctgaggttgctggggctcagctgccttatgacagcctctcagctgtgagggaccggatcagtacggttgccccaaatctagtacatgtagacgagagggagacacccccaatctctgcggaggttaagccgcctgtgaagcaacaagtcagctcgacaccattcaaagctgttgtggagaacttctacatgactgatgcaatcacccgagcttcaaagatcatggcccagtgcagtgcaaccttgctgaagaagtgaggttttgcacaccatcaagctaatcttctgcaaaaacagcttcttagtccctttttttttttacctttgctgagtttcagtgtttcaccacccgttgcttgttttcttgagaggtctgtgtataatttggactgcctctaggtttccagagcagcaaaacctgatcagtacatttccgcgttgtgtgagaagcagaacatactcaataagcttgttgctcacattgaaccatacaagtgccacaagcaaatgatttttgccttttggcgaaaaaaaaaaaaaaaaaaaataatatatantttttagggcggttaat

SEQ ID NO: 12889 - DNA, 3039 bp, Zea mays
aggatatgttcccatccctctgaccgaccaccctcccaaggtcgagggctcctgtatctttaccgtctccaatcgatcccatctcctcgccatcgccgccgccatggcgttcctagcgcgggctctccgccagtccaattcgcgtctgtcgtcgtgcccctccgtcgccgcgtcctgccgctggatctcccggaccgccgccgcgggatcgccggaggccggcgcggcggtggcgccggctgacccggagttgcctccaccccgggagcctgttggcggcgcccgcgtggagcttcctcccaacccggaggacgcgctcgaggtgttcgtggatggccacgcggtgcggatccccaaagggttcaccgtgctacaggcctgcgaggtcgccggcgtcgacatcccgcgtttctgctaccatagccgactctccatcgctgggaactgccgtatgtgcctcgttgaggtcgagaagtcgcctaagcccgttgcatcttgtgccatgcccgcgctgccagggatgaaaatcaagacaaacaccccagtggcgaagaaggcgagggagggtgtcatggagttcttgctgatgaaccatccactggactgcccaatctgtgatcagggtggggagtgcgacctccaggatcagtctatggcatttggtgctgaccgcggtcggttcactgagatgaagcggtcagttgtggacaagaatctgggtcccttggttaagacagtgatgactcgttgcatccaatgtacaagatgtgtcaggtttgctactgaggttgctggtgttcaagaccttggtatgttaggtcgtggcagtggtgaagaaattggaacatatgttgagaaacttatgacaagtgaactatctggaaatgttattgatatctgccctgttggggctcttacatccaagccatttgcatttaaagctaggaactgggaactgaaaggcaccgagaccattgatgttactgatgcagtggggtccaacataagagttgacagcagaggacctgaagttatgcgcattgttccacgcctcaatgaggacattaatgaggaatggatttcggacaaaacacggttttgttatgatggtctgaagaggcaaagactaaatgaccctatgatccgtggtcctgatggcaggtttaaggctgtgacgtggcgtgatgctcttgcagttgttgctgaggttttgcaccaagttaagccagaagaaataactggagttgctggaaaactttctgatgcagaatccatgatggcactgaaagattttgttaacagaatgggttcagataaggtgctgtgtgaaggaaatggtcctaatcctccagcagatctgcgatctaactacctaatgaatacgagcattgctgggcttgaaaaggctgatgtcttccttttggttggcactcagccaagggtggaagctgctatggttaacgccaggattcggaagactgttaaagcaacacaagcaaaggttgggtacattggtcctccagctgactttaactatgaccatgagcatcttggcacaggaccacagacccttgttgagattacagagggtcgtcatcctttctgttcagtactgcaatctgccaagaaccctgtcatcattgctggggctggattatttgaacgggaagaccaagatgccctattctcaatggttgagactgtagccaagaagttcaatgtgactagaccagactggaatggccttaatgtcctgttgctccatgctgcacaggctgcagctcttgaccttggacttgttgctaatcctgccgagagcatcaagtcagcaaagttcttgtatctgatgggagctgatgatataagcctggacaagcttccagacgatgcatttgttgtttatcagggacaccatggagacaaggctgtctatagggccaacgttatcctgccatcttcagcattcagtgagaaggaaggcacctacgagaatactgaaggatgcacccagtggaccatcccagccgttcctacggttggtgatgctagggatgactggaagatcatccgtgctctttccgaggttgctggggctctactgccttacgacagtctctcagctgtgagggaccggatcagtacggtcgcacctaatctagtacatgtagacgagagggagccatccacaatctccgtcgaggtgaagccgcctgtaaagcaaaaggtcagctcgacgccattcaaaactgtggtggagaacttctacatgactgatgcaatcactcgagcttcgaagattatggcccaatgcagtgcgacattgctgaagaagtgagatttgcacccttcgagctaatcttcagcaaacaacttcttagttccctccctttttttttacttgctacgagtttcgccaccgttgcttgttttcttgggaggttttggtgtataatttggactgcctctagattttcttcagagcagcaaaacctgatcagtacatttccgtgctgtgtatgagaagcagagcatactcaataagcttgttgccccgactgaatcatcatacaagtgacacaacacatgattttgccttcaaatactcgccccttatgtttgtttgtaatgtgcaacttgccaaaagatagcaatctaaatcattgcttggttaggttgttaaaaaggatattgcttggttatattaatagtcttgaaatactattatcagtttgttttgcataatcaaattttgtgataggatttgacggtaactgaaagctgtattgtgtttcctaacaaaaaattcacagctcttattagtttcttaccctgttgcaacatctataaagtctttgagagaacttaaattttcttaacgagagtttgccagctgagaccgagaccgctcgcagattatagctaatttcttcgtccagagcttaccagtggcggcatgcttatatcttgatcttgacatatagtatacgcggtacgcccactgtattgtcgcgtcctcgtcccttggctgccgcgctgcag

SEQ ID NO: 12890 - DNA, 1022 bp, Zea mays
taccctcgaggctggccgggttattattaccaaaaaaaaaaaaaaaaatactgcaatctgccaagaaccctgtcatattgctggagctggattatttgaacgggaagaccaagatgccctattctcattgattgagactgtagccaagacgttcaatgtgactagaccagactggaatggccttaatgtcctgttgctccatgctgcacaggctgcagctcttgatcttgggcttgttgctaatcctgccgagagcatcaagtcagcaaagttcttgtatctgatgggagctgatgatataagcctggacaagcttccagacgatgcatttgttgtttatcagggacacccatggagacaaggctgtctatagggccaacgttatcctgccatcttcagcattcagtgagaaggaaggcacctacgagaatactgaaggatgcacccagtggaccattccagccgttcctacggttggtgatgctagggatgactggaagatcatccgtgctctttccgaggttgctggggctctactgccttacgacagtctctcagctgtgagggaccggatcagtacggtcgcaccaaatctagtacatgtagacgagagggagccatccacaatctccgtcgaggtgaagccgcctgtaaagcaaaaggtcagctcgacgccattcaaaactatggtggagaacttctacatgactgatgcaatcactcgagcttcaaagattatggcccaatgcagtgcgacattgctgaagaagtgagattcgcacccttcgagctaattttcagcaaacagctttttagcccccccccccccctttttttttacttgctacgagtttcgccaccgttgcttgttttcttgggaggttttggtgtataatttggactgcctctagattttcttcagagcagcaaaacctgatcagtacatttccgtgctgtgtatgagaagcagagcatactcaataagcttgttgccccaactggggcggcgggcggggggcacg

SEQ ID NO: 12891 - DNA, 1282 bp, Zea mays
tccttgggaaaataaaagtcttcttgaaaaaaaatagaatttccaaactagcatttactagtgtttttacctatcgttttcgagtagccatttgtcatatgtggagacagcctcaggtttactttagaaactccgctttcacgaggaatttccattttaacaaagaaaataaattaattttctatagaaaaataaaaatcatttgaaaaataaggcttacaaactaggaaggtccccgactcccacatggacttgggctgggcttcttctgtcagtttcagccggttgcgcttgcgccgccgggcggacacttgctcgcacgccacatccacagaatccatctccagatgtcagcctccggcgaccccctggacgtcctcccggcggcggtcctcgccgacgtcctgggccgtgtagctgacgccggagacatcgcggcttgccgcctggcctcgcggacgcttctcgccgcgtcctacatctgcccccgcgttcgcctctgcgccgccgaccgcgcccgccgccggcgcgagggcggtggtggttcccccgctttccgcgcgaccactgcaaacctcgcctcgcttctcgggcctcacctccggtccctgtcgctcgacacggccggcggtcagggttcccccgatgacgcgatgtgggtggaggagggagagttcgatgaggccgacggcctgcatctcacctgcggcgaggccgtggcggcctgggcgacgacctccgccggaacggtcctccgggagcttgagatcgccgactactggccgcaagcgtgctggcggaaggccgaggcgctccccctcatctcacactactgtatgcgagcttttttttaaggagattacctctggttatacgcgagttctacagatactactgcatgcaaggtttcactctgagagtgtcattttcgtttggtgtgtctgtcttcggttatgccatgcttgattgatgtaaacatatagctgaatatccgccacactaactctccgtagacatttgatgattagttcaaaatcatatcaagcagtggtgagagggggaggaggggtcatgtactcctgttcatagggaacttcccctaatcgatataatttaggtgttgtgtaacgcaacagcctcccaatgtttttgtagaataataagctcaaacgtcgaaaactttgatcataaataacatttgaagtatctataaactcaccatattcatcaagttatcttggaaagtactttcatggaggcataaatttgttatgttttggag

SEQ ID NO: 12892 - DNA, 4641 bp, Zea mays
acccataaacgctcgtgggtatgtatctatacccatacccgtacacactaggtatccgctacccgacggatacctgctaaccacccactacaatttctgcattcaacacaaaacaacaatttcatcattccagcagcatcaaacaacaatttcaccaccaaacaacaattttggtattcaagtagcatcaagttattggacgataatacaagcaatatttgtggaatgataatgcacaacattctagcaacaatataatttacccgcgatgagcccaagacttgatcacttgatatgatttctttctatggaagtaaatcgtttgtggcattttgttatatacgcacagatttaccatgttcttgatgaaaaagccatccattatactctgtttaaggtatcttgctgattaatcttgcctgcaatgatctggttctgcgcaggtcaaaatctcgtcaagttgtgccttaaaaatgcatggctttctgttgacaggctcaagaaaatgccaaatctgacttatctgacgcttgagttcattagactggatgatgaagacctcaaccaattgaatgaatgttttccttgccttcacacccttaatcttataggagtcggagggctcaaggaccctaagatccaccttcttcaactaaaggcttgctgctgggaggtatcaaatgtcccacggtctttggttgtccatgcaccagacttggtttttctggagttgaaatgtatcagaccagatacactcattttggacactccatccttgtctactctaaagctcaccattgataaacttggtgcaactgcccgagttgatggccttctgcgtttgtcgaatcttcgcatagaatcactggattttagttcccttttcccagcattcatggacaatcaagctatcaggacattggagctcgagctacctgagtcttcaagtcaatatgaacttcttgaagcagttaacccggattatcttctaagaaggctagccagcttttgtgaagtcaagctgggcccaagattttcacgtgaactgaaactatgtcttgcccagtacaaagatatccagtttggaagttgcctgaagaagctcctaattcatgtcccgcaatcagggagttgtttccatctcatgcccctgtttgagatctgtgcacctttgtgtgaggtgactgtgcttttccacgctgaatcagctgatgctgtccgtcgtcaagatgcaatgtcgatttgtatgcagaacttcccagagatcagatggcagtggggtacctggcagtagtaatactgtctatatatgcatattcgtacttgtaggcatattggttacataactgaaattatctgtgtgactgatacttgtagttttgctaacatagcagccccttctacacgattgggagctggttttgtttgatgacatactgtgcactagcattgtacgcagcaagtatggttgtctctgtttagtccattctatattactatatttcttgttgtctaaatattttacttgttgaaaactgtacctgcattattttgctattacctgctactctagctgtgacttgtgacgttcttttcccgtgtacatggaacagcaaggagattaatcgaccattaatcaggtgaggttagcattataccaacctagcgaagttatgcatttgaacttgtattccttctcaagattgtacactgtactgtatactctgtatcagctgatgtgcacatgccaaaccctgtctgccaaataatcctctccgaaaacacaaacatgaggtgccgaataagatctacagtacatctcaagggacggtgcctacccatctaatttcccatttggcaagaaaaaaggcttctgaatcttgtcgaagcaaatcgagttccggccaataaagtgatctcccgccaattcgatctctcacgtcacgtgcagaggcaccaggtgcaccggcagaagctagggcaggagcaactgcagcagccgcatcgccaccactggcaccggtaccaccaggagcaatcgaaccagcagcagccgcagcagcagcacccggtgtcgctgctccgccgctcctcctccgtcgtcatctccatgaaggccgacacggggggctcgagctgctgctgctgcggcggcggcggcgacggcggcggctgttcgcactccttctccagcggctggtacagcgcggtgttgacgaggtccttcttcctcggcgacgtctccgccagtctgcatgcaggtgattgctttattgcacggtcattgcgcggacaaagacaagatcaacaatggacatcacggtgcagtgcagtgcagtacattgggaaggcgaaggagaagttgctggagctgcttccggagccgctctcgtggctccggaacacggcggctctcttggcgtcgttgccgcacccggtgctggcggctggctccgcgctgcgcggcgccgccgcgaactccttggactcgggcgcgtccccgggctccgccccctccgcgagggacggcagcctggagtccgcctccgccatggcctcgtcgtagaagaagtcgaagtgcgacctgctgccggggtagaggtcgctggcgccctggatgctgaagagcgactcgttcgacgccatgctccagtcggcctgcgacaccgacgtcctgtgctggaagacggacgccgggatcctccccggatcgtacccgttgttggaccccgccgctccgaggctggtcggcgagaccgtctggaccttcggcgcctccggccgcgccgcgccgcggccgtccgacgacgcgaacgagtcgtcgacggccggaggcggtggatccggccacgtcacccagtcgtccggcttggcctccgcgctgtgcacggcgggagcggcctgtacatccttcgtcatcgcgccgtccgccggcttggcctcggcgctgtgtacggcgggagcggctcgttcgtcctccagcgtcgccgagtgggccgttttgaccaccgcgccgtgttcgtcctcgggcagcgccgctgccaacgggttgatgagctcgacgacatcgatgtggcacgggatatcagccgacgacgcggacgaggaggaggacgacgacgacgaggaggaggtcgactttctggccggctcgagttcggtgccctcttcctttggctcgtccggcgctgccatctcttccgacggtgttcccgccctggcattgtcccatagcgctgtgcttggtggagagaagagcggcgacccgggctggggctccatgaccacgtcctgcagcagccatggcatgcacgtttcagataatcgtccgtgtgtttattaataatctcctgatctttaacagccatcatcctcggataaataaaagaaaagaaacagctcaaagcaggatcatgagcgcgccacaggcaatcgaatccgttgctcgcctgaagaacaggaggagccccaacacgaggggaggcgggccgggggacggggctgcgacctgcgacgagaggacgagggaccggggctgcgcgcagccgctgcacctaaggacggcaccgccgttttggcggttggtgcgacgcgaggccacgctagctatttttggttgactcgtgtggtgtcgctgcgaatcattacggcgcgacgaggccggggaagccaccaaatccaaacggaacgcatccgcatcctggccctcgccaaatcgaggatgtctctgccagctcgcagctgcccgagacgcagagaaccgccgccgccgctggcgtccaggttgattgatggcacggacgctgatgccggcttgggtgcttgccgcgcgcgccaatggacaatggtgtcgtccgcctaattatcaccaaagtactttgcaatacttagtctattactatttcgagttgatatattgtcatattctatagaaatatgtatatgtgattcctcagtatattctaccgaaataaaatgcttatgattatcgctggttcgtcattagacgtatcatgtgtagctttcataggaaattgactctataataataccattcaacatatccggtactccagagtttataattaagaacttatatccaatgttgtgaaaagcatacccaaggaaaacacaatcgacagttttcggttctaatttgtgcttcttgttaattgacacattcactttagccaaacaaccctaagtgtgcaaataagagatattaaatttcttctttttccatttctcgaatggtgtgatttgtttgttctttatgggaactttattcgggacatgacataaatcagaatgtattaagtctattagtgccaaattactcgcctcctgagccttatgaagcttgcggggttgcttagattgcacgcacacttggcacttataacatttgactaaatcaaatttcgggattaaatttaaattttctaatcatgaaatacaactaaaattgatttgacaaagtcgtgaatgccaaatatacgactcatttgaaatcacattgtttatagagttattacacacatcattgcaaagataagcggaacaagcctccactgtcatagccttttccaacaaatgtcttgtactttgacaatatacgtttattagattcgaaaacaagtt

SEQ ID NO: 12893 - DNA, 1793 bp, Zea mays
tttctttttttttgcctctccagaagtttccgcagggaggcacagcaagagagagagcccagcactagataagtagggggggaaagaagcccgccggggcgtactcctcgatctccttcaagcagctaacataattaactcatgggtgcatagagatatgccgccgacgacccatcatatctatgggtccctccccttgcactgcatctccttcaattcctagtgtttgcttctcccttccttgacctttgcttggaaccattgattgatagttacttattattgggcatggagcacgtcatctcaatggaggagatcctcgggcccttctgggagctgctaccaccgccagcgccagagccagagccagagcgagagcagcctccggtaaccggcatcgtcgtcggcagtgtcatagacgttgctgctgctggtcacggtcatggtggcggcgacatgatggatcagcagcacgccacagagtggacctttgagaggttactggaagaggaggctctgacgacaagcacaccgccgccggtggtggtggtgccgaactcttgttgctcaggcgccctaaatgttgaccggccgccggtgatggaagaggcggtaatgatggcgcctgcggcggtgagtagtgccgtagtaggggaccccatggagtacaatgccatactgaggaggaagctggaggaggacctcgaggccttcaaaatgtggagggcggcctccagtgttgtgacctcagatcaacgttctcaaggctcaaacaatcacactggaggtagcagcatcaggaataatccagtgcagaacaagctgatgaacggcgaagatccaatcaacaataaccacgctcaaaccgcaggccttggcgtgaggcttgctactagctcttcctcgagagatccttcaccatcagacgaagacatggacggagaagtagagattctggggttcaagatgcctaccgaggaaagagtgaggaaaagaaaggaatccaatagagaatcagccagacgctcgagatacaggaaagccgctcacctgaaagaactggaagaccaggtagcacagctaaaagccgagaattcttgcctgctgaggcgcattgccgctctgaaccagaagtacaacgacgctaacgtcgacaacagggtgctgagagcggacatggagaccctaagagctaaggtgaagatgggagaggactctctgaagcgggtgatagagatgagctcatcagtgccgtcgtccatgcccatctcggcgccgacccccagctccgacgctccagtgccgccgccgcctatccgagacagcatcgtcggctacttctccgccacagccgcagacgacgatgcttcggtcggcaacggtttcttgcgactgcaagctcatcaagagcctgcatccatggtcgtcggtggaactctgagcgccacagagatgaaccgagtagcagcagccacgcattgcgcgggggccatggagctcatccagacggcgatgggatccatgccgccgacctccgcctccggatctacaccgccgccgcaggattatgagctgctgggtccaaatggggccatacacatggacatgtattaggcactgcgggtttcgtgatcgctgggaacattttatttgcaggcgtcgctgaataaggctggttgtctcgatctcccttgacatgaaatccaaataactcacaattaaccaaaaaaaaaaaaaaaaaaacactagttgaaggtattgttaatcataatagtgttgttctgtacttcaga

SEQ ID NO: 12894 - DNA, 1753 bp, Zea mays
gaagtttccgcagggaggcacagcaagagagagagcccagcactagataagtagggggggaaagaagagcatccaagcgtactcctcgatctccttcaagcagctaacataattaactcatgggtgcatagagatatgccgccgacgacccatcatatctatgggtccctccccttgcactgcatctccttcaattcctagtgtttgcttctccctttcttgacctttgcttggaaccattgattgatagttacttattattgggcatggagcacgtcatctcaatggaggagatcctcgggcccttctgggagctgctaccaccgccagcgccagagccagagcgagagcagcctccggtaaccggcatcgtcgtcggcagtgtcatagacgttgctgctgctggtcatggtgacggggacatgatggatcagcagcacgccacagagtggacctttgagaggttactagaagaggaggctctgacgacaagcacaccgccgccggtggtggtggtgccgaactcttgttgctcaggcgccctaaatgctgaccggccgccggtgatggaagaggcggtaactatggcgcctgcggcggtgagtagtgccgtagtaggtgaccccatggagtacaatgccatactgaggaggaagctggaggaggacctcgaggccttcaaaatgtggagggcggcctccagtgttgtgacctcagatcaacgttctcaaggctcaaacaatcacactggaggtagcagcatcaggaataatccagtgcagaacaagctgatgaacggcgaagatccaatcaacaataaccacgctcaaactgcaggccttggcgtgaggcttgctactagctcttcctcgagagatccttcaccatcagacgaagacatggacggagaagtagagattctggggttcaagatgcctaccgaggaaagagtgaggaaaagaaaggaatccaatagagaatcagccagacgctcgagatacaggaaagccgctcacctgaaagaactggaagaccaggtagcacagctaaaagccgagaattcttgcctgctgaggcgcattgccgctctgaaccagaagtacaacgacgctaacgtcgacaacagggtgctgagagcggacatggagaccctaagagctaaggtgaagatgggagaggactctctgaagcgggtgatagagatgagctcatcagtgccgtcgtccatgcccatctcggcgccgacccccagctccgacgctccagtgccgccgccgcctatccgagacagcatcgtcggctacttctccgccacagccgcagacgacgatgcttcggtcggcaacggtttcttgcgactgcaagctcatcaagagcctgcatccatggtcgtcggtggaactctgagcgccacagagatgaaccgagtagcagcagccacgcattgcgcgggggccatggagctcatccagacggcgatgggatccatgccgccgacctccgcctccggatctacaccgccgccgcaggattatgagctgctgggtccaaatggggccatacacatggacatgtattaggcactgcgggtttcgtgatcgctgggaacattttatttgcaggcgtcgctgaataaggctggttgtctcgatctcccttgacatgaaatccaaataactcacaattaaccatgagtgttccgtttggtcccagtttcagtgttccgtttggtccaaaaaaaaaaaaaaaaaaa

SEQ ID NO: 12895 - DNA, 1616 bp, Zea mays
ccacgcgtccgcttcaagcagctaacataattaactcatgggtgcatagagatatgccgccgacgacccatcatatctatggttacttattattgggcatggagcacgtcatctcaatggaggagatcctcgggcccttctgggagctgctaccaccgccagcgccagagccagagccagagcgagagcagcctccggtaaccggcatcgtcgtcggcagtgtcatagacgttgctgctgctggtcacggtcatggtggcggcgacatgatggatcagcagcacgccacagagtggacctttgagaggttactggaagaggaggctctgacgacaagcacaccgccgccggtggtggtggtgccgaactcttgttgctcaggcgccctaaatgttgaccggccgccggtgatggaagaggcggtaatgatggcgcctgcggcggtgagtagtgccgtagtaggggaccccatggagtacaatgccatactgaggaggaagctggaggaggacctcgaggccttcaaaatgtggagggcggcctccagtgttgtgacctcagatcaacgttctcaaggctcaaacaatcacactggaggtagcagcatcaggaataatccagtgcagaacaagctgatgaacggcgaagatccaatcaacaataaccacgctcaaaccgcaggccttggcgtgaggcttgctactagctcttcctcgagagatccttcaccatcagacgaagacatggacggagaagtagagattctggggttcaagatgcctaccgaggaaagagtgaggaaaagaaaggaatccaatagagaatcagccagacgctcgagatacaggaaagccgctcacctgaaagaactggaggaccaggtagcacagctaaaagccgagaattcttgcctgctgaggcgcattgccgctctgaaccagaagtacaacgacgctaacgtcgacaacagggtgctgagagcggacatggagaccctaagagctaaggtgaagatgggagaggactccctgaagcgggtgatagagatgagctcatcagtgccgtcgtccatgcccatctcggcgccgacccccagctccgacgctccagtgccgccgccgcctatccgagacagcatcgtcggctacttctccgccacagccgcagacgacgatgcttcggtcggcaacggtttcttgcgactgcaagctcatcaagagcctgcatccatggtcgtcggtggaactctgagcgccacagagatgaaccgagtagcagcagccacgcattgcgcgggggccatggagctcatccagacggcgatgggatccatgccgccgacctccgcctccggatctacaccgccgccgcaggattatgagctgctgggtccaaatggggccatacacatggacatgtattaggcactgcgggtttcgtgatcgctgggaacattttatttgcaggcgtcgctgaataaggctggttgtctcgatctcccttgacatgaaatccaaataactcacaattaaccatgagtgttccgtttggtcccagtttcgaaggtattgttaatcataatagtgttgttctgtacttcagaaaaaaaaaaaaag

SEQ ID NO: 12896 - DNA, 1557 bp, Zea mays
tctccttcaagcagctatagctagcataattaactcatgggtgcatagagatatgccgccgacgacccatatctatgggtccctccccttgcactgcatcttcttcttcctcctcctcgacctccttcaattattcctagtgtttgcttctcccttccttgacctttgcttggaaccattgatagttacttattgggcatggagcacgtcatctcaatggaggagatcctcgggcccttctgggagctgctgccagcgccagcgccagagccagagccggagcagcctccggtaaccggcatcgtcgtcggcagtgtcatagacgttgctgctgctggtcacggtgacggggagggtggcggcgacatgatggatcagcagcacgccacagagtggacctttgagaggttactggaagaggaggctctgacgacaagcacaccgccgccggtggtggtggtgccgaactcttgttgctcagccgccctaaatgttgaccggccgccggtgatggaagaggcggcaacgacgatggcgcatgcggcggtgagtagtgccgtagtaggtgaccccatggagtacaatgccatactgaggaggaagctggaggaggacctcgaggccttcaaaatgtggagggcggcctcctccagtgttgtgacctcagaacgttctcaaggctcaaacaatcacactggaggtagcagcatcaggaataatccagtgcagaacaagctgatgaacggcgaagatccaatcaacaataaccacgctcaaactgcaggccttggcgtgaggcttgctactagttcttcctcgagagatccttcaccatcagacgaagacatggacggagaagttgagattctggggttcaagatgcctaccgaggaaagagtgaggaaaagaatagagaatcagccagacgctcgagatacaggaaagccgctcacctgaaagaactggaggaccaggtagcacagctaaaagccgagaattcttgcctgctgaggcgcattgccgctctgaaccagaagtacaacgacgctaacgtcgacaacagggtgctgagagcggacatggagaccctaagagctaaggtgaagatgggagaggactctctgaagcgggtgatagagatgagctcatcagtgccgtcgtccatgcccatctcggcgccgacacccagctccgacgctccagtgccgccgccgccgcctatccgagacagcatcgtcggctacttctccgccccagccgcagacgacgatgcttcggtcggcaacggtttcttgcgactgcaagctcaagagcctgcgtccatggtcggcggtggaactctgtgcgccacagagatgaaccgagtagcagcagccacgcattgcgcgggggccatggagctcatccagacggcgatgggatccatgccgccgacctccgcctccggatctacaccgccgccgcgggattatgagctgctgggtccaaatggggccatacacatggacatgtattaggcactgcatgcatgcgggtttcgtgatcgctgggaacatt

SEQ ID NO: 12897 - DNA, 1895 bp, Zea mays
ttgggaccctcgaggccggccgatgctctcaggcagcctctcgctgtgtcagttccgctttgtaactgtagaaggagagtgagctcatcatcaagtcgagacgatgggccgcaccgaggcggcggacggcgccgagtccggcgggctgggggtgggggagacggtgcgcgagctgcgggaggcgtacgagggcggcaggacgcggagcctagcgtggcggcaggcgcagctgcggggcctcctccggctcctcgaggagaaggaggtggaggcgttccaggcgctccacaaggacctcggcaagcaccacgccgaggcgtacagggacgaggtcggggtgctcatcaagtccgccaacggcgcgctgcagcagctcggcaaatggatggccccggagaaggtgcgggtcccgctgatcgcttggccggcgaccgcgcaggtggtgccggagccgctcggggtcgtcctcgtcttctcctgctggaacgtccccttgggcctgtcgctggagccgctgatcggggcgatagcggccgggaacgcggtggctctgaagccgtccgagctctcgccgtgcaccgccaggttcctgggcgacaacatcgggaggtacatggactcctcggcggtgaaggtcgtccagggcggccccgacgtcggagtgcagctcatggagcaccgctgggacaaggtcctcttcaccgggagcccccgcatcgcgcgcgccgtgatggccgcggcgtccaggcacctgacgcccgtcgcgctggagctgggcggcaagtgcccctgcatcttcgacgccatgggcagcgcccgggacctgcagatctcggttaaccgcatgatcgcgggcaagtggtcgtcctgcgccggacaggcctgcatcgccatcgactacgtgctcgtcgaggagcgcttcgcgcccatcctgatcaaggtgctcaagtcgacgctgaagaggttcttcccggaagcggaccacatggcacggatcgtgaacgagcgccacttcgagaggctgagtaaccttctcaaagacaggtccgtggcgccgtccgtcctgcacggcggctccatggacagcaagaacttgtacattgagcccacgatactgctgaacccgccgctggactccgcgatcatgaccgaggagatattcgggcccctgctcccgatcatcacggtcaagaacatcgaggacagcatcgccttcgtgaaggccatgccgaagccgctcgccatctacgcgttcacccgggacgccgccctgcggcggcgaatcgtggacgagacgtcgtccgggagcgtcaccttcaacgacgcggtagtgcagtacgcgatagacgggctcccgttcggcggcgtcggccagagcgggttcgggcagtaccatgggaagtactcgttcgagatgttcagccacaagaaggcggtcatgaagcggggctaccttgtggagctgacactcaggtacccgccgtgggacgagagcaaggtcaccctcatgcgctacctctaccgcttcaactacttcgccttcgtcctctctttcctcgggctcaggcgatgaacttcactccagcatcaacgcaagggtcgcacagggattgggcccaataaaccggcattgacagtggatggaggaacatgccaatatagacaatatgcagtagttgtgttgtttgtgaggaacaagtgtcatgccgcacttcaaaaacagtaatgtgctaacctgcatcctaattcctatgatcctatctatgattgcctctagtgagacaaacagtgaaatgcctttcaatctttagtagtacattggtcagagaccatcatctatcctctgcataaaagtatcaagtgcaaaggagcaaaaatagatgccttgcgccgcc

SEQ ID NO: 12898 - DNA, 1960 bp, Zea mays
  misc_feature (1953)..(1953): n is a, c, g, or t
ctttttccgagatcggcgaaacaaatcgctgtaaaacccagcctgctaatcgccccactaggaggagtaggaggactctccgaggtccgagcggggtaggcaggtgtccgaaacggatcaccaaaccccgccggcgcagccgagagatccgacgtcgccgcgatccatggccgcctcgacggcggcggcgcggcgtctcctcctcgccctcgccgtcctcgccgcctgcctcggctcggcgccgcacggggccgtcgcgctccgctcgctcggcgtcgggggcgccaaggcggccgacggggacgcggccgtggacctcgacgcgtccaacttcaccgccttcctccagacttcgccggagtcgttcgcggtcgtcgagttcttcgcccactggtgtcctgcctgcagaaactacaagcctcactatgagagggttgcaaaacttttcaatggcccagatgctgcacatccagggactgttgtgatggcacgagttgattgtgcatcaaaggtgaacgtggatctttgcaacaaattctctgttgaccattatccttacctggtgtggggtccgccaacaaaattcaatttggttcagtggaaaccaaagcaagagaatagtgaattggaactaattgatgatggaagaacagcagatcggttactgaaatggataaataagaagatgggaagctcattcaatttagacgacaaaaagtatgagaatgaaagtatgcacccaaaaaatacttcagatcctgaacagattgttcgagcaatttatgacgttgaggaagctacatctcatgcattgcagataattttggagcacaagatgatcaaaccagacactcgtgactcgcttattagctttttacaaattttggtggctcatcatccatcaaagaggtgtcgaagaggatctgctgagctacttattgactttgatgatcactggcatacaaacctctcattaagtttggaagacagtactacactgttgaaaggtgcaggagagaaagtatgtggaaatggagtgccacgtggatactggattttctgccgaggaagtaaaaaggaaacaagaggatttagctgtggcctatgggttttgctgcattcactaactgtccgaatcggagatggagagagccaaacaacatttacatcaatttgtgatttcatccacaatttcttcatatgtgaggaatgccgcacgcacttctatgaaatgtgttcaagtgtatcagtccccttcaaatctgcccgtgaccttgccctctggctatggaccgcgcataacaaagttaacgagaggttgatgaaagaagaaaaggagttagacaatgctgatccttcatttcctaagatcatctggcctccaaagcaactctgtccattgtgctaccgttcttctagtaggacggctgatggagccatgcaggttgagtggaatgaagatgaagtattcaatttcttggttaactactacgggaagatgcttgtatcatcctacagggagacctccatgcagtcctttcaagtaggctcaatttctgacgattcttccgcatccagtgccgcaacagtacctattggagctgccctgggtatcgcccttgctagctgtacatttggggcgctagcatgcttctggaggacccaacagaagaacagaaagtactaccatttacgttctttaaagaaaatttgactaaacattttaggttcgtaggattccattactaatccgagccttgtagattcatatcatagagaagtgattagggtctttttgtctcctttgttcatttcacaggcaaagaaagaactggaactgaatagcttgcaccacttgcaaaccctaaactgcatgtctgcatcagaagtagcctccgtgagtgtaaattttctggaccggttatcttgacgatgggcccaaaagagtcgaanacagatg

SEQ ID NO: 12899 - DNA, 3788 bp, Zea mays
atgaaaaccgaaactgaaaatcccgaaaccagagcctcggaaccatgccgtttccataaagactatcatttccaaaaaaataccgtattttaaaatttgaatttcaaatatctgtcaacatcatattgtagtcgacaatatgtagattaattacaaagccgggtaaatttccgatcgaccggcaatcgtttcgtatagacgataccatttccgactgcttttgttggtttggacccggtatttgcagtggtccgccagcccaaaagctcatggtcaccccaggttatgatgcggccctatgggatgaagctggggttcaggggctttcttggtctggttgattgaatttcttcttagttaaataacgtgaggtagtatttccccaccgactgagtttttaaataatatattcaatttattatgttttatttagaagtcatcaatcaaagatatggctgtgaagtggtgttggctataagtctattctaccatgctacagtagtacagtatataattctctgtaccccgagggttctcacttactgaagaacttttgcagttgaataaaatgctagactgccagttgccatttctggacttatttttcttattattgaggcgtgggctaacattatccaatagtttctcgatcgaccgatgaccaccgcttgttgccaacttttattgcaataaagtcttgagattttcttctctccatctatttcctgcttacgtcatttcaatgtattgttgtactgctattaacttgaatgactgccatgtttgctcaggtgtcctgcctgcagaaactacaaggtatgtaaccggcagtagactctactatgatctgaactgcaattcatgctgatctcgtttcctctttatatacagcctcactatgagagggttgcaaaacttttcaatggcccagatgctgcacatccagggactgttgtgatggcacgagttgattgtgcatcaaaggtatagtagctccagtgaatagtgattttttgttttcaatttctttgatctaaacaactaagaactttgaaagggttttttttctgtgatcgaatctaactgttaacttgataatgttattccttatagaattatttaatcttctgttccccttttattatatctaaaacaatagaaagaaattctctctctctctctctctctagcattaatagggtttgtttgaatggaattctgtcaggctggcattgcctggccaggcagccttttccagccaccatccaaacatactagtgctgaatttgatttagtttagtttcagtgttatgtcagaagacgatgaagctggtaaataatgaaaacatgttgtggtttgcattggcatgcagtgatgccttatttcttttgaatgttcgacagcacaggtgaacgtggatctttgcaacaaattctctgttgaccattatccttacctggtgtggggtccgccaacaaaattcaatttggctcagtggaaaccaaagcaagagaatagtgaattggaactaattgatgatggaagaacagcagatcggttactgaaatggataaataagaagatgggaaggttagttgccacctattatgctttagtacacaatttcatatcaaatcagcaactgcttttacatctgttcttgcatttctcttttattgcctgtgtttatctggaagtatgctggtggattggtttggccctaattctgttatggtttgaattactttaggacttagtttaatgtaagcatgtaaccattatatacatgctttatttttactgatacagccatcgaatcgtctttttttgcagctcattcaatttagacgacaaaaagtatgagaatgaaagtatgcacccaaaaaatacttcagatcctgaacaggtgcagttgcatactgttttacttgagtaaatttccatgagatctacgaaaagattcagtccttatgaagcactatttactaataattttatgctgatagattgttcgagcaatttatgacgttgaggaagctacatctcatgcattgcagataattttggagcacaaggtttgagtgaaatgatcaaaacttccaactaatgtgctgtctgcacctctttttatgattattgctaatgttacctgcaactgtagatgatcaaaccagacactcgtgactcgcttattagctttttacaaattttggtggctcatcatccatcaaagaggtatggaggtgaatttttgagatactagtgccaatgcatagctgtgctgtattatgcatcatttgtttattgtttaggtgtcgaagaggatctgctgagctacttattgactttgatgatcactggcatacaaacctctcattaagtttggaagacagtactacactgttgaaaggtgcaggagagaaagtatgtggaaatggagtgccacgtggatactgggtatgccaaaattttcagtcagtcagtctgcatgtataattaataatgctatcgccccctcccctctgcaataacccttaaacatcataatccacactatgattttgaaccatttctttaattgcttttggctacatctttttgcgttgaatgtttaaggaattcaaatctctcccttgcaattgttactttgagtttacatttgttttctttgtacttgtgttgcagattttctgccgaggaagtaaaaaggaaacaagaggatttaggtgatttctgcgctctatattttattggaaacgtgcaaaatttatttgatattctttctgagacttcattgagaagctcaatatcacatgaaacttacagttgatttagctgtggcctatgggttttgctgcattcactaactgtccgaatcggagatggagagagccaaacaacatttacatcaatttgtgatttcatccacaatttcttcatatgtgaggaatgccgcacacacttctatgaaatgtgttcaagtgtatcagtccccttcaaatctgcccgtgaccttgccctctggctatggaccgcgcataacaaagttaacgagaggttgatgaaagaagaaaaggagttagacaatgctgatccttcatttcctaagatcatctggcctccaaagcaactctgtccattgtgctaccgttcttctagtaggacggctgatggagccatgcaggttgagtggaatgaagatgaagtattcaatttcttggttaactactacgggaagatgcttgtatcatcctacagggagacctccatgcagtcctttcaagtaggctcaatttctgacgattcttccgcatccagtgccgcaacagtacctattggagctgccctgggtatcgcccttgctagctgtacatttggggcgctagcatgcttctggaggacccaacagaagaacagaaagcaaagaaagaactggaactgaatatcttgcaccacttgcaaaccctaaactgcatgtctgcatcagaaggagcctccgtgagtgtaaattttctggaccggttatcttgacgatgggcccaaaagagtcgaaaacagatgaaaaacatacagagtagatttagtagtgccgagtcacgtggtagtgttgcgcgacggcgcgaactttgttgcaacaggtaatacagattgaacgtgtaaactctgtccttaacatgtttctcggatacctttacctggttatcgatgtaatattatcaatttaatgagtgaaaacgctgtgccttactttttgctgagctgaaacctcatcgatgttgtatctgtc

SEQ ID NO: 12900 - DNA, 3890 bp, Zea mays
gtgaggatgccgcacacacttctatgaaatgtgttcaaggtttggaaaaactactctagccatatattgccacagaaatcaactgcatgtttaatagttaccgttcacctgtagtgtatcagtccccttcaaatctgcccgtgaccttgccctctggctatggaccgcgcataacaaagttaacgagaggttgatgaaagaagaaaaggagttagacaatgctgatccttcatttcctaagatcatctggcctccaaagcaactctgtccattgtgctaccgttcttctagtaggacggctgatggagccatgcaggttgagtggaatgaagatgaagtattcaatttcttggttaactactacgggaagatgcttgtatcatcctacagggagacctccatgcagtcctttcaagtagcctcaatttctgacgattcttccgcatccagtgccgcaacagtacctattggagctgccctgggtatcgcccttgctagctgtacatttggggcgctagcatgcttctggaggacccaacagaagaacagaaagtactaccatttacgttctttaaagaaaatttgactaaacattttaggttcgtaggattccattactaatccgagccttgtagattcatatcatagagaagtgattagggtctttttgtctcctttgttcatttcacaggcaaagaaagaactggaactgaatatcttgcaccacttgcaaaccctaaactgcatgtctgcatcagaagtagcctccgtgagtgtaaattttctggaccggttatcttgacgatgggcccaaaagagtcgaaaacagatgaaaaacatacagagtagatttagtagtgccgagtcacgtggtagtgttgcgcgacggcgcgaactttgttgcaacaggtaatacagattgaacgtgtaaactctgtccttaacatgtttctcggatacctttacctggttatcgatgtaatattatcaatttaatgagtgaaaacgctgtgccttactttatgctgagctgaaacttcatcgatgttgtatctgtcatcctaatggttgccgtactacgtccagtcgaaaaaggatgtaaatgccatttcttggcaaatttttatgtaagaaaatattgataattgtgacgcgtcataaataacactagataaatgaccaactttagtttttatgataaatctatttagaaatacaaatgttgctactgtttcctataagttgatcaaaatttagaatgtcaatcagtcaataccttagttctggtgaaacatgtatatgtatttttttcatgttgaaaatacatgtttcagagataattttaacttgaacaatattattattattaagtaaattagaataagatcacattgaacgatgttttgcgaaatttcacaggatttacaaatatgaaatataccttggccgctaaaactgagtatctcggttgagtgaccaacatatgtttcttggaagtttcatagctcagacccgccccatgaggccatgagcccatgactacgcccagtgcacaaacctgtggagctctgaatttgccttacctctgattcaacttcatccgaagaaagtggtggtcacgtacagtggtctctaactctctatagaatgctgctgggagcagttaaataaggtactgctactactactatgtacaggtgcagtcaaagctgttctgaagctacgattacagccaagtcatcttccatatcatattcgctggcacgtcacgtcacacctgaagctcagtcgttcgtcgaaggatcaacacaattctggacgacagcacagcaagaacaccaggatggatggccatggccagcctgctactgaatgctgatgacatgctgctgcggctgcgtccgctcctctgccgcatgatctgaagcctggccgtgcacaacctgcacaccgccagtcacgcctcagcttgaaactgcatgtacggtcatcttgcagcatgacctttcgtaaaaagatccagacaaacctgccgatgccggcgtcggtgcagcagctcggtaaccgccaccagtatgatgtagaccggaatgacgatggccgcggttctaagcatcagcagctgttttttttcccaaggaggatgatttgtgctaggtaggttagacaagcatccacatgcgacgcacctaggtttgcaaggatgtgttgtgatccagagccttaccgtgaccactgcaacggtgtaggcgtcttggtcacccaggaagacggagacggcgtcgcggaagacgaggaggaccatcagctgaatgaagggtggacgtttcagaatgtcaactcttctttcttttggacgaacaggaaaccggccatgtactgaactgtacttacagcgatggcgattatgcgacagcatagtacgccggtaggatccggcgtttggtcgtgtccgtagcctgtcgacgtagcggagtgatccgcgttctgcatcggccgtgcttggatgtagccaggagcactgcaggttgagaaacgagatagatggatggatggatggatgggtatacaatgcactcctggttagcggtcagattcgttcttgcgataacaagccaagtcccaaggcacctacctgaagaaaaacgtgtttcttccgcgctgaaacagctttgaagaggcagtgtagtttggcacaaattgctgcacggccgtggatcacaagatagcagtcagtttagtttcctttttctttcttttttttttcttttggatgtgaaacactatctcagcactagattaggatttcacctgcaagcatatctcacacacggtgtctcccttctcgtcacaccaccgctgaatgcatctgcgatgggcgtactgcaacagaacacattatattaaccctccgaagttcgaattcctggaacttttctcccctcgctcccccaaaaaaacaattgctgaaacggactaggatcggataagcatgacggccgatgacgcgttgtaccttcaagcttcccttgcaggagcaaggagcctccatgcaggcctcgtcgccgtcctcctgacagatcctgcactctaccagcacaccgctcgccggcccctcgtcttgggcagacacaccgcgcgcagccgacgtggtggtagagggcacggcagagacgtcgtcgtcagtggcggaccgaagactgggctccgcgagcgaccggcccgccatcaccgcggagcggcctgccgtcgtcgatcccgggaaggaagctcgagacgacgaaccgcccgagcgtaagaatggtaatgaagacggatgcagacggaatggaagggggcggggaagaagggcagcgccagcggcgggcaggctgaaggggaaggcttgcggcgagggatttggatatctgaagcgccgagagaatgccgcagggaagcaagagatggagtaggcggctaggcgcctctttggcactgctgagtgctgacagttgcttgcttctcaaacatcttacaacaaaatcgttggtgcatgcagcgaacaaggcaccgccggggaattcggcggcaaaccgatcgagtgttgattgctgccttaataaataaagatattctttccccactaaaacacaaacaagttatagttagagaaataatggagccataccatatcattgctctaagcgttgttcaagcaagcattgttctggtatccgaaattacaacaaaatcgcattagcatttttgtatcctgttgatgctgataggctggtatccggtatcctctttcgcttgtcggtttgtcataaaccatgcgattctggtttggtttaggggtggggaagttgacaaaggaagaaaagaaaggtgctgcatcatattgattaaag

SEQ ID NO: 12901 - DNA, 1502 bp, Zea mays
aaacaaaaccctcctcgtcatccgcggccgcttttcccctgacccctgtctcgaccaatcctccctcccacacacatcacacccacaagacaaaaaaaaaaagcgcctttgagcgccgcgcgatctctggtgcttggtgtcgtcgcgacaccagcgttagtttctgtttcagcgcgcacgcgcgtttgtgctgtgggggttgggaagagccgaagagcgaggcggcagcgcgatcgagcggttcggcgggcggcggccgatccgatgggaagggcaccctgctgcgacaagaacaagggcctcaagaaagggccctggacgccggaggaggacaagctcctcgtcgactacatccagaccaacggccatggcagctggcgcctgctccccaagctcgcagggctgaaccggtgcggcaagagctgccgactgcggtggaccaactacctccggccggacatcaagcgcgggcccttcacagccgaggaggagaagtccatcgtccagctccacgccatcgtcggcaacaagtggtccatgatcgcggcacagctcccaggccggacggacaacgagatcaagaactactggaacacgcacctcaagaagcagctgcgtcggatgggcctcgacgagcccccgcccggcccggccgccggctgccccgccgcgcgccacatggcgcagtgggagacggccaggctcgaggccgaggcgcgcctctccctcctcgccgccaccgccgcctcctccggtaccactgcgaccaccaccaccaccacgtctgcagcctcctcgtcctccaccaccgtcgctggcgcggccgacaacaaggcctccaaccccgcggacatcttcctgcgcctgtggagctcggacatcggggactccttccgccgcaagacggacacgccggcggtgcccgcgcttcccggcgcccgtcgtcaagaggaaggacacggcgatcaagcaggagccgcgggcgctgctgctcggcctcggggacgactcctcggcggcgtccaacgacaacgagacggaggtggcggaggcgctggaggcggagtaccagatgttcctcgacttcgcgggcgaagagctgggactattccatggccggcacggcggcttctcgctgttcccgccgctcgacgtgctcgctgaggcgtccctggactcggctttcaagtgaagacgtagccagcaccacgtacgtacacggtactcatacgtacggcaagcggcagtggccaactggccatgcctctacggcttagctatacgcctcgaaatgcgcgcatggatgtatatagatatgcgtgtgactgcactggcatatcggcaattttttgggttaggccagcaagtgcgtggtttagcttgttattatgcagggttggttttggtaggacatcatggtgtatgggggattctctgttcattggagatgctctaatacatcacgagatgttcttcaatcttcggcaaaaaaaaaaaaaaaa

SEQ ID NO: 12902 - DNA, 2024 bp, Zea mays
ctcggccgggagggatcctcctcggccgcaaacaaaaccctccttggcatccgcgcccgctttcccccctgccggcccccggtctcgctctcgcccaagcaccaaatcttcctcccactcatcacaagacgaagtttcagtgcctgcgcgtgccgcgcgatctctcgtccttggcgtcgtcaagacgcgttagtttcagtgcgcgcacgagtgtgtgttgtgggagttagtgagagcgagagcgagagcgagcgcaccaagcgattcggcgggcggcggctgatggggagggcgccgtgctgcgacaggaccaagggcctcaagaaggggccctggacgccggaggaggacaagctcctcgtcgactacatccagaccaacggccatggcagctggcgcctgctccccaagctcgcagggctaaaccggtgcggcaagagctgccgactgcggtggacgaactacctccggccggacatcaagcgcgggcccttcacagccgaggagcagaagtccatcgtccagctccacgccatcgtcggcaacaagtggtccatgatcgccgcgcagctccctggccggacggacaacgagatcaagaactactggaacacgcacctcaagaagcagctgcgtcggatgggcctcgacgagcccccgcccggcccggccgccggctgccccgccgcgcgccacatggcgcagtgggaaacggccaggctcgaggcggaggcgcgcctctccctcctcgccaccgccgcctcctcctcctcctgcggcgccatcgcggccacctccgcctcatcctcctcctccaccgtggacttgaagaccgcatgcgccaggcccgcggacatcttcctgcgcctgtggagctcggacatcggggactccttccgccgcaagacggccgcggcgcccgtggtcaagaggaaggacgcggtgatcaagcaggagtcgcaggcgctgctgctcggtcccgggggggacgactcctcggccgcgtccaacgagacggaggtggcggaggcgctggaggcggagtaccagatgttcctcaacttcgccggcgaagagctggggctgtttcacggccggcacggcggcttctcgctgttcccgccgctcgacgtgctcgccgaggcgtccctggacacggcgttcaagtgaagacgtagcgagtaccacgtacgtacacatacctattgccatgggcaagcggcagtggacatgcctctacggctagctgtatactgtacgccgcctccgccttaacatgagcgcggatgtactatgtatatatgcatgctgtctcgcgtattataccgcgggctggcgcgcgcgcatacgtacggtacttgtacgtgtgactgctggcatcaggagttttttttttgttagggcatcaaccaaccagcaagtgcgtggtttagcttgttaaccgggttagttttggaccttttggtaggacgccatggtgtgtatggggggattctctgtgcatgcgtcagccgtaactagatatgctgtgctctaatacatcaacaatcgattatgggactggttttcgcactgcaaacatacttgacctgttttttgtagcataaatggagtatggcctgccgcaattttcctattttctgtaaaacatttttgcagcttttagttttcttgaaatctgcacatatatattatacacaactttatatataacattttgaggggaaaacctaatcaagttcaaccataatcgtaacgttttcaatacatctttgtggaacatactaatttcacaagtaaactaatttacatttgagcaatttgcttttttatctttatattaacagaattgctatgttagaataccgtaagatggggggtgcaaaaattctgtatagaatagataatattcttaggtattaacaggtgaagtgagctaccaggtataatttaatagctgcatcgcccctagccctagcgtccctcccatacatatatgctgcactctcacctgcaggcatgca

SEQ ID NO: 12903 - DNA, 2920 bp, Zea mays
  misc_feature (260)..(260): n is a, c, g, or t
  misc_feature (878)..(878): n is a, c, g, or t
cgtgtgctggctgaaattgcttgaagaacagcaccaccgacctctgttcacgttcagtcaatcggcttcagaccgcgggttttgtactgcacacgtttaacgtagtatcacgcgagcaaattatagattaaccggactaaagtttaagccaaaatgcaaacaccccttggcccagtggccagagggcagcgtcatatccaatcaaccagcgcatggcatgggcatgccggcatggtgccatggtcgtacggtccgagttngacacgcaaaaccggaaccgctgaactgagagtgagagggcgagaggcctccgctcccctgcttccccggctggctcccccacgccacccgtctactccgttgtctcgtcgcaggcagcaggtgaaaatctccgccattaagcgcgccccagggatcctcctcggccgcaaacaaaaccctcctcgtcatccgcgcccgctttcccccctgccggcccccggtctcgctctcgcccaagcaccaaatcttcctcccactcatcacaagacgaagtttcagtgcctgcgcgtgccgcgcgatctctcgtccttggcgtcgtcaagacgcgttagtttcagtgcgcgcacgagtgtgtgttgtgggagttagtgagagcgagagcgagagcgagcgcaccaagcgattcggcgggcggcggccgatggggagggcgccgtgctgcgacaggaccaagggcctcaagaaggggccctggacgccggaggaggacaagctcctcgtcgactacatccagaccaacggccatggcagctggcgcctgctccccaagctcgcaggtcggaaccatccctctcttcttgcttccatttcttcttcgcggtttccacccacacgcngtcgtcttgttagttctgcagctgcctccctgccggcctcaaccatacggatacggctgtgatgcttctcgctcggattgcaggcacacgcgcggtctcatctaacccccattcgcggcgcatttgcagggctaaaccggtgcggcaagagctgccgactgcggtggacgaactacctccggccggacatcaagcgcgggcccttcacatccgaggagcagaagtccatcgtccagctccacgccatcgtcggcaacaagtaagcccagaacacttgccgagccgagctatcccctgtccctgtccgtcccctcccattcgatctgtggcagagaccagcacgtttcctctctcatgatgcatactcgctcactcacctagctaaagagcttgcacggccagtgtgctgccgctcggcccagcttccccactgttgcaaagcatcgcgccgcattgagcgatgcggtgccacctccgtccaacctccaacgcatcgctctcgtagtatattcctatttctgccatgatacttggtgatagctactgctgggacttgaaagtatattgatggtcttttttttctggtgttggtccttcttcctcaggtggtccatgatcgccgcgcagctccctggccggacggacaacgagatcaagaactactggaacacgcacctcaagaagcagctgcgtcggatgggcctcgacgagcccccgcccggcccggccgccggctgccccgccgcgcgccacatggcgcagtgggaaacggccaggctcgaggcggaggcgcgcctctccctcctcgccaccgccgcctcactcctcctcctgcggcgccatcgcggccacctccgcctcatcctcctcctccaccatggacttgaagaccgcatgcgccaggcccgcggacatcttcctgcgcctgtggagctcggacatcggggactccttccgccgcaagacggccgcggcgcccgtggtcaagaggaaggacgcggtgatcaagcaggagtcgcaggcgctgctgctcggtcccgggggggacgactcctcggccgcgtccaacgagacggaggtggcggaggcgctggaggcggagtaccagatgttcctcgacttcgccggcgaagagctggggctgtttcacggccggcacggcggcttctcgctgttcccgccgctcgacgtgctcgccgaggcgtccctggacacggcgttcaagtgaagacgtagcgagtaccacgtacgtacacatacctattgccatgggcaagcggcagtggacatgcctctacggctagctgtatactgtacgccgcctccgccttaacatgagcgcggatgtactatgtatatatgcatgctgtctcgcgtattataccgcgggctggcgcgcgcgcatacgtacggtacttctacgtgtgactgctggcatcaggagttttttttttgttagggcatcaaccaaccagcaagtgcgtggtttagcttgttaaccgggttagttttggaccttttggtaggacgccatggtgtgtatggggggattctctgtgcatgcgtcagccgtaaccagatatgctgtgctctaatacatcaacaatcgattatgggactggttttcgcactgcaaacatacttgacctgttttttgtagcataaatggagtatggcctgccgcaattttcctattttctgtaaaacatttttgcagcttttagttttcttgaaatctgcacatatatattatacacaactttatatataacattttgaggggaaaacctaatcaagttcaaccataatcgtaacgttttcaatacatctttgtggaacatactaatttcacaagtaaactaatttacatttgagcaatttgctttgttatctttatattaatagaattgctatgttagaataccgtaatattcttaggtgatattcttaggtgaagtgagctaccaggtataatttaatagttgcatcgcccctagccctagcgtccctcccatacatatatgctgcactctcacctgcag

SEQ ID NO: 12904 - DNA, 2033 bp, Zea mays
  misc_feature (348)..(348): n is a, c, g, or t
cctgctttgagcgtgctgagtaaccatcacacttaagggcttaggtaccatgcacattaatggcgtgtttggtttgtggagttaccctatgcttcataaggtgatgcatcatgagttcatctcataaattttggtggaatcaactcattcctcatgtatatactaattattagcttatgagtaatgaagtggtaatggatcaactattctattccacaaacccaataaaaaagtgaggagcgagaagatggaccacctcatttatcaaaccaaacacaccctaagtttcattttcaattacaagttttgacttggttgtctaaattgtggttgtttcaatgtttgaanatttgaagattacattgctgcgaggaccgtcccagtgatataggggtcattgcaaagattgagagcatcgatgctttgaagaacctggaggagattatccgtgcatcagatggagtaatggtagccagaggggacttgggggcacaaatccccctggaacaggtcccttccatacagcaaagaatagttagaatgtgcagacagctcaacaagccagtcattgttgcttctcagcttctggaatcagtgatcgagtatcctacacctactagggctgaggttgctgatgtttctgaggcagtccgccagcgtgcagatgctctcatgctttctggtgagtcggccatggggaggtacccagagaaggctctcagcgtccttaggagtgttagcctgaggatcgaaaggtggtggagagaggagaagcgccaagaggcactggagcttcaaggtgtctcgtcttccttttctgacaagatatcagaggaaatatgcaattcagcagctaaaatgggtaaaacccggcactttttttttcactgtccactgtaattttgttataaatgcatataagaaattaccgcgctttggtgcgtcctgtttttgcttctgagaagctagcccatgtctcttgtttggaactagttcagatactttgcattctgtttcgcgcataaaacatttgaacccaactcttatgctaacctgtgtgccctgcttcctaacggccaacaacttaggagtcgacgccgttttcgtttacacgaaggatggctacatgggctccctgctctcacgatgccgccccgactgcccgatcttcgccttcacgtcttcgacgtccgtcaggagacggctgaacctccagtggggcctcatcccgttccggctgagcgagtccgacgacatggagagcaacctcaaccgcaccttctccctgctgaaggccaggggcatggtgcagtctggagacctggtgatcgcgctctccgacatgctgcagtccatccaagtggtgaatgtgccctaggaatacgatccccatgtccagctggttccttgacctggaatgtagcatacaattaggaggggcttctttttttgtttgtttgtttgtcatttgagtgtatcccagttcgtagcatgtttctgcctcatgttgaggctctctggatgtcgatattgatttgcgtcagtgtggtttaggttcggactcgaatgctcgatttgaaaattcgaacagaactcggtttgcatcagtgtcatgattaactcaaaccattgttctgtactatatcagaacgtgttactacttatcttagtgtcattcctcagtttcacttggttttttttaaaaaaaatattgggaaaaatgtgcccagtaatctgggaacatatatcatgtgctgatgtgcagtcagtcctgttgatgcaaatgtgtaatcaagcgatctgatgtatctaattaaaatccaatgatcgcatgtaacatggtggtccaattgtactcacacatcaaaatcgtgtctatggtaacaaaagggaggtgacgaatattataagaataacaaatgtcatgtaggtcatgaaaatacctaggaggtttgacaagctttgtgagtagtacgtgggatgtgggtgacctacatgatttatctcactctcagtatccatacatggttcat

SEQ ID NO: 12905 - DNA, 1120 bp, Zea mays
cggacgcgtgggcggacgcgtgggttgaagagttacattgctgcgaggagccgtggaagtgatataggggtcattgcatcggctgcgtgcgccccccccccgaagaacctggaggagattatccgtgcatcagatggagtaatggtagccagaggggacttgggggcacaaatccccctggaacaggtcccttccatacagcaaagaatagttagaatgtgcagacagctcaacaagccagtcattgttgcttctcagcttctggaatcaatgatcgagtatcctacacctactagggctgaggttgctgatgtttctgaggcagtccgccagcgtgcagatgctctcatgctttctggtgagtcggccatggggaggtacccagagaaggctctcagcgtccttaggagtgttagcctgaggatcgaaaggtggtggagagaggagaagcgccaagaggcactggagcttcaaggtgtctcgtcttccttttctgacaagatatcagaggaaatatgcaattcagcagctaaaatggccaacaacttaggagtcgacgccgttttcgtttacacgaaggatggctacatgggctccctgctctcacgatgccgccccgactgcccgatcttcgccttcacgtcttcgacgtctgtcaggagacggctgaacctccagtggggcctcatcccgttccggctgagcgagtccgacgacatggagagcaacctcaaccgcaccttctccctgctgaaggccaggggcatggtgcagtctggagacctggtgatcgcgctctccgacatgctgcagtccatccaagtggtgaatgtgccctaggaatacgatccccatgtccagctggttccttgacctggaatgtagcatacaattaggaggggcttctttttttgtttgtttgtttgtcatttgagtgtatcccagttcgtagcatgtttctgcctcatgttgaggctctctggatgtcgatattgatttgcgtcagtgtggtttaggttcggactcgaatgctcgatttgaaaattcgaacagaactcggtttgcatcagtgtcatgattaactcaaaccattgttctgtactaaaaaaaaaaaaaaaaa

SEQ ID NO: 12906 - DNA, 881 bp, Zea mays
  misc_feature (847)..(847): n is a, c, g, or t
  misc_feature (855)..(855): n is a, c, g, or t
ttggttgtggacccacttggcagtcaccctgagtggctccagacgggtcgcagtcgacccacacggccagcggcctcgcccgcctccttatttagaaccgacgacgacacccatccgacccgatcggcgggagagcacgagacgcccctctgcttccttttctctgtcgctcaaaagttgctggagccctcttctctctctctatctcctctccgagccccaaccatggatgaggcgcaagttatggagtcaaaggatggaaccatctcagttgcttctgcatttgctgctcatcaggaagctgtgcaagacagggatcacaaattcttgacaaaagcagtggaagaagcataccgaggagtcgattgcggtgacggaggtccatttggagcagttgtcgtccgcaatgatgaagtggtagttagctgccataacatggttctgaagcacactgaccctactgcgcatgctgaagtaactgcaattagagaggcttgcaaaaagctcgggaaaatcgagctctctgactgcgaaatttacgcgtcctgcgagccatgcccaatgtgctttggtgcagttcatctctcccgaatcaagaggctggtttatggggccaaggcggaggctgccatcgccattgggtttgacgacttcattgcagatgctctgagaggcactgggttctaccagaaggccaacatggagatcaagaaggccgacggcaatggcgcgctgatcgccgagcaggtcttcgaaaagactaaggagaagttccagatgtactgatgctgcgcggctgaagagggatttcagatttgtacaatgctcacccagaaggaataatacnccaatgtncaaaaaaaaaaaaaaaaaaaaaaaaa

SEQ ID NO: 12907 - DNA, 3229 bp, Zea mays
  misc_feature (2984)..(2984): n is a, c, g, or t
ctcgcgtacgaaaatgcacacctagttgattactcagcttgttgcttttgcttttgcttttgcttttgcttctgcgaatctcgtcgggtgagcctgaaccgctagggtgggggtggggatacggagcgattccggcggtgctccatatcccgtggagtatatgggcattggacagtgttgttgtaactctgttgcctgcttgcctactgggtcaccttggcccccctttttccgtcagattccaatcagattgtgcatcacaaactttagtttttatctggatgcacacgcatgagctgagcgtcgatgctgtaaggtccaccagtctgcttgttgctctactgaaaagacatcatataagcatgacatcgtggaacgatttttctttctctaaactatacagcaagtagacagaccatagggctggatccatgtgaccatgctactattattcttgtctgtgtctttcctgctcattccgcgccaacagggcacatgccaaatagatatgtaggcatcaaatgacaagaaacagtacctaatgaaaccagaattcggttttggttccacaagtaaaattctaggacattctggtatctgacagaaaaattactcagatatgtaggcatcaaatgacaagaaacagtacctaatgaaaccagaattcggttttggttccacaagtaaaattctaggacattctggtatctgacagaaaaattactctttacaagcggggatttttttttaaaaaaaaagataatggaaacgaggttgcagcctagaagtggggaagtgatttgagtgtttgccatgaatgaattgatgtctgaaatacttaactgaagatccgttgtcttgaaattgagccaaactatttgtttcatttgaatgtacaagtcataattgatgtcattgagatttatgcctttgcttcaaaaggaacctacaatatttttcgcagctgcatcttttcttgtctgccaacctgatctctttgtggttcggtacaagtttaggacaaagtaatctgatgaaatttaatcgctgattagctgtatataatcgatattagcagcacggtttcttctgataaaccatgacctcaatctcaacgtatgtgcttttgtactgcagttgtggagtcaaaggatggaaccatctcagttgcttctgcatttgttgctcatcaggaaggtgagaacattgccatggtatttttttttgtagttccctcgtagttgcacagctttacttactgagataaggtcaacactggacatggcctggacctatgatctctaaggtcacagtttctcgcctttggtaaaacttgctcttatgtaacgacagcaagaaaactgatctaagacctgcattgtggtgaattttgcagctgtacaagacagggatcacaaattcttgacaaaagcagtggaagaagcataccgaggagtcgattgcggcgatggaggtccatttggagcagttgtcgtccgtaatgatgaagtggttgttagctgccataacatggttctgaagcacactgaccctactgcgcatgctgaagtaactgcaattagagaggtaaattacctgaaggctaccattagcagtcttacttagtaaaattatcattactttaatctctttttgcaatctgtctagcagttaatttcattatttgatatgtgcttgatggtctctgtatgcccatattttaggcttgcaaaaagctcgggaaaatcgagctctctgactgcgaaatttacgcgtcctgcgagccatgcccaatgtgctttggtgcagttcatctctcccgaatcaaggttcataatttactgttttgattgcctaaacagatataggcacagctagacattactgcgctttggtgctgttcatctctcccggatcaagaggctggtttatggggccaaggcggaggctgccatcgccattgggtttgacgacttcattgcagatgctctgagaggcactgggttctaccagaaggccaacatggagatcaagaaggccgacggcaatggcgcgctgatcgccgagcaggtcttcgaaaagactaaggagaagttccagatgtactgatgcttggctgaagagggatttcggatttgtacaatgctcacccagaaggaataaatacatcgcccaaatgtccattgtttcgaaaaaattttacctcaatcccaatgcttagcattctgatgatgcctgaattccttgtaaacagacacaagattgtcctttgctgtaactcatgtgcagttagtggaattcactttcgcccttcctgatggtgccttttagcccagtaaattcaagtatgaggtcgcttttctgacgtttcatgttttcagggtgccattgtagattcagaatgatatcagaactcataagcttccgcttacaggtttacatgactgatgcataaagtatcaacaaactactatattctgcatagggaagcaaagcctggcagtgaagaattccttgaacaccacacactcatatacctcatatttctaaagtctaaaccaccttgctctcaggcaaataaacttggtctaatactaatgacctcgtttgaataaacggggcaagagcagcttcatccatcgaagacataccaaacctaagcgatttagcttcattttccaccaactccaactcgaatacttcaaggtccgccaagtcctctttagaaccagcagaagtcacaaattaaagatgagttcttcaacatcagacatcttcacaaagacaacaaaaaaaaattctgaaatcgtgcaaaatcaagcaagaaacaaggtttcatgcaaaaaacttcgatatgcttaggctaaaaatagcaagaatattggaacactggaaaacagtaaaagtcagaactatatatgtccaaataggcgggccggaccgacctggcccggcacggattggaatcgtgccgacccggcccnaattattaagaaggttgtgccgtgccggcccacaggccccgagtgagccccagacatggcacgctaaggtattaaccgtgccgagctggcccacggcccgacgggcctaacgggcctataatagtatatgacgtttaaatgataaaatatcttaaaaatatgccatatatgaaggtttaaaccatagttattagctcttaacacttatttacgctcacaaacaaacaaacaaatgtgtttaatgt

SEQ ID NO: 12908 - DNA, 1004 bp, Zea mays
atttttagacgacacccctacccgacccgatcggcgggagagcacgagacgccagcgccatccatcgcggcaaaagccgagacgacccaggaatctcggcaccgtcgcccccctttctctctcgctcaaaagttgctgctggagccctctcccctctctccgaccaccaaccatggatgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccattcggagcagttgtcgtctgtaatgacgaagtagtagtcagctgccataacatggttctgaagcacactgaccctactgcgcatgctgaagtaactgcaattagagaggcttgcaaaaagcttgggaaaattgagctctcagactgcgaaatttacgcgtcctgcgagccatgcccaatgtgctttggtgcagttcatctctcccgaatcaagaggctggtttatggggccaaggcagaggctgccatcgccattggatttgatgacttcattgcagatgctctgagaggcactgggttctaccagaaggccaacttggagatcaagaaagctgacggcaatggtgcattgatcgctgagcaagtctttgaaaagactaaagagaagttccagatgtactgatgctgagcagaagagagatctcagatttgtacaatgcttactcataaggacaagaaataatacagtgcccaaatgtccattgtttcgggaaaaaaatctcaattccactgttcaacattttgatgatgcctgaatttcttgttaacagacacaagattgttatttgctgtaaaatgtgcagttgatggaatatactttctccctgtctgatggtgccatttagcacattaaaaaaaaaaaaaaaaacccttcccccggggcccggtaccca

SEQ ID NO: 12909 - DNA, 960 bp, Zea mays
cttcctccttatttcccccccccgccgcgcccgggcggccccccgatcggcgggagagcacgagacgcccctctgcttccttttctctgtcgctcaaaagttgctggagccctcttctctctctcctctccgagccccaaccatggatgaggcgcaagttgtggagtcaaaggatggaaccatctcagttgcttctgcatttgttgctcatcaggaagctgtacaagacagggatcacaaattcttgacaaaagcagtggaagaagcataccgaggagtcgattgcggcgatggaggtccatttggagcagttgtcgtccgtaatgatgaagtggttgttagctgccataacatggttctgaagcacactgaccctactgcgcatgctgaagtaactgcaattagagaggcttgcaaaaagctcgggaaaatcgagctctctgactgcgaaatttacgcgtcctgcgagccatgcccaatgtgctttggtgcagttcatctctcccgaatcaagaggctggtttatggggccaaggcggaggctgccatcgccattgggtttgacgacttcattgcagatgctctgagaggcactgggttctaccagaaggccaacatggagatcaagaaggccgacggcaatggcgcactgatcgccgagcaggtcttcgaaaagactaaggagaagttccagatgtactgatgatcttggctgaagagggatttcggatttgtacaatgctcacccagaaggaataaatacatcgcccaaatgtccattgtttcgaaaaaattttacctcaatcccaatgcttagcattctgatgatgcctgaattccttgtaaacagacacaagattgtcctttgctgtaactcatgtgcagttagtggaattcactttcacccttcctgatggtgccttttagcacattaaattcaagtatgaggtcgcttttcgg

SEQ ID NO: 12910 - DNA, 1021 bp, Zea mays
cttgccggaggagctaagctagctgcctgctgccctgcctccgtctctctcgggcggctcacatgcgtcatgtcaatgtgtgcatgcaccaccaaacaaaaacctaaagctaccaccaaagccccgagagacgagacgaggcgagatgcgatgagatctatcttttatatatcattgggaccctcgaggccggccgggatcccgaagtcaccgagctgagctccaaagaatctagcagctaggagcaggccgtgtatacgccatccaccacggcaacatgtgctccggctcctggtcctggagcagcagcaagaagcgcaagcgcccgtctcttgttgtcgtcaacctcaagcggcgccagctgcagaagacgccgccgccgacgccacctcgttcctcagttgctatcaggaggaagaggctgagactgaggaggttgcgagccggagcagaggccatggagatggtgaacctgaagctctacctggagaaccggtgcatcatcgcggagaacgagaagctgcgggagagggccagcgcgctccgccgcgagaacctcgcgctgctccaggacctgtccaagacgccggccgtgccagaggcaggagcgggagcgggagctggagctgcgtgagattattgcttcctcttgctgcctgctgagcatggagtagctagcttcgcttgcgttccctcgctggtgcttgtgctagttgcgtgggcaggacagcggactcctaggtatctatttgcttggctgctccgccatgtcggtgctctgctgtctgctcatacatcaccaggctcctggagctctcttgggtgctctgtgccatggtgtttgtacattatatataagtgcgcggattaactagatttacaaaaaaaacaccaaactggacaacaaagatcaacagcaagttatgctaaaacataaacctcgactacgacgaatcgatccatttgaacttctagtacaatgattaatgaataagaatattttcgtgcagagtttcaagcg

SEQ ID NO: 12911 - DNA, 915 bp, Zea mays
  misc_feature (898)..(898): n is a, c, g, or t
accaaacaaaaacctaaagctaccaccaaagccccgagagacgagacgaggcgagatgcgatgagatctatcttttatatatagcctttagcgccccgcccgcccgggatcccgaagtcaccgagctgagctccaaagaatctagcagctaggagcaggccgtgtatacgccatccaccacggcaacatgtgctccggctcctggtcctggagcagcagcagcagcaagaagcgcccgtctcttgttgtcgtcaacctcaagcggcagcagctgcagaagacgccgccgccgacgccgcctcgtgcctcagttgctatcaggaggaagaggctgaggctgaggaggttgcgagccggagcagaggccatggagatggtgaacctgaagctctacctggagaaccggtgcatcatcgcggagaacgagaggctgcgggagagggccagcgcgctccgccgcgagaacctcgcgctgctccaggacctgtccaagacgccgcccgtgccagaggcaggagcgggagctgcgtgagattgcttcctcttgctgagtgctgagcatggagtagctagcttagcttgcggttccctcgctggcgcttgtgctagttgcgtgggcaggacagcggactcctaggtatctatctgcttggctgctccgccatgtctgtgctctgctgtctgctcatacatcaccaggctcctggagctctcttgggtgctctgtgccatggtgtttgtacattatatataagtgcgcggattaactagatttccaaagcctgcaccaaactggacaacaagatcaacagcaagttatgctaagaaaaaaaaaaaaaaaagcgccgaatcgatcccatctgacttctagtacatgattaatggaataagatgaaantctgcagagtttcagct

SEQ ID NO: 12912 - DNA, 866 bp, Zea mays
aatctctctctctctctcgtctctcggctcacatgcgtcgcgtcaatgcgtgcatgcaccaccaaacaaaaacctaaagcgaccacccaagccctgaggcgaggcgaggcgagatctatctttatatatagccttgaagcccttggaacacttcatctccaaattaagtcgccgagctctgaagaatctagctaggagcaggccgcctacgccatcggccgtccacagcaacatgtgctccggctcctggttctggagcagcggcggcggcggcggcagcgagaagcgcccgtctcttgtcgtcgtcaacctcgagcggcagctaaagaagacgctggccgtcaggagaaggaggaggaggttgaggctgaggaggttgcgagccggaggagcagaggccatggagatggtgaacctgaagctgtacctggagaaccggtgcatcatcgcggagaacgagaggctccgggagagggccagcgcgctccgccgcgagaacctcgcgctgctccagaacctgtcgtccaggacagcggccgtgccagagccaggagcgggagctgcgtgagtctgctgcttcgatcctctgccttcctgtctgcctgctgaacatgaagtagcgagctcgcgtcaccctcgttggtgcttgtgctacttgtgtggagtgtggacaggagacacaggccagtggactcctagccctaggtatcatccatctgcttggctgctccgccatgtctgtgatctgtgctcaactgctcatacataaaccgccaggttcctgggagctctcttggggtgctctgcgccatggtgtctgtacattataagtgcgcggcacggattaacgagattttgttggcaag

SEQ ID NO: 12913 - DNA, 872 bp, Zea mays
  misc_feature (869)..(869): n is a, c, g, or t
cattgggtacctcgaggccggccgggacatgcgtcatgtcaatgtgtgcatgcaccaccaaacaaaaacctaaagctaccaccaaagccccgagagacgagacgaggcgagatgagatgagatctatcttttatatatcgccgtgacccccgggcccgcccgggatcccgaagtcaccccgcgctgagctccaaagaatctagcagctaggagcaggccgtgtatacgccatccaccacggcaacatgtgctccggctcctggtcctggagcagcagcaagaagcgcccgtctcttgttgtcgtcaacctcaagcggcagcagctgcagaagacgccgccgccgacgccgcctcgtgcctcagttgctatcaggaggaagaggctgaggctgaggaggttgagagccggagcagaggccatggagatggtgaacctgaagctctacctggagaaccggtgcatcatcgcggagaacgagaggctgcgggagagggccagcgcgctccgccgcgagaacctcgcgctgctccaggacctgtccaagacgccggccgtgccagaggcaggagcgggagctggagctgcgtgagattgcttcctcttgctgcctgctgagcatggagtagctagcttagcttgcgttccctcgctggcgcttgtgctagttgcgtgggcaggacagcggactcctaggtatctatctgcttggctgctccgccatgtctgtgctctgctgtctgctcatacatcaccaggctcctggagctctcttgggtgctctgtgccatggtgtttgtacattatatataagtgcgcggattaactagaattccaaaaaaaaaaccaaaaaaaaaaaaggccccttgcngcc

SEQ ID NO: 12914 - DNA, 1720 bp, Zea mays
tgcagaaaaaagggagggaaagagagaagttacagagggaggacaattactcagcaaattcgttttcaaatctgctgagagcttcctacagaacccgtccgattccctttatttgtagccttcttctccccaacctactcctgtcacaaagaccatttctttctcgtcgtcgacccatactctctctctctctctctctaccattttctccacgctctcctcccctttttcccgatggaaagaaattatgctgctaaatgattagcgaccggaagatccattggcccatgccgcgccgtagtccatgctccatgatggaggagctaagctagctgcctgctgccctgcctccgtctctctcgggcggctcacatgcgtcatgtcaatgtgtgcatgcaccaccaaacaaaaacctaaagctaccaccaaagccccgagagacgagacgaggcgagatgagatgagatctatcttttatatatagcctttagcgcccttcaaacacttcatcccgaagtcaccgcgctgagctccaaagaatctagcagctaggagcaggccgtgtatacgccatccaccacggcaacatgtgctccggctcctggtcctggagcagcagcaagaagcgcccgtctcttgttgtcgtcaacctcaagcggcagcagctgcagaagacgccgccgccgacgccgcctcgtgcctcagttgctatcaggaggaagaggtacccagctaacccgccctgctcgagtttcccaagcttcctctgctcaagtttcagcagcatcagcgacagtttcctgcaatcacacaagtacactgtacacgtacgcaggctgaggctgaggaggttgagagccggagcagaggccatggagatggtgaacctgaagctctacctggagaaccggtgcatcatcgcggagaacgagaggctgcgggagagggccagcgcgctccgccgcgagaacctcgcgctgctccaggacctgtccaagacgccggccgtgccagaggcaggagcgggagctggagctgcgtgagattgcttcctcttgctgcctgctgagcatggagtagctagcttagcttgcgttccctcgctggcgcttgtgctagttgcgtgggcaggacagcggactcctaggtatctatctgcttggctgctccgccatgtctgtgctctgctgtctgctcatacatcaccaggctcctggagctctcttgggtgctctgtgccatggtgtttgtacattatatataagtgcgcggattaactagatttccaaagcctgcacccaactggacacacaaagatcaacagcaagttatgctaaaacataaacctcgactacgacgaatcgatccatttgtacttctagtacaatgattaatgaataagaatattttgtgcagagtttcaagcatccacatctacagaacatgttgtgctgaatatttcccacaaatttacccctctaattcgcgacacaaatgcacctaaaaatgtttttttaaaaaaaaaatctagcagaaaaattacagagacgggaagtttgtacaacaagaatccacccaggcattactaccaacgtccaaccaaataacttagcaataaaccgcaaaaggcggaatatccaaccgctgttgttctaaaacctaaggaaaaaaacgaatatccgggaacacaaggtatcccttcatgaatctgcaggcatgc

SEQ ID NO: 12915 - DNA, 3048 bp, Zea mays
  misc_feature (752)..(752): n is a, c, g, or t
  misc_feature (2803)..(2803): n is a, c, g, or t
gtggtatattatgtgtgtatgtatggttgatcattgcacagctacctgatgtgatccacgattgatttacacgaaagctgcagcaacgatggatggtggtgcttgtgtcttccgtcaatctagaaaacctgcactcggcgtcggcgaagatatggatcaaacgatcgagtggacgcaggaccggggccggggccggggccgggtggcgggacatgcgtcgcgcgtcggtgagcatctgggacggcgcggacccagagcacaggcgccgccgatctagaggtgtcaaatgcaaattcttgtctacctccttggctttgccttccttgtgtgtgtgtgctgtgcaatgagtgcagcaacttttggccaaagctgggggcagtggcccaaagtgtcttccctgcttcaaagttttttttttctcgcctctcgagggatcctcgcttccatgatggtctgtgacgcagtaacgggagctcaatagctgctgctttgtggctggctttctggatgaagaagacggcggcgtcgaattattgaagggctcatggaaacctggcttcccaaggtgccagaaactgtgctgacagccagacagacagatcgttttcaggtccgcgatagaatagaaaccaaatggaattcccccagtagactcatcagccggaacagcgcagcgagagttctgaacgcagacggcagctcacatgtttgcagagcgcgcgcggacgtaaaaaggcgcgcgctgaggcggnatcattctggcgaagattagaaaccgcacacgagcaaaaaggatgcgacgctcgaaagcgaatctgacctcccccgtgccggccgcctgcttgctcttgcgccatcgagcgagtgctcgagaaaactctaaaagcttcatcatgcaacgcccggcccaagaaatcaataatgcacggccattttgctttgacgtatgtgttcactttacccctccaaaaggaaaacaaaaaggcgagaagttacagagagagtactgtgagagcgcaattattcagccgattcgttttcaaatctgggagcttcctcctgcacaacccaaacgacgaaatgattccctttatttgtagtcttctctccgttctccccaacctactcactcatgtcaacagggatcgtgctgtctcgtctcgccgtcgatccatactctctcgtcgtcgtcgtcgatttctccagctcctctcatccctcctttttttttgttttggtttccgacggaaatatgctgctaaatgattagcggccggaagatccattggcccatgccatgccgtagtccatgctccatgatggagaggaggagctagctgccctgctgcctccatctctctctctctctcggctcacatgcgtcgcgcgcgtcaatgcgtgcatgcaccaccaaacaaaaaacctaaagcgaccacccaagccctgaggcgaggcgaggcgaggcgagatctatctttatatatagccttgaagccctggcagcccggcatctccaaattaagtcgccgagctctgaagaatctagctaggagcaggccgcctacgccatcggccgtccacagcaacatgtgctccggctcctggttctggagcagcagcggcagcggcaaggagcacccgtctcttgtcgtcgtcaacctcgagcggcagctaaagaagacgctggccgtcaggagaaggaggaggtaactagcgtgctctgttcgagtttctcaagattcctctgcccagcagcaacagtttcctgcaaccacacacgcgccacacgtacgtacgcatgcatgcaggttgaggctgaggaggttgcgagacggaggagcagaggccatggagatggtgaacctgaagctgtatctggagaaccggtgcatcatcgcagagaacgagaggctccgggagagggccagcgcgctccgccgcgagaacctcgcgctgctccagaacctgtcgtccaggacggcggccgtgccagagccaggagcgggagctgcgtgaggttgctgcttcgatcctctgcctgcctgcctgctgaacatgaagtagcgagctcgcgtcaccctcgtcgttggtgcttgtgctacttgtgtggacaggagacaggccagtgaactcgtagccctaggaggccatctgcttggctgctccgccatgtctgtgtggctctgtgctcaactgctcatacataaaccgccaggttcctggagctctcttggggtgctctgcgccatggtgtctgtacattataagtgcgcggattaactagattttgttggcaagaactaactcttttggtcatataagaacacggtcaagttaattattaaaaaaaaaaaaaaaaaaccttcgttttttaaaaactaaactacaacaaataaaaaaaagtttggagtacaaaacagaaagaggcaatgctagtcagccagttcttctgaaatgaaagggttagatcaggaacgaatcttccctgccttttctctctgctggagacttcagcatatctagttaggcacgaggacctcaaaacccgggtgctctgctttcttctccacctatctgccctttttctttgacaaaagtctagacaaagcaagatcctttgttacacgctactgttttcaagtatctgtcaccagggctgggcttagtcacgtagcgagccaaggtcagttcggctcggacgcattacaataagctcggagatcaggttcggcttggactcgtttagactcacgagccgccacactaaatctaatttaaaatataaattatatatttttattanatataaaataaaaaatatataccaaaaattcataaatatatttgaaactatatctagccttatgtccataaaaaataaatcaataacatagtaaggtataaaggaaatattgtcacaatataacactacatgatctggtcggttcgcgagccgacttggctcgctgtttaagcgagctataaaagtaggctcagctcgagctcattcaggcatgagaacttctccgagccgagccggctcacgag

SEQ ID NO: 12916 - DNA, 1151 bp, Zea mays
gctgtctcgtctcgccgtcgatccatactctctcgtcgtcgtcgtcgatttctccagctcctctcatccctcctttttttttgttttggtttccgacggaaatatgctgctaaatgattagcggccggaagatccattggcccatgccatgccgtagtccatgcgccagggtggactggtcgcgctccctgccctgctgcctccatctctctctctctctcggctcacatgcgtcgcgcgcgtcaatgcgtgcatgcaccaccaaacaaaaaacctaaagcgaccacccaagccctgaggcgaggcgaggcgaggcgagatctatctttatatatagccttgaagcccttggagcccggcatctccaaattaagtcgccgagctctgaagaatctagctaggagcaggccgcctacgccatcggccgtccacagcaacatgtgctccggctcctggttctggagcagcagcggcagcggcaaggagcacccgtctcttgtcgtcgtcaacctcgagcggcagctaaagaagacgctggccgtcaggagaaggaggaggttgaggctgaggaggttgcgagacggaggagcagaggccatggagatggtgaacctgaagctgtatctggagaaccggtgcatcatcgcagagaacgagaggctccgggagagggccagcgcgctccgccgcgagaacctcgcgctgctccagaacctgtcgtccaggacggcggccgtgccagagccaggagcgggagctgcgtgaggttgctgcttcgatcctctgcctgcctgcctgctgaacatgaagtagcgagctcgcgtcaccctcgtcgttggtgcttgtgctacttgtgtggacaggagacaggccagtgaactcgtagccctaggaggccatctgcttggctgctccgccatgtctgtgtggctctgtgctcaactgctcatacataaaccgccaggttcctggagctctcttggggtgctctgcgccatggtgtctgtacattataagtgcgcggattaactagattttgttggcaagaactaactcttttggtcatataagaacacggtcaagttaattattagaaacaaaaaagaaaaaggtccctagggccaaaaaaaaaaaaaaaaaaaaaaaaaaaa

SEQ ID NO: 12917 - DNA, 793 bp, Zea mays
cggccgggccgggtcccgacgccccgagctgagctccaagaatctagcagctaggagcaggccgtgtatacgccatccaccacggcaacatgtgctccggctcctggtcctggagcagcagcaagaagcgcaagcgcccgtctcttgttgtcgtcaacctcaagcggcgccagctgcagaagacgccgccgccgacgccacctcgttcctcagttgctatcaggaggaagaggtacccagctaacccgccctgctcgagtttcccaagcttcctttgctcaagtttcagcaccatcagcgacagtttcctgcaatcacacaagtacactgtacacgtacgtacgcaggctgagactgaggaggttgcgagccggagcagaggccatggagatggtgaacctgaagctctacctggagaaccggtgcatcatcgcggagaacgagaagctgcgggagagggccagcgcgctccgccgcgagaacctcgcgctgctccaggacctgtccaagacgccggccgtgccagaggcaggagcgggagcgggagctggagctgcgtgagattattgcttcctcttgctgcctgctgagcatggagtagctagcttcgcttgcgttccctcgctggtgcttgtgctagttgcgtgggcaggacagcggactcctaggtatctatttgcttggctgctccgccatgtcggtgctctgctgtctgctcatacatcaccaggctcctggagctctcttgggtgctctgtgccatggtgtttgtacattatatataagtggcgga

SEQ ID NO: 12918 - DNA, 1792 bp, Zea mays
aatgaatgcgacgacgaaaactgagcaacgccttcccccacccatttggccatcgccagctgtccattcgcgtatccgacagcttccaggacggatcgaaaccgtcggtgccacccatcagctcttggatcctacggctcagaaaaccagacgcacggcttgcccaccaacacacaacacctctgcatctgacctcaggcgcagcggatccgagcacggccacaccacccgcgcggctcatcataaagaggcgggctgctgcccctcccctcctcgcgccgcttgctttgtccgttgtcgcagagcgaggaagcacgcagagagtgagtaaaaaagaaagagagggatgccaatggagaggtcggtgtcgtgcgcggagaggggcagcacgttcggcggcggggcggcggtggacgtccggagctacagcgcctcctacgcgaggccccagccgcggccgccgacgtccagggtgcagcgcgccaggagcgtgagcgcgtggacgcgcccggcgccgccgcccgtgcagcggaccgggagcaccaagagcggcgccgccgcggcccgccccaccccggggctcaacctgcgctcgtacagcgcctcctacgcggcctcctacgggcccagccttgtcggcggcggcggcggcggcggtggcggcggggagctgaagcgctccggcagcgtcaccaactggacctccgccaaccgccgctccgtcaacctcagggggtacacgccgtccttcgccgcgctggacgacaccgccgcggcggtcccggcgcccaggaaggtgcaggcggtgatggacgacgccgagctgcagcggaggaagcgcctggtcgtgtacaagacctacgacgtcgaggggaaggtccgggagtcggtgcgccgcggcgtaaactggatcaaggggaagtgctccagcgtggtgtacggctggtggtgatcgctagctccatcgtcggcccagcccaccccgccaccggccgatctctccgccgttccggtccatcagagtggtactactacctatgagttgagcctttcttggtgcacgcccatcgtacctcctcttgtttcttctcccttgatctttttcccctcttggagttaggattttttttggttttatctttaggagatggatttggtggtatgtagaatgagcagtggagcttctcttggtgatttgtgagggtggggaggttgggtggtggtgacatggctgttgggatgacaaatcccaagagaatgcttcaggctgtggtgtcctactcctttgtacagatgagatatatcatctttccagcatacttgctagtatctggtctatgtaaatataggtgctgcatatatagaataagacttttgtaaattactactccctccgatgtctttccgacaacggcacagtatataaagtatagctttaatctatatttttctttttaaatataaatacacttttaatatatttatacttcaataaaagtacttattaagatagatcgttacatataaatattaggtttcaaaactaaataataaaacatgtatttgtagtcaaaattttataagtttgacttaaactttatccaaaacgataaataatagaacatcggagtaagaagtagtcctgcatacatcctctaaaaaaatattttatgtcctttatatcttatactccagcatcctctaaatttaatcctctatataaacattattgttactagacttcgttttctatattcttttcgtatgggccgcccacaaaaaaagtcgtttg

SEQ ID NO: 12919 - DNA, 1090 bp, Zea mays
ctcgcgccgcttgctttgtccgttgtcgcagagcgaggaagcacgcagagagtgagtaaaaaagaaagagagggatgccaatggagaggtcggtgtcgtgcgcggagaggggcagcacgttcggcggcggggcggcggtggacgtccggagctacagcgcctcctacgcgaggccccagccgcggccgccgacgtccagggtgcagcgcgccaggagcgtgagcgcgtggacgcgcccggcgccgccgcccgtgcagcggaccgggagcaccaagagcggcgccgccgcggcccgccccaccccggggctcaacctgcgctcgtacagcgcctcctacgcggcctcctacgggccctgccgcggcggcggcggcggcggcggcggctggcggcggggagctgaagcgctccggcagcgtcaccaactggacctccgccaaccgccgctccgtcaacctcagggggtacacgccgtccttcgccgcgctggacgacaccgccgcggcggtcccggcgcccaggaaggtgcaggcggtgatggacgacgccgagctgcagcggaggaagcgcctggtcgtgtacaagacctacgacgtcgaggggaaggtccgggagtcggtgcgccgcggcgtgaactggatcaagggcaagtgctccagcgtggtgtacggctggtggtgatcgctagctccatcgtccgcctagcccaccccgccaccggccgatctctccgccgttccggtccatcagagtggtactactacctatgagttgagcttttcttggtgcacgcccaccgtacctcctcttgtttcttctcccttgatcagagttaggatcttttttttttgttttatctttaggggatggatttggtggtatgtagaatgagtagtcgagcttctcttggggatttgtgagggtggggaggttgggtggtggtgacatggatgttgggatgtgtcctcctttgtacagatgagatatatcatctttccagcctacttgctagtatctggtctatgtaaatatatgtgctgcatatatagaattagacttttgcaaaaaaaaaaaaaaaaaaggggcggcc

SEQ ID NO: 12920 - DNA, 1391 bp, Zea mays
ctcgaggccggcccggcccgggatgacactgtctccatcatatcctctcgatccatcacttggtcatcacgaacgccgattcatcggttgattgctcgtctcatcggtcgagcaataatcgagatgggcgcggcgtcgtcgacgatccactcggcggacttgccgcggctgctgtgctgcgcgtgcgtggagcagtcgacggtggccatggaggagacgtgcgggcggtacgacacggtgctgcagccgggctgccacttcatgccctggtgcgtcggccggagggtcgccggctacctctccctccgcgtgcagcagctcaacgtccgttgcgagaccaagagcaaagacaacgtcttcgtcaccgtggtggcgtccgtgcagtaccgcgccatcgaggacaaggcctacgacgccttctaccgactcagcaacgcccgggagcagattcagtcctacgtcttcgacgtcatccgtgccagcgtgcccaacatgaacctggaccaggtgttcgagcagaagaacgaggtggcgcgggccgtggaggaggagctggccaaggccatgaccatgtacggctacgagatcgtgcagacgctcatcatcgacatcgagcccgacgaggtggtcaagcgcgccatgaacgacatcaacgccgcggcgcggctgcgcgtggcggcggcggagcgcgcggaggccgagaagatacagcaggtcaagcgcgccgagggggaggccgagtccaggcacctggccggcgtcggcgtcgcgcgccagcgccaggccatcgtggacggcctgcgccggttcgtgcccgacgagaagtccgtcatggacatggtcctcgccacgcagtacttcgacaccatcaggggatatcggcggccacgtcgcgcgcccgccaccgtgttcatcccgcccggccccgccgcggtgcacgatgtggctgcgcaggtccgcgacggcgtgctccaggccgcggcgtacaacccctacgccggaaccaagtgaccggccgccgcacggccacggtgcctttccgccctgtcttttcttgcttcttggacatgttcatgtgtgaattcgaaacctgaccatcagtgtgtgtaccttgtgtcgaacctttacttcagtaggcgaaatacccaaatttatacttcgaggtgtgtatatacgtacaaaacataggaatattttatacatgaaaaaaacaagtttagtagcttagaagcagatacttatccaccagcgttgttagtctatctcccgcaccttcaatgtcccatttctcatctcaatttctatttcaaacttcactctacaaatagtattatatacaatgtaaaacagtgttttgtacgagcatgaataagtaaacttaagtaatgtcc

SEQ ID NO: 12921 - DNA, 1381 bp, Zea mays
  misc_feature (13)..(13): n is a, c, g, or t
  misc_feature (18)..(18): n is a, c, g, or t
cctcgaggacggncgggncggggttttgaccatctatacctcctccgttcttcggtcgtccctcctgcccgcgtcaaggtcgccgccgctcgtcagtcaccacctcccctgatcccctcatttccatcccacccttgcgatcccggcagctgatccttcttccctttctctctatcccacttgccgatcgggcgccgtcgccgtcgccttcttcttccctctcgcgctttcctcgcggcggtggagccaccaccaagccggctgcaattcgccgtggcgcgcctgactcgtggcgcgggaacgcggttgcacgcctcgaagaggggagacccctctcccgcgcgcgacggttcccgaacatcccggcgaaggacctgctcggtcatcgctgctgccggagctgctcatgttgaatccgagatctgaaatctaccccaccatagagtatcgccctatccagccctccgacctcgaagctcttgaaaagattcatcttgctctctttccaataaggtacgagagggagttcttcttgaacgttgtcagtggcaatggtattgtctcctggggcgccgtggacaccagcagatcagatgatcgcagggatgagataataggttttgtaaccacgaggatgattgcggcaaaagatagcgagattgaggacctgttcaggtataacagttcacgcaaagatctaacacttgtgtatatattgacgttgggtgtggtggatggctacagaaaccttgggatagcttcatcactggttcgagaagtggttaaatatgcagcaagcatatcaaattgcagaggtgtttatttacatgtcatttcatacaaccagcctgctatcagcttctataagaagatgctatttaagctagtcagaagggcttccgatgttttactacataagaggacaacattatgactcatacttgtttgtatactatgtgaacggtggtcgttcaccttgctcaccactattggtagactcccaatatttatcagtctcagagatatgaagatcgctggcttcatccttggtggaggacgaaagtcatgaatcttaatcttgtctcctgaaatatctccatcagaaaatccaaggatgtgagcaaacctccggtagctcaccttataccagctgccttcaatatagaaattgagataaggaaagttataaggactttcctcatcagccagcttgatccaaagggtagaatagaactgagcaataacttcatcattccaatcgtattggaatgtcataatgttcttcatcctttcttctcacaggccctcaaagcctgtgtcatctctggatcaccaattgcttcacatccttcccagttaatatatctctgatgcatgattg

SEQ ID NO: 12922 - DNA, 6139 bp, Zea mays
atttaccgagatttatataagttattgttaatatttctaatttttatttaaactatttagagatttaactagttatactaattatataatataattattaatgtttatatataaaaatatttgttaaaactaaaattttagcttataaaaaagtaagaacgtcgttcttttaagatttagatagagggagtacacggtatccatgcaaccaccagaaatattaagttcatcgcagaaagatcgaatgcaattttagctaaattagagtcaaactaacttaaatttgattacatttatagagagaatatcaacatttaagaccagtatttcatcgcgaaagaatataaatctagctttaactagaattaaattaacttaaatttgattgaatgtatgggaaaacaatacaagcatttaagactccaaacagatagattataaaattttatttcataacaaatacaataatacttatttggtttgataatcattattttttttataattagtaaacaatctacatatatcggatgatgaaaataaataagaaacttactactcaaaagtaccggacagtatccagcaagcaaccactgtaaagagctatttccacatatataaatttaggttaaacttgaatcagtccagctgagcactgtttagaattgtatctttcttggaacagggtgatatatagaggagaagcgaaggaccgtgaattaggaccgttccaactttgacgttgcgttttcgatctcatggtcgtgtgaattgtgtgcatcgccgaaatgcttagggggtgtttgaatgtactacaactaatagttagttggctaaaaaattgctagtggaaatagctagctaacaaatagctagctgaatattaactaatttactaaaaataggtaatagttgaactattagctaaggtgtttgtatgtctccagctaattttagccactaactattagctctagtacattcaaacacccacatagtgttcggcctcttcgttagttgacgagtactgaaaacttgtcaacctttgttccaaaacgattgtcaaccaggatcacaagtctcggtgaatcagggaaccatctttcactccgtccgaaaaaatctggaccatcatcacttcaggtaaaagtaaaatgtcgtactactaacattgaccaggcccactgctgttcaatgtttaggtaaattcaattgaattaatctcactgctgttgaagttaaaaatgctttgatatttacagtacacatcgcagcagaaacagtcagtaatctatctcatctaccctcgacgacggtgcaagtccagctgctggcgctgttagaccggcaggccttcgcctccgggtcctcgtcgtcgtcgtcgtggttcctccccgtgctgaacgccggctcgcatggctccggcagagtggggttctcgcaggtgagcatcgtggtgaccgccgacatggtgggccggcgcttcggctgctcctgcacgcacagcagcccgatctggatgcacttgagcacctccgccgcgttggacgtgtccgcgatggactggtccatgaactccaggctctcgccgtccttccacagcctccacgcctgcaaagcggaaagcggccggaaaccaagccctgccatgcatgagtgactcgctgcagcaatggttgagctgccatatgcaggagtacaagtcagatcgcacactcacatatcttaggaggttgaggtcaagctcggtgtggtagaaccctctgttcttcttcccgctgacgatctcgagcaccagaacgccgaagctgaacacgtcggacttggtggagaagactccgtccatggcgtactcaggagacatatacccactgcatgcaggtgaaagcaagaataagtcaatgctatagttgatctgaaacctaataaataaatatggatggacgaggccgctgccgctcactcactatgttccgactactttcttggtgtacgcggccgtctggtcggtcccgaatatcctggcgacaccgaagtcggagatcttggggttcatgtccttgtcgagcagaatgttgctggccttgaggtccctgtggatgatcctcagcgccgaatcctggtgcaggtacagtatgcccctcgcgatgccgttgatgatgctgaaccgtttctcccagctcagcatcggctgcttctcctcatctgcgggcggcggacaacaagcgttaattaatcctcactacctcacgcgtgccaggattcgatccattcccggtggcagcggcagccaacaggtagctagcgggcgggcgacttactgaagaggaaggtgttgaggctccggttgtgcatgtactcgtagaccagcatcctctccgacccgtcgatgcagcagccgaggagcctgacgaggttcctgtgctgcagcttggctatcagcttcacctcgttcttgaactcccggagcccctgcgtggaccgccgcgacagcctcttcacggcgatgtcctgcccgctgtccagcttcccctgcagaagagcaccatcatcatcagcagttttcggtttaccatacattacatgcatgccatgcaagactggagttttcggtttaccatgtagacgggcccgaacccgccctggccgatcttgctgtgagccgagaagttgcccgtggcggcctggatcgtctcgacgtcgaacgacggcaggtcgcagtcctggctgccgccctgctggccgtcgtgaagggactcgtcctgcgcgtcggtggacgcggcgatctggttccttcgtccgaacggcgcgctctgcctctgcgcgtctctcagcagcgccagggggatggcctccttctccttcgtcctgcgccttctcgtcctcacggcgcagatgcagagtccggccagcagcagcagcgccggtgcggcaaccgatgggacgatgatctcgacgagcctcttggttcgcccgtccgtgtctgctggcgaagagctgctgagagctggaagatgcagagagtttcacagttcggttagcatgcaccaataaacagtaaggtaggttggaatgtgatccttgatgaattgatcaaactatgcatgcagctaattatacggcacgttcagtttctgtttctgaacatctggcagatcggtagctcgatttcatttatccttttgcaggataatgcagcttctgggtctgctaaagagtcaaaggtctggtatttattgtgttaacctaaattaacaaaaagtgaacattggtgctggccttctttttttttcaaaagtgggcgtcattgtcgttggacctaactgcaggcgcccacttaaccatcgaaattaacaaaatcggtgggaggctgtgactttcgaccttggagggagctgccgattttcagcaggtgaaaaaggtgactttgaacaatcgcagctgcactcgttctgccctccacactgtttgactaggcagcattgctgatcagccttgttcaacttttctatcctaaaggaaaaacccgtgacacgtatacgcgcatggcaagtatgaactctgacaagaaagttattgtgtgaaataagtgtatttagctgcaaacatggcgggctccgttctcaccgtaaaacaaagtacagtaaacgagaaggaaaatatctattcacaagaaaaatcggccgcatgcaaagtgcagctgcaagaggccagtcatcgttcattcacggtgcgtgcgttctatatttgaaatgcgattcaatgagcattgatccgaaaatacatgacaacaaactcctccttatgttagttgacagaaaaaggagaagaaaatgctgacaaaatggcaccgaacttgtcctcaatttgaatttaaatgaacatgagaaataaaggaaaagtgaaatgaagtactgtaatgaagaaggcgcgcaagaagtgagctactcacgtaggtcggacgccgcgagccggacgaagagattctgcccgcctttgccgaactgcctcatgtcgaggaggtcgccggtccacaggaagcagccggtggccccctgcgcgctgacattggcgccggcgtaggcccggcacgcgcagttcctgaggcaggcctctcggcactggtcgagggtgagggacatgtcgacggtggcgttggccgactccggcagcttcatgttggtgagcgcggcgaagccgtcgccggcgcaggcgaggtccgtgcggcgcctgcacccgccggagccgtccctgagcgcccactccttggggaagcgcgggtcgaagcccggcgcgcagccgcagatggggctgcgctcgacgctgcacacgccgtagggcccgcaggcgcggtagccgtcgcactcgtcgagcgggtaggaccagaagaggctccaggagcgggtcatgtcaatccacatgaggcgctggatctgccccgacgagtctaggacgaagcgcgtgagcacggcggcgctgtcgaccacgccgtagctgtagtaggcctcgtccgcggcggagacgaagcggaaggtgaggaggctgttggacttgaggttgggcacgcccgtgaactggtagccgttccagggcccgctgccgtagacgcgcgcggacccgcggtagaggaagagctccggcgagccgctcgggtccaggcggaacgagtactcccccggtgacgggtcccccgcggcgcgccacgagaccatgcgccggtccagccccgtgcggaagtcgatgcccagcttcatgcccggcaggagcgtgtccgtggggtggtcgaagctctgccacaccacgccggcgcccgggacccgcagcacgaggttgccgttgtccaggagctgcgcggtggcgttgctgccgctggacgtggccggcggcggcgtcgcccagaccacgggctgctggtcgtggtcgtagtcggtctcgtccacgacgacgatggccaggctcccgttggcgaggaccctgagcgcggcggcgcccacgccgcccaggacggggctctcgcggttggccacccacacgacggtccgcgcggggatgccgttgaaccatatcccgaggtacgcccgtcctgattccgggtccggcgcgaagaagcccagcacgtacttggcgctgccggcggacaccagcgtccggttccccatgagcggcgcggccagcgtgaccgtgtccgtgtcggtgccgctggcggcgtggtgccggtggaagagggggaggaggaagaggaagaggacggcggcgaggagcggacaccgtcgtcgccgcatggtgccgaaccgccgctggtttacgtacgtgttggtcgtggcggagttgattaatcgcgggcagcctgtgctgcgtttcctttggatgttgtggggggattttgggggttggggctgacacggcacgccgacgtctggacgcgggttcgcggtcgcggcgcggcagcagggccctttcttccgctcctgctggtgcggcccagaggtctggaggctggagcctggcaggcagatccgcatatggatggatggatggagttggtgacgactgactgagcaagtgaggactcgagacgggccgcggcgcgtcgtgttcggtggtgtctcgagcactgcactgcactgcaccgcgtggtgtggttggcctggcggcgtaggcaaggtcgattctgacgatctggaaactgcatacgcgcggctgatgcgctcgcctgcgtcaacatggaaaggtgctcgtggcagccggcaaaggcaggtgtgcttccgagctccgattgtctttgcaaaggacaaaagcgcagcctcctggtcctgggtccctctccctgttcgtggatcgatgttgctgcagctgcaggtctgctgagttgaccacacgatcggccgtccctctgcctctgccctccctggtgctgcgcgtggtttccacacccccacgcgcgctcgccgatgctaacgtcggggaacgccttttcggctcttcttctccagacgaatatggtcccatgccgccacgcggtcgtgttgcgtcagcctgtcctcggtcatgaaccttacccggtaatcttacagtaaactatagtcacatcatttcaaattataattcatttaacttttttgttctaagtttgactaac

SEQ ID NO: 12923 - DNA, 1632 bp, Zea mays
tacatttttctctatgtgcatcacatcgagattatgtggaagcatcaaatctttccaatatggcaattgccacaacccagatttccggctataaatctttggaccgtcactactacgcttccttttatttccagtaatgtcagcctgcttccctggcctgacatctttcaccttctctagctcttgtaggacctcatccacagtgaacctgccaggcacaactttgttttcacgcttaccattgaaatccaagctattccgccatgaatgtgtccttttaaggtaacgacgatgtccaatgtagcataacttgttccttattgccatagacaacagattcttgtcgcaataaatacatgcataatacccttttgttgttcgcccagataacgtggccagcgctggttgtgcctggtgtcgccccagtacaacagcacgaaggtcgaacttcctaccagtacatgcatcataggtcttgacacccttccatagcttcagcagttcttcaattaggggctcaaggaacaaatcaaaatcctttcctggacatcttggacctgggatgagtaaagacataaagcagtttgttggattcacgcattcccatggtgggagattaagcggtgtcacaagcactggccacatactgtactgggtactcatgttgccaaatggattgaatccatcggtagctaaggctagcctcaggttcctcggatcatttgcaaaacctgggtactttcggtcaaagtccttccacgcttccccatcagctggatggctcatcacattggcgactggcttcctcactttcttgtgccattgtgtttcctctgaagtttgttttgaagcaaaaattcttttcaaccttggcaacagtggaaaatgcctcaaaaccttatgtggaacccgcttcgaaccagtttcatctttccatctagactccgtgcatactgggcactcattcaatttagcattaacattccgaaacaacacacaattgttcttgcacacatggatgttttcgtatccaaggcccaattctttaagatatttcatggcctcattatatgattttggcaactcactgttagggtatccatcggacatcagcttcatcattgctgaaaatgttgtattgctgattcgataacgagacttcatatacaacatcctcaccataaaagaaaattttgaatggctagaacccggactaagtgccttctttgaatctccaagaactcctgcaaatcttggctcttctccatcagcctctgccgctgcaaacagttcaccgatcatctcaggtactccatgatcatcatcgtaaacatcatcgtccacatccatatgtatcccaaagtcatgatcatatccttcgacatcctcctctataccctcaacttctgtatctgccgactccccatgatgaatccacctcgtgtatgtagctgacattccataaatgtgtatatgagtttctacttcactctgaggtcgcagcctttgattaagacaattcacgcacggacaacgaatgtgtgtgtcttctgggtatctttcactaacaaaattcatgaactcttcaactcctttcacatatgcaggtgtgaattgtttcccataaaccca

SEQ ID NO: 12924 - DNA, 2207 bp, Zea mays
ctggccgggatgcttccagaatcttccggaaccttgcgccgagcctgaactccccggcggcgcctggccctgtgaaggctgcatgagtagtcccgccgccgccgccgcagcggagccatggggatgctcgccgccgccgttgcccccgctctcctcgcctcgccacaggcatccctcgtccgccgccgcctctccggtgcgtggacgctgcgcctgaagcccgctgctgcctcccacggcgtcgcggcgctcagggtacataattttctcccaaagtgttacattaccaacgttgaggttgatgttagtactgtaaataaagaagaaactttcgatgatcatccatcattggcaccaggacgcaacattccgcttgttaatcttcgaggagatattctagattctagtccttttccgctgcacgatagggcttcctgtccttcaggttttgaagagttgccggtcttgtctgaaggagagcaacatactttggcatccactcctgctcatcctgctggactatatgctctatatgctagttacttatttggtaacttggtggaacaactgtggaattttgcttggcctgccacactggcaattcttcatccaaatctattgcctgtggccattgttggtttcttcacgaagctttcagtgtttgttggggctcccatagttggcaaacttatggatcatttcccccgaatacccatgtacacagcattgaatgctgtgcaggtaggcactcagttgatatcagctgcaactgtcatctatgctctaagaaacctgagccatgcttctacaacagctgtggttctgagaccttggttcattgcactagtggcagctggagctatcgaaaggcttgcaggattggcgctaggagtttccatggagcgcgactgggttgtgttgttagcaggaacaaacaggcctgttgcattagctcaagctaatgctgtgctcaatcgacttgatctagtttgtgagacagttggtgcttctgtttttggccttcttttgtccaaataccatcctgtgacctgtttaaagattgctagtggtctaatgatatgcagtttccctgttctggtcatgttgggtcaactaatcaatagagtttcttgccatgcacttgattcctctagaactgccactgatgaatctatttgtgctgatcttttagatgtacgcaggatagttccaaatagcttgagggctatcaaacatggatggaatgagtataagcagcaaacagttctacctgcaagtgcagctaccgtgttcctaaatttcaatgttgcacttgctccaggtgccataatgactgcattattgatgcatcgtggtaccagtccatccattgttggtgctttcagtggattgtgctctatcatgggccttgttgcaacattcatctcctcaagcctggtgaaaagagttggaattctaaaggcgggagctgctggattgatatttcaagcttcactcttgtcaatcgcgctcacagtgtattgggctggttcaatttcgcaaacgacacctctacttatattcctagcatccattgcattgtcgcggttggggcacatgtcttatgatgttgtggggactcaaattgtccagacaggtgttcctgcttcaaaagcaaatctaattggaggaatggaggtttcaattgcaagccttgcggagctagtcatgcttgctatggctataattgcgaatgatgtctcccatttcggcttcctggcgatcctgtctgtgtcatcagttgctggggcagcatggatgttctgtcggtggttaacaaatccaacagatgagcagagggaactattcatggttgatcccctttatcaagttcaggcaatatagtggatgaggcaggaaacaaccaggaaaactgcaggcgcctacttgctggtggtgcttgttggatctgcaataccgttacgatgatactaagatacagtgtgacatttaggttcaatacgggatacacttagggtagaagcatttgctcctcgtggcctcagccatgcgcagaattcaatttgtatactcgttcatctcctcacctgtacagcacatatttgatctgtataagtgttacttgttatagctgatgtagaacaacattaacagccatcggtagcacacagtcaatgaaatctaaccccctcacctttcctccctta

SEQ ID NO: 12925 - DNA, 2153 bp, Zea mays
gattgcatctcgcggttgagccgaagcttccagaacccaaacccctgcgcatctaacactgtgcgcctcgggccccgcccggcggcaaaaagcaaattcgagtgcgcacacgagcagacccccgcagacagccaggcacactcgcgcgaccatgtaccgggcggcggctgtcatctcgaggtcctcatcagcactgcggaggcagctcgcgcggggcgtggccggggagctgccgcgtctgttggcgcgagggtatgcggccacggcgaaggaggtgtccttcggcgttggcgcccgcgccgccatgctgcagggcgtcaacgacctcgccgacgccgtcaaggtcaccatgggccccaaggggcgcactgtgatcatcgaggggtcccataaaggtcccaaggtcacgaaggacggggtcactgttgcaaaaagcgtggagttcgaggatagcgcgaagaatgttggggcgaatctggtgaagcaagttgctgatgctacgaacaaagctgcaggggatggtaccacctgtgcaactgtgcttacacaggcaattcttactgaaggatgcaaggccgtggcagccggtgtcaacgttatggacttgcggaatggtataaacaaggcaataaatgctatcactgctcacctcaaaagtaaagcgtggaagattaattctccagaagaaattaaccaggtagcaaccatttctgcaaacggtgaaaaggaaattggagatctaatatcaaaagctatggaaaaagttggaaaggatggagtcattactattgttgatggcaaaacattggacaatgagcttgaagcagtacagggaatgaagctgtccagaggatacatatctccttactttgtgactgatcaaaagactcagaaatgtgagatggagaaccctcttattcttatccatgacaagaaaatctcaaacatggattctctccttccagcattagaaatttctatcaagaatcgcaagcctcttctcattgttgctgaggatgttgaaggagatgctctgtcaatgcttgtactgaacaagcatcgtgctggactcaaggtatgtgctgtcaaagctcctggatttggtgaaaatagaaggcacaatctagatgacatggctgtgatgactggaggagaggttattagcgaggaacgcggtcttgatcttggcaaagttcaattacaaatgcttggcactgctaaaaaggtaactgtatcccttgatgatactatcatcctagatggtggaggtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaagatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggctcccttgatgaccatagctgcaaatgctggcattgatggagctatagtcatagggaagctgattgaacaagaggacctcagtttgggctatgatgcagcaaaaggggagtacgtagacatgatcaaggccggcatcatcgatcccgtgaaggtgatccgcaccgcacttcaagacgctgcaagtgtttccctgctgatggcaaccacggaggccgctgtctccgagctcccggcaaccaagtccagaatagccagccgtatgccgcagatgagcgggatggacttctgaggaaattcaggcgccgtgtatgatgctgatctgtgacctgtaaggctaggaattgggaggttggggacgaactttgtttccctagcggatagtcggatacgtctacggagttcattcgaaacgaggtgcagaactgtcaccgagttgcagtttttgatgcagtgcggcgttcgatggtggggtaataaagctggactgatagcgccttccattttgaaaaaaaaaaaaaaaactcgacctcgtgccgagagagagagaa

SEQ ID NO: 12926 - DNA, 2445 bp, Zea mays
ggtcttcccgtgatgatgatggatcgagagtcgatttattatgacacaaacacgtacaaacatgcatgggatacctgaaggagtttgttgaggctgtgtgggggctcctcatggcgcagaccgcttcgccttcccgtgtgcagcttgccgttactgcgataaggttcttgactacagttgctgagagtgtgcaccatgctttatttgggagtcctgaggcgatgaagcagatatgtgatagtgtcgttgtgcctaacttgcgcctgcgggatgaggatgaggagttgtttgagggcaattgggtggaatatgtcaggcgcgactctgagggtagcgatgcagatacactcagacgggcagcgtgccggttgctgcggggccttgcagcgaactaccaagagcaggtggctgcactcgtctcagcacaggtccagcagatgttggttgcatatgctgctaatcggtcaaacaactggaaggagaaggatgctgcaatataccttgttattgctcttatgcagaagcctggtgccacaggtggtggcacacctgtggttgacatggagagcttctttacatctgtgattgtgcctgagctccaagcccctgattggcagtctgagccaatgttgaaggcaactgtgctcaggttcttgaaggagttcaaggatcagatccccaaagctactgcactggcactcctacaaagtgtgatgcggtttttgacgcatgagtccaatgttgttcattcatatgctgcaacttttatcgaggacctgctgataatcaaggatgctgtaccggtaccaggggtgaccacagtgatcaggtctccacgttatgttgctgctgatatcaatccatttgccccacagatcattcagaacctgtccacagcactaggtttccctgattcacaagagaacccctacctgatgaagtgcctgatgcgggtgcttgggattgctaatattgctggtcaaattgttcatgagatcacagctcaacttgtgggtattctcatggaagtgtgtaataatcccaagaaccctgacttcaaccattacttgtttgaggctctggcagcagttattggccggactggtgagcaggacccaacactactccctgcttttgagaccagcctctttccagtgctccagaggatattggttgaggacatctcagagttctggccatatgcttttcagatatttgctcaacttgtcaatttgagccgaccacctctctcacagaattacatgcagctatttggtgtccttctcagtaatgcaacttgggaccggccaccatgtgttcctgccttggttcgtttgctgcgagcattccttaggaaaattctaaatgagctaaaccaagagggcaggcttccaaatatattggcaatatcccgtagcctcctctcacgcagcagcactgaagattctgcattctacatgctgaacacactagtggaaaacgttggttttgacattctgaacccatatataagtgagatatggagtgctttgtttactcggctacagactagacagacagtgaaatttgtgaactctcttgtggttttcatgtcgctagtgctggtcaaatatgggtcaagtgttcttgtcaattccgttgatgcaattcagccaaatcttttcacccaaatccttcagcgattttggattcccaacctcaatttgatcaaaggtgctcttgaagttaagttgacagcagttgcttcgataaagttgctttgtgagtctgcggtcctgttggatgctgcagcagcccagttatggggtaaattacttgacagtattgtcacactattgtccagaatgaatcaagatggatcacaacaagagcataatgatggtactgatgcagtggatactcagaagacatcaagttattctgtttcatttgtacgacttcaatatgctgggaagagtgaagatgaccttttgaaagaagtaaatgatccaaaacagtttgtggtcacatccttagccacaatttctgcccagtttcctgggaggtttggtcctgtcattgagcagcatgtggacctagcaaacaaaagtgtgcttcttcaactttgtgcagcctacaatgccaacattgtctaggtaacaacttcaatgatattattttataagtttaaaccatggatcaaactatgcattgagaatggatgtttcatccaagtttaatttcattttatatggcatggtagtcttggaaacaatgccatgaaactctccactaggaatggtcttggactcttggtggtctcaacgttcaagtacggagtaggatttagctacatggctgtcccattagtagccattcttgctacagacacaattaatgactaaatttcttttttcaagatgttttaggcgatgttataactcctaaatatcatgtgattaacac

SEQ ID NO: 12927 - DNA, 1538 bp, Zea mays
atttctgcaaacggtgaaaaggaaattggagatctaatatcaaaagccatggaaaaagttggaaaggatggagtcattactattgttgatggcaaaacattggacaatgagcttgaagcagtacagggaatgaagctgtccagtggatacatatctccttactttgtgactgatcaaaagactcagaaatgtgagatggagaaccctcttattcttatccatgacaagaaaatctcaaacatggattctctccttccagcattagaaatttctatcaagaatcgcaagcctcttctcattgttgctgaggatgttgaaggagatgctctgtcaatgcttgtactgaacaagcatcgtgctggactcaaggtatgtgctgtcaaagctcctggatttggtgaaaatagaaggcacaatctagatgacatggctgtgatgactggaggagaggttattagcgaggaacgcggtcttgatcttggcaaagttcaattacaaatgcttggcactgctaaaaaggtaactgtatcccttgatgatactatcatcctagatggtggaggtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaagatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggctcccttgatgaccatagctgcaaatgctggcattgatggagctatagtcatagggaagctgattgaacaagaggacctcagtttgggctatgatgcagcaaaaggggagtacgtagacatgatcaaggccggcatcatcgatcccgtgaaggtgatccgcaccgcacttcaagacgctgcaagtgtttccctgctgatggcaaccacggaggccgctgtctccgagctcccggcaaccaagtccagaatagccagccgtatgccgcagatgagcgggatggacttctgagggcccgtttgggagggctccggcttctggaaatatggctctcgctcctactcctttacaagagcagcttatccataggagccggtgctttttctaaatcgtttggcaaaaatagctccttgtgtattcttctcatggcgccatggtcctggcaaccatgtccaactcgatgtgctaacacagcatctcaagaacttcagcatcttgagcttgtactgatgcgccgctgcgagcagatcctagatcattgcgacgacgccctgctgttctttctcccatgggtgccagcgtgttggtgtacatgaagtggaccagcgtatttttgaaagggcggccgccaccgcggtgga

SEQ ID NO: 12928 - DNA, 1934 bp, Zea mays
  misc_feature (35)..(36): n is a, c, g, or t
  misc_feature (38)..(38): n is a, c, g, or t
ataaataggaaataaaaacgctgacttaaattttnncntaatatgtggactggtttgttttgcaactccaggtctccacgttttgttgctgctgatatcaatccatttgccccacagatcattcagaacctgtccacagcactaggtttccctgattcatatgagaacccctacctgatgaagtgcctgatgcgggtgcttgggattgctaatatagctagtcaaattgttcatgagatcactgctcgacttgggggtattctcatggaagtgtgcaataaccccaagaaccctgacttcaaccactacttgtttgaggctctggcagcagttattggccggactggtgagcaggacccagcgctactccctgcttttgaggccagcctcttcccagtgctccagaggatattggtcgaggacatctcagagttctggccatatgcttttcagatatttgcacaactcgtcaatttgagccgaccacctctctcgcagaactatatgcagctatttggtgttctcctcagtaatgccacctgggaccggccaccatgtgttcctgccttggttcgcttgctgcgagcattccttaggaaaattccaaatgagctaaaccaagagggcaggcttccaaatatcttggcaatatcccgtagtctcctctcacgcagcagcactgaagattctgctttctacatgctgaacacaatagtggaaaacgttggttttgacatactgaacccatatataagtgagatatggagtgctttgtttactcggttacagactagacaggcagtgaaatatgtgaactctcttgtggttttcatgtcgctagtgctggtcaaatatggatcaagtgttcttgtcagttccgttgattcaattcagccaaatcttttcacccaaatccttcagcgattttggattcccaacctcaaattgatcaaaggtgctcttgaagttaagttgacagcagttgcttcgacaaagctgctttgtgagtctgcggtgctgttggatgctgctgcagctcagttatggggtaaattacttgatagtattgtcacactgttgtccagaacgaatcaagatggaacacaagagcaaaatgatggtactgatgcagtggatattcagaagacatcaagttattctgtctcatttgtacggcttcaatatgctggaaagagtgaagatgaccttttgaaagaagtaaatgatccaaaacagtttgtggtcacatccttggccacactttctgcccagtttcctgggaggtttggacttgtcattgagcagcatgtggacccagcgaacaaaagtgtgcttcttcaactttgtgcagcctacagtgccaacattgtctaggagccaattgcattgggaaggcatttgcttgttgtcaaatgggtctggtcgaaagatgagtctcttggagttgtctgtctgtcaagattttctggtgtcatccttatttatttagtggcaggatgttggttgtgccgtgggaccgttggatgccgaaacatgtagggttggtttggtggccagagatcacgagggatcaatgagagagtaatccattgctattcaaattgaatagcaaggggattcttccccatggatccctttgtgatcttggtcatcaaatcagcccataaggaaaacaacattagctttgtggaggattcgtctgtttggtttggctgaggattttgtttcaaggctgaagttccttttttggggcagtctaatggtgtactgtcctgattatgtatctgaaggtcctgaatcaatggttcggaaaacaacattagcttcaatggttgttggaacacgctgtaattttgcctgcctgcctttcatggttcggggaatgctattctgcgcatgcagagccaaaattgacgaaggaaccgtagatgttc

SEQ ID NO: 12929 - DNA, 1663 bp, Zea mays
actcccacgggcccgcccggggtccaggcgtccaccccaaaacaatcatgactcgtctctgtccccttcacctcctcctcatcgctgccgcggcggcgtctgccagcggtgccgacgaggcgcacgtctccatcgcggtcgcggagaagggcctggccttcgccaaggacgtgcttatcagcgaggccgtgcggtcgctgacccctcttcgcctccccggggtggagaaggccgtccgcgtgcccttccttggcggcatccgcgttgccgcctccaacatcacgctattccacctagacgtcggggacaactccactatcttccccggagactcgggccttctcgtcgtcgcctccggcatcaccgccaacatcagtatgcattggagctactgctacgattcgtggttgtttcccatagagatcaccgacagcggaacggcctcaatcctggttcaaggaatggaagttgggataaccatggttataaagaacaagaatgggagtttggctctgtctgtttcacagtgtggttgttatgtgaaggacctagtgatatccctggatggtggagcatcttggttttatcaagggtttataaatgcttttgaagatcatattaaagctgcagttgagaaggcagtacctgaaaatatcattgaaggcgctgggaaactggactcctttctgcaaggtctccccaggaccatcagtttggacgacgtcgcggccttcaacttgactttcattaatgatccacactatggcaattcttcaattgagttcgatatcaatgggttgattacttcagcggttgctgagacagccaatctgcagaagcatccacaactttctttggcttgtggtggtgcatcaaaaatgcttttgctctcacttgatgaagatgtattcaattcagcactagaagttcattttaaggctggttcaatgcattgggttgttgacaaagtccctgatcaatctctactgaacacagctaattggaaatttatcattcctcgtttatactggaattacccaaatgacgatatactgctaaatatctcaatggcctcatccccggtgataagggttacatcagaaaaaattgaagctaccattaatggagacatgataattgatgttgtagataacaaggagatagttccagttgcatgcatctcagtgattgtcagtgcttcaggtgttgtggatgcatcaggcaataaagtatatggtagagttggattagataatttctcccttgcgttgaagtggagtaaaattggcaacttccatatgtctttgattcagggagtgattcgggttctcctgaacacagtatgcatgccgtatttgaactcacggcttgggaatggattgatcttgcccgtggtccatggtttcacacttcaagacgtctacgttttaacctctgctgagcagctgacgctttgttcggatgtcaccttcaacgcaagcagcatggcgagtttattatgatacagggaagtgcgtgtctggcgtatttcatttagcgttgaagtacaacactcgcacatatgtgtacattatattgtacatactacacaacatctcgttataaatattgtttacattcaaaaaaaaaaaaaaaaaaaagcaaacatctgcgtgcctcgtgc

SEQ ID NO: 12930 - DNA, 1418 bp, Zea mays
tgggtacctcgaggccggccgggaaaagtcgagaggcgggtaccaaccgcatccctagtacagatcgcgtgggccgccgccacgcccggccgccacgctccacgctcccactcgcaccccccgacgggtcggaacctcagctcagaggatcggaagaacggacgacggcgagatggcaagcggggaagaaggcaagggcgagacggtgctggtcaccggggccagcggcttcatcggttcgaccctcgtccgcggcctcctcggccgcggctacaacgtccgcgccggcgtcctcgaccccgacgacagggcggagacggaccacctcctcgcgctcgccgccggcgccggccgcctcagcttcttccgctgcgacctcctggacggcgccgcgctgctcgacgcggcaagggggtgctcgggcgtcttccacctcgcgtcaccctgcaccgtcgaccccgtcaaggacccccagaatcagctgatggtgcctgcggtggaagggacgctgaacgtggtgcgcgcggccaaggacgccggcggagtgcggcgggtggtcgtgacctcgtccatctcggccgtcgtgcccaaccccgggtggcccgccggcgaggtcgtcgacgagcgttgctggaccgacatcgactactgcgagaagaatggggtttggtaccctgcttccaagacgctggcggagaaggcggcgtggaagtttgcagaggagaacgggctggatgtggttgtggttaacccggggactgtgctgggcccgatgattccaccagccatcaacgctagcatggccatgttttgtcgcctccttcaaggctgcacggaggagtacgccgatttcttcctagggccagtgcacgtggaagacgtcgccatggcgcatatcctggtgttcgagagcgcatcggcgtcggggaggcacctgtgcgtccactccatctgccactggagcgacttcgccgccaaagtcgccgagctctaccccgactacaaagtgcccaagttccccaaggacacccagcctgggctggtgagacaggaggtggggtccaagaagctcatcgcgctggggcttcagatcacccccatggagaagatcatcagggatgccgtcgagagcctcaagagccgaggccacatctcctgaatcctgatggatggcaggatgggcagtgcttgtgatgcgtgaggccgtacgtcatggaccttgctaagttgctagcgtggcttgtgtaactagttgtaataaataatgatgtcaccagacgacgacgacgaacctgagaaggaaaattgagctaatagctcgattttcagttcttaatcacgaagtttcaggtaacgaactggattggattctttgtcgcagatgaggcctagagacacacgctgaacgttctgatagt

SEQ ID NO: 12931 - DNA, 2680 bp, Zea mays
gaacagccctgaaaaaagcgaggaaaatttgaagaaatcttgctacacagttctcactgatggctatctttgctacacagttctaatgccccctgtgacgtgacttgagcagatcgagaggcgggtaccaaccgcatccctagtacagatcgagtgtaccgtagccactccacgtctccacgctccacggtcccactcgcaccccccgacgggtcggaacctcagctcagaggatcggaagaacggacgacggcgagatggcaagcggggaagaaggcaagggcgagacggtgctggtcaccggggccagcggcttcatcggttcgaccctcgtccgcggcctcctcggccgcggctacaacgtccgcgccggcgtcctcgaccccggtcagtagagtacagtagccctagccccgcactctccgccggctttgcttcctctcctcctgaacaagcgtcgccatgaataatgacgccgggagagaaagctgctggccccttgcccgcctgcgacgcggcgctcgctcagctcatcgagtgcgccgcggtggtgtgcatgcagacgacagggcggagacggaccacctcctcgcgctcgccgccggcgccggccgcctcagcttcttccgctgcgacctcctggacggcgccgcgctgctcgacgcggcaagggggtgctcgggcgtcttccacctcgcgtcaccctgcaccgtcgaccccgtcaaggacccccaggtatgtacgtcgtcgtgccgcgcgcagtgcagtatagtagtgacggtaaccagtcgccgccgtctgcccgctcggcgccgcgcgcacacccatgacccacgcacgccgaccctgctccgctcgccttcggtgcagaatcagctgatggtgcctgcggtggaagggaccctgaacgtggtgcgcgcggccaaggacgccggcggagtgcggcgggtggtcgtgacctcgtccatctcggccgtcgtgcccaaccccgggtggcccgccggcgaggtcgtcgacgagcgttgctggaccgacatcgactactgcgagaagaatggggtgagcatcgactactgctcctgcttgggttcttcattccttcccaatcccacccagcgaacccacctgatgaactctggactttgggaaattaacagcaacctctgcatgcagagcttcacttttcatcagcaatttgctggctgttagcagcatctcaggcgaggttcaatttgcttttgcgtgtaggtttggtaccctgcttccaagacgctggcggagaaggcggcgtggaagtttgcagaggagaacgggctggatgtggttgtggttaacccggggactgtgctgggcccgatgattccaccagccatcaacgctagcatggccatgttttgtcgcctccttcaaggtaatctacctcttcttgctagggttggaaaaaaattgaatcttgttatccgtccatttaaaaatcagtgggattgctcagtaacctttcgttctctgcttgctacacatggccaaatgtctcttccagactcagttcaggcaccagcagtttcaattgatacatagatgaccaatcgaccatgcattggcagtgtggtagcaacgaacacaaagcatgcatgcatgtctatgtcttgcaactgttcttgcttgctcattacaagcttgtacccctgcaggcatgcacggaggagtacgccgatttcttcctagggccagtgcacgtggaagacgtcgccatggcgcatatcctggtgttcgagagcgcatcggcgtcggggaggcacctgtgcgtccactccatctgccactggagcgacttcgccgccaaagtcgccgagctctaccccgactacaaagtgcccaagtacgcggaacggaaccacacactgtcacacacacagtttatagtttttaccaagaaaaaaaacgactgaaatctagagacattgtgctgtgttgctttacctgcaggttccccatggacacccagcctgggctggtgagacaggaggtggggtccaagaagctcatcgcgctggggcttcagatcacccccatggagaagatcatcagggatgccgtcgagagcctcaagagccgaggccacatctcctgaatcctgatggatggcaggatgggtagtgcttgtcatgcgtgaggccgtacgtcatggaccttgctaagttgctagcgtggcttgtgtaactagtagtaataatgatgtcaccagacgacgacgacgaacctgagaaggaaaactgagctaataactcgattttcagttcttaatcacgaagtttcaggtaccgaactggattggattctttgtcgcagatgaggcctagagacacacgctgaacgttctgatagttgccgtcaactgtacttggccacgccatttgctcctcctcttctttggcctgcactctgcacaaagttcagtaatgtgctttggtgcaggatcatgagcaactgtatacagattttttgggggtgcaaaacagtgaagcaccctctaaagcctttcgttcggttgtacgtggatcggaagtggttgagagtaaatcttttttctatttaattttgactagcaatatatttaatcctctccgaccgtctcaatacactcataaaatcgaataaggcctaaagaatctaggtatcc

SEQ ID NO: 12932 - DNA, 2625 bp, Zea mays
  misc_feature (54)..(54): n is a, c, g, or t
tggtgtgatattgatgtaactgaacaatgaactaattatattagagctgagttntactctttttttctttttagggttttctcacgaggtgtgagtttttacctagaaaggtttttaatgatgcagccattgcacaaacagctctaatgttttatttaaagtctatgagactaactactactatctgtgacagaactgtgattttgtgacttgattttgtgacctgagaactgtatttatatgtgaagttgtgatttgtgaagttgtgattatgtgaagttgtatttatatgtgacaatagacagtagattttgtgaagttgtgatttgcgacctgagaactgtgatttatatgtatgcgggctcaggctagcccggttgttgtgtaaatgggtcgtgcttaccgggccagcacggcacgaccgtgtcttacccatgtcgtgctcgtgcaaaggatagagcccgttggatggcctgacccggcacggatatataatcaggcttagtcgggtcgggcttaatcgaacccaggtcggatcgggccgtgccgcccgtttgaacttctataattcgaaccgtcctaagctagactgattggatcgacggcaaaagcatttccaccatatgaccgagcgtacgttggacacaacagagaagcactgaagaagcccactgagcctccagtccagatcgagagctcctactggctcggcgatcaattcatcagatgctcacagggagcaggcgaatccagcgcgtttccgtgagcgcaagggcacagccagccaatagtgcatgtggtgcgcattgtcattagtgtacatacactggagcagatgtaacactagagcgatgcgatcactagtaagcagtgcgcagtaagccttcgtcttcgtcgtgtctatggtcgcatgtgcaagctaggacgacatcaactgtggcaccaagctatgtcgtctatctgccggtgctgcaccaaacgcataccagctatagctagtgctgccatgcattctcggccacgcgaggaccgcactgactccgatgattatacctcggatattttctttgtccactccagatgcgaaggtgcgcatgcatggcgagagatcgccacaccgtgccggccgctatataaacccgtcgtccatggctgctatataactcagattcagtacaagctcaagccaggcacacagcaagacatcgaccatggctgcctaccaacaagctcccgctctcctgtgcgcctgcctgatgctcgtgctcatggcgggcgcggcatccggcggccgcgtagacgtggaagacatgctgatgatggaccggttccgcgcgtggcaagccacgtacaaccgctcgtacctgaccgccgcggagcgtctgcgccggttcgaggtgtaccgccagaacatggagctcatcgaggccacgaaccgccgcgccgagctctcgtaccagctcggcgagaccccgttcaccgacctcaccagcgaggagttcctcgccacacacaccatgtccacgcgcctgcatgcgtccgaggccgcgcggcggcaccgggagctcatcacgacgcacgcaggccccgtcagcgacggcggtcgccagtggaaccggcggaactacacgacggacctcgacgtccccgaaagcgtggactggaggaccaagggcgcggtgacgacggtcaaggaccaaggagcttgtggtaaacgatagcatttacatacttattccttgctagctatatatgaaaagaagttaaaatatagacacacaccataatagatgatcgaagatgctgcccctccttgcaggcggttgttggtcattcgcgacggtggcggcgatcgaaggcctgcacaagataaggacgggccagcttgtctccctgtcggagcaggaggttctggactgctcttccccgcccaacaatggctgccacggcggcaaccccgcggctgccatagactgggtgtccgctaacggcggcctcaccaccgagtcggactacccgtacgaggggcggcagggcaaatgcaagctcgacaaggcacgcaaccacgtcgccaagatcagaggcaggaagttggtggatcaaaacaacgaagccgcgctggaggtcgccgtggcgcaacagcctgttgccgtgggcatgaatgtacatccgatccaacagcactacaagagcggggtgttccatggcccctgcgacccagaggatctcaaccacgccgtcaccatggtggggtatggtgccgaatccggtggccgcaaatactggatcgtcaagaactcgtggggcgagaagtggggcgagaagggatactttcgcggtttcgcctcgagaggcccgtcaaggacgtcaggggcacctgcggtatagccgagtgggcaaactacccggtgatgtgagctcccgtcccgtgtctgtcgccaccgtgctttacctgcctggcctacagtgcggtcgtcttgctttcctgcacatgcgcaagcctatatatgatgatgtgcagaagtcagcttgtagaacaggctgaaataaactcgacgcgcccggcatgtgtactcggcagtgtcgtcgttgtcatttgcctattatctatcatcttaagaacta

SEQ ID NO: 12933 - DNA, 3057 bp, Zea mays
aaaaaatagcctattccattagtaagattccaattcctcaaaatgaaaggaaacaaacaggacataagggaaatgccttgttaacatagctatagctttctattaaaactacacttagacttgaagcacaagcagtaacaagtaacaacagaatttctgtcagtagtcatgttataaatcaaacatcaagtaacttcgtttggtgatattgtctgttagtgttttattataatctgtctggtcataatagctaatctaagaattctcttgttctcttttaactttgcaacagattgatgcttcaaatccttttggggatcctacacctttcaaggcagttcttgatgaaagtccagcactacctcagacacatgctgcaccagctggttctttccaacccactgggtacctcgtggccggccggggtgaaccctttccagcctgcttcagccgcaagctttggttttggagacactcttggtgatctcacttttgcaccaaatgctgcacctgagctgcaagatatgtttgcaaacacagcctccttgccttcagaggtagcaccagcaaacccatctgtggttctccaacagccagttcctactaatttctcctctcaggtatctcagccagttgctggcacattgcatgctgctcctacagcatttgctccttctcaggctcctcccacatcatttgctcattctcaggcacctcaggctgcccctgcattttcttattcacaagggcctcatcctggtgctgccatccagtctcaatttccccagactgtcgccccatcatttcctccttcgcaggtgcctcaatctgtaacacccaatctgccaccaggccaatcgaacttttttttgcaatcagcatcagggtctggtattgacagcctgtctggggttcctacccagaatggagcaccatcctacattcccccacagaattctcagttcactgctccggcaaatcaacaaccattgcagccaagcttcatcccacaaactagcacaccagcactccagccggccttgatctctaggggggcatcccagccccttggtgtgccaaattcagtgcctactagtggcagcttcccgttgcagtcaagttcatcagctcccccagaaacaatcgtttctgctttgcaagtcaatcaaactgagccagtgaagaagtttgagcccagatctaaactgtggtctgatactttgagccgaggtctagtcaatctggacatttctggacgtaagtggcctgtcgtcgtttacttttttcccctgcaatgccaacagcttacctttgtgttggctgaccccattgcgtatgttttttttacagcaaaagcgaatcctcatgctgatattggagttgactttgattcaatcaatcgcaaggagaaaaggcaggaaaagaaaatcaaccaagcacctgtggtgtctacagtcaccatgggcaaggccatgggagctggttccggcattggtcgggctggtgtaggtgcaatggcacctcctcctaaccaaatgggtgccgggaggggtatgggtcctggtgccggtgccggttatggtggtggaatgggaatgaaccggccaatgggcatggggatgggaatgaatcaacaacagatgaggatggggatgaaccaacaaccgatgggaatggggatggggatgaaccaacaaccgatgggaggaatgaacatggggatggggatgaaccaggggatgccgatgcgtcctccaatggggatgggtcctggtggaatgcccggtgctggctacaatcagatgggcgcggcgtacggtggccagcagccatacggtggatacaggtgaggaggggctatgcagtcccccacaccacagatttatgggggcgaggtgttgaagaaacggttttggaggcatctgtattttgctcacctggttttgctttgggtatgatttcttgtttcttttgggggtggaggtgagaagggtataattttcgtcactattcttttacagtctatgttggatactgtacctactttactaaatagcaaaaagcaaacatatgaacaagggcggtgctacaactactgcgttgtgttggatgtaaagccttgatatattatctctttcccatgtagttgtggctataggcggcttcttttcagtgaacatattgtctgtttcagcgttcttgctggatggatagtaaatggctgtaccatttggttgaattatcatggtttttgctttgatgttagtttgcatgtgaaatttgacatgctttgttcacatcgttattcttgtatcagttactatcgaggaactaaccgcaatggcttagatctagctggaggacagtcgtcattctgaaggaacaaagatcggtcaaaaactaggtcaatttggctaccgaagattgggacgaaaactttgtgcgggagcctgagacatttttgggagaggacttggtagaatgaattccacctccgtctttaaataaatcaacccaaaacccattcatgcaagtcaaactatcttaaaataaatcacctcaaaatccatacaagcaagtcaaactatcttatcttaaaaataaatcaactcaaaatccatacgtgcaagtcaaactatcttaagtttaattaaatttacaggtcaaacttttacaaattttacgtgaaagagagccaccatctatgatataaaacgagtatattataaaaaatatgttctatggtatatataacacgaaagcatctagtccctaatttgatttcggtgattaatggcgtatgttttatagaaacaatgtaaattaggtcatactgcctccatcccataaaatatggcatattttttttttgcaaaatctttagagtgaaacttagacaagtatttttttaaaaaaatacgacattaacaaatataaattgagcatcatattaaagtattttaaatacaaattcaagtatataagatgtatacactattttttcttgaattattagtcaaagttttgaaatgttgacttttttaaaaaccatgtacg

SEQ ID NO: 12934 - DNA, 1908 bp, Zea mays
tgatgcttcaaatccttttggggatcctcacctttcaggcagttcttgatgaaagtccagcactacctcagacacatgctgcaccagctggttctttccaacccactggacctggtacggatgtgaaccctttccagcctgcttcagccgcaagctttggttttggagacactcttggtgatctcacttttgcaccaaatgctgcacctgagctgcaagatatgtttgcaaacacagcctccttgccttcagaggtagcaccagcaaacccatctgtggttctccaacagccagttcctactaatttctcctctcaggtatctcagccagttgctggcacattgcatgctgctcctacagcatttgctccttctcaggctcctcccacatcatttgcccattctcaggcacctcaggctgcccctgcattttcttattcacaagggcctcatcctggtgctgccatccagtctcaatttccccagactgtcgccccatcatttcctccttcgcaggtgcctcaatctgtaacacccaatctgccaccaggccaatcgaacttttttttgcaatcagcatcagggtctggtattgacagcctgtctggggttcctacccagaatggagcaccatcctacattcccccacagaattctcagttcactgctccggcaaatcaacaaccattgcagccaagcttcctcccacaaactagcacaccagcactccagccggccttgatctctaggggggcatcccagccccttggtgtgccaaattcagtgcctactagtggcagcttcccgttgcagtcaagttcatcagctcccccagaaacaatcgtttctgctttgcaagtcaatcaaactgagccagtgaagaagtttgagcccagatctaaactgtggtctgatactttgagccgaggtctagtcaatctggacatttctggaccaaaagcgaatcctcatgctgatattggagttgactttgattcaatcaatcgcaaggagaaaaggcaggaaaagaaaatcaaccaagcacctgtggtgtctacagtcaccatgggcaaggccatgggagctggttccggcattggtcgggctggtgtaggtgcaatggcacctcctcctaaccaaatgggtgccgggaggggtatgggtcctggtgccggtgccggttatggtggtggaatgggaatgaaccggccaatgggcatggggatgggaatgaatcaacaacagatgaggatggggatgaaccaacaaccgatgggaatggggatggggatgaaccaacaaccgatgggaggaatgaacatggggatggggatgaaccaggggatgccgatgcgtcctccaatggggatgggtcctggtggaatgcccggtgctggctacaatcagatgggcgcggcgtacggtggccagcagccatacggtggatacaggtgaggaggggctatgcagtcccccacaccacagatttatgggggcgaggtgttgaagaaacggttttggaggcatctgtattttgctcacctggttttgctttgggtatgatttcttgtttcttttgggggtggaggtgagaagggtataattttcgtcactattcttttacagtctatgttggatactgtacctactttactaaatagcaaaaagcaaacatatgaacaagggcggtgctacaactactgcgttgtgttggatgtaaagccttgatatattatctctttcccatgtagttgtggctataggcggcttcttttcagtgaacatattgtctgttccagcgttcttgctggatggatagtaaatggctgtaccatttggttgaattatcatggtttttgctttgatgttaaaaagaaaaaaaaaaaaaacgctccccgcgatctagaac

SEQ ID NO: 12935 - DNA, 1760 bp, Zea mays
gccacgatgaatgctttttactgcaatacaacatgatccagctatctggagcctagacatttactgtttctttttttactattcatttttaacctagttccacaaaaatatgaaaatttactttggtcaaagataggttatgaagggcatgcatctctttgcccttagccagaaacaagtagcaaattattgtgctcttgtctcttcactgaaagaagagcaccaaaattgtgaaggggtaggttgggtagtcatcatgatatagtaagaaccttatgtgacttgtttgacactgtttagatttgtcatatgaatggttatcttggttgtctgaacttaatactggctctgaattcatatgcttatggatgtatctatgcaaactaggaaataaaaaaaatcgaaatacattggtttggtaattgtaacatgatgcagtttaaattatcttgggtctgatgtattcctatttttttgtgacatctacagtacatatagtttttttaagtacttctgcatatttatcatgtatttgactctattgcttttgtctcagtttgttggagggcttggcatgtcatggcaactctcattcggtgtgctggtgctgctgtacttctactcgcactatttctttgccagtggtgccgcacacatcggagcaatgttcaccgcgttcctgtcggtggcgagtgccctgggcaccccgtcgcttttcgctgccatggttctttcattcctctcgaacctcatgggcgggaccacccactacggcatcggctctgctcccgtcttctacggcgccgggtatgtcccattggctcagtggtggggctatgggtttgtcatctccgttgtaaacatcatcatctggctcggggtgggcggcttctggtggaagataatcgggctgtggtgagcagagagcagcacattaactgcgacatcccttttgtttttctgttgtttttttgtcgagtggggggaggaaaactatttcctgaatttgcggtgctacagatgccgctgtccacagttttgtcgtcgacatgatcgcaatgcaacccattcttttttagttggtatcgatacatttgttcgaaaccttccggtggctaattgcgaggccagggtgcagtttttaacgcgcaaaatttgttatatagagtttgtgctcaatggttcttggagatccctatatatatatatatccccacccccacgacgatgggtgctggttccttttcatgttcggattctgagtctgctgcaacagcacacgatgttctgcatcacattggtgcatccggtagatttatatatactgctggctgggttcttacttcttaggcaacatctgatatgtacaattgacattgctcctgactttgagaactctgcaaattgctgtgagatgatgctcgagtgctgtcatcagcagatcccgcatatggccgtactgtttatatagtgaaggccgtactgtaataggagaggggatagaagataaaacaggagagatgatgaagacatcctcaataccaactgcaatcattctatcccgaggatgaacaatggctcgctagtggagatgcttgacttagggatgaaacgacttgtgagacagatggcgtgaaaggtacactgttttcctttttgtctaaaataacgctctgaacgttaggtgctctgtgaaaggtacactgttggaggtcacgaaaaatcacggccaacattgggtgtgctttcctgcgccaact

SEQ ID NO: 12936 - DNA, 2089 bp, Zea mays
  misc_feature (24)..(24): n is a, c, g, or t
ttgggtacctcgaggccggccggngcaatcgggtccctcgagcccggccgggaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggcgccgccgtgctcagccgcacgctcacgttcgccgcggccttctcggccttcggcgacccgatcccctggctcatcgcgctcgccttcttcttcgcgagggggttcatcaagaccggcctcggctcccgcgtcgcctacgccttcgtcgccgccttcgggtcctcctccctcggcctcggctactcgctcgtcttcgccgaggcgctcctcgcccccgccatcccctccgtctcggcgcgcgctggcggcatcttcctaccgctcgtcaagtctctctgtgaggcatgcggctcgcgcgccggcgacggcacggagcgccggctcggagcctggctcatgctcacgtgctttcagacctccgtcgtctcgtcagccatgttcctcactgcgatggcggccaacccgctctcggccaacctcacggctgccactatcggcgaggggatcgggtggacgctctgggccaaggccgccattgtgccggggctgctgtcgctcgtgctcgtgccgctcattctgtatgtgatctacccgccggaggtgaaggcgagccccgatgcgccacgcctggccaaggagcggctcgccaagatgggacccatgagcaaggaggagacgatcatggccggcacgctgctgcttacggttggtctttggatctttggaggcatgctgaatgtggatgcggtttctgcagcaattcttggcctagcagtcctcttaatctcaggggttgtcacatggaaagagtgtttggcagagtctgtggcgtgggatacccttacatggtttgcagcacttatagcaatggctggctacctcaacaaattcgggctgatctcttggttcagtgagactgttgtgaagtttgttggagggcttggcatgtcatggcaactctcattcggtgtgctggtgctgctgtacttctactcgcactatttctttgccagtggtgccgcacacatcggagcaatgttcaccgcgttcctgtcggtggcgagtgccctgggcaccccgtcgcttttcgctgccatggttctttcattcctctcgaacctcatgggcgggaccacccactacggcatcggctctgctcccgtcttctacggcgccgggtatgtcccattggctcagtggtggggctatgggtttgtcatctccgttgtaaacatcatcatctggctcggggtgggcggcttctggtggaagataatcgggctgtggtgagcagagagcagcacattaactgcgacatcccttttgtttttctgttgtttttttgtcgagtggggggaggaaaactatttcctgaatttgcggtgctacagatgccgctgtccacagttttgtcgtcgacatgatcgcaatgcaacccattcttttttagttggtatcgataaaaaaaaacaaaacaaacaaaaaaattgcggccaaaatttaaaaaaaaagttaagccttaaaatataaaatagaacctttttaat

SEQ ID NO: 12937 - DNA, 1464 bp, Zea mays
aaccgttaagcattatatggatttaaatagctttactttggttgatgcactgctgggctacggtataacctagaacccacgtcttcaaatagactgtcatatggtgcatttaccaccctcgaaccatagatgatttggcagagatgtcttctgccggcatcagcggatgcgtgcctacaactgtaaacataagaacaccatatacaaacgaatcatggacctgtatctgttgcagtgtatggtgaccatgacaagcctgcccttgttacttaccccgatattgctttaaactatatgtcctgcttccaaggactattgttctgtcccgaagccgcttcgctgctgcttcataatttttgcatttaccatattagccccccaggacatgagttaggagctgctccaatttcaccaaatgctcctataccgtctgttgacgatttggcagatcaggttgcggatgtcctcgatttctttggattaggctctgttatgtgcttcggtgtcactgcaggtgcctacattctaactctgttcgcggcaaagtatagggagcgggtactaggtcttatccttgtttcacctctgtgtaaaggccccacttggactgagtggttatacagtaaggtaacatccaatctgctgtattactatggcatgtgtgggttagtgaaggagtgcctacttcagcggtacttcagcaaggaagtgcgaggattctctgaagtacccgaatcagacatagtgcaggcttgtaaaagcctgctagaccagcggcagagcatgaacgtgtggcgcttcgtacagacaatgaacgagagatacgacttgtctgagcatataaagcggctgcagtgcagaaccctgatttttgtgggcgacaattctcagttccacacggaggccgttcacttgacgtcgaagctcgacaggagatactgcgctctagttgaggtgcaagcgtgcggttcactggtaaccgaggagcagccgcacgcgatgcttataccaatggagtacttcctgatgggatacggcctgtacaggccgcctagccaggtggtggagtgcagcccgcgcagccccctgagcccgttctgcatttcgccggacctcctgtcacctgagagcatgggggtgaagctgaagccgatcagaacgcgagtcaggcttgaggtgtagcagagggctaggctaacttttgcaggtctgtgtttagtttttggaggtatagttatactgccatgtatatataaatatataggaaacgctgttctttgatttgtagcctgaaagaaaataatagcagaagtttgggtgtacagtctctctattatgccattatacccgctggtttggttgggtggcaggattagatgtggttcccaaagaagcatatgtcttaagaagataagagatggaccagctgtagtatttgttcggtttgttgtttggtgtcgattt

SEQ ID NO: 12938 - DNA, 1838 bp, Zea mays
ctcgaggccggccaacaatgagaggagagggagggaggccgcgcgcctggctcgtcctcccccttgcttccttccgtcgtttataagcgacggcaacacaggcgaagaagacggggggagaaaggggcgcacgaggcaatttatagggaggaagaggaggggccgggcctgagcagagcaggccggaccagccatctctcctctgaggcgtcgaggggaggcggcgcccgagatgggggactccggtggctccgtcgtgtcggtcgacgttgagcgcatctcctttggcggcaaggaacaccatatacaaacgaatcatggacctgtatctgttgcagtgtatggtgaccatgacaagcctgcccttgttacttaccccgatattgctttaaactatatgtcctgcttccaaggactattgttctgtcccgaagccgcttcgctgctgcttcataatttttgcatttaccatattagccccccaggacatgagttaggagctgctccaatttcaccaaatgctcctataccgtctgttgacgatttggcagatcaggttgcggatgtcctcgatttctttggattaagctctgttatgtgcttcggtgtcactgcaggtgcctacattctaactctgttcgcggcaaagtatagggagcgggtactaggtcttatccttgtttcacctctgtgtaaaggccccacttggactgagtggttatacagtaaggtaacatccaatctgctgtattactatggcatgtgtgggttagtgaaggagtgcctacttcagcgggacttcagcaaggaagtgcgaggattctctgaagtacccgaatcagacatagtgcaggcttgtaaaagcctgctagtccagcggcagagcatgaacgtgtggcgcttcgtacagacaatgtacgagagatacgacctgtctgagcatataaagcggctgcagtgcagaaccctgatttttgtgggcgacaattctcagttccacacggaggccgttcacttgacgtcgaagctcgacaggagatactgcgctctagttgaggtgcaagcgtgcggttcactggtaaccgaggagcagccgcacgcgatgcttataccaatggagtacttcctgatgggatacggcctgtacaggccgcctagccaggtggtggagtgcagcccgcgcagccccctgagcccgttctgcatttcgccggacctcctgtcacctgagagcatgggggtgaagctgaagccgatcagaacgcgagtcaggcttgaggtgtagcagagggctaggctaacttttgcaggtctgtgtttagtttttggaggtatagttatactgccatgtatatataaatatataggaaacgctgttctttgatttgtagcctgaaagaaaataatagcagaagtttgggtgtacagtctctctattatgccattatacccgctggtttggttgggtggcaggattagatgtggttcccaaagaagcatatgtcttaagaagataagagatggaccagctgtagtaaaaaaaaaaaaaaaagggcggccgcccttttttttttttttaacacgtcaataacaatatttagctttaacaagcaatccaatcttggacagttttttcttaaaaaaaacctgagttcagttcaggcagggcagctatagttgtggctataacaatagaacatatatagtacccaacatgggtaactaatctagcacttgatctccttaagaccatgagagaaatagaggaatgtcggattagtggcaccatccttgtaataggcgaataccacggacgcttcgtccttcatgctctcacc

SEQ ID NO: 12939 - DNA, 564 bp, Zea mays
  misc_feature (258)..(261): n is a, c, g, or t
  misc_feature (267)..(268): n is a, c, g, or t
ggaccaacagcttttgcttgcttcgcagcagaatatttttgttccatgaaccttcattccaagtatgaaacataagtacaaggttacaaggtaacatcgtgaacaaaaccctttcccttaacaaggcaggggaaaagtagcacatttattccagcagggcagcaacagtatgcctcagatttgggaccttacttgaattcgaaatattctctataattagcacatgggatagggggggggggggggggcctttggggnnnnatttcnncatcccgcagaagggaaacgggcaacaaatgggttacgctttaaccactggaagctccccgcactcgctggtgactacttttttttttgggcgggcacctttgtcaatctcctgggacttgatcagccttacaatattcattcctttcaagacctggccaaaaacgaaatgcctttcattcaaccaaggggttttgacagggcaaatgaaaaactggcttcccttggggttcggtccaacatttgccatgcttaccactccaggtccagtgggaaccaatttgaagtttttatttt

SEQ ID NO: 12940 - DNA, 4753 bp, Zea mays
  misc_feature (3826)..(3826): n is a, c, g, or t
  misc_feature (4065)..(4065): n is a, c, g, or t
tgaaggccagtcgatttatttggcaatgcagtttcggtgggcagatctgatatcaaggcacacaaaatcgacatcgttttttcctgaactcgctgccgccgcaacggtcgacgaaactcgactctgcgcctgatgccctacaggctacggctaattcgggcccagtggaccactccaccgtagcccaattgtcaggcggcccaccgttcatttccagacccgcacctaaatcgccggttacttccgcgaaccgcccccacgttccagctccagcgtgtgaatgtgcgtgtgtgaactgtgaaatgtgaactgctgaggtgtgcgtgtcagtgtgtgaaccgtcacgcggcgaagcaaagcacggcgcctttcgctcgctttcctccaaagggccgggcggcgttcgtccgcgtcgatctggacgagcagtttgcccatgcagtcgtgggactccgccgtgcgctaggcagcaaccgaacatggcggcgaaaggaattgttgttttctagcagtagggactagaagctcattcacgtgccgtcatccaagagctggctcggcaccgccacctcccaccatcatcatcgacgtccggcagtagcagcatcattacgagacatcatcttgttttatatctaaagctatcgttatctctctgaaaagcttcaagaaaccgctctttgtggctttagagattagcttgggcagaaacccggcggccgcccatgacggaggtggagacgttgatcgcagtcgcagacaccggtttcggtttctacctggtcctccggctcgtgggccgggtcgcaggcaacggggacacgatcgatgtgcaaccgctcttgaccgctgctactggacgctggacgagtgaacactttcacggattgcgagcagcatctttggctcctggaacggtcatgtggcggtgatgccaaaaaaccaaaagttaaaagcggccagccatgtgcactgcgggctgcggcccggtctaatgtctatctctctctctctccacccggctcctcactcacgcagtcacgccttcccgtccgatcgatgccgctgaagcagcggtccatctgttcccctttgtcctgttgcaatcattcgaggccccgttctcgcacgagaccattacctagaacatcctaatcgaaaaacgcgctcaattccactgccaagattcgccactccgtccgttaccttcactcgctcactcacaatgcggcgccatggcgaggtacgcgtgatcttagctatggccgccgccgccgccgccgcgctcttggcgtcggcggccgtggccggacgagacggccggcagacctacatcgtccacatgtcccattccgccatgccggacgagttcgcggagcatgaggaatggtacgccgcgtcgcttcaggcggtgtcggatgccgccaccgtgctgtacacctacagcaccctcctccacggctactcggcgcggctgacgcgcgcggaggccgcggcgctggagtcgcagccaggggtgatcgtcgtcaacccggaggtgcggtacgagctgcacaccacccggacgcccgagttcctggggctggacggcacggacgcgctgttcccgcagtcgggcaccgggaccgacgtcgtcgtcggggtgctcgacaccggcgtctggccggagaggccgagctacgacgacaccgggttcggccccgtgcctgcgggctggaagggcaagtgcgaggacggcaacgacttcaacgcctccgcgtgcaacaagaagctcatcggcgcgaggttcttcctgacgggctatgaggcggccaagggccccgtggacacgtccaaggaatcccggtcgccgagggacaacgacggccacgggacgcacacgtccagcaccgcggcgggcggcgccgtccagggcgccgacctgctcggctacgctgccggcacggccaagggcatggcgccccgcgcccgcgtcgccacgtacaaggtgtgctgggtcggcgggtgcttcagctccgacatcctcaaggccatggaggtcgccgtgacggacggcgtcgacgtgctctcgctctcccttggcggcggcacggcggagtactaccgcgacagcatcgcggtgggcgccttcagcgccatggagaaggggatcttcgtgtcctgctccgcgggcaatgccggcccgggcgccgcgacgctgtccaacggcgcgccgtggatcaccaccgtgggcgccgggaccatcgaccgcgacttccccgcctacgtcacgctcggcaacggcaagaactacacgggcgtgtccctgtacagcggcaagccgttgcccaccacgccgatgcccttcatctacgcggggaacgcgtccaacagcagcatgggccagctctgcatgtccggcagcctgatcccggagaaggtggccggcaagatcgtcctttgcgaccgcggcaccaatgccagggtccagaagggcttcgtcgtcaaagacgccggcggcgccggcatggttctcgccaacaccgccgccaacggcgaggagctcgtcgccgacgcgcacgttctcccgggctccggcgtgggggagcaagccggcaacgccatgagggactacgccatgtcggatccgaaggcgacggccaccatcgtgttcgccgggacgaaggtcggcgtcaagccgtctcccgtcgtcgcggcattctcctcccggggccccaacactgtgacgtcgagcgtcctgaagccggacatcatcgcgcccggcgtgaacatcctggcggcgtggtcggggtccgtcggcccgtcggggctccccggcgacggccgccgcgtcggcttcaacatcatctccggcacgtccatgtcgtgcccgcacgtgagcgggctcgccgcgctgctccgcgcggcgcacccggagtggagcccggcagccatccggtcggcgctgatgacgacggcgtacaacgagtaccccggcggcggcaacggcatcctggacgtggccacggggcggccggccacgccgctggacgtgggcgccggccacgtcgaccccgcgaaggccgtcgacccggggctggtgtacgacatcgcggcggcggactacgtggacttcctctgcgccaacaactacgaggcggcgcagatcgcggcgctcaccaggcagcacgcgtccgaggggtgcagcgccaaccgcacctacgcggtgaccgcgctcaactacccgtccttctccgtggcgttcccggccgccggcggcacggcgaagcacacccgcacggtaaccaacgtcgggcagcccgggacgtacaaggtggccgcgagcgccgccgccgccggcaccccggtgacggtgaccgtggagccgtcgacgctgagcttcagcagggccggcgagaagcagagctacacggtgagcttcacggcgggcgggatgccgtcgggcaccaacgggttcgggcggctcgtctggtccagcgaccaccacgtggtcgccagcccgatcgcggcgacgtggacctaatggctagcggcggccgtaccgtagcaatagcgagataaaatcccgattgggggacggcaatggcgagcgcgcgccattctcgaatgcgagagagatggcggatatcgtcgaggatgtgctgttgtattgtgtgcatgagtccgctccggtgtgtaagctgccggtgtagtgtaatctatctgtagctgacccgattgtagcgatgcagcaattaaatctcaaaagggttgcagacttgagcacttcttcgaaaaaaaaaaaaaaaaaaaaaaacggtacaaaaaaaaaaaacactgatccgantttgaacatggataatgaatggctctggcgtattggggccaagggccgtgcaggtgcaggtgcagggcatcctgtggggaacatactgctctgctcccaagtcctaacttatccacaccgccatgtttcctgtagcttaggctcatgtttatcccctcctagttgacgaatctgagaataatatagtgcacagctcgctgacagcggtcggtcttaacgtggactcaatcacttgattnccagattagcaacacctttcgctcttgaaggccgggccaggccaggacaggagtaaaccacacgcaagagaatatgacccaaactgtcaagagcactagcgttatgctgccgtgacatggcactttaagcctcgacaagtcaacatcatcaacaagggtccccctaaaaaaaaaggtctcgtgatccgttaaattccgcatcgcgtgcggtacagtatgcatcaggggtcagggccattgaagggaaatccgctaccgtctttcctcgctggattacgccgcccagtgaagcactcgctgctgactgctgtgctgcctgcaaccatgcgcggctggacactaccacccacatgcggacatgcccgtgccgctgcagctcacatgcgtgtctccgtgccgtggtcacaggtggatcggatacaacgttgggcgggaagggaatggatcacggacgcgacgctgcgacagggctggtcgtagatatttcatcgcgtttcgccttccaaacgcgtgacctctgcctgcgtgggcccgactggtctcttcgttctcgtgacccacggggtcaattcgcgtggtgcgccgtactcatgctgtggatagtggacatgcttcggcttttcgactgcgcgatccatccgtgaccacttacagcagtttacattatcttgtgcacaattctacacca

SEQ ID NO: 12941 - DNA, 1657 bp, Zea mays
atgtcaaatggcatttctgtccctccctcgctcacctgaattttcagtttgctcaggcaaggcaacgattagcttcctctcgccgaataaaagctgtcttcttggtctgaggagggaaagtggtgtgtgtgtcttcgcgcaaaaataatttctcagccagcagattaagcatttaatgctggtgtgttaaccaaggcgcaaactttaatcaacggggtggttgcaaatgaggcaaccgcagaggaaaagggtcgggcggatggtggcagtggcacgccgcagctacctctcccctccccatcgccgccaacgccaaggccaacagcacaaccatcgcaccacccaagaaatggagctgagtgtgccccttctcctcctcgcggctccccaagctcctgctccgcgcgcgtagccgcgcggcacctcccagtcccaacacgcccgcaagctccgctcaccgcgaggtgctgtttgaaccgtgaagatggcggcgatgactgcttacaagtatcaagctcaggccttgatgagggactatctgctagctgatccactagttccgtacacctctgtgctcattggcattgtcctctgcaagatggcttacgatttcactcgaatattgagctccttttatttcaagggctacactttactgacaaaaatacagcgcatcgaatggaacaataggggtatgtccagcgctcatgcaatttttatcacggctgtatcattatatcttgtcatgtcaactgatcttttctccgaccgcgtcaagggacctattacattccgttattcgataatatccacctctgcgttgggggtttctgtcggctacttcatcactgatcttgcaatgatcttctggctgtatccttcccttggtggaatggaatatgtcctccaccatactgtttccctggttgcaatagcttacacaatgttgtctggggaagggcagttttacacatacatggttctcatttcagagacaaccacccctgaaatcaacttgcgatggtttcttgacactgctggactgaagaaatcaagtgcttacttggttaatggaattctgatgtttgttgcatggctggtggcaaggatatttttgttcatgtatgtattttaccacatctatttgcattacggtcagataatgcagatgcatgcctttgggtactacctgacatttgttgtgccatcagtgctctttgtaatgaacacaatgtggttcatgaagatcttaaaaggtgtgatgaaaacactggcaaaatggccatgacgtggatgacgccaagaggatctcagaactatcaacaggatttcgtctttctggcatcattacgtgaccttaatctgtgaagttatggatatcagggtaactagagaaacataatatgtaaagtattagcaaacaagctatattaggtgaaattgccctattttcagtcgagctggaagttcataaccggtttggtttgtaccggagatccagcacgctgttctgcttaccccacctgtgccatgtgtatatctgaagagaattttaatgggtggtttgttcaacagtacaaaaaaaaaaaaaaaaaccccccccgtttctttttacaagtcgtttccaacagccaatctataaatatcggcgacatct

SEQ ID NO: 12942 - DNA, 832 bp, Zea mays
  misc_feature (831)..(831): n is a, c, g, or t
ctcctctgtgcgcattgggccggcgcggcccgcgggaaaatctcctaccactacactaccaccgtttcagtgctataggataggattttcttttgacggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgtggctcggccgccgaggaccccataaggagagtcatgttcttggctccctggggccacacataaaacacagacccagatctgggcttgcaagagcatggccggatctgcagagaactgctcaaccatacttaaaaggaactggagcttgtcttgtaaactatggagcatgctgcttgcaccacgaacatgaacgcatggctggttaactaggtagatatatgggtgtggatgggggagagagaaaaaaacaaggtatgtagtccaccgacgtctctgatcttggatggagaggcatgagatcttgggatgctcatgcatgggccatgggtgtggctgagatctggaacttttgtagccatcaacttgttttccagaaaccatgtaataagggtgacctgtgtatagctatgagacatcaacaaatcttgctgctttgtgtgtccaaaaaaaaaaaaaaaaaagcccccccggccacaagattctccttctagtgcgggcctttttatcatctatgtgttcttggctgaaactattgaaactaccccttctttcactgtaaaaaaaaaaaaaaaaaaggccctagggnc

SEQ ID NO: 12943 - DNA, 811 bp, Zea mays
  misc_feature (775)..(775): n is a, c, g, or t
ccattgggtacctcgaggccatctcctaccaccaccactacactaccaccgtttcagtgctataggattttcttttgacaagacaggtagcagccggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgcggctcggccgccgaggaccccataaggagagtcatgttcttggctccctggggccacacataaaacacagacccagatctgggcttgcaagagcatggccggatctgcagagaactgctcaaccatacttaaaaggaactggagcttgtcttgtaaactatggagcatgctgcttgcaccacgaacatgaacgcatggctggttaactaggtagatatgggtgtggatgggagagagagagaaaaaacaaggtatgtagtccacgtctctgatcttggatggagaggcatgagatcttgggatgtggctgagatctggaacttttgtagccatcaacttgttttccagaaaccatgtaataagggggacctgtgtatagctatgagacatcaacaaatcttgctgctttgtgtgtccaaaaaaaaaaaaaaaaaagccggcccgcttcagaagattctcttctagtggggatctttttatcatctatgtgttcttgtctggaactatcactttcttcactggcttctgtcgngaaaaaaaaaaaaaaagcggcctcgagctcagcttt

SEQ ID NO: 12944 - DNA, 6769 bp, Zea mays
  misc_feature (6014)..(6014): n is a, c, g, or t
  misc_feature (6132)..(6132): n is a, c, g, or t
gctgaggtagctatgacggatggtaaaactgatgatggtcaatagtattgttaatagtacgatcgatggctgatatatagacccgcaaagttagaacaaaccttagctgcatataactgtgttgtgcagcctactgcctacatctcttctctttcccttttttttcccctcttccaactcagcaaaaaaaaaggaactgatgccagcccttatggctcttttgctttattacattttcgcctactttactttattgcactttatctgaaacggaaaggaattctggacgcagccaggtatgcggttcttttcacatgagcaggaaaggtgtggttcacaggctctttgttttagctcccttcattctcaaaagttctaaaaaaacgtacggtttgatattatatctagattaaaaaagggtatatttagaaaaaaaaatttaaattagtatataatagatactccttctttgattccaaaaacttcggaataaaattttaactgagcgagtggttgagatcctgctggtgccatttgagaccaaaagaaccagaaacaaaacaagtccgacttgaactcttgcaagattttttataggctttgttgagcagcgtgtcacaaaaagacatttgatcaccactctataatctatatatctaatcagcaccattacactagtgataatgcaaagccggattccacttcgcatccccttttgccccttcggaatcggaacctggtcccgggcgcaccagctcagctcggccgcagctggaattcccattctgccctgcccctcccccgcggccgcctataaataaccccacaccgcgaggccggccggtgaaaatctcctaccacttagcactacactaccaccgtttcagtgctataggataggattttcttttgacggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgcggctcggccgccgaggaccccataaggagagtcatgttcttggctccctggggccacacataaaacacagacccagatctgggcttgcaagagcatggccggatctgcagagaactgctcaagctcaaccatacttaaaaggaactggagcttgtcttgtaaactatggagcatgctgcttgcaccacgaacatgaacgcatggctggttaactaggtagatatgggtgtggatgggagagagagagaaaaaacaaggtatgtagtccacgtctctgatcttggatggagaggcatgagatcttgggatgctcatgcatgggtcatgggtgtggctgagatctggaacttttgtagccatcaacttgtttcccagaaaccatgtaataagggtgacctgtgtatagctatgagacatcaacatatcttgctgctttgtgtgtccacctttgcttccatctcagctggtttggttcagaatgccttcttgtctgaaactattgaaactaccccttctttcactgcctccttgtctgaaactacccctctccggcctcttttttatgtcaaggtgattccattggatgcgaggaaagaacattagcgctgctgggattttaggaaacatgaatcctgctccgtgcccaagaaagagtattgatgatttcaacacttgcatatttcaagtaacgaacctcaaaagatctcggagttcagtgagatcaaaggctacctattcaatcaaagctgtatcctgcaggaaagctggaagcttcctttctggatatattttgcagtatcatatagtttgttatatgtacaatatcatatcattattataacttggacagaacacagaagccacccagaaagaagaataaaaggaagccccttttttacccttatttttgtactatataactaaaaagaatcggactcctcttttcctttggattaatgacctacgaatcctactataaacaagacaacgatgaaaaagactgcctcccacttgcaaggataagccaaactctgtgggtcaccatcttgcttgctttctcgagcaccttatcttttcttcagatatccacaaagaaattgacaaggatattactagcagaaacaaaagggttcaccgatctgatatgctgcaaatttagcgcgtaaatcatgacaatatattgcctgcctaaagacaggctatcagaaacttttgcgtgtatgtgggtgggtgggtggggggacactttttgtgtcttctaattgaaactgcttaataaagggaggcaaaaaaaaacagcatttttttggggcttcatgaaccattgagccgtgttactgagaccctgtttgtttccctcctagattatataagctggattatggtggaatgttagaaagatgaaatatcactttagaattacaaataagctaaaataagctacccaatactagctaatttcagcttatttatggtcttaaagtgatattttaccctcacaccctaattacaacttttgacaaaaaaaaaagttgagtcactcatgattcatgaagttggccaccaactgcgcactggatgggggtaaaaacgccagcacagctacacttatctcgattcttgacagaaagcgatggttcaacttccaatcctggcaagttgccagagtgtgcagttttcagctacctcgttcttgaatcataagctgggacacaaatgatgtgcttgccaacctgtgactgcttggatctggggagttctgaatacagcaacatcaagtttgtcataaaattcaaaggatttcttaagacagatcaaagtgaagcttcgagaactcctttgaacaataattcaatgaaatatggataatccaattgaactgagcaaactattctggtggtttgttcgattaagcaaacactttagtcaaaatttccatggcgtaaatgccaaggcaattataatcaagtttcatatttttcttacccagtctttactgaaatttttcaaaggtccaaaaacacgtcaccaattattgctacggacacaataagaatagtgacaacaatgtaactttctatatacggctttgcttactgtaacaaggactcatgcaacactaattgtaacagttcttaaacagacaatataaagatacaagataaggttgtaatctattaacaaaaatacaacacaatcttgaagtctgaagaggagaaagtggatttggaaaagagttgtatgtgttgtcagtcggaccaaaaaaaggacctagatcatttattagtctggtaggccattagagcaagtttaataatacagccaacagtggcctttatgaagttgttatgtcgcatatagccaacttaaaacatactcgtataataattctataatgataaaagttgtacatttaataatgtgtcaatctctttctctcacaaactgtcttggtcttggagttcgtgaacagtctgctttcagttggctactagtggcagtctagtgaaagggcctctagcctagcggttaaggactttcgagtagcacctccaagtcctgggttcgattcctatcgggagcgaattttcaggctgtgccccatccgctctcgggttgcgatgtcctatgcgccaccttccggttgggccgttgcagagtggacagctgacgccggcccgttagtgatggggggccagggttcggggattttctcggccgggaccattgtttcggtctcttcttatatgaaataccgggaggacggtctttccctccccggccgagtttactagtggcagtctactttccttctctctctatttttctttcttacacatcatcataaatctgacgtgacatctcttacaatccacctacatcatcttattatacttgctttcatcccaatataattagtattcgtttcttagtagacatttagcccttcacagttccttagccagctgaacaaaggctcatatatgagatatctaatatttgttcttggatctatatgtgtatatgcattttttgtaaatacaaacatatttaacgaacaaggacgactatatgactggtatccaacaggtaaactattctacttactacaacaaacaaagtatacatgaaatacaatagccaaacattggtgtggaaggcacagggaagagactgaatggaggaatgactaacaagcttcaacagtagttgttataacaagtagaaaaacagaaggaacaaggaaaagatacaaaatgttaagaattcaaaattgtcatactaaccagtgctactcagcattaggatctgcactagggtgcatcttgttccacacatacattatcactgaacatgtacctaaaagggcaatgttcaactgttctgaagtgttggccttgatgctgacccgtccagttagtttgttgtttacatcaacatgaactgacatgtttgaagaccttccaacagagacatgggaatccaaatttgcggccatggtccactctttatcgccatttcactaaggatgcacccaaagtggcaacgccttgacctacaggatagcttttttcacgaagagttgcttccataatcactccatatgcagcatcacctctcatggacacagcaccagtgttgcctgatagtgttaacctgttaccaactaaaagcttgtcttcaagctttgctccagcccaccatggaatttcccaaaaaggtcatggataaaccaccagtagtgatgtttttcttgaagtttttaaatttggtctcccctctgagggtgtaagaaagctggttcataattgtttggatgtcaaagcctgccaggctcgaggcataatctccatgcttaactgacattgaggaatccaaatggatggtaaactctctcttgtccttgttaacttgaacccacagagatgctggatatttgttagcaacatcatggctgtgttggacactcacaccatcaaatccaaaatcatgatcccatccatcaggattgtaaacagcacgcaccagaaggtttggtgcgggctcgcggcaccgatagcggtacacaggatcatcagaatcaaatgaagatggcaaggtccattctggcataggatatctatctgtatcatatccatcatcgggatgatcatcatcagaaagtatatcattatcatcaccctctttcttcttcatttccttaaatcctttgagctgttccttcagctgcttcttctgaagcagcttagttcggtaatcagattcatcaaaatacaaattctgttgctccttggagagttttgcaacctgggatttacttagtggcttgaagggaggaagttgatcatagtcatcttcatcctcttggtccccattcaacaattcatctaggtaaaaatctgagtccacactcacaacattatggtcattggaacgcttagggtgctctctagatttcaacaaagatgataagaagtaaggaattggaggcacttggagaaggcggcctaagaaacttgcagaagaagcacggcgggttgagagactgtcaatctcagcaatcatctttagtgagaagcataggaggaggaggagccgcctccagataaggccatcaggaagcatcttttcaccttctgcgttcctccgacacagatgatggttctccacaagagccacaggattctgaatttgaggatcattagttatctgccggatgctttgctgaatggcatgagttcgacgagacacaaccatatcatagttcacttccaaaccattagggccttcaggggaagctgctcctgagtgagtgagagtaataattgttctgggccatattgacaggcctagcacactggtaatgcatcgcaagagggataggctatttgcctcctcccgcggtgtatcaagcctatcaacatacagaataatatctggagggcatctcnttcatatacttccccaccccggtgagcattttcctatttgatttttcatcctcggctgaagtcccaagcccaggggtgtcgacgacatgaaacttaccaccattaacaactccattanatctccttcacagatgatgttgccggtagaaaagcatttgttttggatttatcttccccgaagatggaatttattgttgcacttttcccaactccagtcttcccaaggaccaaaacattgcaggagaattcaaggttctcagttccctctgcctcacgctgcaaagccctcttccaggcattctcgatctctgaggaatggtttgtcatccttacgcacctgaaactttcaacaagactaagccgaaacaacacttgtactggtacctgatggttagtatcataccccaatctatgaacaagacgcatgtatttgattcgtgccatgtccacctttccgtaaatcttcttttcctcatcggtcatctgtttctcagggtcagcgattgcttgtggcacaggagcagaagccacgttcatcctagcattgctggctaaagtgggaggcagatccctaggttcagaagattcaactgggaaaaccttggccttgccttgttcaggcgagctgcttgcagctcttagaagctcaattaaagctgtatgatcaaaaagctcgttctcctttccattcatctcttcttcatattcatcatcaccgttgatctctgcatcatctgaatcatccgcaacaaagc

SEQ ID NO: 12945 - DNA, 4930 bp, Zea mays
  misc_feature (3956)..(3956): n is a, c, g, or t
agctcggaattcggctcgaggaaatttcgcgaatctgcaaaagtagatgccaggcactgggagcagataaatgagcggcggtataatcttgatttggttcgtgatgtgatgtctacagagctaagagcaattcgtcaagacaaatacggttggatattgcacggagaaagtgagtggcaaagccagctccaagaacttgtccatgagagaggtatttttcctatgcggcaaccatccacagaacctgagtggcagctgtgtggtgttgaaggaccatatagaatgaggaagaaacttgagcactccaaatttaagatagatactattcagaatgttctaaccagcaaccttggatcaaatggtggtaagattatcaataaagaggatggagaattgttgttgacatctgggtcagacacaatgtcaggcttgaatcttttgacctatgacactgagcagagggatcttgatgctgtcgagttttcgtcattcaaagatgatgatgacatattcaaaggaggaagcacaatttcaggtccaattggctggactgatgataaaagcagcgttaatgagcagagccttcattctgcgacggaatttggagcaaaatcaagttccctttcttttcacatgactgagagtcaccagggtaaatctgaacttagttcaccaaggagggcaccttcagtcaaaggtactgatgcaagaacctcagaggataaatcagaaaaggggttgcttgacaatggtgagtatcttatcaggccttatctggagccctatgagaaaataaggcataaatacaactgtgaacgggttgctggtcttgataaacacgatggaatatttttaattggagaactttgcttatacattattgagaacttctacattgatgattccaattgcatttgcgaaaagggcagtgaagatgagctctctgtcattgatcaagctttaggtgtgaacaaggatataatgggaggcagtgaatctcagttaaagtcacctaccacttggggtgggacagcaaaggtcttgcttggtggcagatcatgggcatataatggaggtgcttggggtaaggagaagctttgcaacagtagcaacctgcctcatccatggcatatgtggaagcttgatagtgtccatgagttgttgaaacgtgattaccagctccgccctgttgcaattgaaattttcagcatggatggttgcaatgagcttctagttttccacaaaaaggagagagaggaagttttcaaaaatttgattgccatgaatctcccacggaatagcatgttggacacaaccatatcagcatcctctaaacaggagagtggtgaggggagccgtctttttaaagtcatggcaaaatcattttctaaaagatggcaaagtggagaaattacgaacttccaatatctcatgcatctaaatacacttgctggtcgagggtatagtgatctcacacagtacccagtatttccatgggttctcgcagattatgagagcgatgttttagatctgaggaatccacagacatttcgcaggcttgataaacccatgggatgccaaacggaggaaggtgaagaggaattctgcaagagatatgatagctgggatgaccctgatgtaccaaagttccattatggctctcattattcaagtgctggaattgtccttttctatctcttaaggttgcctccttttagcacagaaaatcagaaattgcagggtggacaatttgaccatgcagaccggttattcaacagtgtgaaggatacatgggtaagtgctgcaggcaaaagtaacacatcagatgtgaaagaactaattcctgagttctattatttgcctgaatttttggagaaccgttttaatctggatctgggcgagaaacaatcaggagagaaggttggtgatgttgttttaccaccttgggctaaaggcagcgccagagagttcatcaggaagcatcgggaagcactggaatcggattatgtatctgagaatctgcatcattggattgatcttatttttggatataagcagagaggaaaggcagctgaagatgccgtcaatgtcttctatcactacacatatgaaggcaatgttgacatagacgcagtatcagatcctaccatgaaggcttcaatactagcacaaatcaaccattttggtcagacccccaaacagttattccagaaaccacatccacagaggcggactgacaggaaagtccctcctcatcctctacggtactgtgcctatctaacacagcaggagattcgcaagacagcatcttcggtgtcccagattgtctcctacaatgataagatcctaattgctgcagttaactgcttgctcaagccgctaacttataatgaatacatttcctggggattccctgaccgaagcttgagaatattaacatatgatcaggatagacttttgtctactcatgaaaaccttcatggtggtagtcaaattcagtgcactggagtgagccatgatggcaacattctcatcactggtggtgatgatggagttgttgcagtgtggagatttgtgaaggatggcatccgccgtctcctgagaatggagaaggctttgtgtgctcacacgggcaagataacttgcgtctctgtcagccaaccttactcattaattgtctcaggctctgatgactgttctgttatcttgtgggacctgacaagcctagtctttgtgaagcagctaccaaggttcccggcatcagtatccgcgctacatgtgaacagcctcactggtgagattctgactggtgctggtgttctttttgctgtttggagcatcaatggggactgccttgctgtggtgaacacctcccagcttccttctgacctcatcttgtctgtgacaagcgcgacacactcagactggcaggacacaaactggtacgtgacaggccatcaaagcggcgcggttaaggtatggaagatgttgcactgctcgtctgatgaagcagtaaatagcaagagcaaatcacctgcggtatcgtctggtgggcttagcctgaacggccaagcaccagagtataggctacttctgcagaaggtgctcaagtcacacaaacaccctgtcactgccctttgtataccaccggacttgaagcagcttctgagtggcgatggcagcggtcacttgctctcatggtcattgaaagacgacagtttcaagggttcatagcacagagaaatatagggattcagctgcacatatagagaaacactggttaaattgtaccactgatttcttcctcgtccagaactgagcattggcgtgcattgacaaaagatctcggatcagcaagcttctacatggtatatgaaatgttcccttgatgtcccatgcctgggccatacagcagtccgggcaggagagagaatacaacagacacaattggaaggatgaagtggacgtggatgcgccgctgcgctgacatcataatcttatactgtgaattatgagatggttgtaccttctcttgtttttttgaggagaaaaggattcatgtgggctgtaggtgccattgtttgtaaagtctatacagggtaattttggtggtgccggttgaggtggctgatggtgtagtgtctcgatgttttgttcggggttgcgggagcaaggaaagaggtattaggttcaaaatctccccccacctctggaggctagtttgggagccacaaaaccgaaagtgattggatggactaaaagcttctacatattcaaaattgaataagaacgagattttaatcacttcaatcctcttcgattttgtggcttccaaactagccccagaagtgttgattctttgactgggtgtaatttgagcacccttgtgttcagtaagtctatttgcgtatacatgcaagagttttgctgaacaaagcgacgagccccttccatgnttcgattggaagtgaagtgtagtgtcgcagatattttctccgccctaaattataagtagtttgatttttataagtagttttgattttttttttctagggaagccaaaataacatagttgaaacagagggagaaattcagaaattttgaaggtttaatgtgtagttcagccaccgttacggttcacattcgtgatgcaacagcacggcttacattcgtgttgcaacagcccggcagcggctccgtgcagctaattttggagagctaaatggtttaactttgagtataatttttcatttttataaccacactgttctatatagagttaatttaaacaataataaattagaaatgaagcggctccatttcatcatactctagaactaaatcctacctaagtgtagccgtgcaatcacagatcaacaagcggataagatgcattaccaatcgtttttttgttcggttatacaggaatagggaattgaaatttcttcctaatcaaaattaataaaaaggatttaatttcctttgatccttgcgcaatcgaaaagaccttaagatgttcatctagaccgacgccttgaatccgatcgacgtatcctctcgttgttgtcactaggatagacggcactttctctgtatacaaatgtttgtcattgttatttttaaggagttaattatttttaactttaaccatatttatataaaaagatcaatatttatagtacataatttgtattattaggtagatctttaaatctattatatttcataactctaattaaatttgagaaaatttgaccataacgacaaatatttatggacaaagggagtaacatgaaagtttatctagaaattcgcccatggctccatgataattttgtagccctacatgtgaggcacaaaatcgtagatgtctcgactctgttcttcgctcttcgcaccaaagagaaggccctaagagcagtcccaaccc

SEQ ID NO: 12946 - DNA, 2946 bp, Zea mays
  misc_feature (885)..(885): n is a, c, g, or t
aagtcatctaatgtcatttaaaaaacatatgttcgtcccaacgatcttctcccccaatatgcttctagggtgacccaaagattgagtaaatagcaaggttttgtactgacttagattttattatttcgagagcagtactatattctaagagcataggtaagctctgaagacttctagtaagacaaagaaagacactggatccagaaacctagtgaatagtgagttgattgctatttctttttccatttcttcttacctaatgaatagcccaacaacatgaatcaaaatcttcaagacaaattaatcttcatctcttcatcaacaagctcaaatatttcaccaattccgagataatgtaagaaatcgtcattgttaccacaaccaaattcaaggtgcaaattctgtttgttaacatataaaataaaaggttaaaagataacaaaatatggcttacctagttagcttgatgttcatattattatgccgagtggttaaatagacatataaaacaagaacttaacaaggtaactaagctagtctaagactgagaagcatgacaactttaggttgctaaactttatgaaatacaaagatgatccttctataaatcatttgttacacactaacaacatagtattctaagcctagctaaaaggggatataagataacatgagaggaacatttctacaatatagtatgttgtattatgacaaaagaagaggaaatcaaacctgcacgacaaaactaaataaagtatgtgaaacaaaccatccctctgactggaaatgaatttagaatgaagctaatggctatatattattcagataagaaaatacgctactaagaaaacaatctcatttagcgcacggggaatttagacaatntggtaaaatgctaaagcgacacgatttaggtatagaagacgttgcactgctcgtctaatgaagcagtaagtagcaagagcaaatcgcatgaggtatcttctggtgggcttagcctgaacgaccaagcaccagaatataggctacttctacagaaggtgctcaagtcacataaacataaacaccctctcactgccctttgtataccaccggactggaagcagcttctgagtggggatgctagcggccacttgctctcatggtcattgaaagacaccagtttcaagggttcatagcacatagaaatatagggattcaactgcacatatagagaaacacttggtgttctagagaaatttaattaaccatttgtcatatagacttgggtaggaataaacaataggcacaaatccaaagctaaatgtacctttaagtgatggataatgcatgagagatacccttgaatgattttcatcaagctatgcatcagagcatgtatggttatggtactggcaaatatgagaggacatgaaaagttcttgcaaagatactgcaatgctaaaacagaaaaaggggaaaaacaggaaactgaaactttgttgtcttttagttgccattttaccattcactcatattgcaggtgttcatgtctcgactatcttgtagctataattgttaatacccaacaggtcgtccaatctagtgtgatgcttgacatgtttaagggcacctatgaggttatcacaaaaggcaacccaatgtggaactaattaattgtcccaaaaacgtcactctattcatgggactcgaaatccaattacattcatgtgcccccatactccaaggacatgaccacatctattgtaatatagtaggtaccttctgtaatagaaactggttatgcacatgtaccatcagagttgacttgagcacatggaggcacacaacctaagcaaggggaccccgttttagctggttcagccccgtagacaagaaaatggaatcctatgtgtatatagtcgagcaaagttctaaaaagttgaatacgatcagtatcttctcacccgtatgcaagtttatgagtcctatttgctactggccagtaaacatttcagataccatgtgtaaagctcgaaccttctgtgagtttggctgagctacaactcaacttagctgaactttcaatgatgctattcctttcttttttttcaaatgatgttttataatgtagcaaacacagccccacaaaaagagaacatatgtacaatttgctaggtatagagtgcaataccaagtatagcctttgaactataacaaaaaaaactctaatattgtcccctctattcttttttacatatcacattagctttatcctaagtcaaacattactatctttgaccaaccgttttaagaatccttagttccacaacatataaactatatattattaaagtattttgggatctaaaaacataaatctatatagttttttttctaaaaatatcagcaatcaaagatataaatatttgcatgaggcagaatgggtaaaaaatacggaactaatgaggaacttggaagcttgttgttacctaggagaattcagttagtcgtttctagagatcctttcgcttgcagagtttcaagttcctttcaacggtattctctctacatagttggacacacagttaaatggatgaaataagctctgaaacaaacatgcacctatctaagtaatcaccttccaagataactcattattcctataagcatttgttaagtttttttgctagaaaaaaacaaatgcaatagcaacagtgaaaacagatccactatggcaaattggacttaaatcttctgtttagaatcacaaaggtaggagatctgaatttttgcagaagggaagaacaacaacaaaaatgcatcacttattataaacaaaatatatgttctcaaatctcaagttattgctacaactcaaactaaactgatatatgacacattactatattatattagcattccatcaaacaatttaatggcatgataagcagtgggtggatgttg

SEQ ID NO: 12947 - DNA, 2461 bp, Zea mays
ccggccggagccggccggcagaaccctcgcatcctgtaaatggcgacacgcctcgcctccatcttctctgccgtgcgcagccccacctcagccccgccccacactctccgccgcgctctcccaagcttcagctaccggcgagcgcatccatctcagccccgcatgtcctcctcttcagccgcctcctccgcgccgccggccgccgagaagcctacagtggcgccgttcgggtcctggaggtcgcccatcactgcggacgtcgtatctggcgcggataggcgcctcggcggtatcgctctcgctggagatggacgccttctctggatcgagggccgccccgaggagaaagggcgtatggttattgtaaaggaggaggataatcctgtggatgtcatacctcaggaatttgcagcacgcacactggctcaagaatatggaggtggtgcatttgcagtcgacaagagtgttgttgtgttctcaaattacaaggatcaacgtctatacaagcaaacaataggaactggtggtccacctgtgcctcttacacccgattatggtgcgccaaatgtcagttatgctgatggtgtatttgatcctcacttcgaccgttatgttactgtgatggaagatcgtcgaaaggatagcttgaatcccaccacaacaattgctgctataaacttgagtggcagtgatgttcatgaaccaaaggtgctgatcagcggcaacgatttctatgcatttcctcgcattgatcaaaataaaaagcggatagcatggattgaatggagccatccaaacatgccctgggataaatcagaactctgggttggttacttcgccgaaagcggagacttgaccaaacgggtctgtattgccggtggcaatcggctgctgattgaatctcctagtgaacctaaatggtcaccgaaaggagaactgttttttgttactgacagagggagtggattttggaatatttataaatgggttgaacaaaccaatgaaattgttccagtgtattcactagatgctgaatttacgagaccattgtgggtttttggcatcagctcgtatgattttcttggaaacagcgaccacattgttttcagttatagacagcaaggaaagtcacatcttggtgtgcttgattgtgattcaggttctatttcattgcttgacatccctttctctgatttatctgatgtggttgctgcagatgattacttctatattgaaggtgcttccgcgagtattccacggtcgattgctaaggtgacattaaatgaaagcaaaaccaaagtagtcaatttctcaatagcctggtcgtcctcaccagacctcgtacaatatagacctttcttcagcacaccagaacttgttgagttccctacatccaagtctggccagaaagcttatgcctatttctacccaccatcaaatcccaattttcaaggtttgcctgatgaaaagcctcctttgcttgtcaaaacacatggaggaccaactgctgaaacacgtgcaattctggacctcagtgtccagtattggacaagtagagggtgggcatatgtcgatgtcaactatggaggaagcactggttatggaagagagtatcgggagagactattgaacaaatggggtattgttgatgttgatgattgctgcggctgtgcgagattcctggtggagagtgggaaagtagatgggcagcgcctttgtattactggtagatcagcaggtggatacactactttagcttcacttgcattcagagacacgttcaaggctggagcttctctctatggtgttggggacttgactctgttgagagcggagacgcacaaatttgagtctcattatatggacaatcttgtaggaaatgaaagagcttactacgagagatcaccaatcaactttgtcaaccagtttacttgtccagtcattttgtttcaagggttggaggataaggttgtgccaccagatcaggcacgcaaaatatacagtgccttgaaagagaaaggtttgcctgttgctttggttgaatatgaaggagagcagcatgggttccgtaaggcggagaacatcaagttcaccttggagcagcagatgttgttctttgcaagattagttgggaagtttgaggtggcagatgatataactccaatcaagattgagaacttcgattgatctcttggagagtggtgtccggttcgaagttttgttcacgtaacccgattatatgttcagtacattagccgttgcagtaccttttaggaatacgacttcatcttatttttgagggttgatggaaatctcttttttgcgctgtaacgatgaagtcaccttgttttctgttcggttctagaatgaaatagaacggaatgacactatcctttatttggttgatgagtgaaaatagataatttcataactatagtacattcatacaaccatatatata

SEQ ID NO: 12948 - DNA, 2385 bp, Zea mays
atatatatatatatatatatatatatatatatatatatatctgaattgaattcaattaaaaccagcagagacgaaatcgggtacacgcaactatcaagacctaaacagcaggcttgagaagacttgtcatctaatcatacaaattgctgacctccgtcatcagcatcttctctctctctctctctctgctgagctgcttactcattccagcttcaattttctttgtccgtgatctagctagcttgcatgtctctctagagtcgatctgaatcgatacaattgagactagctactacgagtttgcagatgcatagctagctagctctcaatcacatgaactcctccagcgccaccgctatggatcaaataggcaagtactggggcatgtggggagcaaggagaagcagcagcagcagcagcacgatccccatctctgcttgggctgcggcgtacggcggcagcagcgagccgtcgtgggaggagcaggccttcgcacgcgacgcggcggaacacctcggcggctgcgtctggccgccgcgctcctactcgtgcaccttctgccagcgcgagttccggtcggcgcaggcactcggtggccacatgaacgtccaccgccgcgaccgagctcttctccggctggggggctcgtcctcccccgaggacgtgcacgccaccaccaacgatcagccacacccgcagcaaggtgctctcctgtacagggcagcagcctctaaccctagcactaccacgccgagtactactgcagctgcaggtactactgctgccggcccagcagcagccataaccatagcaggtgcaggggatggagatgccaacaccaccaccaccactacttacttgtcaagaattatcaaggagagcaagaacaagcgcttcatgcccatgccagatcactctgtcgcggggatgagagaagatcaggcggcggccatagatgatcatcgtcataatgaagatggcgacagctggcggtcagcctcagccgcgaaaaagaggaggcgtctggatcatccgttggcaacggcggcggcgcttctgatctttgtgcagccagcaccaaaggccgctaccaatgttgcagcatgtgaatcacaaggaggagctgatcatgagacaaaggtaccgcacacgacaaccctaacaagccctagctctagttcccctcttcttctggatcaacgacatgaattggatctagagctaaggcttgggactacaccaaaagttacgtacatacatggcaacgatacacgaagctagctagctagttcgtctgcacgctagtagttattaagcagatcgatttatttggtcttttgaatttactatcatatcactagttactcttgcttggttgttcatcatctttctcctcttcaatttctccccctttttcctttcttctgctatccatggggccgtacagactattacattttttggccaaagagctatacctctccctctttcaattcaatctcaactattgttcttgtttcaatacatacataaaaagttaaggggcatacgaatacaatacatagctcaaacattcttcctctgtggttactgttgttgtttttgctgtgttcatgcatacctgtgatcaattatttaagcacatcctatttttgcttctatcatccatatacacaaacctccattatggaggactcgtaatgactcacaagctcgtcccttcattaattttcatttcacttctgcttggttcgcgcgtcatgaaatttttgtgctgcaattctatctctaaattctgcaagtgtatggagcttgatggatgcatcttgccagtttatataaataggttccctagtgtgtacccaaactaaaacattatatatcagctagctagctagtagatcaacatatatccaaagagattattgtgtgaatacgatattgattagaaggttaggtttgcttgcttgagctactcaacaagatcacaagcagacaatagtgagtacaaaccgacagcgtgctcatctgttgttttcctacaaacttccaatatactcatcatggggcatagaagagagggggagggaggacgtagctcttccatatataaaactatatgtctactatattaggattagaaagaattataattccacatacaaattgagcactgaaaaataattacttgtgtgcttctcaaagcttgtttcctagcctctttgcatttcatttattacacggctccttcaatccacttatttattgcatgatctcttagaaaagaaatgcaaactacacgtgcttttttctttgcctattttcttctatcatctcaccaggtttgatatatatatatatatatatatatagggacgaggtaat

SEQ ID NO: 12949 - DNA, 1440 bp, Zea mays
ccggccgggagaaatggacgccgcaaattccacccacgttttgcatggtctatatatgtatgtatagtggcatccgcccggcagcaagaagctgaaagctaaaggcagaagcagagataatggacgacgtgcctgtctggttcgtctcgctggcctgccttggtgctctgtacatcgccgccatctgctggcggcccctcgcctatctcgcgttgtgcctgcgcgggccgaaggacctccaccgctacggctcatgggccatggtgactggcccgacctccgggctcggccggtccatggccatggagctcgcgcgacggggcctcaacctcgtcctcctcgacctcgacgccaacaacctccaggagacctccgaggccatcaagtccgtccaccccgtgaagataaggactgtggttctagacctctccctcgtcgccacaccagaaggcgacaaggcgatccgccgtctgcgggaggcgatcgaggggctggacgtggggatactggtgaacaacgcggcggtgaacacgcctggcgcggtgtacctgcacgaggcggacatcgagcgctttgtgcggatgatacgggtgaacttgtgggggctcaccgaggtcacggccgcggtgctgcccagcatgctagcgcggcggaggggtgccatcgttaacgttggatcgggctccacggtggccgtcccgtccttccctctgtacaccgtctacagctccaccaaaaagtatgtggctcatctctccagaagcctttacgtcgaatacaagagcaaaggaatcgacgtccaataccaggtcccgttctatgtgcacacgcgcatgctgtcgagcgccgtgaaggccaagctccggccgtggttcgtggcgacggcggaggactacaccagcacggcggcgcggtggatcgggaacggcccggtgtgtgttcccggcgccgcccagaacctccagtggtgcctcaccggcttcgtgccggactgggtccacgactggtaccggatccgcctgcacctgcagcacagagccgtcctccgcggcggtcgagccgcgatcgccagcgcccattcacgcgccgagaaggccgtgacacctgacgatgacgacgccaattcagttgcgccaaagatcagtgcctagccatttggctagccagctgtgctgtgctagccctatctctctgcatgcagctgtcagtcaatacaacagtcatatagtactcatgcaagtgatcaatgatcgacgccatacatataatcattatattaaaagtacgcgtgcccttcttcgtgtgtataattgttttaccacgttggattgaagttgtcagatctgcaccgatctagttggatggttattacttactccgtctatcccatattagaattcgttataggttcgtttaatatttaatatatgtgttttatat

SEQ ID NO: 12950 - DNA, 1269 bp, Zea mays
ctgaaacaaactgtcgaccggaggccggagcaaatgcgactagccgaagcggccgcggcggaacacctcggcgatcggcgtgcgtaccttccacgcgggggtgcgggaccgttgctgcgacgctgcgtcagatcgacgcgcggcgcgtccgccccccaccctctcgccgcctatataactcgcgcccgaatcggcggctccctcctttgccctctccgcgcaccttccaccacgctctggaagctgtttcccctttctcgagagtttagaaagctggtgcagagatggccggggagagctgcgtccccaagcccctgttcggcggcgccatcttcaccaccttccccgaccgcttccaggacgtgagcaacatccgggaggtccccgaccatcaggaggttctcgttgatccatcccgcgacgagagcctcattttcgagctacttgacctcaagggcgaggtggacgacgccggcagcgcgctctggttcctgcaagacatcgccaacgagcaagacgccggggacaacttggtggtagagcattctgggacacttgaactggctgctttgcatctcggagaagctcctgcagtggctgcaactgcagttggccagctggccgtctcaaaagggaggcagggcagagaagcacaaaacattgttcgaatttacctggcaaacatacgccttaagaatgcggcaaccgatgtacttatcaccgcatatgagccattgttgataaaccccctgagtgaaagtgctgtggcagttgcagctggtccggcaatacctgctgaacaagtagggtgcttgccaatgtctgaggtcttcaaacttgcagtgacgaatttcaatgtgcgtgattggaaccttttcgatggtggcccttgaaccagagtggataatctctccaaaatcagatgtagagcatctggttgacatacggaagactactacctgttttctagatttacaattcattgtcagaaattatgctatctgacttaatcttccaaatactcctattgaacttacctctggaacattagctgagtttgtcatgatagattctactagtggattgtacgcagatggtctgtgtcgcttcatcggtaaagcaaactctgctcgttcctgttgaacacaggccatttaaatttagaaattagaattgatgctacgaaaaatccaatagtagcatgctttcagtttaaaaaaaaaaaaaaaaaaaaaaaaaaaagggggccgctcgcgatctagaactaga

SEQ ID NO: 12951 - DNA, 4520 bp, Zea mays
  misc_feature (5)..(5): n is a, c, g, or t
  misc_feature (1480)..(1480): n is a, c, g, or t
  misc_feature (3994)..(3994): n is a, c, g, or t
ccggnaaaaaaaaaaaaaaaaaaaaaaaaaaaaaaaaaaaaaaaaaaaaaggtaccctccgggctccgccggccattcgttcgcgagcctcactgccagttccagcacgaatcctcgtccaatccacgcctgctgctcgcgagccatcgccacagtgctggccatgcctggagccgttgcgcttgcgcccacgctcgcggcagcgagcagctccgccgccgcggcctccacgctggctccgaacccgacaagccgaggcgacccgctaactattaggttgtgccgcaatgctcctgctagcgcaactccacttgttccacttgtagccacccgtcgctacgtgcgtggctgccgcggcgcggctctagtcgccagtccccaccacgctccaaaccctcgcctccgattcgcgtctgcggcagaggggatggctgcggaagcgagcacggcgggtgcggcgtcggcagccgaggcgaagcccttcgccgtcctcttcgtgtgcctcgggaatatttgccggagtcctgctgctgaagctgtgtttcggaccctcgtaagcaagcgtgggcttgactccaagtttctcatagactctgctggtaccatcgggtatcatgagggtaataaggcagactcaaggatgagagcagcttcaaagaagcgggggattgaggtcacatcaatatccaggcctatcaaaccctcagattttcgtgattttgatcttatccttgcaatggacaggcagaactatgaagatatattgaactcgtttgagagatggagacgcaaagagcccctccctgatagtgcacccaataaggttaagctgatgtgctcctactgcaaacatcatactgagtctgaagttccagatccttattatggaggccctcagggatttgaaaaggtgctggacttattggaagatgcttgcgagtcgctgcttgatagtatcgtcgcaaacaatgcaagcatttctgggtgacatcgatgtaaatctccacatacagacatctattttcagacgcaccgaaggctgtagcatccatgcacaaccggagtaatttggtttctaatgcaacattgatcatgtcgtcattacccaggtcttggtctggtttgtatataccaccatccttatacctggttatgtgataagtgacaaaaaaactgctcatcatcacttttttccactaaagataatcagaaacaatcagaatgaccgacaaagcatgcttatgtccatttgaaacttactattttcgcataaggcatactcggttcctcaggaaccatgcttggaacaattgtttgactaatttatatgacatttgataagctggaaaaaaaaaaaaatactggctagatttctagctatccctttgtttgaattttgcactgttttttttttcttcttcccggtgcttttctttagcctgcagcaggctgcaaccagcacgacctccacaggtgactncggctaccatgaaatcagtcgtcaccggcggtagcactgcacatgcaagaagaagccgccgggcgactgctctgtggcagctgtgtcgtcggccatccacagcctgccctccttctccgccctagccttcaccatgaactgcgcccccgagcccgcgctgccgccaccccgcccaccgaaccaccagtcgtgcacgtcccacatgacgtcgaccacctctccgtcgggcagcacggcggcgcggttgccccggaagccccagcccacccgccgcacctccgtcaccttctcgccgtcgatggtgacccgcagctccccctccccgcccctgcacgcgtgcacggccacctcgtgctcgtccccgccctcgcggaacctgcagcgcgtgacgtgcgccgccgccgccgctgccgcgcagcgcagctgctcccgccggctgacgaggagcgcgggcgcggcgcgagcgctcggtgcgaggccgaggcggcgggagagctcgcgcgccgcgccgcccgcgccgaggaggagcgcgagctcggcgtcggccacgacggcgaggcagtagtcgcgttcgggctccggggacgaaggcgacgggtacttggcctccgcggtgtcccagtgcacgccgacggccgtgccggcgccggtgaccagcgaccggctccctcttctcttgtgcagcaggaggacaggaggcctcgtccgggccggcgacggcttcggcgcgtcggaggtgccgccgccgccgtcgtcatcgaagtcgaaggcgaccgcgacgccggcctctccggccgcgctccgggtccacgtcacccggacgagcacctccttgcccgaggacagcgcggccctgtacacgctggtggtggccgcctgcagcgcccggtcgagcgcgccgcggccggagacggcggcgtcggccgtggccacgctgacggagccgtcgccgaagcaggacagctccctcatcgccgcagccacttgattcggacgccgagcaaagcgacggaacgctgcgaatctgctgcggatgcattggagggaggcgaggtgttttaatcggcgggtgtgcgtgtcgtttggctgggcttgcaatctgcgagaggaggtggcagtcaaacaaaggatttcgtgaatcaaccgacggcagaagcacccgccggtatcttgaggttcggtcaaataaggaattcgttagttcaagtgtttggcaatttgaccaaactatatactttattttcatttcagttcagctgccgtgttgtattgtattgtattgctagctgaagctgagtgaattttgcacgacggcaagcatgcgtgcatgcatgttggcagctgacagggcgactaccagaccatatcatattccgtcccgatcatgcttgactcccaacctagcatcatgtctttttttaatctgatttctgtcccacgcgccatcattgcgaggaaaatgtgtttgtctgtgtgtttgggcgggcgttcggctggcaaggaagatactggtcgaccaaaccgacgccacagcgcgatttgcgatgcacgaacaggtaccttgtccacgacacgcgcacgttccatgagctaggaagtatggatggaatggaaacatcagacgctatctttgctgaggtggttgaaaataattcaattttgcagttccaggccgtgcattttaggccacgtcgagtagtagagttttattattctcattaaatagagtgctgtgttagcattttttacgacataacagagatttactacataaccaaaatgttctgaaagctcgtacatggttggattggatcagctaaaaaataggcctgcccgcaacaaaatatcgcatcttacgtatattccgtggatagaacttacgtagatgttgtatattccatggatagcttgttcatctcaaaatttaataggagtagatttaatcccctccaattcccttgcaaacgaataagccctaagggcttgttcggttctactccaatccatatggattgagagggattgaggtggtttcaatccctagcaagtcaaaatccctcccaatccgtatcaatcccctccaatccatatggattgaaaataaccgaacaaaccctaaaggggctctccctgttgggggagatcttgttcatctgacatgtgaaagaatacgacagagcaccaccaggtccctggtatggaggatgcggcgatggacatgacgatcatggtagcatggtaaggttaactctagcaacgctgtacatactggtgtgtataacactgtttttgcattatagatgtactgtttgtcgagattagtttaaaatagggagtaggataacgagtgggacagggagtctgctggagatagtctaaagcttgatgataaagtagtcatttaaataggcaaaaacaatcttatactccctctgtcccaatttagtagtgattgtagcacttgttttttatgtctgtattcaaattaattcaaattaatgatgattaatctanacacatatataaaacatatacattaattattgtatgaatccattaaaagaagacaaaaacaaattttgatttgggacggagggagtaacatagatgatatagtctcgtaagtaaagacatacacattaaagcccagtctaacaatagaataaaaagaatcgttataatagcaaatattatctcaaccaaaaccaaccatttagaaacctctattccactaatatagttgcaacagctatgtaaaagattaaacatgtgtaacctaaaaaataaatgctcatagtgatggtggtgctctcatttcctttgcatgtcgtgatgatttagtacctaaaagccaaataagggtgagtaaaactcttatcatgtataattataacctaaaaattcaaaggtcacatggtgatccatgaacaaagagccaaaatactaagaaacggtagtttccatttaaaacagacagtgcctaaatgcatctatagtatttatcgataaagccaagcaagtgcaagaataaaagccatgc

SEQ ID NO: 12952 - DNA, 1936 bp, Zea mays
tgaaatgaggtgtgaggaaaaggagggaaagcattggcgggcgggcgggcgggcgcctgtctcttgcggctgtggtgccgcccgagagcgcgacccattcgttcgcgagcctcacttccagttccagcacgaatcctcgtccaatccacgcctgctgctcgcgagccatcgccacagtgctggcctggccatgcctggagccgttgcgcttgcgcccacgttcgcggcagcgagcagctccgccgccgcggcctccacgctggctccgaacccgacaagccgaggcgacccgctaattattaggttgtgccgcaatgctcctgctagcgcaactccacttgttccacttgtagccacccgtcgctacgtgcgtggctgccgcggcgcggctctagtggccagtccccaccacgctccaaaccctcgcctccgattcgcgtctgcggcagaggggatggctgcggaagcgagcacggcgggtgcggcgtcggcagccgaggcgaagcccttcgccgtcctcttcgtgtgcctcggtcagtcccctcaaccctagtctctgctcacctccgtctccgtctccgtctccatgccctgcccgtgagtgcgaaccaattttggtaccgatcctccatttttcctgcgtccatgcggattgaacttactcgttattgtgtcgcctaattgacttggggtagttcttggaatctcatcgacaatagccggtagccaactagccatagcattgcattacccatcttagcaccacagctacctctagcttaaggacgaattacaaattctcacaatttatgggatgaaggttcggagattttgattgttcaaatatcaactcgccctgcaacgcgattaagaatttcggatggtttgatctgagcaatataatgcttaccagttgtgtgcatagtgatgttcaactatgttggcactggttgttgcacgggctgtatgaattcaggtccttgatgcttgtttattatacttcttgtttccatgcacttgcattctagttctcacttttcagttttcacaatgtgtatgatcatgtaattctttttgtacatgctatgaaatcagcctagttgctcagacccttagttctcctatgcacttgcagccacttagctgcatgtccctccatatgtagagaagctgcagtatgccacactcaggaatgttgtacagatgaaaacaatcctgacatttgtccctccagatacatggggtttgtgccctccaacataggaaaggacatctttggtaaagacaggcgatgctgagtgtggggttctgaacgaaaaagactcagaccaagcatcaaatggttggggagcgaagtagctgcttctttgagcggagggtgattgtggaatggagaagagggtggtgcatggaggccgcatccttgtcagactgcgccaaagttagcttaacaattgcctgaccagtaatccccatctgcttggccaaagtttgttgatccttcaacagttgcttcaaaacctggacgctgagatccacccgctccgccacacgttgctgattggagtccatctcagtgacttagtgtacagaagatcaagcgactcctgaaaatggtcagcattcatctgctttggatttctccgccgccatcgcctccaggatgaactgaatctggatggaaggcttgggaggagctgtggtgaccgacctcaaaccgagtgaaccacagacactgaattacaggatcatgcgcgagaatccatggaagtctcacacgcaatcaaccaaccgccaggaattaccactcaaggctgaaggaatcgtacggtaacagaacagaactcatcagccaagagaggaaagccgtccgtgctgccgagagaaagctgaatcacctggttgccgtcactgccaccaaaatgctggaatccca

SEQ ID NO: 12953 - DNA, 1114 bp, Zea mays
aaactgcccctttggcttcccggacaatccatctacgcgccggcgctctccgcaccgcacccacccatcgaaattccacttcgcctaattccaaatcgccaaggccgagcagcagcaagcaaagccgcgccggtgaggctggctgttggagaggcatgccgcctaaatccgatagcgttgaaggaatcgtcctgggtttcgtcaatgagcaaaacaggccattgaattcacagaatgcagctgatgcactgcagaagtttaatcttaagaagactgcggtgcaaaaggcactggatgcattggctgacagtggacagatttccttcaaggagtatggcaagcagaaaatttacattgctcggcaagatcaatttgacattccaaatggtgaggaacttgaggagatgaagaaaacaaatgccaagttacaggaagaacttgcggatcaaaagaaagcaattagtgaggttgaatctgaggtacgaggtctgcagtcaaacttgacactcacagagatcacgtcaaagaagagtgaattgcaaagcgaagtccaagaaatggaagagaaactaaataagttgcggagtggtgttaccttggtgaaacctgaggacaagaagatcattgagaattcctttgctgaaaaagtgagccaatggaaaaggcggaagaggatgttcaaggagctctgggataatattactgagcacagcccaaaagatcagaaggaatttaaggaagaacttggtatcgagtacgacgaagatgttgatgtgaacgtgcagtcttactctgacatgctagcaagtctcaacaaaaggcgaaaaatttcccgctgatgatgtagcataagagcgtcttaagttgaaagtaggctacaaccgttacatgccagcagctatgcattcatggttctaccggttcttaaggttctgtagagattagtttaccctgacagcattgaggccccgtttgtttcaactttttttcagcttctgaccaccagaagctgctgcagactaccaaatgctcatattttcagcctgcttttgttagaatcgctttgataaaaaccgttcaaaatcaacgtaaacatgcaaaaaaaaaaaaaaaa

SEQ ID NO: 12954 - DNA, 966 bp, Zea mays
ctcgaggccggccgggccgggatagatccaattgttcccttcctatattgctattgctattactaggcgcgaagcgccgcagcggcaggccacgcatctctctcccttccttctccccgttctccgtgcaatctcggccgtttccgctcccgccatcgccatggaggaggccaaggttgtggagtccaaggacggaacgatctcagttgcttcagcatttgctggtcatcaggaagctgtgcaagacagggaccacaaatttttatcaaaggcagtggaggaagcataccgaggagttgactgcggcgatggaggaccatttggtgcagttgttgtccataatgatgaagtaatagttagctgccataacatggttttgaagaacactgatccaactgcgcatgctgaagtaactgcgataagagaggcttgcaaaaagcttgggaaaattgagctgtcggattgtgaaatttatgcatcctgtgagccatgcccaatgtgttttggtgctgttcatctatcccggattaagaggctggtgtatggagccaaggcagaagctgcaattgccattggatttgatgatttcattgctgatgctctcagaggaactgggtactatcagaaggccaacatggagataaagcaggcagatggaaatggagccatgattgctgaacaagtatttgagaagactaaagagaagttccaaatgtattgaaccgtggaattacttggtgggatgatttaacattgtgatagccctctgattctcaaaaaagaataacacaacctctggtattatgtaatttatgatgggccacaaattgccattgtgcttccatttctgaaaacaagattgatgtcactccttgttcttcaatgagcagttgattcttaacttacctgataaaattttttttatttgttttatttttaaacaaaaaaaaaaaaaaaaaagcggcc

SEQ ID NO: 12955 - DNA, 1694 bp, Zea mays
gtactacatgtcacggcctgcgattgcgggtttctcgggtccgtgtgctaaggcataaattcgggatccacgaagtgaaagtgtggagatcctggggtgccccccggtcttggtcgctgagcggtgactgacaggtttggtcttcggcataaggagaggacgggttccaggttttgcgtatcctgattaaactaggaactcgcagaattggtggtggcggcgtttgatgcgtggcggctcgcggtggctttagctgaagatgaacttggcggcgacagactgggaggagtagattctgagtgttgtagcaggatcggagtagtgggatttaaaccagtctgcgttagtcaggacaatactctgttcagttcagttctgttctgttcgtcggtgtctcgattctgcagccaatgcatattcggactggaaagggggaaatttgcctcctttcccaacttactagaggcagcacggaagcttagttttgtaatttcctaaatcctaaatcctaatgagtgggaaaagatggctacacaacttgccaatttacgaattgtggtgctagtaatgttgtgtgtgtgtttgcacgggattatctgtaattctgtatgaaaacttgttcgacaccattgagcagctgaagctaagcagggagtgccttgtctgctccctctctgctacaagcctacaaaccgatcaattataccatctacgtggcagttgtacggtatccatctgctggaaatccagttttcctgctgtggaaccgtgggatgctgtgctaaaataatctgtgtacaccaatcttccttcatggccttgatcttcttacctccaaaagcatcttgcctgcttatatgtgataatatggttgctattttttcatcattcgggaatagaatgttcacatgagctgaagtgtacaattaatctagctaaggagttatatctttcttccttttggatttgtacttgctaaatattagttaatctagatggctcgtgtatgatctttccccctcttgtagttgtggagtccaaggacgggacgatctcagttgcttcagcatttgctggtcatcaggaagctgtccttgttgcttcctcgtccactaaactctatattgtcttgtccccatttcatcgcatgcatggcattcaagattcaactaatacaacctatgcattcctgtacacactgttattccttactgtgaaaaaggacttgcttatttgagctttggtttatcaaacagctgtgcaagacagggaccacaaatttttatcaaaggcagtggaggaagcataccgaggagttgactgcggcgatggaggaccatttggtgcagttgttgtccataatgatgaagtaatagttagctgccataacatggttttgaagaacactgatccaactgcgcatgctgaagtaactgcgataagagaggtaggatgctctgttgactgcctctctagcttgcaccggggcatcttaatatgtggacccttgaccatccagttggttactccttccatgctttggtgttagtaccacattcagcatgtaaatagtcaaatgttacattcatcttttacagatgtggaatgactcattccatctaaacattcaatttgcaaggttcaaatttagttccagtaagttaagatgattatctgcaggtcgactctaaagg

SEQ ID NO: 12956 - DNA, 957 bp, Zea mays
cgctgcagtatacaacgaagcgagtgtggaaaagcaaggcagcgcgacgaagcggcgccgccagctccccaaaacctccccagctgccacctcctctgcctccctgcgtcccccgagcaaagcagaacaaggggggaaaaagttgacatacgcttgcagcgatggcctttgccgcccgcgccgcgctcgtgcgcgtcctccctccgcgaccatcgccgacctcccaaccgaagcagctcaagcaaggtctaggcggccgcggcgggtcctcgctcgccgttcgggcgaaggactccgatgacttcggggcccttctgtcggagaagctcgatgcgcaggcgcctgagaagcgggatgggcgggatggttttgggagggaggcgagtagcgtggaggaggagaaggaggtgcagggcgagccggcttcgtggggtgtgctcaaccagatcggcgtcgagttggactctgacaaatcatattctgctctcatatatggcacatctgctcttgttgcaatttggatatcatcaattgtggtttctgcacttgattcagtccctttggttcctcaagtgatggaagttgttggtcttggcttcacaatttggttcacatcgagatacctgatatttaaggagaaccgtgatgaacttttcacgagagtcagctccatcaagaagcaaattttggggtctcatgagaactgagcgtctctcttacgttctgttctgttaactggtactgtgttttattgaagatgtttttttttggaataaacagtacatttttttgtttttcgcctgcatttttttactaatcgaaaggtaagtgcactgtactcttttcgttgattccaactaattttaggtgagtgtagggctgcgatgacctaaagtgcgactttctttgcatgctttgcggggcccgctgaggcggctatcaattgtaaaaaaaaaa

SEQ ID NO: 12957 - DNA, 1438 bp, Zea mays
cccctgtctgcctcggagagtatagcatgtaccggagagggagcccaccttccactgatcaattacagatgttataataactatcacatgatagctatgtgtcgaatgttatgcacaagtttgattacactaggccttacatttcaccttaactgttcagtcacactatgtattcaaaagttttaaggttgagagcaaatactgtcagtgaacaagcatggccaacaaactaacaacgcaattagagcaagatacgcgaacacagcaacattggtctcattttgttgaccgcaggcaacgacacacggaaaaaaaagatctaaggcgcaccaacctgttgctgggcgtgctctgggcgctgccgccgtcgatgcgccggaggagaaagttgcggtaggcgacatagccgttgtcattgcaccgccactcctgcacccaggaacgcctcccacgaacaccaatgagtcggattcatccattccccaaagctaaatgcaatatgaacgagggggatctaagaagcggggggtacgcctactacataccattcggtgctgaagggcggaggggggcttgcggcggagaaggaggcggcggagggcagcgtaatcggcgtcggggcgggacgaggaggaggtcggtggctgcaggacgcagctgaggaagtcagggtccgtcggaatggaaggggcagcgggacactccgggggggaggaggaagaggccgtggccgagtcggcggcagccatctcctccgtctcgccggccgcgtggcgtgtcgcccgcgcgcgccccggggagatcagggacgaggccgggcgggtgcttgggatctcagggaatcggccacttcgggcgtcgtacaggggtctgctggcaagaagtggtttgtttgtttgacctgtactctatggttctgatttcgtataaaaaatatattaacaacattcatacttttaatttaatgagtaatacaatattattatatgtaaataaaattttataatttgaaatttccaacttatgttggcataacctatatttaaattgtagttccacgtaaaacatataattttgtagttgacattttttttaaaaaaatagttttttaggcttagatatttgttttgtcctctaattttaaaatccaactttaaaaataatgtaaatgaactcagatgttaatgtggtcgatattaaaattgtaactctcaatatgttatacaactttatagttgataatatttatctaggattgtctagaggcccaaatttttattttaaattctaatactttgaaattttaattttcttgaactttcaaacgacaataaaatgacctataaatgatttcaaattaaaaaaattacaactataaaattatagatcatgttgagaactataactttggtgtgtaccacatcaaattttggggtca

SEQ ID NO: 12958 - DNA, 4930 bp, Zea mays
tgcatgcctgcagtccactccggctctcgatcgagtgcgttgcgacctgcgagcacgcttcctcggtcgttttttacgtggacaaggctactacgcatatgcgctgcgcgacccaaccgcgcccgaaaagcgagggcacgtttttggtcaactccacaggccacggcgcgcaaccagcacgaaagccacgcgaaacaccacccaccacccggtgtcccggtcggcgctgtcgcccgcccgtcgtccacgcccacacaagtttccacggcatgtggcctcggactcggactcctcggccgaaccccgctatttaaccaagcgccaaatcttttcctcttcctcgtcaaaaagcacaagcaaagcaaccagagccagccaccactactcgcctgctccgctcgcgcatcccatcccagcggcggcagacagagagcagggatcggcgggtccgccgtcgacatggctcggtacgtggagatgctggacatgggcgtgcgcatcgcggcgaggttccactcgcactgcccgcagacggcgcgcatgtactacaagccgccgcagacgcagacgcagacgcagtcgcagtcgtcgtcgtcctcctcggccgacgactccaaggccgcgaccgcgagctccgccctcgacgcgccgtcggtccggcggcccttcgcgctcgcggcggcggcggcggagttccgcgccggcgaccggtcgggccatcatcagctgcacggcttggacaccgcgctagtcgtcgtgtacgaggtcatgtgaggggtcgacgaggggaggggaacaagaacgaccttcttggcaagcgccgcaagaaatttgctgcgagatgtgtactctgttctttgatttgtacatagctgtgtcggaaagttttcgtccaacacagatgaactgagaaaacattcattcattcaacatgttgttcttcgggatttggatgtgattcgatcgaactccccacttgggaagtaggggggggggggggactcaagcttggggatggttcaacgaaggtcgatgggcgcgtgttttgggtggaaaaaatcgcaagactgactgggtctcggggattcagtgcgtttagaatcgtcgtcagtaatactgtacaactttacggatcattgcgtcagtcaaacagacgggaaaaggaagaagatgacttgttcgtcccaaacaagagcaggtgcaggcgtgcagcgcagcagaatcgtctgtgaattcatttggcatggagagacctaggaggagaaacgagcgaaaacagatcccggcttgcagttgcagtacatggcatggcgcgttcatcgaactgtgtgtgatcttggcgtcttgtgcagcagcagtggctcagtcagctgtggtgtcaccagttggggtcattcatggagtccgtttgttgtgcatcgcgggtggccggaagatctgtacgcttatgagttgccccgtttgttggctgctttgaatttttttttatagctgcagttactcggcgtgcttgcgctacgatccacatccactgatctggaatctttctatgagcaaacgaagcggcggggagggggaggggccggaggtacacgcggactcgcggagacagatcaaaggaaagcgacacgccattccgtttctgcgatgatttttttgcatcctcactcgccgtcgccggccgtcgaggcgccgagtcggtgaaaagggcaggcaaacgagctccgaaaaggtcgcgccggaacccttccgtccactccggccgccagccgagagtgcgtgcgtagtgtgccactagtccactaccgcgtgcccccacgctgcccccttcgtttgtgggcgtccggcgcgaaccgacggggtcagagctagcggctgcacgggaacgggaacggtagccacacgctcacggcccaccccagcccaaccacagcgtaaaagggcacgtcttttttagtcaactccccgccgcggaagaccaagcccgcacgaaggaaaggcacaccgcgccccggtcacgcgcccacgcccacccgtgcaggtcgactgcaaggttgagggttcagaacgatcatgatggacagctcaataacctagttcgatatggatggagactagcagtaacattttactcaacacattctgaattgtgttagcttcgatgatgcacgaaagggaggggaggagatgaacgaccaacatggttatttcagcacgtgtttggttgcgaaacagatcagaggaatgagatgagcccttgtttaaaagatgaaaagcaataggttcgtccatttacatttatttgtaaattttgaatttcctgcataatttaaggtagaacaaagcttgtttttttgtggtctgttatttcacaaatcttttattgtctccgctttcttacctaatatacgtagtgttatggatccgccttctgtcttcaagtgacaaactgaaactgaccatgaagccatgaaacaggctccgctccggcctgtagccgtgacggtgacggcgtcaggctcagctcgctcgccccccccacgaaaaccctaatggcgtcccgcctccttcacctccgccgcctcattactcctccccccaccgtccccgccgcttccttctccaccgccgtcagcgcgaccccgcgcgtctccgcgctcgtcgacgagatctgcgggctcaccctcctcgaggcctcttccctggccgatgccctgcgcggccgcctcggcgtcgaccagttgccgccactagctatcctcacgggcggcggcgcaccgctcgtcggcggcggagtaggtcccggcgcggccggcgaggaggcgaaggccaaggaggagaagatggcgttcgacgtgaagctggaggggttcgacgccgcggcgaagctcaagatcatcaaggagctgagggcgttcacgaatctgggtctgaaggaggccaaggatctcgtggagaaggcgcccgccgtgctgaaggctggagttcccaaggaggaggcggagagtatcgccgagaagatgcgggcgctcggcgccaagattgttctcgagtgaacgacgagagctgtgtatgccctcgtttcttgatttgtttcgtgtttcttgtatgaaaaaaagagagaattttggaacaaggagataataattagtaaatttgactagagatcttttcactgcgagtgcaaacaccaattgagcttcggtgaatacgaacttagacttagtgatcaactttcgagttctatatcaatgctttttatgagatgtatgacatatagcgaactctagcatcagagtaccatcttctgctgattctgtttaccatcttttgctgattctgtttttaaggagaggattgcaattaggtggctttcacttgtcgttttgtggttgttgcaatcattgttatctttaggtaaggttttgcaagctaggatactttgaaatgtgaagttggtttgcgctcggacaaaaactggtatttgagtgacttgttatcatttttggcaatattttttatcaaacaatgcaggagagctgtgcgcatttcaacaagtacacttctgccccttctggcaatatctgtttgaattatgaactattattaaagttttcatctaaaggggagtagtctgcagaaatagttgtgttctagagtacttttatgtgcacagcaatgtttataaaattttgaaatgttttagctgaagtagttaaagtcaagtgttcatatgaatgtaatgtactaatgttgttatcttgtagttgaagtccacatgctcacagtcatgctaaattgctaagatattatgtttcttggaagtctgttcattatgcttgaatgagttcatttcgataatagtttccggctggctacactagttgtcatttgaatccaattggtgatactatgtactgaagatatgtgttacttttttttttgcagaatttgatatgaattttttgcagagtcaatgttctaggtataaaaatcaggcatgcttagcatttgattaggtttgtataacttcagcttcaacggtaatttgtggttggtttaaaacagttaacttgtgaatccaattggttgtttttgcagaatttttaccaatgttaccaccaataattgctaaggtatttaaattcttatgtatacagtttgatatggagtttctgaaataattagctaggttcagcatatagatgggtgcgaatgccaaggagagaggaatatctccattggagtgcatggcctggcaggctggcagcgcaggagaaaatggtagtgaactgattgcatagattctttaagaaagtcatttcttcccatcaagatttcagaaatgcaagtactgcagcattgtgtacaaagttggaagaaaattaatcatgattaacctctggaccaaatgaagggagacatttctcatattgttctgctaactaaatctcgaatgtggctattaatattgtctgaatacgcagttcttatcctacataaatttgtgcaattgtgctcttagatctcattgttgtaccatgcacattgtaggttgtaggatttgacaaaccaaagcaatcacctttgcataataggctcatatatttctgctttagaggtaaatataaatcttctaacatgagaatagctaggattgtaaatctcagcttttctgtttgtaatttagtttggagaagacaagtgaaatatattacctcattctattgttaaagaatttggtgttgttgaataagaagagttatgctctccgttgcttcatgttgtaacattttgatggctcatgtaaataatcatgatcaatctcgatctcgaagctatataaaagctctgtggatgttttttgtaactttgttatacattcctgatcggctgcccttttttggactggctgcagcctgcaggcatg

SEQ ID NO: 12959 - DNA, 1259 bp, Zea mays
attcgagaggaaaggaagaagaactggagaggaaaaaaagtgtaggatcgagggagatggagagcggccaagcgtggaccaacgactcctcttctccgatcctcccgcagctgcaggccgtagctagctctataaaaagctaagggagcctgcctgccatcgtcgtgcatcgtcatccaccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggcccggccaccgtcaacctcacctccggcacccactactacatctgcggcttcaccggccactgcagcgccgggatgaagctcgctgtcaccgtcggctccggctccggctccgggtcccccacccccggcggcggctcgcccagcacacccacaccaaccaccccgagcgcccccacccccgacactccggccagcgcgtccgtgcgcctcacggccggcccagcgctcgccgtggccgccaccgtgctcgtcgccctcttctgatctgatctgatctgatactgcatgcatgcaccgtgccaggaccaggatagaggcagtgcaggatcatagtattcttgtgtacgtacgtacatactttgttgttgagctagcgttttcattctgacgacggcggattattgtactctcgtacgtttttatttccacatgtactactgtctatcattcatgcttccaattcttcattgttaatttgttgcctgtggtgtgtatcatcatatattcatacgcaaagtacttaccaagcatatggtgctaattggaccatctctcaggctcaactttgttttcctcaactttggtttcccacgataccaaagcgaaacaaattaaaaaatattgggtttcaacatcaaggttgcttgttattctacaagcctaaaactgatgctgactaaacaaggcgcaaatactacctaggtaattaaaaaaga

SEQ ID NO: 12960 - DNA, 1300 bp, Zea mays
  misc_feature (1223)..(1223): n is a, c, g, or t
gggtacctcgaggccggccgggccggggtgtatcgtcatccaccacgatcgataaagctaattaagctgctactgctacgctagcctcgatcgatcaagagagcagctcacagacccaccctccatatgacatggctggagaaactgactgtcttgattgatggatgtagctgagctgaggtgcggatacaggccccacaacgataggtgacttgggaatcataccattggtcccatggcaccacaagagctttgacaacgagaacgatgttaacagcgtgcgtgtcccttcgctagaaatggcttgcaaagactttcatgcttgccaatggccttcagacctgacaaatgatgatgaggctcttgctctttactttgacaagttgaatgacaagaatcatgatgctattgaagaagtgaaaagtagcagcaaacatatattaacgttttcacactttgtaccaaggcaagagttgtgtccggagaaacgaatgctttattacccatatcttcctaaggtcattggctctgattttttggagaggaggctgagagatatacacagcaacagagaagacagagcagcttgccatgtttttgggcacactcatttctgttgggattctgtggttgatgagatcaggtacgtgcaggctcctctggcataccctcgagaaagaaaacgccggatgaacggtgaaggctggctgccattttgtgtataccgtgacggtttcaacccagaaatttatccagcactgtggtcagattactacaacaagaacaaaagggaacccgagaacactcagctcgcgccttgggttgccagccattacgcaaagtaccacaagttccactgaccctttctgagttgccttggctttttgccgaattgatgcagatcgtcccttcaggatggtgttgaattagctgggaaaaggagatattgacgttttacctgtacatgatcttttcttgtttctacccttaccataacttttgggcaagtaagcgccagcctctgttcgttgtatgttgcagaaatctgaataatgtgtataagattcttcaaagcattgctgcagagatagcgaaatatagctgattctgttcatctaacgaaaaaaaaaaaaaaaaagcccctaaaaaaaaaaaaaaaaaaaaaaaaaaaaaaaaaaaaaaaaaaaaaaaaaaaaaaaaaaaaaaaaaaaaaaaaaaaaaanggggggggccgttttaaaggaccaaagttaacgtccgcgggcttgcaagttaatattttttttttagggcccccaaa

SEQ ID NO: 12961 - DNA, 3195 bp, Zea mays
gggtacctcgaggccggcccggaacaacccctttctttttcttaattcctcatccactcgccgcacgacgaagagagcggctcccattccccaccacctactcggaccggagcagcaggttctcgaagcgaccggtgaaacattctcgcgccaattgtgggggccatgggcgccaacggacacccgccggcgagcaccgtcgcgcagaacggatcccactctggcggaggcggaggagggggagggggagtgaaccctagcaacggcggcacgggggcggctcttcggcacgaccctggtctggcgcgggagtggtcgacggaggagcagaccatcctcgacgagctgctggtcaagtatgcatccgatttacccgtcgttcgctatgcaaaagttgcaatgaagttgccagagaaaacagttcgggatgtagccttgcgctgcagatggatgaataaaaaggagagcgccaaaagaaagaaagaggatcacaactcgtctaagaaaagcaaggacaaaaaggagaaggtttcagattcttcgtcgaaaccacctgtgcatatggtgggtaggcctaatgttcctccataccctcttccagttcttccaatggacgatgatgaaatctcatccaaagccattggaggtccaacgggtgaaatacttgaaactaatgcccatgttttgggtcaaatttcgtcaaaccttagcaacatgcagatacaggacaatatctctctgctctgccaaactcgcgataatatactcagggtcttgaaagagataaacgatgctccagatatcatgaagcagatgcccccgctacctgtgaagataaacgaggagctcgtcaactcgttgctccctagaccaactgtacctatgcagtagtgatagcaaaatgagcttttaagataggcagctgaaataaaaaaaaaaggggcagccctggtacttttttgttcgttttgtagctccatcctctcgccttctgtattgtatgtttcgtctggatgcttatgtttgttccaaccttttgcaagtcaggcggttggaacgtgtaccaagttaccaagggctgcttccacataagtatcaggtcctgactctgttttgtaatctatagctgtttggtaatgccatggaatcggagtacacttagcgggtccgtttcaactttattccatttggattagatggtattgagtcggtttaaattcataacaagttaaaatctataccgatctattccaatacacatcaatccacatggaattcaaaataaccgaggggacgatggtattgagtcggtttaaatgcataacaagataaaatctatcccgatctattccaatacacatcaatccacatggaatttgaaataaccgagggggccgttcgtttcttccggaatataggcatggaacaatacctagccgttttgtttctctaatttatataagttttgatcagctggaataatttctggtccattcctggacaaacgaacaaggtctaaggaaatcttcctttacattcaataaaccagcccataaatgggaatctctaggagttcgagacacctgggtcagagacttactccctaaatatttgttcctgaggatttgttaccaaatgccatctttgttaataattttgtaaagccatttttttagcaaacaatgattcttggttgctaggttgactacctctagcctacctggtcttttggctggcaaaaagaccgcattctcttctattatttgcatcttctttgtttgtttgggaaaccattccacacgaactaactcatctggttcaatgactccttttcccagctggagtacgagctgcagagggagatctccggcatcttgattcagaactacgtctgcggtttgcgccaggagtatgagatgaagttgtgggagcaccggaactgcatcagcgctctgaacaggaactgggcggaaaaggtttctgagatcacggcgctgcgagacgagcttcgcgatgttctctgtacttctgaacctgctactcatcatcaccatcaccgctcccacgggagtctagaagacgagacgatcattgcgaagacggaaggtgacagtgagcctccggtaacagagaaatcttctgagtctacgctcgagatcccagatttttccctcctgaagcacatgcacggcgaagaaatcacgagttttctcaggacagaatggctaaagctgcgaaggcagcacgagtccgagcttcacgagaagacagaggagctgttcagggtgaaaagggaacacgcaaaggagaaagcttcgttgcctcttaagaaagagcgggagcttgagctccacaggtcgaagctgctacagaccatcgctaggctgggcgagatagcctccaggaaagaggaatcttgctctgactgcaacgaggatgaggagatgtgcagattgaaggacaggatcggcgtgctactacaagaaaacaatcgtctccgaggcttgctggctgataagaagcaggaggttaaacatctctctttgcaagtgtcagattcaaggagcaaaatagcccagtactcactgccagagtcaaaactgtcgaataattgtgagaagcttagggctgaacttgaagattttaagatagagaggcacttgaacgatttattggactcatctgtattcagggaagtttgtcacaattatgaggatcagatatgtgatttgaatcaggagggatccttcctcagagacctgcttgatgaaaaagaagaccagctaagtatcatgtacgaagatagacagaagctcaagcatgaaaacgatcaactcgtatcgattgcagggtcaattatacagcatcatgaccaagccaacttggttcatgacgagcttatgatatataaggagaaattgtgcgagcaagaacttttaatattggagtcaaagggcgaatataactccatgaaaaggtgcctgtatgaggctatgcagcaaatccaggtatgcaagcaagaaattctaggcctgactgagaatttaacttctatgtctattgctttggagaaagccaaggaacagaatgcctcacttgacgccacaatccgagagatgaagaaaacaccagggcaaagcattggcagtcattgggggcaaactggggaatttgatcttaccagtatggagaagt

SEQ ID NO: 12962 - DNA, 1304 bp, Zea mays
gcacgagaccattacctagaacatcctaatcaaaaaccagatcgagtgtacccgtgcacgaggcgccggcctggagtcgcggtcgctgccgcatggccctggcctccctcgcggcctcgctcccagtcgccgccaccgccgccgcggtgagattcccattccgtttccgcatcggtcgcgccatggcctccgccgccgcaggggcctcgccggcgagggtggccgtggtacagatgacctccgtgggggacgtcgacgccaactacgccacctgctcccgcctcaccaaggaagcagctgcttctggagtgaaatttctttgcttccctgaggtcttctcattcattggatccaaggatggcgaggctatgaagctagctgaaccattagatgggccaataatgcagagatactgctcacttgcaaaagaatcaagcatgtggctatctcttgggggttttcaagaaaagggacctgatgattctcaccagtacaatactcatgtattaattgatgacactggaaaagttaggagctcatatcgaaaaatacatttgtttgatgttgatgtacctggcaatatggtgtacaaggaaagtcgtttcacagccgcaggtgatactattgttgctgtggatagcccttttggacggttggggcttactgtttgctatgatttgagattcccagagctttatcaaattttgcgttttaagcatcaagcacaggtattactagtgccatctgcattcacaaagataacgggagaggcacactgggaaattctcctccgagctcgtgcaattgagacacaatgttatgttattgctgctgctcaagctggaaagcacaatgaaaaaagagaaagttacggtgattctataattattgacccatgggggacagtgatagctcgacttccagatcggctctccactggatttgcagttgcagatcttgatttgtcaaaagttgaggctgtgagaactcgaatgccaatttcagagcaccggaagttcgacagcgattggaaacccacgcctctttagtagctgagggtttattttgtgtttcctatgtttaatgtgcgtatacacatatagttgatatattcatctatgcataattattaccacaggtttggtcagtttgtgactgggaactcgcaagagaggttgctgaactaaataaggttcctaaattgccaaacgatgggactaaaacatggactaaattgtttgtctctagtctttcaaggggagactaaaagggactaaaccatataaattttacttttcaaaaaa

SEQ ID NO: 12963 - DNA, 1545 bp, Zea mays
gcacgaggggattacaagcgttaccgccgccatcttgccgaaaccgacggacgtcacgtcaccatatatcggtcgcgtggccgggcgcgcggggcgcagttctcctattcatgtccaagttcgtggttagtgattacgaccagcaagtcacaagtgagggcgggagaggttgaggttgaggaagagcagaggaatccattccaggagtgtttaatggcgggaggcaaggaagcgcacgggtgggcagccagggatgtctctggtcacctctccccttaccacttctcacggagggttcagagagacgacgacgtcaccatcaaggtgctcttctgcgggctttgccacactgacctccacgtcatcaagaacgagtttggcaacgccaagtaccccgtcgttcccgggcacgagatcgtcggcgtcgtcaccgacgtcggctccggcgtcacaagcttcaagcccggcgacacggtgggcgtgggctacttcgtcgactcctgccgcagctgcgacagctgcagcaaggggtacgagagctactgcccgcagctcgtggagacgtccaacggcgtgagcctggacgacgatgacggcggcgccaccaccaagggcggcttctccgacgccctcgtcgtccaccagcgctacgtggtgcgggtcccggccagcctgccgcccgccggggccgcgccgctgctgtgcgccggcgtcaccgtgttcagccccatggtgcagtacggcctgaacgcgccggggaagcacctgggcgtcgtcggcctcggcggcctcggccacctggccgtccgcttcggcaaggcgttcgggatgaaggtcaccgtcatcagcacgtcgctgggcaagcgggacgaggccctcggccgcctcggtgccgacgcgttcctggtcagccgcgaccccgagcagatgagggcggcggcgggcaccttggacggcgtcatcgacacggtgtcggccgaccaccctgtcgtgccgctgctggacctgctcaagccgatgggccagatggtcgtcgtcggcctgcccaccaagccgctccaggtgcctgccttcagcctcgtcgccggcgggaagcgcgtggccgggagtgccggcggcggcgtcggggagtgccaggccatgctcgactttgccggcgagcacgggatcaccgcggatgtggaggtcgtcgggatggactacgtcaataccgccatccagcgcctagagaggaacgatgtcaggtaccgcttcgttgtcgacgtcgcgggcagcaagattggaggctaggcatcaccattcctagtgttctgtcgatcgacgtgtgatttgcttcttcctcgagcgtgtcttattgttctggttggagcacgtatgcggccatcacacgcaggcgtggacaataaacaaggtagagtttcgggttgtgtcgtttctggatgtatggtgccggtggataataaacaagcttggtggggtcggtcgaaaaaaaaaaaaaagacgaccgctagggcggccgctatctagggatccgaggctacggac

SEQ ID NO: 12964 - DNA, 3087 bp, Zea mays
gccgagtgctctctggcactcggcaaagagttttgcctagtgcccgacaaaaagcactcggcaaaggaggctttaccgatgcactgtttgtcgagccttctttgccgagtgtttttaaggcttcgccgagtgcttcaggcactcggcaaagctattgattccggtagtgacttccaagtgtacacagtactatgagtttttggaaattaagtttattttgtaaagttcggtagtactgatggcatgtacaaccctgacactgttgcacggtactataagtataagacacaactaaaacacaacataatacaatgggcatgtctaaaacatgtgtcttactatattcattacaccaatcaaagcattcaataaatcaaattgaccaatcagctagtctcctgcatcaagcatagagctaagacactatgtcttcgtcaaggtacactatctttatttttttttgcattcatccttttagacacactcgaagacagttctagactcttattgtacataccctgagatgctgactaatttttggatgtaatggttaattaagagtgtatttggtttagaagtgcaggaggatagagtggtttcattccaattttttggatgtttggtttccaacaaaataagaacggagcggcttctgaatctccatatgtaaatttattacaaatagttggaacactctcgctccataaaaacgaccggatgcgagtgctctcctggacacgagcgctctcccctctctccttcctcctacactcatatggctcttctccaaccaaacaaagaatggaatggctccgctgtattctactattcaaccaaacaaaaaatggaacggccatgttcttcttgtcaaacgcagaataggatgacttcattcttaaatactggaatggaatcactacattttatttgactctccaatcaaatgcattctaaacggaactagccttgagagcgtatgcatatcagtacctgttgtacatactttgatatagctgtaacctggtgtgttcaagtcaagtctaaaattgctgcacataaacttgacaataatgtacatggaatctcgtgacttcacatacagttcacagatggcgactcatgccgctaccgaatcatcagtagggattcaagcgttagccgccgccatcttgccgaaaccgacggacgtcacgtcaccatatatatgtaatatgtccatgagagctgagcgcagttctcctatttatgtccaagttcgtggttagtgattacgaccagcaagtcacaagtgagggcgggagaggttgaggttgaggaagagcagaggaatccattccaggagtgtttaatggcgggaggcaaggaagcgcacgggtgggcagccagggatgtctctggtcacctctccccttaccacttctcacggaggtattgctttccttgctgcagtctacaacttgtgcactagttcatcatcttcgtggactgaaatgctgcgccggctgatttcgatttcagggttcagagagacgacgacgtcaccatcaaggtgctcttctgcgggctttgccacactgacctccacgtcatcaagaacgagtttggcaacgccaagtaccccgtcgttcccgggtaactatacatgttcaccaacacccaagccattccattttgcaagcgaggacagggatttactcagacggccgcagcaaagcaacaaattaaccaccctaggctcgctcatcctttcgggcgcaggcacgagatcgtcggcgtcgtcaccgacgtcggctccggcgtcacaagcttcaagcccggcgacacggtgggcgtgggctacttcgtcgactcctgccgcagctgcgacagctgcagcaaggggtacgagagctactgcccgcagctcgtggagacgtccaacggcgtgagcctggacgacgatgacggcggcgccaccaccaagggcggcttctccgacgccctcgtcgtccaccagcgctacgtggtgcgggtcccggccagcctgccgcccgccggggccgcgccgctgctgtgcgccggcgtcaccgtgttcagccccatggtgcagtacggcctgaacgcgccggggaagcacctgggcgtcgtcggcctcggcggcctcggccacctggccgtccgcttcggcaaggcgttcgggatgaaggtcaccgtcatcagcacgtcgctgggcaagcgggacgaggccctcggccgcctcggtgccgacgcgttcctggtcagccgcgaccccgagcagatgagggcggcggcgggcaccttggacggcgtcatcgacacggtgtcggccgaccaccctgtcgtgccgctgctggacctgctcaagccgatgggccagatggtcgtcgtcggcctgcccaccaagccgctccaggtgcctgccttcagcctcgtcgccggcgggaagcgcgtggccgggagtgccggcggcggcgtcggggagtgccaggccatgctcgactttgccggcgagcacgggatcaccgcggatgtggaggtcgtcgggatggactacgtcaataccgccatccagcgcctagagaggaacgatgtcaggtaccgcttcgttgtcgacgtcgcgggcagcaagattggaggctaggcatcaccatttctagtgttctgtcgatcgacgtgtgatttgcttcctcgagcgtgtcttattgttctggttggagcacgtacgcggccatcacacgcaggcgtggataataaacaagagttttgggttgtgtcgtttctgtatgtatggtccggtggataataaacaagcttggcgtggtcgaagtgagctcgcaaactccatggcacgcaagggcggtctctcctttgactagctcgtcaatggcaaccttctccctcatcccttcgtccggcggaaagctcaatggcggaaggctactttggaaaattgaatcttctccggtatttctagaaattgagcgagaaattaaactaatttctcgttcaatccccgagaataccaaagaacatttaagtttccaaactagcctttaaaaaacgaggtgaattcttaaccccgtggag

SEQ ID NO: 12965 - DNA, 1438 bp, Zea mays
gtatgcgttcggcgacgcgccccgcaccgcccgccattccgcggccacgacgagcacaatcctgttcgccacgccatgcctctccacgcccgcgcaccgccgctccgccactcccaccttctactcaccgccgccaccgctcggctccgcccgtgcgcagcgccagcgaccaagccccgccgccgctccctcgtcctcgtccgcgcctccagctcggaccctccgcagcagcagctcaacctctccgtgctccgcttcaccctcgggattccggggctggacgaatcgtacctcccccggtggataggcctcggtttcggcgcgctcgtcgtgctcaaccacctcctctctgcgtccccgacgcccgcgcagctcaggtccgaggctgtggggctgtgcctggccgcgttctcggcgacgctgccgttcctggggaggttccttgagggcgctgatgctgccagccgagtgccgttgcccgaggggagcatccaagtattcgtcatgtctgagaacctgtcagctgtgcagaaggaggacatggcgtgggcgtcgtacgtcctgctccggaacacaaacaccacgtctgtggtcatagcaattggggatctcttgtgcgtacgaggatactggaatccacctgcaaatacttcaaaatattccatgattgagtggttcaaaagtcagatgcagcaagtaggacttgttgatttgagagatgctttgtacttccctaattcgtcaggaaagtttctcttacgctgtcaatcatgctgctctgaccagattctcagcttgcgaaaattcgcccagatgggattctttctgtgctagcgcttcctattctgagtcctgatccagctggtaatgaaacaaaaactgaaggtgtcatcctgttggcctccaatgcaaattatgcatatagtgagaaagatagggcttggataagaacagttgcagacaaatttcaacgtgcttaatttagagaaatgttgacagtcaggcagtactggaaaatggaccgggaaagattggggagtgtaaagtagactgactggtccaagaaggatttggagtcttggcaacgtggactgagcagaataagagagttttgcagttgggaggaaatcagcattaagctactgtttattagggttggcgctagttgaagcaaaatagtccagcaatagtttgttcagttggctagagactatgtggtgatgtgtctactggtttgtctctgtgcctcttgctttggtatgtatgtctgattggatttggcattgaagcagaaaggctgctccagagattagtgacatgtgcaaagtagcaatgctgtcataatttacgcatgctccagcccaattgaggcagttgatcacctggctgcatttatataagcagtaaaagcatttttagttcaaaaaaaaaaaaaaaa

SEQ ID NO: 12966 - DNA, 1545 bp, Zea mays
  misc_feature (18)..(18): n is a, c, g, or t
ctcgaggctcggccgggngctttgctaataataataatcaggactcaggagagcgagcaaagaagaagaaggcaacacgtacgacaggcacagtagccatctttcccatcctctctggctagctctttcctaagcttaggctagctagaggtagctctccatcctttgggaattaatagtaagtgtttgggacttgggagagggagaggcgtcatgtacctgaacccaagaatcgtaggctctggggagaggacactggttctctcccatggctatggaggcagccaggctatctgggacaaggtgctgccgcacctctcacggacgaacaaggtactactcttcgactgggacttctcgagtaccgccgccggagaggaggaggaggacgcggagcacagctgctacacgttctcgaggttcgccgaagagctggtggcgctcatggacaagatgaagctgagcggcgccgtgtacgtggggcactccatggccggcatggtcggctgcattgcgtccatcacgcgccccgacctcttcacccacctcgtcctcgtcggcgcatccccgaggtacatgaactcggaggactacgagggcgggttcgacgagcccgacatcaaggcgatgctgtcgaggatctcgtcggacttccgcggctgggccgagggcttcgtgccgctcgccatcggcggcagcgcggacgaccaaccctcggcggcggagctgctggcgcggagcttcttcgccatggacccgcgcgtggcgcacggcctggcgcgcatgatcttcctgggcgaccagcgcgagctgctgggtgacgtggccgtgccgtgcacgctggtgcacgtctccggcgacttcgcggcgcccccctgcgtcgggcgctacatgcaggcccgcatgcgcaccgcctccatgtataccatcgactcggtgggacacttcccgcagctcgtcacgcccgacgagatgctcaggatactcgaccgcattctcgtcggctccgctgcttcccaagaggaggagactaccgcggcggcggcggctgccgccaagaccgagacgacgagtagcgaggtcgtatcctctggtggtgttgccgatgcgctggagtccaagggccgtatcgacgtggcgacatagtgctcctgctgctctggtgcaacatccctctcgaagtctcgatctatcagccttggctggctcttgtgctggtctcagttgatttgcttcggtccacactccacacgtttaacttacattattgcgcttttggattttctaatgcgtagaaacattaccatggttcgttcggaatttttagccatcacgtcacccaaactgcgtgtattattggtttgatcatggattgaattaaatgaaacactgagtgttaaagcattgtaaatgacatgcatggtttgcagccttgcaggattctagcttcctagaattatttatttttttggaaaatatttcatggattgaattaaatgaaacacttgagtgttaaagcattgtaaatgaaaaaaaaaaaaaaaa

SEQ ID NO: 12967 - DNA, 1397 bp, Zea mays
cattgggtacctcgaggccggccgggagtcccatagggaggaagttgagagttctaataagagcaacggccaataccattagcgagttatttttctgcaatatatgtcagcaaccgatcatttggttatggctcgtgtcatacaggatgtattggatccctttacaccaaccattccactaagaataacgtacaacaataggctacttctgccaagtgctgagctaaagccatccgcggttgtaagtaaaccacgagtcgatatcggtggcagtgacatgagggctttctacaccctggtactgattgacccggatgccccaagtccaagccatccatcactaagggagtacttgcactggatggtgacagatattccagaaacaactagtgtcaactttggccaagagctaatattttatgagaggccggacccaagatctggcatccacaggctggtatttgtgctgttccgtcaacttggcagggggacagtttttgcaccagaaatgcgccacaacttcaactgcagaagctttgcacggcaatatcacctcagcattgccaccgctacatatttcaactgtcaaagggaaggtggatccggcggaagaaggtttagggaagagtagaaaccataggccactgcatggtcacactatagaaatatcatcaataatgtgcactatattgaatcaatgcaccacctctatatgctgaatgttatgtatctcaaactatgattgtactgacttgaaaggttgagagcttagtctcttagcagaatatagcacaatattactagtatgttccatgattaatcagacaaagtattctccttggagaagcaagtacagtctcaggatcttactagagtacctgcttgtttcaacaggtattaaacaaactcagcagtctgaattatctaaagtatatttcatggaaaacaatcacagcatcacatagtgtatattattccttgctccaatcagaagagcacattataccttattcacattcaaagtattgtgccccagttgcttagaaagtagtcaacaagacgctataaagcattacaaattctcagaattaacttacagcagaatcaccttggagaggaaactaatcacttcttctcaagatggcacacctccaccaattcccatgactccaagcttatatctatggcatccttctataaagcacaagctcagtgatatcaaactctattccacagatatccttgatcagctcatctatcttcttctttgcctcctcatcaattcatcatcatcatctgtaaagtctccatataagagtctgacgtgcggcaaccaagtgtcagtactaagtagtcaatagcatgtgatttttcactcaggaacagaattcaggggt

SEQ ID NO: 12968 - DNA, 1627 bp, Zea mays
agtaacagaaagtcagaaatagagtaagttcaagaaattcaatccagcaagataaaccacactgttgttatgatgcaccaacatggggtgcaagaaatttgccattgcaaatgaagtgaagacgagacagtttttggaattcggagttttgtttttcactaaaatatataatcaaaacaaagtatagtgcatccaactgggtttcctacaaagctttcctagaaaagtggcacaagagttaaaactgcagagggtggaaaactgacacatcaagcatatcgttgctaattaatttaccaagatgcgcttcggtttgaaaactcggttaaattgtagacatgaaccaagtctgcagtgctttttcggtggagaccatacaactacagaaacaggcttggagacagactttttactttattgtactagaatataggagagcttgtaccataagtaacccaaatcccaacagctgaacaagcagaaacatagtagcataactaataaagccactaacttagtagcataactaataaagcaatcaggtagactaaagctgctagtagtttgcgtgctttgctccagcaaaccccaacaatgttttaataaataagttgctgaagcatatcactgaaaagactatgcagactgactacactacagagatcatgctttgacaaagtacgttaaaaaatcatgctttgacaaagaagcacacttcagctatctgggtgtatctcaaatgctagaagttgaataagacaaccttcctcaactccagtataaatagttcatgctcaggctgcagcttcctatggggcacctcgaggccggccgggagtccatagggttatttttctgcagtatttgtcagcaaccgatcctttggttatggctcgtgtcctacaggatgtgttggatacctttacaccaaccattccactaagaataacatacaacaatagtcaagttctggcaggtgctgagctaaagccatctgcggttataagtaaaccacgagtcgatatcggtggcaatgacatgaggactttctacaccctggtactgattgacccggacgccccaagtccaagccatccatcactaagggagtacttgcactggatggtgacagatattcctgaaacaactagtgtcaacttcggccaagagctagtattttatgagagaccagatccaagatctggtatccacaggctggtatttgtgttgttccgccaacttggcaggggtacggtttttgcaccagaaatgcgccaaaacttcaactgcagaagctttgcacggcaatatcacctcagcattgccagtgctacacatttcaactgtcaaagggaaggtggatcgggtggaagaaggtttagggaagagtagagaccatagaccactgcatggctacactatataattatcatcaataatgtgcactatattgaatgtcaatgcaccacctctatatgctgaatgctatgtatctcaaactatgatttgtaatgacttgaaggattgagagcttattctcttaacggaatatagaccaatattattagtaaaaaaaaaaaaaaaaaaccgcccccccgaaaaaaaaaaaaaaaaagcccctaggggc

SEQ ID NO: 12969 - DNA, 4445 bp, Zea mays
  misc_feature (1703)..(1703): n is a, c, g, or t
  misc_feature (1833)..(1833): n is a, c, g, or t
  misc_feature (3552)..(3552): n is a, c, g, or t
ctctctgaaattcatgaatactcactgctcttgtttttgcatttttctttgcaactggtctctgttctcttggccattctttgtttgccgaggctgaatgagcggcaaatttccagatatggaacacaacgcgacacttgttgctttcccgagctgaattgctgatgaggttcaccacagttagatgcctgatttgagcactttgtctgtgaaattggattaaataaatggagaacagccattggttctactgtttctggtgttctgctatttcttagttcaattctgtggtctgatgaaagagaggagatgttactaatgatttctttggtagaattggatgaacaacacctgtcatgcctccttagtttctgatctgtgggcattctgctcagccagcacaagagttgtgtgcacctgtagagaacaacaacagggacaatgctcatgacacagattgatagatgaagttggaggtcattgccagatctgcatatgttactgctgtagtgggttgaactgatttgattggcttataagatgcaacagaaatcatcatttcattattagtgtttggttgtgttcactgccctggccatgttttcagttgggttcattggcatccttgctgcagatagaatcatgactgcagttggcttgttttgtttttgttgatatgacctgcctacatagctccttgtcccgctacctccatcagcatttagtgaattgatgacaaatttgatcttttttatgttttatattttttaaactaggtagagcttgcaatgatttatggctgcaactcttttacacaaatgcttatttcttaacagctgcagcaaatttggtatttgcttttttttgtatttcaaactcaagcaagtccttttcttaagctctcctttttgaagttatttcttgtgtaatacattttttaccagtgctgttattgtttgagccttgagggcagtaactgtttccgtgctccggtaatggaagctgacttttgtttagggttaaaatttgcatactggtaatttattcagtattcagtgatcatttatgggcacttgaaggacaaatgctggaacagaaatttgttgctagcctcaccagtgtggaccctttgatccattgtctgtgtgatattgctttcagccccctccatgctttgcattgcaattttgggaagacaaactggtttgacctaggagatcagctaaccagcagctcagacttaactgttgttaccattgaaaagctagttgtttgcctttaaatttgtgcattggcttaagatggtctggtatgcaaactagagaatatgcctcaccagtgtggaccctttgatccattgtctgtgtgatattgctttcagccccctccatgctttgcattgcaattttgggaagacaaactggtttgacctaggagatcagctaaccagcagctcagacttaactgttgttaccattgaaaagctagttgtttgcctttaaatttgtgcattggcttagatggtctggtatgcaaactagagaatatgccagtgggcatatctgctacattgtcctgtcatcagaatatgctgaattttttgagaagttcatggcggtaatgataaaattggttcctgcttggaaacagtccagttctccaaaacatggttcccactcccagagttctatagctttgctccntgtctgtgttaatgagttttgctgtcttggggatagacaatttcatgaaggtagttacagctagatgcatctgtgtcaggattatgatttgttcttgtattaccgagatccaggaataacctagtctcantgcttctcttctgaggtaatgtccttttgttgtctatctaaacttattagaagtgattctgcttagtgtaacctatttcacgtagtggatactattaattgatatggcatgttttgatggttttctcatgtatcactgtgcctcaaggtatcagtacgggtatgcccatcacttactgatatggtatctgtttattttccccacattgattacgctcatgagtgtttctacttgtagatcatgctggagaggcacacataccgccacaggggctttggcttcgtgacattcgaagatcgaagggcagttgacagcgctatcaaagagatgcgtggccaagagttagatggtcgtaccatctcagtgaacaaggctgagcctaagatgaatacagatgacacaaggttcgacagtggcggtggacgaggacaatatcgaggtggtagaggtgatggtccaccccctggcaattgctatgagtgtggccgtcctggtcattgggtccgtgactgccctagtgctgctggtggtcgttctggcagattcccgtccaagttcagtggtggtggcaggggagaccgcttttctggatcagataggtttagtgatcgttacatggatgatcgttatgatggtggtcgttatgggtaccgtgatcaagttgatgcaagggacaagtatgctgggggccgagatcgttatgccaatgatcgctaccccgctggtggcgatcactttgacggagacaggtatggaggtggcccggatcggtacgcgccgaatggttatgggagggaacgagaaagaagctccgagagagatggagttcgtggcggcggtggctatgataggagtggctcaagaggtggtggaagctatgacagggatggccctagaggcggcaagggtggtggctatgtcagggatggcccacgcggtggtgttgctgatcgttatggtggtggaggacctgcacgctatgatggtggaagttacagggagaggcctgggccatatgatcgccctagcaggggaggaggtcgttttgatgaacgccactgatgaactgcctctagactcgagcccctggtcttgtagtttagccttttgcagttctgcatagcttaatgtttaatgggctatggaagatgcctaatttacccccctctttggcacttcaatgtctgctctgtatttcaaccagtacttgggcgccgttgttgccttctcgataagtttatcaagctgactgtttttgcatgagacgggtcatcctttgggctactactctgcctgttggtccggatgtttcagttgtgcatgccgtgcgtcctgcagttatagtggagtcgaggttctcagtgattgtttgtcattgttgatctgaatatctggtatgcatggactgactatgttttcagtgattgcctgtcaccgttggtctgaatatctggtgaacatatatgctcagtgacggtgcttgtcaatgttgttggtctggatatttgggttcgcaaggatatatttgcagtgctgagatgcaagtgcttaaccgaactgtagccaaagtaaccctatgctagaagtaactggcaaccatgttgaattgttaatctcgttagttttttgtctggggtcttgaaaatgccctccagatctctcacgagaacgtgaacttcacctatcttctctatcgagctgcatcgccctctcttttgncgagcaggtctttggattcaccgtttgcttgtgtgatatctgcttagttgtgtggggatgatcaagtggttggaaagctttgctgtgactgttcgttgatcttctttctgccgctcattggatcggaggaccgtcttgtttttgtgtgaatgttcgaggaacgacactgttaacaactgacctttttatgttgacaaattacagagttgttcaccttggcattagatgttcgtttgactttaatctaaaatgtcttctattgtttatattgtgttttgtttctatggattatacctgcagcagttcgaacatccgaacagtcagcatgttagcttgagttcagcaaatgcatgttttttttgataaaataagggaaccgagagattcagaggtggagcaaggtgcggttagtccaatgatagctggtgccgcctatcgccgtctccacaactctatcgcccagcgtgactgtctgactgagttccccgtctcggtcgtcctgcgtctttccaattaggctcgccaagaaaaatcacgatctgtcagtctcggtcccgtgatacactccagtccacctccaagaaacatgtaaattaatcctgtcgccatcagcgccaaacggcacattgctcaagctattctagtggagcactcctaagtgacgcatttctttgcgctgtgatccatgaccaactttggtatttattagctctttgtatcattgtaatgtgttctctttgttaacatactgctgccaccagtgtactattaggtgttgtttaggatagtggtacggtctctaaaatataacttaaactatttttttaaaatataataaactcttaatacatttatatatttataaaagtacttgttaagataaatcggtgtat

SEQ ID NO: 12970 - DNA, 1480 bp, Zea mays
atgtgcctcgataagttttcctggtgtccggtccggctacccctgttccctctcgcagtcgcagacttctcttctcgccaaaccctaatcctgctcctgcctttctcgtctccaaccgttggccgagcagtagcggtggcgatggagggcaaggaagaaggtcggatcttcgtgggcggcctgtcgtggcaaacggacgagcgcaagcttgaggacgcctttggccgcttcggcaaggtcgtcgacgcccagatcatggtggagagacacactaaccgccacaggggctttggcttcgtgacatttgaagatcggagggcagttgacagcgctattaaagagatgcatggccaagaaatagatggccgtaccatctcagtgaacaaggctgagcctaagatgaatacagatgacacaaggtatgccggtggtggtggacgaggagagtatcgtggtggtagaggtgatggtccaccccctggcaattgctttgagtgtggtcgtcctggtcattgggtccgtgactgccctagtgctgctggcggtcgttctggcaggttcccatccaagttcagtggtggcagtggcgttggcaggggagaccgcttttctggttcagataggtttggtgatcgttacatggatgatcgttatgatggtggtcgctatgggtaccgtgatcaagctgatgcaagggacaggtatgctggtggccgagatcgctatgccaatgaccgttacccatctggtggcgatcactttggtggagacaggtatggaggtggtccggattgttatgtgccaagtggttatggtagggagcgagaaagaagctacgagagagatggagttcgtggtggtggtggcggcggcggcggctatgataggagtggcccaaggggtggtggtgggtatgacagggatggtccacgcggcggtggaggaagtgcacgctatgatggaggaaattacagggagaggccctgggccatatgatcgccctagcaggggaggacgttttgatgatcgctactgatgaactgcctgtagactcaagctccttgtcttggtagtttaatgtttgcagttttgcatgggccgaatgcttaatgggctatggaagatgcttaatttatccctcttcggcactttaatgtctgctctttatttcaaccagtactggggcactggtttgccttgataagtttatccagctgacagtttttgcatgagatgagtcatgctctgggctattaccctgcctgttggatatttcagtagctgaggtttgcagtgatcgattgtcattgttgatctgaatatctggtatgcgtggactatgtttaaagtgattgcctgtcatcattggtctatatagttggtgagcatatatatgttcagtgtcggtgcttgtcattgttgttggtctggatatctaggcttgcaaggatatatttgcagggctgagttgcaagggctt

SEQ ID NO: 12971 - DNA, 2038 bp, Zea mays
cattgggtacctcgaggccggccgggaaccaagtcctgctagcggtgtccggtccggcgcccccctatttcctctcgcagcctcttctccccaaaccctaatcttgctcctgcctatctctgctccaatccgtcggtggagcggcggcgatggaggggaaggaggaaggtcggatcttcgtgggcggcctgtcgtggcaaacggacgagcgcaagcttcaggacgcctttggtcgcttcggcaaggtcgtcgatgttcagatcatgctggagaggcacacaaaccgccacaggggctttggcttcgtgacattcgaagatcgaagggcagttgacagcgctatcaaagagatgcgtggccaagagttagatggtcgtaccatctcagtgaacaaggctgagcctaagatgaatacagatgacacaaggttcgacaatggcggtggacgagactatcgaggtggtagaggtgatggtccaccccctggcaattgctatgagtgtggccgtcctggtcattgggtccgtgactgccctagtgctgctggtggtcgttctggcagattcccgtccaagttcagtggtggtggcaggggagaccgcttttctggatcagataggtttagtgatcgttacatggatgatcgttatgatggtggtcgttatgggtaccgtgatcaagttgatgcaagggacaagtatgctgggggccgagatcgttatgccaatgatcgctactccgctggtggcgatcactttgacggagacaggtatggaggtggcccggatcggtacgcgccaaatggttatgggagggaacgagaaagaagctacgagagagatggagttcgtggcggcggtggctatgataggaatgactcaagaggtggtggaagctatgacagggatggccctagaggcggcaagggtggtggctatgtcagggatggcccacgcggtggtgttgctgatcgttatggtggtggaggacctgcacgctatgatgggggaagttacagggacaggcctgggccatatgatcgccctagcaggggaggaggtcgttttgatgatcgccactgatgaactgcttctagacccgagcccctggtcttgtagtttagctttttgcagttttgcatagcttaatgcttaatgggctatggaagatgcctaatttacccccctctttggcacttcaatgtctgctctgtatttcaaccagtacttgggcaccggtgttgccttctcgataagtttatcaagctgactgtttttgcatgagacgggtcatcctttgggctactactctgcctgttggtccggatgtttcagttgtgcatgccgtgcgtcctgcagttatagtggagtcgaggttctcagtgattgtttgtcattgttgatctgaatatctggtatgcatggactgactatgttttcagtgattgcctgtcaccgttggtctgaatatctggtgaacatatatgctcagtgacggtgcttgtcattgttgttggtctggatatttgggttcgcaaggatatatttgcagtgctgagatgcaagtgcttaaccgaactgtagccaaagtaaccctatgctagaagtaactggcaaccatgttgaattgttaatctcgttagttttttgtctggggtcttgaaaatgccctccagatctctcacgagaacgtgaacttcacctatcttctctatcgagctgcatcgccctctcttttggcgagcaggtctttggattcaccgtttgcttgtgtgatatctgcttagttgtgtggggatgatcaagtggttggaaagctttgctgtgactgttcgttgatcttctttctgccgctcattggatcggaggaccgtcttgtttttgtgtgaatgttcgaggaacgacactgttaacaactgacctttttatgttgacaaattacagagttgttcaccttggcattagatgttcgtttgactttaatccaaaatgtcttctattgtttctattgtgttttgtttctatggattatacctgca

SEQ ID NO: 12972 - DNA, 995 bp, Zea mays
attgcctcctcgcccccccccgacgaaataaaaagattctctctccttttctttttcttctctccacccgcttctctctgttgatttctggccggggttgcctggcttggttctccttctggctgctcgctcgcctgcaaccgccaagggacaggaagcaagaaggattggaccgccgtccgccgggacacctcttcctgatccaaatccaagggacggacagctaaagtagctgtggaatatggaagtcgagcaggccgccgaagtaagcgctccagagacggctgatcttaacgtgcctgctaagacgccggcacacgatgatgataaagaaaaagtacccaatggtaatacaaatttgcaagtcaaggaaacacacaatgatgaagacgatggaactggatctgatgggtttgaactgatagatgtgaaggaaaactttgactcagcaaaagtgggggaagaaatcgctgcttcaagaagtactacggttgatacatctcctgttacagaacaaagtgaaacacaagaagaaaaaataacagcacctgaagaacaatcagttgcagcaaacacaagacatgtagagtcctcaatgttgaaccaacaaacagaacagttggaaaagctgacaaggcgtattgaggagcttgaatctgaaaaagataaactagtaaaggacttgacagaagcagaaaacaaacagagcatgcactacagttctctacaagaagctcaaagctctctttctatgaaagataaggagctggctgaagcaacagagtcgctgaaggagctgggttctgagcttgaaacctcaaaaaagagggttcaagaaattgaagctgaattggattcatcagcagataagcttcgtaaacttgaagagctgaaggatgaaagaagcttgcatgctgcacaggaggcgaagagggcttcagaacttgataagatgctggaactggcacagtcaaacatgaaaaaaaaaaaaaaaa

SEQ ID NO: 12973 - DNA, 1302 bp, Zea mays
attgggtaccgcggggccggccgggacgtacattcgggcgccaagaaagagttgagtgcgctttgtcttggactcgccgaattgaggatggcaggacaaggcatcacgtccatgcttgccgccgctgcattgctcgtcggaatctttgcgtccatccctacagcggtgcagtccatcggcgtgtgctacggcaccaacggcgacggcctcccgtcggcggccgacgtggtgcagctctatcggtccaacggcatcgccgggatgcgcatctactcccccgacgccaccattctacaagccctccgcggctcgggcatcgacctcatcgtcgacgagaccaacctcgactccctcatctccgacgcgccggggtgggttcaggccaacgtgcagccttacaaggacgacgtcagcttcaagtacatcgccgtgggcaacgaggtggaaggcggcgacacgcagaagatcctcccggccatgcagagcctcagtgacgcgctctcggcggcggggctcggcaacatcaaggtgtccacggcggtgaagatgagcgtgctcgccaccccgtcctcgccgccgtccaccggcgcgttcgccgacccctccgtcatgggccccatcgtccggttcctggccggcgtcggctcgccgctgctggccaacatctatccctacttcgcgtacagggacgcggccgggacgatcgacctcaactacgcgctgttccagccaagcaccacggtggtgagcgacggcggcggactggtctacaccaacctcttcgatgccatggctgacgcgatgtactcggccatggagaaggaaggcggctccggcgtgcccatcgtcgtgtcggagagcggatggccgtccggcggcggaggcaccggcgccgagactgtagacaatgcacggacctacaaccagaacctgatcaaccacgtcggcaacggcacacccaagaggtctgggccgcttgagacctacatattcgccatgttcaatgaggacaagaagcagggggacgaaacggagaagcattttggcctcttcaacggcccggaccagtcgccagtgtaccagattagtttctccacatgaaagttctacactgcacgattgaggtgttgtacctattaacgccttcgatgagtattactgtagaaaatacaaccgtacctggcacccatatatatctcttcaataaatccaggctatgagctagctataacaaaagaaagtaggttctttttgggaaaaaatctatattttcccattaaaaaaaaaaaaaaaaaagcggcc

SEQ ID NO: 12974 - DNA, 888 bp, Zea mays
ttccagttctttcaagcagttcttatctgaaggcgaggaatggttgaaaccatatgcggcattttgctttttgcgggactttttcgagacatctgatcacagtcaatggggtcgtttttctcagttttccaaggataagcttgacaaacttatttgtgaaggtactttacaccatgacattatacgttttcattactatgttcagtaccatctatatatacaattatctgaggcagcaacatatgcaagaaagaaaaatgttatcctgaaaggtgatttacctattggtgttgataggaatagtgtcgatacttgggtatacccaaccttgtttcgcatgaataccgctactggagcgcctcctgattattttgacaagaatggacaaaattggggttttcctacatataactgggaggagatgtcaaaggataattatgggtggtggcgagctcgtctgacacagatggcaaagtacttcacagcatacaggatagaccacatcttgggtttctttaggatatgggagcttccagatcatgctgcaacaggtttagttgggaaatttagaccttccatccctcttagtcaggaggagcttctaagtgaaggtctatgggattttaatcggatgagccaaccatacattcgtcaggaaatactggaggagaagtttggatccttttggacagtcattgcagccaattttctaaatgagtaccagaagcagtgttatgagtttaaagaagactgcaacacagagaaaaagattattgtaaagattaaaacaagtgctgaaaagtcactgtgggtagagaaagaggacagtatccgccgtggccttttcgatttactacagaatattgtccttatcagagatccagaggg

SEQ ID NO: 12975 - DNA, 3860 bp, Zea mays
  misc_feature (2596)..(2596): n is a, c, g, or t
  misc_feature (3005)..(3005): n is a, c, g, or t
  misc_feature (3767)..(3767): n is a, c, g, or t
cattgggtacctcgaggccggccgggacccccagacagacactccagtcgatcgactggcagtctggcaccagaccacaagtccacaagcttgcagaacgaagctaggcaccaactagtacgtactgcgcatggagcaagcgtcccactatctgtgcctcttcctggctctgatcctaccgctcctgctcctcaggctactcagggggcgccgcagcgacagcggcgtccggctgccgcccggcccatggcggctgccggtgatcggcagcctacaccacctcgtgggcaagccgctggtgcaccgcgcgttcgccgacctcgcgcgccgtctggacgcgccgctcatgtacctcaggctcggcgaggtccccgtcgtggtggccacgtcccgggacgccgcgcgcgaggtcctgcggacgaacgacgtcacgttcgccacgcggccgtggagccccacgatgaagatcatgatgcaggacgggctgggcatggtgttcgcgccctacggcgaccactggcgccagctccggaagatcagcatcctggagctgctcagcgcccgccgcgtccagtcgtttcgccacgtccgggagggacggaggtggcgcgcctcgtcgccgcagtcgccgccaccgcaccaggccagcccgtcaacgtcagccaccggatcgccgtgctcgtcgccgattcggcggtgcgcgccatgatcggggacaggttcagcaggcgggacgagttcttggtgtcgctcgaggaggggctcaagctcgtctccgggttcagcctaggcgacctattcccgtcatcgccgtttatgaacttcctcagcgggacggcacggcgagcgcatgcgaaccataggaagaactttgagctcatggaatgcgccatcaagcagcacgaggaaaggagagcccaagcggcggtgaacggcgctgctgtccaggaggaggaagcagaggacctagtggacgtgctcttgaggatacaaaaggatggcggcctcgacatgcctctcacaatgggaataatcaaagccgttatacttgtaagtacataacaagagtttatcatgtttgttttcattttaatttgtttatcatgcatgttcttgcatatatatacaggacttgttcagcgctggaagtgagacatcagcaactacactgaactgggcaatggcggagcttatgaggtgcccggatgtgatgaagaaagcacaagccgagctacgcgacagcctcaatggtaagccgaaagtgaccgaagatgacttggtagagatgaaatacttgaagctcatcatcaaggaaacgttgaggctgcatccagcggcgccattgcttgtgccaagggaagcaagggactcatgcaagatccttgggtacgacgtgccaaagggcaccacgggtgttcgtgaacgcgtgggccattggcagggatcctgagtattgggatgatgctgaagagtttaagcctgagcgatttgagtgtggcacggtcgacttcaagggcatggactttgagtacataccgtttggtgccggtagaaggatatgccctgggatggtgtttgcacaggccaatatagagctcgcgctggctgcgctgctctaccacttcgactggaagctcgaagaggggctggagccaagtgagctggacatgactgaggacataggcctcactgttcgaaagaagaacgacatgcttttgcatcccagcgttagagtgccccataaatattgatgactaaatggaccagcactaagcatgacaaatctagcatggccaagcaccgcattatgttaactaatagtttctgtgtcggcatggaccagtgcatagcgtcgtgtttaggttactacctaaatctctagtgtcggttgaaacacgacacgattaagaagcaggcactattgagtcggattatatgataaagttgtaataatttttagacttgaataatagatttgtaacttaaataaactcagaaaaaaaaaaaaaaaagcggcctctttttttctatctatctagagttttctaatgaggtgtgagtgttttgataggttttaaatgaggttgtcattgcaattaatagcttagttaatgtatatttgatgcctatctgtatcagaataatttttattcgtttatggtgcctaaacaggcatgagcactacgtgcttactgtgtctatagtgccagcacgataaagttaatgcactgtctccgctgacgttcagacattagtgtcgtgccgacacggcatagttatttggtcgtgccggatagtgttgtgtctaatcgtgcttgtgtcgaattagttaaggtcgcccatttagccatgagtacccatgaataagcaccattgttgtctgcaacattatatatttgtgtatatgattcatatatgtgttgagcaccaaatgtaacatctaagcgaccagacggtccgatcatgtggcccagacgattctgacctcagacggttcggcttgtcaacggtccatgatctaattaatttgggctagagtccttatcttgtgcataattatcctaaaaatgtgtctagacctcttcctatatatatnaaggggcacaaccgattgaatcatccaacaattgaaccataatccagttttatcttatttactttatgcaccagctttaggagtaaatctagccttagttgtagcctctcaacctccaatctttgcctctctccgaatccatgtcatcaataagagctttgggtggcctgccgacaccaaagcaaccataagatccttccttctagatagggtccctctcggaaggcgagatcttggatcttcatgaagctctgtgtcccatcgcggatggttcgccactcacccgcgaacggtccgcgcgccagcataggaggagcacatctctctgcgtagtcatggacggtctggctgcccaacgcggatggttcgtgctcccatagagaggaccctaaggcccagcatgtgacgnacaggctctagggttcgtttggtgtttgtcccaaaaaggcgccaacacactttttggcgactctgtaagtgacaagtgcattttagatctattagaatggcctcaatggtcggtcccaaagatcacactaatgcctccccagataatttccttagattgactatggaatgtctctcggtcgatgagcaacaatggtttgaagacctcatgaagcaattggatgatgatgtgctacgacaatgtgcatgggtgcacgaagaagcgaagttctggtcacacctcactctagatcgacaccagagaattatcaagaaaggggagatcaagctcgacttccttgtaccttcactccaaaatagcaatgtaagtaattctactgataatcaatctattaagcattatgtagatcaacaaagggatcagttagagcagtttctgggaggggtagaacacttactcaagaaactcacaggtgcgctcgaaaaatctactatacctagttttccatctcacgaggtcgcatcggcaacaaatgggcctccacaatcctagcaattatatggtatgccaataaacttatttctagggaagctgctacccttacaactcctatgtaacatgctagcatccctatgcacgctcgagccatccgagtataatctcggacagtttggccccagactggactcttgataactcgttgtggacctaccacggactgttcggggtacaacactcagattggtacaatatgcacaacangcaaccaggctctataccacaacatctcctccctcctccaccttcggcccaccaaaaccaaagcattcccgcatctagaactgagtaccgccc

SEQ ID NO: 12976 - DNA, 1550 bp, Zea mays
  misc_feature (1532)..(1533): n is a, c, g, or t
  misc_feature (1535)..(1536): n is a, c, g, or t
ctatttcaacaggacagtttgcaactggagccaaatgcattctaagttttgttgtaagcaatcctaagtacagtattatgatatgcaggacaattacttttctaacctctgatgtattcttaataccgcagcgctgaatgaaacctatgacacaacagatgcccagtttacattcaattcccatcttcagtggtactaactccattcttaaatatttgacgccggaatttttttttttttttttggtttttttttttttttttaaaaaaggagggagtatatgatactcaaatcctttttttattgtagtacaaaaccaaaagcatggatttcttgcactaatagtagcctacatgttctgaacattccatcgcatggattccttacactaatagtagtctacatgttctgaacattccatcacaattacacacacttatgcacagaactgaaacgcacaccagaccaaaaccttgattgcttccactgaaaccaatcatggccacaccgtgaccactgagacaacatggcgatcttttccatcgtcatagggcaggaagacatacatgttggcgaactcattgtagatctcccctgtgagctctccgtgcatcgcgcggcagtgcatgtagagcacaacgttggccaccatcccgtacagcatcatcacggccagcagcgctgtgccagccaccgccttgaccaccacaggcgccatcccagcccacccagccccagcgtcgtacctctcggcagccacaccgccgaagccccagagcgtgaccccaatcccggcggcgaataccaggaacgaggagagcgctgcgaggcgggcggtagagaggagctggcagctccgccggagcggcgtgaagcctgtggccgattcgaccacggcagcggcgccagcgagggaccagaacggggacaaaaggatgaagccgaggacgagcagcgcggcgccgagcgcagcggggagcgggaggagcggaaggagtgcgagcggggaggccaggatggcggtcaggatgaggcggaggagtgaggctggcactgagcggagcgaggcgaggagccggacggggcgaccgaagaaccctgcgtgcgcgctggccgcggcggcggcgaaggcggcgaggtaaaggagcgccgcggcaagggcgagcagcggcagcgggatgggtagtgggtacctcgacggatcctgcgggacccggagatgcacgggaggggaggcggcggaggaggcggaggcagagaagaacaacgggcaggggagggcgagtaggaggagggcgagcgggagaaggaggagagaggatagggccaggaagtgacgggaatgcgcggcgacgaggcggcaggtggaggacgccgcgcccgcgaggaggtccggccagaggagggcggacggcggcagagagggcggcggcgtgtccatcagggactggaccggtggtggcagaggcggggatgccgtatacggtacggctggatgagactgttcacatttttttttttttttttttttnntnnaaattttttttccc

SEQ ID NO: 12977 - DNA, 2936 bp, Zea mays
ctgacaagagcagcatctgagttggagggatagaaaaatctcagcatctgcgccattttctactacttatccttggggttgaactgtctcccgccgcgactattgtgctatctcctttgtttgtcttctccacaaccatatatacaccaacttgccaaggaaggcttcatggccatggcttacctccccgttttcgtcttcctgttcatggttgtcttatgccaatccgatgacaggctaacacctgcaaagccactcttgcccaacgaggtgctcatctcaggcggtggtgtctttgctcttggcttcttctccctgaagaactcttcaaggttctatgtcggcatatggtacaacaacattcccgagcgcacatacgtgtggattgccaaccgcgacaacccaattaccaccaatgtgcctgggaagctagtttttaccaacagttctgaccttgtcttgttagactccacaggccgcaccatctggacgacgacaaacaactataccgcaggaggaggcggtgaaactgcttccatcctgctcgattcggggaacttggttatccggttgccaaatggcactgacatatgggagagcttcagttacccgactgacacaattgtccccaatgtaaatttttcactgaacgtagcttccagcgctacgctccttgttgcctggaagggacctgatgacccatccagtagtgatttctccatgggtggcgaccctagctcaggtctccagattatcgtttggaatgggacacagccatactggagaagagccgcatggggtggtgaactggtgcacggcatattccaaaacaacacaagcttcatgatgtaccagacagttgtcgatacaggagacgggtattacatgcaattgactgtgcctgatggctcacctagcatacgcttaactttggattacacaggcatgtccactttccgaagatggaacaacaacacgtcttcgtggaaaatctttagccaattcccctatccatcatgtgacaggtatgcctcttgtggcccatttggctactgcgatgacacagtacctgttcctgcttgcaagtgccttgatggttttgagcccaatggtcttgattcttccaaaggatgtcggagaaaggatgagctgaaatgtggtgacggagatagtttcttcaccttgcccagcatgaagactcctgacaagttcttatacatcaagaacagaagtcttgaccaatgcgctgcagagtgcagggacaactgctcatgcacagcgtatgcttatgctaacctgcaaaatgttgacaccacgattgacacgacaaggtgcttggtctggatgggggagcttatcgatgctgagaagttcggtaacacatttggtgagatcctatatcttcgacgtcccagctcacctgttagtaagaataagaagagtaccacattgaagattgtactcccggttatggctggtttgattcttctaataacatgcacatggcttgtattcaagccaaaagacaaacacaaaagcaagaaaagtcagtacacactgcaacactcggatgcttccaacaggtttgagaacgaaaatttggaatttccatcaattgccttagaagacatcatcgttgcgacaaacgacttctctgattttaacatgcttggaaaaggtggattcggaaaagtttacaaggcaatgttggaaggtggcaaggaagtagctgtcaaaaggctcagtaaaggctctacacagggggtcgaggaatttagaaatgaagtagttctgattgctaaactgcagcacagaaacttaggtagacttcttgattgctgcattcataaagatgagaagttactgatatatgaatacttaccaaacaaaagcttggacgccctcccgtccggtacgttctgacttcatttcacatattacgaaacaattttagactaactgaaattgtgactcacaatacattcatgaagatgctacaaggaaatctttgcttgattggccatcccgtttcaaaataattaaaggtgtagcacgaggacttctttatctccaccaggattcaagattaacgataattcatagagatctcaaagcaagcaacatcttgttagacacagaaatgagtcccaagatatcggatttcggtatggcgaggatttttggtggaaatgagcaacatgcaaacactactcgagttgttggaacatatggttacatgtctcctgaatatgctatggaaggctcattctctgtcaagtctgacacctatagctttggtgttctactactggagattgtaagcggcttaaagattggctcaccccatctgataatggactatccaaatctcattgcttatgcatggagcttatgggaaggtggaaatgcaagggaattggtggactcgtcggttctggtgagttgtccacttcaggaagctgtacgatgcatccacttgggtcttttatgtgtccaagacagtccaaatgcgaggccgctcatgtcatccattgtgttcatgctagaaaatgaaacagccccggttcctaccccaaaaagacctgtatattttactactaggaattatgaaactaatcagtcagatcaatacatgcgaagatcgctgaataacatgagtatcacaactctagaggggcgttaaatgtttagtttcattgttcgctattttggtaaacttttgtttaatgtgtgccattaaacaattacattaggtttgtattaatacaattacgctagccgttcaggtttgtacatagaaaatgttccattaaatctgttgtacaccatcggttcggtgggttgtattgatatattctcgagactgtaaagtttcctagtttttacaactggttccgcatgtcaaatgtcggttatcatcctgtccatgtgtgcat

SEQ ID NO: 12978 - DNA, 2806 bp, Zea mays
ggccggccgggcccttctcctgcagccatcagaaaagggggcaaaaaggcccccgaattctcctcgcccgggcacaacctcgctccagagtccaggccagaccagcaggccgcctttccgctcgagcacccacgcaatcatcaccgccgtcttcctctcgctcttctcttccccttccattcctcggcaccacgtcctcgggaacgccgcatgccctccgcacaaggcgccgcctgttcccggtgaccgcggggccgagatcggcgcgccatggccgcgcccggaggcctggaccaggactgtgcacaggacgccgccattaagctcttcggccgcagcatcccggttctccactcctccgtcttcgccgccaccgccgcggccgaatccgaggttagcaccaaattagcaaatgatgttagaagcaaagatggcatgccatgccttccaaacatgtctttgattgtcaaaacaaatcccttcccttccaagagcaatatgaagaatggtttacaggcaatcagcagtcagcatgggaaaatggaagctgattccaactctgaggaagctaagaatagtttacaagctatcatcagtcagcctgggaaaagatacgattccaagtctgaggaagctaagactgaatctggtggatctggccaagagaaggtactcaagaagccagataagattctgccttgccctcgctgcaatagtatggaaacaaagttctgctacttcaacaattacaacgtgaaccagcccaggcatttctgccgaaactgcaagaggtactggactgccggggggactatgagaaatgtccctgtaggttctggtagacgcagaaataaggatccatctcatcaccatcatttcaccaaggtgtgtgattataccatagctactaatggagatgtttctgatgcaactcagcgccagtccgttgcagccaagctatgtctccttcaaggttcagggaaacaaaatgaaacagcgtgcaagtctgtatctccagtcagtaatattaaagagcagaacaatgctgaccttatttccttggtctctggtgataataaggaagagaaatcatgtgcatcctctgcagtggtatctggttcctccgaaaattggatgccagaaaatacagttaaaaaggaggaggataatacttcagcgtacggtaatggtgtgaaagtacctgatcacaaaatgcagcctcaccatgctggacctgtttcggtgttctccagaaatcctgctgcagtcatggcgactaatcagtgctcagaagatggtattcatacgccgggaaatggtacggtcagtcctctttcactgccaccaccacccatggtaccaaccccaggaatttgtgcacctgctgttccattccctttccctctcgtgccagccttcgtgagctgcattcctggctggccaagtggactatggggtgcaccatggcctggaagtagtgcccctacattactatctcttcctccaaacggtttagctctttcaggaagcaactctggggtgttaggaaagcatacaagggtagctaatttgcaggaagaacagaaggcagaaaagaagttttgggtccctaaagctctccgaattgacaacccagaagaggcagcaaagagttcgatctgggcctctcttggtatcaagcctgatgacagaatcatattcaagtctttccagtccaaggatctgaaaaatagtgcgactaagacgccagaatccctgcaggccaatccagcagcgttttcccgctctcagacatttcaggagagggcctgatacaaaaataaagtgtcctcaaaacaaaggataccagaggatggtcaatgttcctatttaagctttttcttgagttgatctgtcgctaagcgcagcagtttggcaatcaactcaggcctggccaagatttacattttttttctttctagcgatagctaggttggtgtgaagattctgactgctcaaggagcgcttatgtaaatacagtaggcctgtgaattgatgttgaatgttgatagtcttttaccctggcaccggttaatgttctaatgtactccctctcttcccaattatagttataagtcattctggttttcgtaaacacatattttgctattctaattcatcctataaaaaagaaaaaaatctatcatttttaatccatcatattagatagattttttatttttaaaaataaattagaacttgaaatttgatatgttggtagagtaaataacgaagtgcatcgataaatattttgagaattcttatgacttttggaagtttagttgcacaaatattgcacgggaagcttgattgcaaacttgtttttgtcggatataatatatatctagacatatagtatataactaaacatcacaataacatacaatttggaatggaagagtactttacattaacgtcatgaagtggataactaggttcatgagtcttaatgagataataatggtcgctagcctatatatatttacgagggagttcaaaaaccatactccatttgttagcagccttaggccattagcagtgggagttttattatagttttattcttattgaatgagatgacacatcagcatattggatgacatgtcacggtatttatgatgagagagatagagagagtttcataggaggagagtgttttatccagatgaaacttacgatacacaatttcatagacgagtgttttatccagaatgaaacttaagatacacaatttcatagacaaaaactgatatgtcattttgaaaac

SEQ ID NO: 12979 - DNA, 1182 bp, Zea mays
acttgtcttctccaggcccgcagcctctctcctgctcccctgccagtgccacattgccacaccctcacgccgccccggcaaacatctccaaaaccccattccgcaatgagacccgcagccgcagcagccaccgctaccaccgccgcgctccgtctccgcgccgcctccctctcgccttctctcgctgcctccctctcgccttctctcgccgccctcctttctcatcgtagatcctccctcattcttcctccgctgcgccgcatctgctcccttgcgcctccccactcctccgccgcccccaattcgcagcccccgccgcagttgctctctcccatcatggacgcgcagttcgagctcttccgcgcgcagctcgacgagtcttccaccctccgcgaccgcatccgtgccgtcgtcgccgagattgagtccgcctcccgcgtcgccaccgccgcgctcctcctagtccaccagcccgtccccctggcagatgtgcttgtgaaagccaaggcgcaggtagaggtgatcaaggggttgtacgcgcgcctggcggaagtcctcaaggaatgccctgggcagtactacaggtaccatgctgattggaggactgagacacatatggtagtgtcgatgcttgcattcatgcactggctggagacaggtggcctactcatgcatgctgaagcccaggagaagctagggttgtgctctggggagtttggccttgatgttgaggactacctgacaggactgtgcttcatgtccaatgaatttcctagatttgtagtaaatcgcgtcactgctggcgactatgactgtcctaaaagggttttgggcttcttgaccgatcttcatgcttcgtttaggatgctgaatctgcgcaatgacttcttgcgtaagaaatttgatgggatgaagtatgatttgaggagggtggaagaggtctactatgatgtgaagatccgtggacttgtacctgcgtagttgaaacaagagacttagaatccttggtaatgttagattgttaacatactgtggtttggcttttgtcatccataacgtgttcatctagctaaaatgtgaaatatattctgttggagcgtatgtgttatggactgaacttgagggcactcgaatgaccttgctcatttcttttactgtggcgccacaaaaaaaaaaaaaaaa

SEQ ID NO: 12980 - DNA, 1169 bp, Zea mays
tcgagtcagctacgtagccccccccccccggtcggcgtcgagtctcgaagcttcgttttggcgcaataaggcgacctgagtcctgaaccgcctcgagccgctctcggcttcgaatcccgacaacctccctccccaagctgcttagccgccggctgggcctcagacctgcgtcaagcttccggcggcagcccatcgagcaccacaatggcgtccggcggagcggccatctcggcggggcctacaccgccgtcggcgacggcgtcgtcggttgagtggcaccagcggccgccgaacccgaagaaccccgtggtgttcttcgacgtgaccatcgggtccatcgccgccggccgcatcaagatggagctcttcgccgacatcgcccccaagaccgcggagaacttccggcagttctgcactggggagcatagaaaaaatgctttgccacaaggttataagggctgccaattccatagagtgatcaaagatttcatgattcagggtggtgacttcttgaagaatgatggtactggatgcacatcaatctacggtaccaaatttgatgatgaaaattttatagcaaagcatacagggcctggactgctctcgatggcaaacagtggaattaactctaatggatctcagttctttataacatgtgcaaagtgtgactggcttgacaacaaacatgtggtatttgggagagtgcttggagacggtttgctcgtcgtgaggaagattgaaaatgttgcaactggagcgaataacaaaccaaagcttgcctgcgttataagtgagtgtggtgaaatgtagcttgatccctttgtgtggctaatcgtggattcttgacgctgctgatgtagaccctgtttggttgatggaagtacttaagcagtggaaacattgatggaaatgtattgtgtctaggcaacctgcagaataatagaccaaaaaaactaatattcttgtttggcttgggagttcggccttcaagaaaaaaaaaaaaaaaagatcctgttgtttctgattagagatggcaatggccttgatccctttattccccgctcgaaaattactccattaaggactagttttgggaacttcaatttctaggggtgtttatttttccagggaaaaataatattatttttcttaaagaaaatagagatttc

SEQ ID NO: 12981 - DNA, 2387 bp, Zea mays
ggaccctcgggccggccgggcgcttattttctccattacgtgttcccagctgcatgccgcaagtgtcaaactccaattagtcaccagccttgcttgcttgcttgtcccagctaagccgaggacaggacacgcgaagaagaggaacgatcagtcaccagccttgtttgacatcctgagcagcttcatctcctcctcctggcaagtttcttggcaagctggtgctcaaacaatggcgtgttaattaggaataggatagaacaggatcgttgcatcacgcagccaaggagacatggctaggagcagagaggtggcgggctggggcacggtggccggcggcggcgcggcggccgtggagaaggcggtgcggtgcctcggcaggggcgtcgacatgacgggcgacctgaggctgaagcactgcaaggacgcggggggctgcctggtcgtccggagcgccgggaggaaggcggcggaggaaaaggccgtcgtgccgggcttcggcgtcgtcgccgacctgcccgccgacgtcaggtgcggcaagggcgaccggatcaggttcaggtccgacgtgctcgagttcaacaagatgtcggaggcgttcaaccaccggaattcgctggcggggaagatcccgtcggggctcttcaactcctgcttcgacctggagagcggctcgtgggcggaggacgccgccgccaccaagtgcctcgccttcgacggctacttcatctcgctcctcgacctccgcctcgactgccggccgctcgccctcgccgaccacgtcgtcggcgacgtgccggcggcatgggacccggcagccatagcaagtttcatcgagaggtacgggacccacatcgttgtcgggctgggccttgggtgggcaggacgtggtgtacgtgaagcaggacaggtcgtctccgctgtccccgtccgagatcaaggagcacctcgacaggctcggtgaccagctcttcaccgggacctgcaccctgcccccttccaaccgcaaactcagggaccacaaatctaaggtccctgaggcgttcaatgtgttcgatgcccaagtgacacagcaagggctccaaggactaatggctactccagtgtcctgcaaagagggcgtgacggtgatacactccaagaggggagggaacgcggcggcgagcgaccactcggagtggctgctcaccgtgcccgcgacgccggacgcgattagcttcaagctcgtgcccatcacgtccctcctcaagggcgtgaccggcgtcggcttcctctcccacgccatcaacctgtatctcagatacaaacctccgacaggcgagctgaggtacttcctggacttccagcaccacaggctgtgggctccagtgctcggtgacctgccacttgggccctgctccaaccggcaggctcccactccggccttgaacttcagcctcgtcggttccaagctctacgtcagctcgagcgaggtggttgttccaagactacccgtcaccgggatgagactacctctggagggcaagaataaatacccgccttggcctccacctgcagcatctgtccaacaccccagcgttcatcggcggaacaccggccaatgagcagccgccggcggcggtgtggcgcgggtcggagacgatctccgacgcgcggtactacgagccggtccagtggaggatgttcgcgcacgtgtgcacggtgccggtgaagtacgaccctcgctgggccggcgccggcgccggcccgccgtcggcgtacgtcgtctccggcgcgcagctccacgtcaaggcccacgactcgaccaacatcctgcacctcaggctcctgtacgcccggctgccgggccacgccgtggtgcagtccaggtgggcgcacggcgccgccaccaggctgtcatcgggcagagggagcttcttcctgtccaagtcgctggcctcgggctccggcggcgtcgacaaggagcagcagcacccggggagggttcacgtcgactccggcgtgttcgccggagggccgcccgtgcctgtcgggacccagaggctgctcaggtttgtggacacgtctcaggtcaccatggggccgcaggacagtcctgggtactggctggtcactggcgccaagctggacgttgagaaggggaagatctcactccgcgtcaagttctcgctgctcgctccagtttcttgacacgctagtcttctttctgctaggagaacaccgctgtgcagaaggccgaaattaggggggactccttgcgcagtgatgagtgattgtatcaaggtcatatttgattttacacagccttccgtacatatttttgctactactttcttgtacaatatattcttaaaatccttcagatttttcatgcaattatacacatttgc

SEQ ID NO: 12982 - DNA, 2331 bp, Zea mays
cagtggggtccgcgtggccggccggggcccccgcgcggcgagaatccccacgcgccccgtcccaccccacagtccaatatggccgcttcatccagatccaggccgctctccaagctctccccttcccacctcgtccccctcgacctctccacatcctggtgctgcacgccccacggtctcggcggccacgccccacactcctcgtcctcgtcctcctcctcgcacccctcctccccggcccgcgccgccgcccatcacatggacccgccgcccaccagctctaccgtggcctcctcctacgccactccgccccagccttcctacgcgccctcctaccctaccagctacaccaagttcaactccgcgctcaacgcggggttgctcaatcccatgtccccgccgccgctgccacttgacaagacgcgctccagccccacactcttcgacatgatggccaacgagcaggactaccacccccgcaccgccgccggcatccactccatccccgccccgccccagccgcaccagctcccgcccgcgcgctccatggacaggcagatgctgctccaggaccgcatcgccgacctcatcggcagctgtagccccgggaaccagttcaacgacgccgactcctccgacgtccgcctcaccctcagctccaaggacggcctctccgtcacgctctgcgttcaccgccacatactcgtcgcgcacagcaggttcttcgccgccaaactgtccgaccgctggtccaagcagcagcggacgctgccgcacatcgtcgagatctccgactgcgacgacgtcgaggtgtacgccgagacgctgcggctcatgtactgcaaggatctccgccggaggctgatgcgggaggatgtgaacaaggtccttggcatcctgaaggtgtccgcagccattgtattcgatgccggggtgttgtcttgcttggagtacttggaggctgcgccttgggctgaggacgatgatgagaaggtggctacgttgttgacgcagctgcatcttgagaactccggggctggggaggtgcttaagagggtgtcactggaattggccccttcgtcattggttgaagaggcagatgaaggaggcagctgcaacggtggcaattccagtggtggtgaggaggtattgctgaggctcctgcaggtcgtcctggaagggaaggacgaaaaggcaaggagggagatgaaggggctagtgtccaaaatgctcagggagaacagcacatcccgtggtggagcaattggtggcgaccttcgcaaggaatcgctctattctgcgtgcaatggatgcttgtccctgctgtgcgagcaatttgtgagggcttcagagggtgatcactcagaggtggcgcggatcgcaaggcaggctgacaacctgcattggatgcttgacatccttgttgagcgccagatcgcggaggatttcttgaggacatgggcaacgcagactgagttagcggcgatgcatcgtaaagtgccagcgatacaccgctacgaagtgagccgagtgacggcaagactctttgttggggttggcaagggtcagatcttggtgtccaaggaggcccgttgccagctcttgagcacctggctagagcccttttatgaggacttcggatggatgcggcgagcatgcaaggggcttgaccggcatttgatcgaggatggactggcaaacacaatcctgacgctgcctcttgcaactcagcaggagatccttctggcatggtttaatcggttcctcaactctggggaggattgcccaaacattcagagagggtttgaggtgtggtggcggcgggcattctggaaaaggaactctgaaccagaaccaccatcccgtttgaggattactgcgatctgcgagaactcttgatgacgacggttcatattcgacatggaatgtggcggatgttgtgatataattattgattttctgtgatatgtagtagtgtctagctgtttctcagtttttttttgttatgtctgattaggcagttagccaattacacatgtcatcttgatcctgtttcaatgcaatgtataccaggtccaatgtactactatgccgcaaccattttgattcgaagtgaagtagagtgactatttgtggtttgctatatagcataagcaaacaatggaaggattcagacacatctggagtttggaaatggttgcacatctggggtttggaaatggttgtcctgaggccttatttgatactatccatatgtattggtgtggattggagtgtaaattagtttaatttacacctgaggtcttgttcgattattgatattacatgtgt

SEQ ID NO: 12983 - DNA, 2170 bp, Zea mays
cctgccgggacaagtcccaacaccttcccacgcgtccgcgccggccgccgccgcgtcccggctagcccgaaggaactccgccgcaaatacagctatgagctcagccgcttccgcggcgccacctagccgccgcactaggagccgcccgccatcagcttcttctcgcaagtctgacgactcctcggccgccgccgccaacgggaatgggaacaggaaggtcgcaaccaagcccgcctccccccaccagctcacgggggagaggacagtgaagaagttacggctctccaaggcactgacgataccggaggggacgacggtgttggatgcgtgccggcggatggcggcgaggcgggtcgacgccgtgctgctcaccgacaaccaagggctcctctccggcatagtcaccgacaaggatatagctacaagggtggttgctgaggggcttagggtggagcaaaccatcatgtccaagatcatgacacgaaatcctgtttatgtgatgtctgacacgctcgccattgaggctttgcagaagatggttcaagggaaatttagacaccttcccgttgtagaaaatggtgaggttattgctatgctggacattgcaaaatgcctttatgaagcaatagcaagactggaaaaggctgcagaacaaggaagtgcaatagcagctgctgttgaaggggtcgaacgtcaattaggagggaacttttcagctccttctgctctcattgaaactctaagggagaggatgttcaaaccttctctgtcaaccatcgtcacagagaatacaaaagtagcaattgtttcgcctacagatcctgtgtgtgtagcagcacaaaaaatgcgagagttttgtgttaattcagtggttgtctctacaggaaacacattgcaggggatctttacctcaaaagatatacttatgcgtgttgtgtcacaaaatatttcccctgagttgactctagtagaaaaggtgatgactgttaacccagattgtgccacattagaaacaacaattcttgatacattacatataatgcatgatggcaaattcttgcatattcctgttattgacaaagatggacagattgctgcttgcctggatgtcctgcaacttacccatgcaactattcaattggttgaaggagggaatggaactgtgaataatgtcgcaaactcggtaatgcagaggttctgggactctgctcttgcattggagcctccagatgaggaatttgatagccatagcgaggtatccttactcctgcagtcagaggctggagatggaaagagtagtgtttatccccctgtggttggcaattcgttttcctttaagctccaagaccgaaaaggccgtgtgcacagatttacttgtggctcagagagcttggacgagcttgtgtcttctgtaagacaaagattaagtattgctgatgaaaaagaagctgtgcaactcttgtatgaagatgatgaaggtgaccgagtgctgctgacaacagatgccgatcttgctggtgcactgctgcatgccaaatcatctgggttgaaggtgctgaagttgcacatcgaagaccctagtttgaacactgaagtgacaaaaccatcccaagagctggcaccacctcccctcaagagtgggatatcgatggttcatgttgggttaacggccggtgtagtcgctctcagtggcgcagcagtgatggtttacttgaaacgatctcaactgtgatttcgaaaatcggaggatgttttttaggagcttgattatctgaaacaagcattgccatcagctaatgcattctgaagctttgccttcactcggtgccatttacaagctaagaactgaaggaatgtacagaaatgaagaccacatctgtgatcttttgatgagctgaaagtccgtacaggccacgggacaagatcactgtttttggaggtgaatttctgggcagaacggcgtgcctatctttgttcattcagcacaagccgtggcaatttcacgactatgatgtaatgtgtaaacattacatatttgttcctattcatactgatgtatttgtttgtagataaaaactcatttcacatgacactattgtttgagaattgagaggggtctggtaggatgtcacctgattttgaggatagaatcgaatacataacatatatg

SEQ ID NO: 12984 - DNA, 2114 bp, Zea mays
cgggggacgactctgcgcgcttcgatcccatccccccacagtcccacaccacctgcatatctccgtgcggccgtgccaagtcaaagtcgcacctcaggtctgccgaggttggcattggtggtggtgtggtgacccggcgatggcagcggagcgggatatcgacgacctgccgcggaacgacgccaactacacggcgctcacgccgctctggttcctcgagcgcgccgcgctgacccacccggccagggcctccgtcgtgcacgggcccgtgcgctacacccgcgcccccgccggcggccgccgcccccccctcgcctccgccctcgcgcgccgatccgtcggccacggaagcacggtagctgtaatagccccaaacatcccagcgatctatgaagctcattttggagtgcccatggctggggcagtggtcaactgtgtcaacattcgactaaatgctgccactgtagcatttctcttggagcactcctcagcagaagttgtcatggttgaccaagaatttttcaccctggcagaggattctttgaggattatcgcagataaaaagaaaggcactttcaaacagccacttctaatagttattggtgacgcaacttgcgatccaacagccctccaagacgctttgagaaaaggagccatcgattatgaggcattcttggaaagtggagatcctgaatttgcttggagaccaccacaggatgaatggaagagtatcgcgctaggttatacttctgggacaacttccaacccaaagggtgtggtattgcatcacaggggggcttacctaatgtcactgagtggtgctttgatatggggaatgaacgaaggcgctgtttacttgtggactttgccaatgttccattgcaacggttggtgctatacatggacacttgctgctctctgcgggacaagcatatgtcttcgtcaggtttcagcgaaggccatcttctcagctatagccaacgagggcgtgactcacttctgtggggcaccggtcgtcctgaacaccatcatcaacgcccctccagccgacacgattctccccctacctcgtgtcgtcaacgtcatgaccgctggcgctgctccgccaccctctgtcctggcggcaatgtcgaagcttggcttccgtatcactcacacctacggcctgtcggagacctatggaccatccacggtgtgcgcctggaagccggaatgggacaggctgccagccgacgagcgcgcccggctccacgcgcgtcagggcgtccgttacgtcggcctggagggcctggacgtggtggacccgaagacgatggtgccggtcccggccgacggcaccacgatgggggagatcgtgatgcgcgggaacggcgtcatgaaggggtacctgaagaacccggaggcgaacgcggaggcgttcgagaacgggtggttccactcgggcgacctgggcgtgcggcacggcgacgggtacgtcgaggtgagggaccgcgccaaggacatcatcatctccggcggggagaacatcagcagcctggaggtggagaaggcggtgtacctgcacccggcggtgctggaggcgtcggtcgtggcccgcgccgacgagcggtggggggagtcgccgtgcgcgttcgtgacgctcaaggacgccgtggaccgctccgacgaggcggcgctggcgcgggacatcatgcggttctgccgcgagaagctgcccggttactgggtgcccaagtccgtggtgttcgggccgctgcccaagacagcgaccggcaagatcaagaagcatgagctcagggccaaggccaaggaactgggcccggtcgggaagagcaggatgtgatcgagcctcgagctcgtcttgctttgctacactgtactattcgtaggatggatggaagttgtatactacagactacagtgcaaactgcgtttcttctgtataacaccactactgtacgaacaatacagtcgtgtctgagcttttcttttgccagtgaggactgaactttgtatgaagtatgaactcgcgaagggcgctgcaacactgctcccccttgtatattccaaatttccaagggtacagtaatggcaagacagttaagaagttgccc

SEQ ID NO: 12985 - DNA, 1167 bp, Zea mays
atcgaggccggccgtcatcctcccagttgcgccctcttccctccctcctctcgctcgcctcgcccgtgtctctgcctgtgccgtgtgcgtgactcgcggcgcgtgtcgtcgtcctgccgcaggggctcgggaacaacacgggcgactacgcgcggctcgccgcggcgctgcgggacgaccacggcctccccgcggccgtcgtggcgcgggtcacccgccccgactggctccgcaacgccgcgggcctcgccgacgccagctactggcggggcaccctccgcccgcgccccgtgctcgactggtacctgaagagggtggacgacgcggtgtccgaggcgagggagctatgcgcgccaggtgggaagatatcactgatagggcattcagctgggggctggctcgcgcgcgtgtacatggcagagtttgatgcttccgacataagtctactcctcacccttggcactcctcacctgcctcctccaaagggtgtacctggggtaattgatcagactagaggactactgaactacgtcgaggagaattgtgctccagcagtttatacaccagaattaagatacgtgtgcattgctggaaggtacattcaaggtgctcctcttctggggaactccgcagctgcttctgacgagatcctcgcagttgacactccttcagaaggaggcgatgctgttattgtcagtagcagtgacaattctacatctactccatcagctgtctcgtggcgagcccggttcgttgggcaaggttacaagcaggtttgtgggcgagcagatgtgtggggcgacggcgttgttcctgagatggcagcgcatctggagggagcgctgaacgtaagctttgacggtgtgtaccactctccggtaggttccgatgatgaacaaaggccctggtatggctctccggcgatcctcaagcagtgggtgcatcaccttctcagctgagatagtgacatacaagaggagctagctgccggaacagacagaaactgggatgtgtcctgcagctgacatgacaccattggccaccaaagggcaaaggcgatttttcttctctgaaattgaggtgcatgatatagcatggcagatccctggttgtttgttgtcagtttctgtagataatttaatcatttaacctgaggtctttttgtcc

SEQ ID NO: 12986 - DNA, 720 bp, Zea mays
aaacagccccgctcccccttccccctcgcgtgcccacgtcttcgtcggggccgtcgccggcgacgaggtacgtacgcccccatccccctactgttccctctctgcttggcgaagcgatcttgttcccggaccctgcgcgcccagggaacgggaaaggggaggaagaatatgggcgagttcgacgactattgggcgcgcgcgtacaggggcgactctgcggtcccgcactccgacccgcagcggcttgtctccacgtggaccggcgccgttgccctcggcgcggccgcttgcgtccaccaccacgcctccgcgctcgcctcccacctcaagtccctaccggcgacttggcaagacatgacattggcgcttgatcaaaagcgatggaagaaagctattgagaaaaagcaacagcgagcttaagctcattattatttcctgccccttgggccccagttggatgagcatgtgtctggtcatcaattgtggcgcatgaagtttcagagttttctatctctatacacataatgtattgactgaggttctacttttggtttccctgtgtagcgttagaacactgtgaaaacgaatgaattatgttaaactgcccccattttttatgtttgctacatcccagatcctcacatgacattcagaatgattcatctgttcttgaaatctttattatcccttttaacatgctaaaaaaaaaaaaaaaaaaaa

SEQ ID NO: 12987 - DNA, 1963 bp, Zea mays
gggtacctcgaggccggccgggaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacgatggcagagagaatcaggcatttgagagaggaggtaagtggtatgttccaggcttgcaagaacgttgtggacaaaacgaacctagtagacgtggtacaacgtcttggaatagatcaccatttcgaggaacagatagccactgccctagccagcatccacagcgctggattattcaatagctcaagcctacacgaggctgcccttcggtttcgcttgcttaggcagcaggggttttgggttcctgcagatgaacttgtcaagttcatcaagaacgaagacgggagctttatcgatggtataaccaatgacccaaagggcctgttgagcttatacaacgcagctcaccttgttactcacgacgaggggacgacgacacttgaagatgccatcgcatttgcaaggcagcatctggaagctgctagaagatgtagtctcaagtcccctctagctgaacaagtcggccgtgcccttggtatcccactgccaaggaccttgaagagggaggaagcaatagcttttatcccagagtatagctcacaacaagatcaacaagtgtacagccccgtgatactagagcttgccaagctagacttcaacctccttcagcgtctccatcaagaagaactcaaggagatttctcaatggtggaaagacctctctggagaaatcggattaggctacgtcagggaccgcatcgtcgagtgttacttttggtcgtatactgtgcactacgagcgagggcaagcgcgtgcacggatgatacttgccaaggtattcatgttaacgtctttgttagatgacacttacgatgtgcatgcaactttggaggaggccagggagctcaacaaggctattcaaagatgggatgagagtgatgtttctcttctacccgagtacctaaagaaattctttgtcaaggtgataagtaacttcagggagtttgaggatgagttggagtcacatgaaaagtatcgtaatgtttacaatattaaagggttccaaacattatccaaacattatctccaagaagcagaatggtttcatcatggctgcactccaagcttcaaagatcaagtgaatgtttctgtcataacggggggcgctcaggtactaagcattggtttgcttgttggcatgggtcatgaggcaaccagagaggcattcgagtgggccatcggtgacactgatgctatatgggcttgtggagaggtgtcacgtttcatggatgacatgtcagcgttcaagattatccttagaatggtaggaacaaaatggatgtcgccagttctgtggagtgctacatcaaggagcacaatgtccctagcgaggtcgccctggcaaggataaattccttggttcaagatgcatggaagaccataaatcaagcaccatttaagtaccctgctctattcccggttgtgcaacgagttaccagcctagcaaagagcatgacactgctgttcctcgataagagggatgcgtacacatacagcaaggactttcaaacgacactggagacccatttcgtaagacatattccgctctagtactaggctgtttatagagtggagttttaaataaaatgtgagctgccaggatagccttagaaagccaaattcatggtgtgtgtttcagtcagacatctaataatctttttgttttcgtctaccatatgtattattttttttcataaggtatccggaatctgtgttatgtctgatgttagaaacatatttatagaacaaaaaaaaaaaaaaagcatttcaccgcctaatcttcctgttgat

SEQ ID NO: 12988 - DNA, 1351 bp, Zea mays
gaaccttatcttcttccctgccaagaaaggccaaaggggaggagatgcggcgtcccgtgcacgccttaaaaacgagatccctggggtcaccactggtcaactgcgtcactgcgccgaatcactagaaaccccaacaaacggaatttcacacatccagcgagcaataccgcaccgcaggtaagatcaaagaggaggcgatggctggcggcgggcaggcggcgatttcgttcatgacgcggatggcgaaggtggcggcggggttgggcgtggcggcgtccgcagcctccacgtccttctacacggtggacggcggagagcgcgccgtcatcttcgatcgcgtccgcggcgtgctcccgcgtacgatgtcagagggcacccatttgctggtccccatccttcagaagcccttcattttcgacatccgcactcgccctcacagcttctcctccacctccggcaccaaggacctccagatggtcagcctcacgctccgcgttctgtcgcgacccgacgtcgaacacctcccggacatcttcacctccctcggcctcgagtacgacgagaaggtcctcccatccatcggcaacgaggtgctcaaggccgtcgtcgcgcagttcaacgccgaccagctcctcaccgagcgtccccacgtctccgcgctcgtccgcgaatcgctcaccaagcgcgcccgcgagttcaacatcgtcctcgacgacgtcgccatcacccacctagcctacgggcaggagttcgcgcaggccgtcgagaagaagcaggttgcgcagcaggaggccgagcgctccaggttcctcgtcgcgcgcgctgagcaggagaggcgcgctgctatcgtccgcgccgagggggagagcgagtccgcgcgccttatctccgaggccacgaccactgcgggcaacggcctgatcgagctcaggaggatcgaggcggccaaggagatcgcaagcgttctgtcgcgcacgcccaacgtctcctacatccccgccggcgacaatggccagatgctgctcgggcttaacgccgcccggtgaatggatcgtctttttccgcgcttcagaatgtcaggacgagatgaaactgttcttggtggggaggagggaaagtttgtttctgtagagcttctagaagtgttgctaagagtctgttttttattaatgaaatggctgggaagtctgtttgtgctcaatagagtgtttcttctgtgaaataaaactggtctatgagatggtgtggcgagctctttgctttgctttgctctctgcaattcagttgtatcccatacatgctgtctttatctctgaaataaaacttttcgagcgaaaaaaaaaaaaaaaaa

SEQ ID NO: 12989 - DNA, 1020 bp, Zea mays
  misc_feature (931)..(931): n is a, c, g, or t
  misc_feature (933)..(934): n is a, c, g, or t
cttccgaccgcccggcgccccctcccctgcaacaccacccaaacccaagcagagaagcaaagacacatttggctcactcactcacactcactcgctcatagattgtcctgtccgtccatcatctctagctagcagctacaagtgagagcagcaagcgacaccacaaccagaccaccaccaacgccgagctgtgagataggatgggcaagctgtggacgatcctcactcacctccactcccttgcagggccaacggtgatgctgctgtaccctctgtacgcgtccgtgcgggcgatggagagcccgtccaagctggacgacgagcagtggctcgcctactggatcctctactccttcgtcacgctcatggagatgctcctcgagtccctcatatactggatccccatctggtacgagctcaagctgctgttcatcgcgtggctcgtgctccccaacttcaggggcgccgccttcatctacgacaagttcgtgcgcgagcagctccggaagcacggcctcaccgccgccggctccgtcaagtcgtcgtcgccgtcgtccaaggacaaggacaagcccaagaacaagttcctcgccttcgtcacgcccaagaaggatcatgaagcttactgaagtgggttgcagtgatcccattcctggaccatgtcccggcaacctgtagctgtagtgcactccactagatttctgttgtgtttgttctcgacttgaaatagagcctgtacgatgtgtgtatggccattctgtatgtgtgagcatcaactctaacatggaatggagacaagtgccaactttcggtgcttatgatggtgggaacgggtggggggtatgtcaaaaaaaaaaaaaaaaaaaaaaaaaaaaatttttaaaaaaaaaaaaattgaaaattaaaaaaaaaaaaaaaaattttcgaaccngnnaaccccgggggggggcccggaccccaattcccccaaaagggggccgaataacgcccgcccccgggccgccgtttaacaacgccggg

SEQ ID NO: 12990 - DNA, 1463 bp, Zea mays
actacaaaagaaaactaacgccctcccggcctcccctctcccctctcacccccgcctcctctattccaggagccgcctccttctagagggagagagggagggaccacagccgcggccgcaccggcgcacaccagctacaccgcccgaattcccgatcgataccggagctggacgtggcctagggtttccgagccaggccggcgctatggtgggctgctctaggggctccctccccacctggatgaccgccgccgccgcgcgggtcgacctctcgggcggcgtaacgccttcgcaccagggcccatcctcttcgtccccctcctcgggtccctctccggccgcgggggcggaccaggagctcgggatgtacgagcgcgcgttctccgctgccggcgccgccttcgtctcagctatcatcgtcaaccctctagatgtcgccaagactagattgcaggcgcaggcggcaggggtgctgtacaaccagcctgcccagatggcggcgctcggccccgatgcgatcctgtctgaattccgatgctctccttcgtgcacacgtggtcttgtattaggaagtgagccagtttgtcctcctgactgcttccagtacaaggggacacttgatgtattcttgaaagtggttagacaggaggggttcgttagactatggagaggaacaaatgcaggcttagcattagctgtacccactgttgggatatacttgccttgttatgatatattccgcaactggattgaggatttcacaagaagtaatgctcctggcttgacaccatatgccccgctagtagcaggatctgttgcacgctcgttagcatgtattgcttgttctccaattgagctcgcaaggacgcgtatgcaggcatataaagagtttcgtcctggcgtaaagcctcctggaatgtggaaaaccttggttggtgttctctcaccacttccaagttcgagtcagaatgtacaaaattaccgtgttctgtggactggggtgggtgcacaacttgctcgagatgttcctttctctgctatatgctggtcaactcttgagcctatgcgaagaaaactacttggttttgttggagaagaaggcaatgcaggtagtgtattgggagtgaattttgctgctggttttgtagcaggcagtcttgctgctggtgctacatgccctctggatgttgcaaaaacaaggagacaaatagagaaggatactgagaaggcaatgaggatgactacaaggcaaacattagctgagatatggaggtctggaggcatgaaaggtctgttcgccggcgttggcccacgtgttgcacgcgctggtccatcggttggtattgtcatttccttctacgaggttgtcaagtacgctcttcatcaaaggcacacctcatgaccgagttttgttgatgagatggaagccctcccattttgtgaaggcatggtaggctagttac

SEQ ID NO: 12991 - DNA, 2286 bp, Zea mays
  misc_feature (235)..(235): n is a, c, g, or t
ggttttgttcattttcatcaccccactaatttcattttttatctattttcaatggccctgtttctaatcccattttttaaataagacgtgaaataagagaacgagatagaggtttatctcgtcgacccattcgttttcatccctagttgaagatttatgttattggaatacaagataaatgaatagttattttttatcaatttaatcgtttagattaaattgattggtacatgtnatttaataagatatcaaattgacaagtctgacttgtgagaatagaacagtcgtaggaattcaaaagcgtttttgttttgtcgaaaccgaagatggaaatcaacacacgacaacacaacctctccacacgagaaaaaggttgcctaccgccagcccggccgggctctagaaagcgacaccaaagtcttctccctctccctcccgcggttccgcccgccacgcctcctctattccaggagtcttctagaggtgaagagggaccacaggtccacagccgcggcagcaccgccacctacgccggcagaatccttgatcgagacaggagcggacgtggcctagggtttctgagccaggccggcgccatggtgggctgctctaggggctccctccccacctggatgaccgccgccgccgcgcgggtcgacctctctggcggcgtaacgccttcgcaccagggctcgccctctccacctcactcctcctcgggtcccgctccggccgcgggggcggaccagcagcttgggttgttcgagcgcgcgctctccgccgccggcgccgccttcgtctcagctatcatcgtcaaccctctcgatgttgccaagacgaggctgcaggctcaggccgcaggggtgctgtaccaccagcctgcccagatggcggcgctcggccccgatgcaatcctgtctgaattcagatgttctccttcatgcacacgtggtctcttactaggaagtgagccagtttgtcctcctgattgcttccagtacaagggaacacttgatgtattcttgaaagtggttagacaggagggtttcagtagactatggagaggaacaaatgcaggcttagcattagctgtacccactgttgggatatacttgccttgttatgatatattccgcaacggcattgaggatttcacaagaagtaatgctcctggcttgacaccatatgccccactagtagcaggatcagttgcacgttcgttagcatgcattgcttgttctccaattgagttggcaaggacgcgtatgcaggcatataaagagtttcgtcctggattaaagcctcctggaatgtggaaaaccttggttggtgttctcccaccacttgcaggttctagtcagaatgtacaaaattatcgtgttctgtggactggggtgggtgcacaactggctcgagatgttcctttctccgctatatgctggtcaactcttgagcctattcgaagacaactgcttggtcttcttggagaagacggcaatgcagccagtgtattgggtgcaaattttgctgctggttttgtagcaggcagtcttgctgctggtgctacatgcccgttggatgttgcaaaaacaaggagacagatagagaaggatactgaaaaggcaatgaggatgactacaaggcaaacgttaactgagatatggaggtctggaggcttgaaagggctgttcaccggcgtcggcccacgtgttgcacgtgctggtccatcagttggtatcgtcgtttccttctacgaggttgtcaagtatgctattcatcaaaggcacacctcatgatccagtttttagttgaaaaagggatggaagccctttcactttgtaaaaacaacaccgaccccggtttccgaaagtaggcctcgttactctgaccttttggacggtcagggctaggtgtaacatcagagtgctcaacagtcgactcaacagcctttttcgtcgacaatgtccatctcggtggaggataacatatcagttttgcctggcaggttttggatcattgcctaatcttatgtttgggcggatctgaagctgctttgtttaacttgttaggtagtctctgtaattgaaggtgtagtagcgcatacgctgatcaaataataataccctcggaactacagaagaaatcttgcacatcctagtctgatgctttctcccaaccatgtcttagtttcaagtttgcaactaggttattttgtcggttagatgttatatgcgtgtacgatcgttgttcaacaaagtttatattgcttaaagaagcgtttgcagc

SEQ ID NO: 12992 - DNA, 1319 bp, Zea mays
  misc_feature (1)..(1): n is a, c, g, or t
ngtttttcgccccttgggggggaggaggcccccctttttaaaagaggggggcgttgtttcaccaaaggggggcaaccccccccgcccccttgtgtgggggtgtattttttgttgaattataaaagggggattttgtgggggattttggcgctcttatggttgaaaaaaaaaaagggagggtggttttccgagaaaaatttttggggcgggggtttttttacccaaaaagtttttaagggggggtaagaaattttcctcatttcgccacatttgaggggtgtgggccacaactgtgttgggggaaaaggggcggattcgggggggggggggcccttttttccggttatttttaccgcccacacctcggggagaaaaaagggggggaattgcctctcccaaaagggcggaatttaaagttgggggtaacccccccaggggttttttccccgatgccaccgaccgtttgtaaaaaacgggcgggcccaggggagcgggggggttaatatcggcctcccctaataagggcggaattggggttcccgggcccccccctagagggttcggcggggggcggtttgcttttttttttttttttttttgataaattaaaaggcgtgacgtgtgcagttcaaaaatcgctacaaaacgtgctcctcggcaacagagtaatagcaaagaaaccgatcccaagtgggcacaataaatcccaggattgaattccaccagaaacacggaacatccacaggcagaatacacacacaccgtctgatcccgtcaacattgacagagagaaataaaaaactagggcgacatattatgctctgacaaagctagaatagcacgatagcattccaggctcaatccagttccagctctctctctctctccctcgcatagaaagctagtagtttcacttgtcgccgtgtcgaatccgtcggtcggcccctctcactctcagaagcaggcgtccaggaggcagcagcagcagagggcagccaagcatccctccatgaaggaaggcccgctgctctgctgctgctgtggaggcggcggctgcgcgtactgcggcgggtagccctgcggagggtagccctgcgccggcggggggtagccggccggcgggtaccccgctggcgggtagccgtccttgcccgggtagccttgctgcggcgggacgccgacggggggctgctgcccgtagtagctcatctccctcttcttccttgcgatcggatgcgcggagagggttaggggagctttcgcgctccgccccccccggtgtgggggccggacgcggggcggacgctgggtcgaccggg

SEQ ID NO: 12993 - DNA, 916 bp, Zea mays
gcttttttttttttttttgataaattaaaaggcgtgacgtgtgcagttcaaaaatcgcaacaaaacgtgctcctcggcaacagagtaatggcaaatttttttttttttttttgggcacaataaatcccaggattgaattccaccagaaacacggaacatccacaggcagaatacacacacaccgtctgatcccgtcaacattgacagagagaaataaaaaactagggcgacatattatgctctgacaaagctagaatagcacgatagcattccaggctcaatccagttccagctctctctctctctccctcgcatagaaagctagtagtttcacttgtcgccgtgtcgaatccgtcggtcggcccctctcactctcagaagcaggcgtccaggaggcagcagcagcagagggcagccaagcatccctccatgaaggaaggcccgctgctctgctgctgctgtggaggcggcggctgcgcgtactgcggcgggtagccctgcggagggtagccctgcgccggcggggggtagccggccggcgggtaccccgctggcgggtagccgtccttgcccgggtagccttgctgcggcgggacgccgacggggggctgctgcccgtagtagctcatctccctcttcttccttgcgatcggatgcgcggagagggttaggggagctttcgctgcttcgggttgtgggggtgttgggggcgtgacgggaatacggatggacggtggacgggtctgtcaggtcaggtggttttatggaattttcgatgcctcgtggttccctcctggtgttttccggctggtcctccggcgaaccgcgtcgtcaacgtggtgctggccccagggcatgcctggtcccttaagacaaaagaactcgagcaacccggccggcctcgaggtacccaatg

SEQ ID NO: 12994 - DNA, 879 bp, Zea mays
aatacattccatgggccagcccatgcgcattcatcgctttgtacgctagtggtatggagttggtgcgtgcgtgcaccagtcaagccctggtcctctctcggtcgtcgtcgtcttcttcttcttcttattccccttcctccacagcacggcacgcgcacacgctgagtccaggatcatggcggcgggcctcaaggtccccgagatggcgctcaggctctgcgtcgtcccgctctccttggcctccctgtgggagatggccaccaacgcgcaggcagacgacacctacggggaggtcaagttctccgatctctccggattcagctatttggttggcgtcaacgccgtcacagccgcctacgctgtagcctccgtcttggcgtcgtccttcaagcggcccctcgccgcgcgctacgactgggtggttctcgtcatggatcaggcgtcggcatacctgctggtgacgtcggcctcggcggcggcggagctgctgcagctggcgcggcacggcgaccggggcgtgtcgtggggcgaggcgtgctcctacttcggccggttctgcgggaaggccacggtgtcgctggcgctgcacgccgccgcgctggcctgcttcgccgcgctctcactcgtctccgccttcagggtgttcagcagcaggtgccacccgccgcctgacgctgacggccagccgcccaagcacgcacgggacgaggagcaacgggtgtagcactactgacggcaaggcgtgtctccattccattgccaaacaaataacatcctgctcccctgtgtattactactgccgtctaccaaggccatcggtgatctttccacaggcccaacccacatctataatctattagtcgtcttcaaaccattagt

SEQ ID NO: 12995 - DNA, 1199 bp, Zea mays
cttgggtaccccccgcgccggccgcaaccacactgatccaccaccctccctctagttgagatactgccgccgccgccgccccgcccaacgccaggtgccgaggccttcgccggcgaagagcgccgaccggtacgagatcgaggaagacggccatgttctcatccgcccgccttgccctacgccgagctgcctctcttggggcgggcctctgccgcgccgcggaggatcccttttcgcgaaggtttctccatgggcagctcctcccacgttcctttgcctcagatgcatcgggacacaacaggggtttcccaccttctgggtctggagttgttgcagatacggatccacgtcagaattttaacagatctggttttgtgtctcaagatattcgtgctaagacacaggtcaacttcaacaacacagataatggagcggcgatgtctgggacaccccgtggccagaaccctttcagctcaagggagggcttcacagtcaacctccgcacctttgccatggaccacgaacagtattccaagaagagagctttcgtccacgtcctactgaagagaaagaagaccttcgtgacggtgacagactccagcgggaacaaaaagacgggtgcctccgccggctgcttggaggacaggaaaggacggtcccgtctctcccgatacgcttccgaagcggtcgcggagcaggtcggacggtccgccaggaagatggggttgagctccatcgtcatgaaggtgaaaggggcttcgttcttcaagaagaagaagaaggtgatcctgagcttcagagaagggttccgaggcgaaagggtgagggaccaatctcctatcatgtacatccacgacgtgacccagcttcctcacaatgggtgccggctccccaagcagcgccgggtgtagtttcggagtggactggaactagagctgggtttaaagaaagaaccggggaagtgtcggaggtgattttcggaaacttaacgtaatcgttgtgttgttggcctagttgatgtaataatatggacatgtgttttgggcaaatctacccttgttcttgtattgtatggaagcaacttactcgctcgatgagttatagacaattctgcgtaataatgctgttgagttctgaaatgtctgccgcggtatgatatgagatcttgcattgagacctcacctctcaaggtttgttct

SEQ ID NO: 12996 - DNA, 1090 bp, Zea mays
  misc_feature (46)..(46): n is a, c, g, or t
ttttttttttttttttgctgaacaatcagttgaaatggaggcctantttaacactctctgaactcttccgtctccggcagctaaaaccgccacgcttatcgtcgctgagcaagaccggcctaaacgtcgaggcatgtcccaggcaacttggtaattacaggtttctgggcagatgacggcttacgcatacaaggttctcgctgagtgaatacaccgctggaccggatgagtttgttcaggtttccttgctcttgcccttcttggacttggacgacttcttgtcgtggttcttggacccaaggctgttcacccaggcgtagtcgctgggcaccgtgaaggggtcggcgttgtccgcgacctgcgacaggttcacggccttcggtctcgagttcttcgagccccacctcaggtacgagctgctcttttgggcgtcgggcttcgccgtgatgctccctggccctgggctcgccagcaggctggggctcgacatcggggtgaagaactcctctggctccgtgaggggcacgaacttggtgaaagtgatgaccaccctcactgtcggcaccactgggattgcaacctttacagggaaagtccctggtgggaacttggtggtgagcagctcgcggagccggcgcacggcgcgcacgcggctggccaggatgtccagcagcggcaggaattcgtcgacgctcagggggaagtcctccgtcagccacaccgacggccgcagtgtcttaatcgtctcctcctccttccacttggctccacccgtcgtcgtcgtcgtagctgggtgccgggcgaagatgccgtcctcgccgcgccccaccgacgcgcacgccggcagtcgccgcggcacgtccacgctgttcctccgcctctgcggggttcccaagtgcgacggcggccccgccacgctgcgccggccgggaacgtagcagctgcgccgcgctgggggcggcgggatgtcagcgacaaggaagtcgccgtcctcgtcgtcgtcccggatctccagtggcaggaactcgtcgtcgtcttcgtcgccgtccatcgtctccagcgagctcgaaggtgagatccttgccgaatc

SEQ ID NO: 12997 - DNA, 2789 bp, Zea mays
  misc_feature (1914)..(1914): n is a, c, g, or t
  misc_feature (2032)..(2032): n is a, c, g, or t
cattgggcccctgcgtgtgtctcgcccggcgtctttcccctcctctccgtctatttccaagctttctccagatcaaatcagaaaggggaagggaagaacggcccagcaatgccgctctgcagcttctacgcctccacctccgttcccgtcgtcaagccccagcagtccgtcgcctcgtccaagccccccaccacggcggtggcctccgtggcgacaactgtgccgatgcgcagtgcagcgacggtgacgccagccgtggccacaacaacgagcctagcgctgtctctgcacctgccggagctgccgtcgcaggtgaaggacaagatcctgagcctggagctgatgggcgtggactatgggcgcgcgctggagcagaacccggcgctccgcgacgcggcgccggagtccatccacgcggtggtgtcgttcctccagtcccgcgggctccagttcaaggacctgggccgcgtcttcggcatgtgcccgtccgtgctgaccgccagcgtccgcgccgacctccgccccgtgttcgccttcctctccgcggacctgggcgtgccggagtcggcgcaccggcgcgtggtgatcaagtgcccgcgcgtgctggcctgcagcgtccgcgaccagctccgccccgcgctcatctacctccgccgcctgggcttccgggacagccgcgcgctggcgctgcaggacccgatcctcctcgtctccagcgtggagcgcaccctggcgccgaagctggagtacctggccgggctcggcatgtcccgcgacgacgcggtcgccatggtgctgcgctgcccggcgctcttcaccttcagcatcgagcggaactaccggcccaagttcgagtacctggtggacgccatgggcggcggcgtcgaggacgtcaaggccttcccgcagtacttcgccttcagcctcgagaagcggatcgcgccgcgccaccgcgccgcggaggacgccggcgtcgcgctgccgcttccggacatgctcaaggccaccgacgaggagttcagggagatgctcgacaaggagcgggagctgcacgagcaggcagcgacgacggactgatcgatcggggggctagtacagcggtttgcacctgatccgactctccgaagcatccaaccgccgtcttcgtggcgatcgagtgtcctggccatgacggtagccagcacatgtagtcatttgatttgagtaattagtagcctgtacatatatgcattgacattatttgctatagtcacgattcgtagctcatgagagaatatgcctgttctttctccattccaagtgaataagcacagagctggaagtcgtgtcttgtacacacgtgtaatgaatgaatgtaccaagttcattagatattatttgctctgagctgcacgcttgcgcaacacgtcttgtctcgtgtggttgtaattaatggtgtcaaaagctatggttgaaatccaaaggacaagcaaacaaatgctaatggagcatctccagtagacaaaaaaaagtttttcaagtcactaaaaagtgtagagccgcatgttggattttttcaaaccgtttccaatatctcgcctctaaggaaaaattcaagtgaagtttccttggcagcaggccagcagttcggtctccttcacgcgtggataggtcttggtccaatatgcttatgaactagtaaattactcgcgcctagcgcgagtctttgagcgatgtggttacagttacacaattctaaaagtacaatttggtaatatattaccaaaaatatattcaaattcgtcttttgagcggtgtggctatttttggtaatacatcatcaaactaataataacctttggtagcaaaggaaatagctgtcatggtgatcatgattgcagtataagttgaaaccttatcaccatgcaaaagtgntttacaaccaaataggtatgatccgattaataaatttgtagcatggaaatttaaagattagggtacaatatggcaatacaactgcgcaacatgcaacatgaatatgtggaaaaataanattaggtgcattaaggcagaggcaaacctcctcttttatatctaacttgtctgaagtcgactctttaaccaaggagcaaatgcatccaactgaattttcacaagaaaatatctggcaaagaattttctcatagcatattcgtgaacttcactgtaaaaagggtttattgaagtcattatgtaggaaacttagagcaggttggaaatgtaaattacaagaaaaaaaggacaagacgataagattcatttgtgcaaaagacttcgacttttatagaatgttgttgaatcagcacggccagtttcctagaaagagcatagtaagatgtctagaaaagagaagaaaatgggagggtggggggaatctgcatggaatatacatgtatgtattcttctacgctttctggcaagatacaatcaaccacctttaaaagagcaaatgcttgaatcagtccaggtgataagcagtgtaacattgcttaaagctataggctgtcacatttgaactttgtatgctagtcaaatggtcatacccgttcaacgtcactcttatcaagacccattctgaatgccattgttgcaacaacctttagtcacagggaggaagacaacaatggtgagacatcaacacatgtgtaatacatttgataaaataggttctgacaaagagcttccattaccactcttattttgttagagcaaaaaagcttatgtacacggttcctattcttcttaagaagtccattgtggtacctctgcag

SEQ ID NO: 12998 - DNA, 1782 bp, Zea mays
ttttttttttttttttgtgcaaaagacttcgacttttatagaatgttgttgaatcagcacggccagtttcctagaaagagcatagtaagatgtctagaaaagagaagaaaatgggagggtggggggaatctgcatggaatatacatgtatatattcttctacgctttctggcaagatacaatgaaccacctttaaaagagcaaatgcttgaatcagtccacgtgataagcagtgtaacattgcttaaagctataggctgtcacatttgaactttgtatgctagtcaaatggtcatacccgttcaacgtcactcttatcaagacccattctgaatgccattgttgcaacaaccactcttattttgttagagcaaaaaagcttatgtacacggttcctattcttcttaagaagtccattgtggtacctttattgtcctcggagtcgaatttgctagaaattagagatgttttcattaagtgtgtgggaccatccatggagtatatttccttattattaaagcagaaccgaaatctcctcctgttgttggagttgaagctgtaggaaattagaaatggtttagttcaacgcgatgggccgacttgcagaaattgctagaaaaaataggctagtaagcagtaagcgatgtaaataaatgaatctataaagaaaaatgtatatcctaaagacatgcacatgcaagaaatagtaacaacttttattggaacacacaatcttaagataaacctcatgtcaaagttgtatatagccatgagatgtgtacccatgtcaacatgtatggtttacaatttatgtaggcaccagaacttcaatgtgaactgtccctaaagaccttacactaataaaatctttcacacacgcacacatgaagtcttgtgtgaatagtttgataatagagaagaagcgcaacattaataaactgcaattgataatatataatatcaccaaactgtaaatctgcttccctccaagttcatctccgcctggatatacatattgttgactgagaatatatctgtacaaagtccatctttcggatgtaaaactacttcagccaaaccagaattcttctacaactggttggaggagtatcaagaaccagcacatttcttataaagtattagccctgctcatgtgcatacacgacactcaactactcaattttccaccttcattctgttgtggttagggaatggtgatccaaatgggaatggcctttttttgctcaatttggctctatcttgtatagtctattgctagcaatttctgcaactgtgttttttctttgcatttactgcccacgctctgttttttctactacagacatcacatgaacgaaacggaaagtgaagtgtagcagaatatggaaggcataaaaactgaaagaaccatccttgggttggactctctcaagcgatggccggacactgacgtgacgtgtcactatcctcgacgaagatataataaatcgaattactgggatctggccgtctggctgctggtgttcgtcggcagctatggcgccatgcggttgctgcccgttggtgtggcctgcgctgcgggtggccggtagctggcagccggagtgctggacgccggtggctggcagcctgggatctgcccggtggccggctcctacctcggtggctcggtacctgcgctggtggccggacggcgcttggacttggacgcagccacgcaggacgtttgatgcctactgcctaggttttttcgattaggatgttctaggtaatggtatcgtgc

SEQ ID NO: 12999 - DNA, 2847 bp, Zea mays
cgtcgatcgtcgagggtcaaaagtcaaaacctagttccattttgcaacgcgtggtgttcccttgctcggccggccgtacaagagaaaccaagaagtagaggggctcagattttacagctgtgacggggtgactggacacaggactcgaccgccgccgccacgtcacgggcacatgcatcccccatggcacaacccgttccgttcagaccacccacccccacagactgttcatacaggtgggctccacgcctccacccggcacccacccaccggtccctctcctctctctccccctctcgcgaaacgcctcgtatttatataccccttctctctcccacccagcgtccaaccaagcagagcaaagagagagagtcgcggagccaccgcgttccctagagagacgcggagagccagggcaaggcagctgtcgccgcagcgacgatgtggagctcgggctctgaccgcgacgaggccgtagacacggcgaacgcctcgtcagtcgacgcttcgtcgcccgcgcggcagccgtccacgccgcccccgccgcctcggcgccggcgccagcgcgcgcgacgccgcgctcaccgcctccgtgccaggaacacgggcgcaggagcggaggaggagggactcgtggaggcggacgcggacgcggacgacgtctggcgcgggctgcagcagcagcgggagcgggaggcgtggctgcggcgggcgtcgaggcccgtggtggtggtcgccggcgaggaggggtcccctccggacgcctccgccggctcgggggagagcggcggggtggggagggcgcggagcctgaccgacgacgacctggaggagctcaaggggtgcgtggatctggggttcggcttcagctaccgcgagatccccgagctgtgccgcccccggccggccctcgacctctgctactccatgagccagcgcttcctggacgagcaccaccaccagcagctgggcaaggcggaggaggcgccgccgctcgctccggcctcgccggcgcagccggccgccaccaccaactggaagatctccagccctggtaattacctgcccttggttcgcgatgggacatgtcaaatctgttcgacatataatagatctaatgtatatgcccaatatgtgacgctgcaggcgacagcccggacgaggtgaaggcgaggctcaagtactgggcgcaggcggtggcgtgcaccgtcaggctctgcagctagctgatcaacggcgtggcagtggcggtggcggtggcggtggcgccaccatcaatcaatcttggcacaagagatgagagttgagacgagcacgcaagaagggaaatccattccgtctccgcccagccagcacagggcatctggtggtcggcatacaggcaggaaccgtggcaccaccgccggaccaaccagccagccagccgtcaaagttcaacgtaaacgaacacagacaggagcatcgtcccattcccatacatgcgctccatccagatcaagatggcctggactagcatcgtagcgtcaccatggccagcattcatccgtcaggagcacacaggagtcgtgaattcgaatttcgctccaagattttgcttgagatatgtggtagggacggaaggaggagggagaatcgcgtagttaattccatgccgtcctttatgttttttttttttttgtctctgttcaagctttgacatgatacaatctgccggctagctgccaccaccttgcctttgccttcaccggggaggcttaatggaccgaatcaacggagaatgcgtctaaagaacatgtccatcatcactttggtcctgatcatgagccagctgtatcatacaggtgttcttgcttttggcgaaagttttattttttttagtccaggtgtgtgtgaatgggccaggcgtctccggactctccggctagacattcttttaatctgagatctgcaggcttggctactacagctcgccagtgcaggagcttgcctgactggcctgctctgttcgggaaagttgtgtggccagaatcagaatagatagaccgccgcactgcgataactgctcctccatgtgcacatttaactctgcaacctgattatcaataaaaaaaaatccatagttaactgtggctatactttggacagatggcatcacatgtcatgtgtaaaatgtccaaatgtaatagtatgcttatatatgatcttatatatgatctggccatttgcaaaaaaaaaaaaacatttacacacaatatatgtgttgtcatttgtgcatgttccttggagagacgagagctgggatggttatggtcagtcacctgctccatggggcagagaacaacaatgtcatagcatttggttaggagtaatgggcggccatccaaggttgaatacacatcatctaccgctacccacaggtggcactgctcataccaggctgccttgtttctgttttcgtggaagcttggacctgattgtcagctagctcaaaaggcgcgtggaaaggtatccaggcttgggtcgtccaatgctgacagacagaagtagaatacgtggctggggcgatgatgaaaacgacatctttgacgatcgcgtactgtatcagtatgagatcaatgcgtgatttcatcgagttggaggcatgcgtcccggtgaataggacgttccgcaagtagtactagagtatgagagctgcttcaagagagttggtagatggatcatcaatagagcaacagggaccccatccctgatttcacaaggagaattcctctattagaatgtctccagtggttcgtgtaaaacaggagacacgaaacgatagatgatgacattgtttgtagagtgaag

SEQ ID NO: 13000 - DNA, 1372 bp, Zea mays
ggccggggtccacctagcagagcaaagagagagagtcgcggagccaccgcgttccctagagagacgcggagagccagggcaaggcagctgtcgccgcagcgacgatgtggagctcgggctctgaccgcgacgaggccgtagacacggcgaacgcctcgtcagtcgacgcttcgtcgcccgcgcggcagccgtccacgccgcccccgccgcctcggcgccggcgccagcgcgcgcgacgccgcgctcaccgcctccgtgccaggaacacgggcgcaggagcggaggaggagggactcgtggaggcggacgcggacgcggacgacgtctggcgcgggctgcagcagcagcgggagcgggaggcgtggctgcggcgggcgtcgaggcccgtggtggtggtcgccggcgaggaggggtcccctccggacgcctccgccggctcgggggagagcggcggggtggggagggcgcggagcctgaccgacgacgacctggaggagctcaaggggtgcgtggatctggggttcggcttcagctaccgcgagatccccgagctgtgcggcacgctgccggccctcgacctctgctactccatgagccagcgcttcctggacgagcaccaccaccagcagctgggcaaggcggaggaggcgccgccgctcgctccggcctcgccggcgcagccggccgccaccaccaactggaagatctccagccctggcgacagcccggacgaggtgaaggcgaggctcaagtactgggcgcaggcggtggcgtgcaccgtcaggctctgcagctagctgatcaacggcgtggcagtggcggtggcggtggcggtggcgccaccatcaatcaatcttggcacaagagatgagagttgagacgagcacgcaagaagggaaatccattccgtctccgcccagccagcacagggcatctggtggtcggcatacaggcaggaaccgtggcaccaccgccggaccaaccagccagccagccgtcaaagttcaacgtaaacgaacacagacaggagcatcgtcccattcccatacatgcgctccatccagatcaagatggcctggactagcatcgtagcgtcaccatggccagcattcatccgtcaggagcacacaggagtcgtgaattcgaatttcgctccaagattttgcttgagatatgtggtagggacggaaggaggagggagaatcgcgtagttaattccatgccgtcctttatgttttttttttttttgtctctgttcaagctttgacatgatacaatctgccggctagctgccaccaccttgcctttgccttcaccggggaggcttaatggaccgaatcaacggagaatgcgtctaaagaacatgtccatc

SEQ ID NO: 13001 - DNA, 2260 bp, Zea mays
gggctcaagattttacagctgtgacggggtgactggacacaggactcgaccgccgccgccacgtcacgggcacatgcatcccccatggcacaacccgttccgttcagaccacccacccccacagactgttcatacaggtgggctccacgcctccacccggcacccacccaccggtccctctcctctctccccctctggcgaaacgcctcgtatttatataccccttctctctcccaccgagcgtccaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggcagccgtccacgccgcccccgccgcctcggcgccggcgccagcgcgcgcgacgccgcgctcaccgcctccgtgccaggaacacgggcgcaggagcggaggaggaggagggactcgtggaggccgacccggacgcggacgacgtctggcgcgggctgcagcagcagcgggagcgggaggcgtggctgcggcgggcgtcgaggcccgtggtggtggtcgccggcgaggaggggtcccctccggacgcctccgccggctcgggggagagcggcggggtggggagggcgcggagcctgaccgacgacgacctggaggagctcaaggggtgcgtggatctggggttcggcttcagctaccgcgagatccccgagctgtgcggcacgctgccggccctcgacctctgctactccatgagccagcgctttatggactagcagcgatcgcaccacctataccaccaccaccagtagctgggcaaggcggaggaggcgccgccgctcgctccggcctcgccggcgcagccggccgccaccaccaactggaagatctccagccctggtaattacttgctcttggttcgcgatgggacatgtcaaatctctccccggcgcagccggccgccaccaccaactggaagatcgccagccctggcgacagcccggacgaggtgaaggcgaggctcaagtactgggcgcaggcggtggcgtgcaccgtcaggctctgcagctagctgatcaacggcgtggcggtggcggtggcggtggcgccaccatcaatcaatcttggcacaagagatgagacgagcacgaaagaagggaaatccattccgtctccgcccagccagcacatggcatctggtggtcggcatacaggcaggaaccgtggcaccaccgccggaccaaccaaccaacgccagccagccagccagccgtcaaagttcaacgtaaacgaacacagacaggagcatcccattcgcatccaatacatgcgctccatccagatcaagatggcctggactagcatcgtagcgtcaccatggccagcattcatccgtcaggagcacacaggagtcgtgaattcgaatttcgctccaagatttcgcttgagatatgtggcagggacggaaggaggagggagatagccattgtctgacgttgtactctactcacacgattatctgattctcgccttaatttttgctcttgtaaaacatcacctgtgtaaaatatacatactcatgagtcctgaagcaatcgcgtagttaattccggcccgccctttttgtttttttttggtctctgttcaagctttgacatgatacaatctgccggctagctgccaccgccttgcctttgccttcaccggggaggcttaatggaccgaatcaacggagaatgcgtctaaagaacacgtccatcatcactttggtcctgatcatgagccagctgtatcatacaggtgttcttgcttttggcgaaagttttattttttttagtccaggtgtgtgtgaatgggccaggcgtctccggactctccggctagacattcttttaatctgagatctgcaggcttggctactacagctcgccagtgcaggagcttgcctgactggcctgctctgttcgggaaagttgtgtggccagaatcagaatagatagaccgccgcactgcgataactgctcctccatgtgcacatttaactctgcaacctgattatcaataaaaaaaaatccatagtcaactgtggctatactttggacagatggcatcacatgtcatgtgtaaaatgtccaaatgtaatagtatgcttatatatgatcttatatatgatctggccatttgc

SEQ ID NO: 13002 - DNA, 3692 bp, Zea mays
ggcagtgtggaggctctcaacccagtagctagcaggaacgaatggctgaaataacaaggagcgcatgattttgttagtagttggaggaagtcgggtcaagagatgaggactagagcgaatattctaaagacttgtcgcatgggcgtggaggttgatgacaatggcctcgtatgccaaatgggggtcaatccactaggggctttgggggagggttgaggcagggagaactgatggtactcagcctcgacaagttgccaggcgagagcatccgccgtggtgcatttgtgctttcaggcgagggctgcaacccgttcctgctcgcctgcagcaaactcaacatccgaaggcgggaaaggggtcagcggaggcgtgaaagacggggaggaccagaacgagacacctgtgacggttggagtcatgcccattccgacaccagcatctagaccggccaggggcacactggcggcacccatgctggcagctgcgaggctcgctcctaggctagccacgcttaggccgagggtagccaggccctggccctggccggcaaagccctaggaaagggcggctgggccgccgacgctttgactgtcacccgcgggagcaggggctggcgtgccctagatgggaggtagagggagagcgtggcctagtcggcggtggcaagcaggctctgacggcagctgctgtgatggaggaggggcggcggtgggaagaggaggggccacgaccactaacacccagcggtgggggagtagagaagggaggagaggaggagagctggatggagggggaggagcgccggccatggcgcttgggccaccggaggctaccatgttggagaaataaaaccccttatccattgattttgggctgcagtagtacatatacccagcactagtgggttacatgagctgggctctaggctcataatacttaaacacacacaaacagtacaggaactttggctagataccatgttggagaaataaaaccccttatccattgattttgggctgcagtagtacatatacccagcactagtgggttacatgagctgggctctaggctcataatacttaaacacacacaaacagtacaaggagtctaacaatctttataattaatcgactcttttcagggcctcacttgtggaagtcagaatctacctgcagaaacatgtccgaagcaaggaacttcatcttctggtgagcatgctgtagcctgaagtgtctgtttgcaggccatcttttcatctcagcagcctgaaaactcttataaatgtgcaactgcaggtcaagcaggaccctccgcgtcggccgggagtgattacaccatacaacaaaaattggtatttagcttaaatgggaaagagcttgaccagggctgttacctctatatgcagtcagatcctgcaggatcatatcaatgcaggggtctgagataattctggacatgcagttgtggcgcagtgtacatgacataactttcaaagctgctaatccagaagcaaatagaacagctgctaacccagaagcaaatgattctcctaggcattcctctactgcaatgtcatcaataaatgagaatacaactgggtttacatggcagatgctcccattcttttctagtatgttgcttggtaaacttccttgcaaacttgacagatcaggtgcttcgtatgacatattgtttatgttacacattttagagggattaaacaggtattcctttcacctcgtgtctgatgagagaaaccgttcttttgcccatggaaggataactaaccttgatgatctgaaggctgaagttttctcgattcctcagcaagagtttgtcagcgccaaattaacagataaattggagcaacaaatgcatgatccattagtttcaaggtcttgctgcctgcctttatggtgcattgaactgatgtctgcatgtcctttcttattttcatttgaggcgagatggaagtatttccagttgacggcatttggttctttgaaaaatcatcatggccacatgatggatgcaagtgttaacagtgttgcggaaagggggtcttcccactcacggaaaaagttcaaagttgatcgtgatgatatactggtttcagcagcaaaaatgatgaagtcccatgctaagagcaatgctctacttgaagtagaatataaagaggaagtgggcactggtttaggtcctacaatggaattctatacattgataagtcatgaatttcagaagtctggtctaggcatgtggagaggggaacttccttgtaaatctggtacccatgatactcatgtttctagatttgtggttgcctctaatggacttttccctagaccttggtctgcttctgaagatcctgcttcctttcaagaagtgagcgagcgattccacttacttggtctggttgttgcaaaagcaattaaagacaacagaattcttgacattccattttctaaagcattctacaaacttatccttggacaggagcttaatatatatgatatccagtcattagattctgaactggccatatgccttgtggagtttcaagcgcttgcttgtcagagaaaatatgcagagtccaatttgacaagggactgccagatatcagatttgacttatcggggttgtagaattgaggatcttgctattgagttcgctctcccaggatatccagaatatgtgctctcgccaggaagtcgctctgactgtttgaatgctgagaatttggaagaatatgttcgtcatgttgttgacgcaacggttaaaagtggaattgcaagacagatggaagcttttaagtcaggatttaatgaggtatttccgctaaaaaaactccaggttttttcagaggacgaactagagagattactttgtggtgaacaagatacatgggatgtatgcatctatcttctgttggcatctgttcatgttttgttattattttattctggttgctgatttcttggtctgaacagtttgcgaaacttgtggatcacatcaaatttgatcatggctacacttccagcagccctcctgtcattaatttgctggaaatcatacaagagtttggatccattcaacgtagagctttcttgcaatttataacgggttcacctcggcttccaccaggcggcttggctgcactaaatccaaagttcacagttgttcgaaagaataacagcaatgatgttgatcatgacctgccgagcgtgatgacttgtgccaactatcttaagttacctccatactcttcaaaggaaaagatgagagagaaactcctctatgcaattacagagggccagggatccttccacctatcttaaccaataagcgataatgatacttcgcatgcaacaggagtttctctttgtaagtatctcgtaggaaaggaaaacacggtgtaaatgtgggtggttcactgcttattttagctgacagcacgatctggtggagctgattttaggagagaaaaaaacggctaccgctctttgtacatactaggtttcaggtgtgatcaagcagatcactagtgtgcctagttcgctactcttttgttcaaactttcggtgtacatatgcgtgcctgcctgatagaagtgccagtgctatctttcattgttaaaaaaaaaaaaaaaaaaaaaaaaaaaaaaaaaaaactcgagaaagggccgcggtacc

SEQ ID NO: 13003 - DNA, 3308 bp, Zea mays
tccgctaaaaaaactccaggttttttcagaggacgagctagagagattactttgtggtgaacaagatacatgggatgtatgcatctatctcctgttggcatctgttcatgttttgttattattttattctggttgctgatttcttggtctgaacagtttgcgaaacttgtggatcacatcaaatttgatcatggctacacttccagcagccctcctgtcattaatgtaagttctctagacaagatattttgaattggcaatgtatgttgtgaaccgttaatggaggcctgctatttgaatctaaaatgcattgcagttgctggaaatcatacaagagtttggatccattcaacgtagagctttcttgcaatttataacgggttcacctcggcttccaccaggcggcttggctgcactaaatccaaagttcacagttgttcgaaaggtctgtttttgtcgtaaagctctcgtttatgtttcagttcgtttgaaccatcttttgctaacattgtgatgtaataataaacagaataacagcaatgatgttgatcatgacctgccgagcgtgatgacttgtgccaactatcttaagttacctccatactcttcaaaggtttgacctgtctgcgtatcctaacttagtggagtttactaggttaattttttcagtatcattaatggtttgagagatcgaaaggacattaggtggaatagattgagattggacttcttatatcatttgggagattgaaccaatattataaagttgtctgactaatcacgattagtcaggctgatcgatgccatggcgatcagctttgcactacgattagacacgattagttgagctgatcagtgccatggcaactaggattgattagacaatttgataacattggattgaacttcttataacaaacaaatcaggcgaaataaattgaaattaaacgtccatgttctcagggtatctcaacgtcaagatctctccctcccagccaacataaccaaaaacaataagcagccaacatagctaccaaaaaaaggctaaaaattatgcaagtcaagttttttttgtgttgattcatagtaaaaaagtgttttgaacgctgaacttctcactcagcaaatttccgcgcatttgatgtttagctatgctttgtttgtttcgacccatgaaagtttgcttgtttttcctgtaggaaaagatgagagagaaactcctctatgcaattacagagggccagggatccttccacctatcttaaccaataagcgataatgatacttcgcatgcaacaggagtttctctttgtaagtatctcgtaggaaaggaaagcacggtgtaaatgtgggtggttcactgcttattttagctgacagcacgatctggtggagctgattttaggagagaaaaaaacggctaccgctctttgtacatactaggtttcaggtgtgatcaagcagatcactagtgtgcctagttcgctactcttttgttcaaactttcggtgtacatatgcgtgcctgcctgatagaaagtgccagtgctatctttcattgttcgttggtgtttgccttcttaagcgtcgttgtgtgacttatggcgaaatatgtgcaaattatttgtggatttcatatgaacaatgtctgatccgagcgtgaggaatttgtgcttttggaataggacagtgccttttccttcggttccgaaaaaaaaaaaaaaatagtggcctgtcccttatcgtccctcatcgatcagacatttttcgtggcgattgctctgctatgttcctgttgttatctttggttctcaaaagtttcttgtgtgtgcgagaggtggcacacgaaggcaccagagaaccggtgagccgggtcgcttccagatgcagccaagtcctgcatccgtgccagtaccgtagccgttggcaacaaaagaagcctttgcgtgcaaataaatggctctgcccagaaccgcttttaaacaaaaaaggagttaggaatacaatatctgatctgaggaacaaaagaagctatagtttaattgtattcttctgtccaaggataatacgcttgtttgcagatgtcgcaactcctttcccttcaaaagcttcctttgattgatatctaatcagaaaccactgtctggtgtgatttttatagcccttttccgcttcttgagcggatctttcgggcaagtaaacccgttcattggctgtctaaaagcttcgcgagaaatgagtaacatgatgtctaggaaagctttggagctcataggctgttgtcgtcgtaccatgtgattaacagaagagctagcgacgcgtcactagcaaataggaaaagtgaacaactgtcaacttaatgagctccaaaatataagttttaccactcctaattgtaccacatggttctgcaactcagatggtctgccttttctagaactttcaatcagtataagaacacctcatgatacaatagaaattagttcttagatacgtcgtggtcgaggcactgcataagaaccgtgtacttttagggcttgttcggttattcccaacacacatggattggatgggattggaaaaaaatgagaagaaatttgacttgtttgggattcaaactcatccaatcccactcaatccacatggattgagagctaaccgaacaagcccttattgtttttaaactggatggactttatttatgtagttttatttgctgtaacgagctatgtattttcagaatgttttcctcgtttttgtattttatttgaattaaaaatcatgttttgttgtgtgtatgagtctgtaaaagaaaatctgacgtgacgctgatgaggttgtaagctgactataaatgttatgcactaagatcctatttatttcctcccaggattatataattcagcttatatattatataagtatctaatgtactgcttatggattatcataatctaggtacctagaatatataatccacataaaaatatatgttgtttgtttgtcatttaacttatttaagttggattatataatctagagagtaaataatcggggcctaaaaagttgtggtagataaataccggcaatagtggatacagattgatcgatagtgggtggcagtagatataggctagtgatattggatccaacctaagatttggatgtagaggaggtaagaaatactatcatgttgtgagtcttttatttaagttgtgataacgacagctataagacaaatttaggaaaaacagagaatcggaaacatccacacgcttaccctctaaaaagtaatgtatgcatcgatat

SEQ ID NO: 13004 - DNA, 685 bp, Zea mays
accacagcaaactgacaaaccgcagcaacagatccatttctgcggccagtgctctcctatctcctccattcccctcgtctcttcgccatggtcgccatctccgctcacctcatcgccactcttccgtctctcccgacactccggccctgtcctcgccggcttcagccgagcgccttcgctacatccgaggccccgcaccgagcccccgcccccggcgtcgccctccgtggctgcaggcgttgcagcccttccgtaagaagatttcatgggtttcagaatgcaataagctttgggaaggagcacaacaggcaagccctattcgcttcaggcagaggttctcctagctccagtgacgatggctcgagttctcctgatggcccacctgtcctgaccattctggcaggtgtcaccgtgttccttcttgtcctctgggtcgttggatcggtcgttacctggattgtgggcttggtctttggcgctgcgaaatcttagaaggtggatggtaggctaccaatcagttgtatatactttatttgtgttggaatcgttacattgaatagctgcatttgatgctcttttttttctgacggaaagtctcgtttatataattgcaattgccttttgtgccgttatctgtccgaggtactgctgggtttttattttttttcctcgtcctgaaaaaaaa

SEQ ID NO: 13005 - DNA, 2218 bp, Zea mays
tttctcctctgtgatggtggctacggcgaactggcagaggggtagctaggtcgcgaaggtaggaggataaggagggggaggcgagcccggccgtgctccctataaggtcgcggtcgtggtcaagcgcacaatggactgcgcgcggtctccgtgcccccgccatgcgcggtgaaatctgttgagggaggtgggagaagggagcgcgaggcgccctggctgacgcgcgggtccgacaagtcaatgactgcggcagcgacgttagcgcgggggagacggtggctgacgtgtggggccaggtagtcggcgcccggtgggcgcgcgcgtggagatttcatgactgggccgcgcgaagggaaaacgtgaattgggccggaaaggaggtagtcggcccatgtggctttctttttctttttctttttctttttctgatttcctttttctttgttatattttgggttttcaaatttgaattcaaattttatggtgagtttcacctttgagcaaatgaacaaatccaaatcttaatatagaaatgatatattttattatctatatttttattctatatattttttgccacatagtattcccttggtaaaataaaaaacccgtgcgaaaatgggttcccaaactagacctaatagctagtttgggaatcctaattttccaagggattttcatttttcaagtaaaattagttcgttttttcatgagaaaatagaaattccttaaaaaattggtgtttccaaactagtccttccatttcaaattacaagattataaaacttcattttaaaaaatatcaaacgacctcggacattgacatagcgtatatccaagttgtgtttgaccaaaaaaagtaatttaaaaccatctagagacccgaatgttggttttaaattctcagaatttaaaatccaactcttttcccacatgcaagtctgcaaatcgatgcaggcggccgcgcgagacacgcgggcgccccgtccagggcagcgtgcggtcaccctgttttctctcccgtccagcgccatcctctccaaatggcctccccgtgcccgccggcatccccccctcctcctccccttcacagcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgccaacccctaccgccgcggctgctccgccatcacgcgctgcgcccgcaacatgaactgagcccagcgctagctgctgccggggcgcgccgtcgtcgccgagccggtcggtctggtctggtctggtctgcctgcctgccaggtcacgcagcctggctccaccgatcgcacaccatacattgacgtcgtcgtcgcggccgtacgtgccgttggacggtggaggaggcggtggcgctacgacagtatatatatacacaattacacatacacaccccaaaaagaaaagaaaaaaactactgccattgctgtcgttgtgcgtagcttctctctatatatatacccgtatttaaattctcgacaaaatttgtttgaccacggtgatctgtcatatatgtcgtccattgatttgtgttaatttgacaaaagacgttgaaaagaagctgcactactctactgtgcatccgattttcttgtggcccgccttctcgcgttcccgaattcagaaatggatcaaaattaagaaatgacgtaggagctggcgaactgccatttctatttgcaaggctaaaagctgggcatctagttacaccacacggcccaattttattggtcaccgtgccggcggtgggctgagactatgggctaccatt

SEQ ID NO: 13006 - DNA, 484 bp, Zea mays
gtcttggtatgatgatttatttgaaaatatgattaggtagtagtttcaagtgctcaaggatgataagtcagagggttgaactgaagttgtggattggtggtgtatgccaaggtaccatcatgtcaaaagtagatcatttccccgtggtttacctcatttgagcgtgagcattggcagtgttacccaggtcccagtcacttcaaccacactcttctccttcatattgttaagcagtttcaccgttctcttttgtttagctcggcctccatagcctggagttctttctcctttttctttagatccttcttccttttgaagggaaaaacttttgatctcacatcctgtatattgtgatcagctctcggctccggagttcgtagccgcgatccgtggttggggggaggcgaggttttgcccctcagcacacccggccggtttggagaagagaaagagagattaggaaatagttctttgttgatttttt

SEQ ID NO: 13007 - DNA, 1062 bp, Zea mays
cccacgcgtccgcccacgcgtccgcccattcgaaaacttgcagctgcagttggcggcgtcatcgtcaaccgtcacataaaccaactcgatcgatcgcgtgcgactgcgagccgtccgtccgtcatggcggacgtgctggtgggctccgagcgccgtgtcctcatcagcggctacgggtacggccttcccccgcagcccccgcccccgccgccgccggcagagagccagctgctcggccgcctcgatcagatcgatctacggctgcggcagctggaggagcagcagcagcgccgcccgtcgcacgccgacccggccccggccccggcccgccgcgcgccggcggcgcagcaccagcacaccaagtccctgccggcggcgctgcaacacgtgcaggtgcggagcgacctcatggaccgcctcaacctgctggagtcccgcatcaggcagctcagcagcgagctggacctggacgtcggcggcaaggccgccggccacgccgcccaccagctggtgctggggacctcctcgtcggtgccgccggtcgaggaccccgccacgtggtccgacctcgcgccggtggcggtggtggacccggcccctgctgcggcgttcggcggcggcggcggcggcaacgagagcaagagcaagcccgcggcggcggcggccggcgggagctggagcgccgtggagatcccgccgcggggcgcgcgccagctccatcgcagcaccagcagcaagcctaacgcgcccaccaaggtgaagaaactgcaagaaacaaaatgcgcgtgccagaaggagaagaggaaggcggagcgcagcaagacgagcaggcggtggttcatggttggatgctgaagaagtggaagttggcagtaacacgcatggcgatgaactgatcttggtcgatcgtgtacaagccatatatatttttttgtattgtttttgtactctgctttgatctacttccgtccaccattagttgtaaagtattgtcatggaccatgaatgcagcatttttgtcgtctatcaaaaaaaaaaaaaaaaaaaaaaaaaaaaaaaaaa

SEQ ID NO: 13008 - DNA, 640 bp, Zea mays
cattgggtacctcgaggcccccgcccgggcggaagagaagccgcggttcaacgaacgtcggcggccattcacagccggccggcacctgcccccctgccccacggttcaacgaaagtcggcaggttcttccctccaggcaagataatagtagcacctttgagcactgctgctgaaaatgagctgcgccgaattgccacctgaaaccccagctgtgaacggagaagggtcatctgccgccaccgccgccgctcctggtgccgggtcgaagccgaaaaagaagatatgctgcgcgtgccctgatacaaagaggctgagggatgagtgcgtcgtcgagcacggtgagcctgcttgcaccaagtggatcgaagctcacaagcgatgcctccgtgctgaggggttcaatgtctgaaacttgtagtctgtcgggctcgctttcctagaaccgtaggaaatggaaacattagaaaaatagagttatcaaactagtcataataataccttaatgccaggagttatacggcaaggggaaatcacgatgtgaaaattatgttggcgatgaaacgtatttgagaatgagattgttgaattttattcgctaaaaaaaaaaaaaaaaaaaaacctagggccaaaaaaagcggcc

SEQ ID NO: 13009 - DNA, 2974 bp, Zea mays
tgcaggaggagcacgggacaggtcgtcgtcatcacacgcctgccgtctgatcgatcacagcgacgacgacgacgacgccggccggccggccatgcccatgcatcgtgcatcgatcgacggccagccggacgcaccgccggatccctgtcatatattcgtcccacccaatcggccggcagtcaaatatatgaagagatccatcgtcactgccactgctacatgcatgcgctggcagcagcagcagcagcagcactgccagcacagcgtcctgatcgatcgacaagacaggacggcaggcgggcgtgccgcgcgcggccgtgcccctactgcttcgccgcccgcgcccacctcgctcgttgcacgccctgccgacgcgtcagcccctagctacgagtagctcggtcacgcacctgcggcatgccagccatcctggacctctgtctgccgcgggccgcggcgtcatcgtcctccactccattggctgctgcttcacctggctagtagatagctagctgagctgacgacggccattatatatattgagcgcccgggaagcttcgtcgccgaacccatgtcgacgagcggcgcgaggtcgtggtcgccgccgccgcggccgagccggtacgagtcgcagaagcggcgggactggcagaccttcacgcggtacctgggcgcgcaccgcccgccgctggagctgtgccgctgcagcggcgcgcacgtgctcgagttcctgcgctacctcgaccgcttcggcaagacgcgcgttcacgcgccgtcctgcgcggcgtacggcggcggcggcggcggacggccggtggagcccgccgtggcgtgccagtgcccgctgcgccaggcgtggggcagcctcgacgcgctcgtcggccgcctccgcgccgctttcgaggagcgtcacggggcgcgtgggatctggacgtcgtcgcagcagcccgacggcggcgttggcgtcggcgtcggcgtcggtggcggcgacggcgccaaccccttcgccgcgcgcgccgtcagactgtacctgcgcgacgtccgcgacgcgcagtccagggcgcgcggcatctcctacagcaggaagaagaagaagaggagcaagcagctggtcgacggcgccgccgcagccgggtgcgcccgcccgcccgtgaccagcgtgacgttaatgcctgctgctgctctgccgcacgcaccgcctccaccatgtccgccgccgccgctgccgccgccgtactgcctcaccggtgtgcccttcgagttctgtgactatggcagcgtcctcggaggagttaccgccaacggtgcgcctggcttctacttgccatcgctgttcaacaccttcggctagctagggcatgctgcctgccatgtttgccgccatgcgtatccttgctttcggttgttcttgtgttcagacttcagagacgttattaattcatgccctagagtgtccttcctttcgcttggtgaatatggcatccaaataatataattaatttctctgttgacgacagcgcgctttccccctaatgattatctatatacatatatctttcaagtgattttttgatagtgcctagcacataaattagtgttcttgaatttgcatttcatggtgtttttagatttgaaccacagaccgcgcgcttcattcatagttctatttactttgcagctttttatgaaaaggtagtaggcaagaactacttgaaattcaagagctatatatgtttgaactcaagctagctaaatctttccactcagtgcttactgctcacatcgtcaagattggggaaaaggcagctcaaaaactaaactctgttgtgaacctgcctccatttaaaccagataagcagagctcgtaactataaatctaatttgcaacatagagatccacttttgaaaattgaaaattttagttttcaaatgagaagcgctacaaatttttagtagatatatatatatatatatatatatatagacacaagaaatagaaactaaaaaaattctctttgaagcgcctgacaccctatataaataatatcccccctagtaattagggtttcatattggtctcccacaacgccaatgtaaacttgttcgatgcggcttgctacggttttaattcggctgcgctacattgcagtacttcatttcactacttcatttttgagtagtatacataaaacaaaaaaccctctacaattttcaccacttcatttcactcctaccattgcactacattgtttgtgagtataaatagaacactatcttttttatcaccattcgtaatatcatatggaatattttgtctgctaaataaatttaaatgaaaaaagttaactacaaagttttaatcattgctaagctctataacttttgtataggatgtgcatccattcgatattgtttgcttttttaaaaaaaaattaaatacctttattaatcgaaaacaaatatttaaggctataaaaatcatttgaataaaaatttatcaacaacaaacttatagattcaaggtggttttgaagataatcatgtgagcatccaaggtggtatggaaattctaaattttgagtttcaaaatataaaaaacttaaaacacatatttggcctctaaagaacttgaaataaaaaaaccatatataaagttataggttttattgagagcaacaattttcgtgtatagtgtggcagcatccgaggccgttgatataatttgaatcctaaaaatttgaagaacctaaaaacaatattttaggactctaagtagtttctaaaattttaaaagttcccaactacaaagttagaaatcactttgaggactagaattttaatgtaaagtttttctttagcatcttactttgtaaaatgttacaaattatttttagatgtaatttttttatagagacggatctccaatctatgctaatcaatttcaagagatatatagattctttagaataataga

SEQ ID NO: 13010 - DNA, 1418 bp, Zea mays
attcagtgtagccagcaggtagctgcatcagctagctagctagatagacacttagacaggcataaaaccatctcgggcactcgttccctgcacaagtgtaggagagagctgaggcctgctggccatggacaccaccagcaagaaagcctacggggttgccgtcgtcatacagctcatctacaccggcatgtacgtcgtctccaaggcggcattcgaccatggcatgagcacctacgtgttcatcttctaccgccaggcggccgccactgcgctgttgctccccatagccattgtgcttgaaaggaagaatgcaccacccatgtcattcaggctgtttctgaagctgttcttctatgcattgcttggcaacacattgagcatgaatctgtacaacataagcctcaagtacacctctgcaacagtggcatcggcaacgagcaactctgtccctgtggtcaccttcttcctggcagtcctgttaaggctggaagtggttcggctgagaagcccgtcaggcatggcgaaggcggcgggcgtggcgctgtgcctggccggggtcctgaccatcgcgctgtacacggggccgtcgatgagcccggtgaaccaccaccgcgccttcgcgtcgcaccagcagcacccccatccccatgccgatggcggcggcggcggcaaggggacgtggatcaagggcacgttcctgatgctgctgtccaacacgacgtggtccctctggatcgtgctgcaggcgtcgctgctcaaggagtaccccaacaagctgttgtccacgctggtgcagtgcgcgctcagcaccgcccagtccttcctcctcgccgtcgccgtcgagcgggaccccgccgcctggaagctgcagctcgacgtcggcctcctcgccgtcgcctactccggtctggtggtgacgggcgtgtcgttctacctgcaggcgtggtgcatcgagaagcgcgggcccgtgttcctggccatgtccaacccgctgggcctgctgctcaccatcttctgctcctccttcttcctcggcgagatcgtgcgcctgggcagcctcctcggcagcggcctcctcgtcggagggctctacagcgtcctctggggcaagagcaaggaccacctccaccaggagcatcaagacgacgaagagaagcagcagcagcagccgagcgcagcaggcggagacaaccagaagcagctcaaggagcagttcgcaatggagccatcatcgccactgcgccatcagtccggatgatgaggaatggtctacgcgtgtatgtgtgtgagtaggttctacgtacgtgcctatatatgtcttaatgtctatgtggtgggtctgggcgtatccaactccgatgcacatggatggtctcttgttcgcccgaaaaaaaaaaaaaataaaaaaaaaaaaaaaa

SEQ ID NO: 13011 - DNA, 1538 bp, Zea mays
gtacccccgggctccgccgggatctccctcttgacccgcttctcccctctcccgatcgagtatgcaccacatactatgcattctccctttgctactcctatgcacgagacgcctacctagagcccgctcctcgcaacagagacatcgatcagctagctagctgctgccaagagctagccaggggacagagcagcagcttgaagttggtcaccaatgctaaggatgggccgcgccagcgccacagcaggtgtgttgcgcttcgtcagggcgttcgccctctgcgtggctacggcatgcctcctcctggcggccggcatgccctcgcctgtggcggcgcaggacccgtcgaagctgagcctgcagtactactccaagacgtgccccaacgtggagcacgtcgtccggacggagatggagtgcgcggtgcgcgccgacacgcgcaacgccgcgctcatgctccgcctccatttccatgactgcttcgtgcagggctgcgacgggtcggtgctgctcgacgacacggcaaccatgatcggagagaagcaggcggagcagaacgtcaactcgctgaaagggttcgatctggttgacaagatcaaggagaagctggaagccgagtgccctggaaccgtctcctgcgcagacctgctggcgattgcagctagggatgcggttgtgctggttggtgggccttactgggatgtcccagtaggaagactggactccaagaaggcgagcctggacctagcaaacagcgacatccctacggcccagcaaggcctcctcacgctcattgccaagttctgggagaagggccttgatgccactgacatggtggccctcgtcggatcccacacgatcggattcgctaggtgcgagaatttccgggacagaatctacggcgacttcgagatgacgtccaagtacaacccgtcgtccgaggcctacctgagcaagctgaaggaggtgtgcccgcgggacggcggcgacgacaacatcagcgccatggacagccacacctccgacgtgttcgacaacgcctacttcgagaccctcatcaagggcgagggcctgctcaactccgaccaggcgatgtggtccagcatcgcgggctactccacctccgacacagtcaacaagtactgggccgaccccgaggccttcttcaagcagttctccgactccatggtgaagatgggcaacatcaccaaccctgccggcggcgaggtcaggaagacctgcagatttgtcaacacataggatatgataatatatataggatgctcgagactgcaggagaaactcggtggttgtgattgtactttacgcctgcaccttctttcgatggcttgtttagggtggcttggaaaataaaaaacccctttgctgagactattgtattatacatatgtagcatattatatgttcttgtcactgttaaccatatatatggttggctatgtgaagatacatacacatctttgtctgaagaattctacgggtgatttggctgagatttaaaaaaaaaaaaaaaaaaa

SEQ ID NO: 13012 - DNA, 3437 bp, Zea mays
  misc_feature (304)..(304): n is a, c, g, or t
  misc_feature (404)..(404): n is a, c, g, or t
  misc_feature (410)..(410): n is a, c, g, or t
  misc_feature (3125)..(3125): n is a, c, g, or t
gaagaaggtttttgattactaggtatccattacagactacatctaaccaaacaattgtatggatatcgctttacatacgtaattgaatcacattacatttgatctaaccaaacgcctccatagtaccaaactgattatggttttgatagatactgtggttttactgcagtatataaaagtcatagtattcgtgacaagtgtaaactatagtatttgaaaactaactatagtatttgaaaactgtggttctgaaatactttggccgcaaacggggcctcagtcttctccagactccactactccnaaccggcaagcaccgatctcgtcacctcgactacgggaataaacgacgttcgacggaacgacgggactacgggagcaagtaaccagcgcacacgtacacntcccantacgcacacccaccgcccccaccgcctatttccccccactcgtggcaacctctgctctggccccccaaaccccacacacttcgcctcgccaaactttcccctcggcctccgcccgcacttccaccaccgcaccgcacctcgcagatgccccagtaggctccaaaaatccaaagccatccctccccaggcctcccatccatctccgggagatggcggccggcaccgtgacggcccgatccaacggcgagggccacggccacggcggcgcggggtcctggtacccgcagcgccgcccgcactacgggtacggcggggggtccgcctccttccgcggctgctgctgctgcctcttcctgctgctcaccttcctggcgctcctcgccctggccatcgcgctcgtcgtcgtgctcgtggtgaagccccgcaagccgcagttcgacctcgaccaggtgtccgtgcagtacctcctcgtggcctcgccgacgtccccggccggcctgccccccgcgaccccgggcgccgcctacatctccctcaacatcacgctgctcttcaccgcccagaaccccaacaaggtgggcatccggtacggcgccaccaagttcgacgtcatgtaccacggggtgccgctcggggtggcggcggtgcccgggttcgagcagcccgcgcacagcacccgcctgctccagacccgcgtcattgtcgaccgcttcaacgtgctccaggccgacgcgcaggacctcatccgcgacgccgcgatcaacgaccgcgtcgagctccgcatcaccggcgacgtcggcgcgaagatcctcgtgctcggcttctcctccccaaaagtgcaggtacgaatcgacacgccacccgcaacggggaccaacaacatccgttcgcttccgccgcaagtgtttttgccctacactaaaaacactcttccgcgggcgaaactgacgtaatgtgtgaacgagccccaatctgcaggtgtcggtggattgcgcaatcgccatcagcccgaggagccagtcgctgaaatacaagcagtgtggcgtggacgggataagcgtgtagtgtaggaaccccaagccgccgccgccgccgcagaagctgtattgcagtggagaagtgggtggatctgtgcgtcgattctaatttccctaatttgtggggtttgatttccttcttgtgcttaggtggtaaattttgagcacttacttttggaggaggccactgattctgtgaattattgctgcttgcaatcagcaatcagtaggtatcagtatgaccacggttatacatccatcgatcgccgtgaacaattgcttaggagctaagggaagtggtgggcgtcggttcgtctgtggttgtcttgtttcgtttcgtttcggagttgtgggtctgcgctgtctgccatgtccttgtctggcggctaatcttgttcacttcatcagttcatcagcccgtagttagtggtagaccggtagtggactagtggtgccggggagattgtgagggaaaagttagcgcgggagagcgtgggtggttgatatttctcactgacaagatagtggcggggtcaaaccgtcaaaattttactgcaatttacgactcgtgacggggcaaaacggagtttgtaatgcggactttgtgtaggccgtcgcgtgacccgtgtggtctacactacacatctcctatgtcaggtcgggaagttgtatatatatgtcttcaaatcttagttcgcgcacatgccctggcgtgttttttgcatttttttttctgctgaatgtacaggagacttgcgtgccaccggtgccttggtttattgattcccatgttatactgcaagtgcttttgtattttttgtgctggactttaattcctttctagttgaagtgcttctgggcttggtttggattgctgatgaagcagtgaaggtgaggcatagtaattcgagaagcgactacgggcagagcagccctcccaaatgctctaaaagaagagctcttaagagcacctagaagcctgagctatttttatagaggatctagagccaaaaaaaaaggctcctagtggtttctcctctcactccccttctcgcgagaaactctcactccccttctctcgcattattaaaaggagaaactctcactccccttctctcacattaaaaggagaaagtagctgttttgtcaaatgatttattaaaaaaaacactgaagaagctagagctggaatcatttttagaggagtcgcagcggtgccaaacgcagcgtgtaacaaacaaactttagaatgaaaaatatcgtcgtttcttttacttctcgcaaattgtttgctgtggacttcctcacactgcttgactaaacaaactcaggtcgctgcatttctaatccgttgatcgcggtgaaatgttgtggggctgacgcaaatgcggcagccggtcgtgatcacgaatgtatccacggagcggcctgttttcattgctttgacgttctgccttcggttcccaacagggtttagcgagtagcaaccatcgttattgacctcataggacggcattcacgagtggctaacaatgccgtttccttcatcgctggacccggacatgcgtctttaactctttatcattgtcttggcatcgtgaattttctgaattctgactcactgcaaaccgtccgttttgcacttggtacttggtagtcagtaggaccttggatgttngagagcgaacaactgaggaggctgggaaatcacgtggttcaaatcttagttcgcgcatgtcctggcgtgttttatgcaatttttaaaaccatggtttttaaatacaatggtattcaaatgtcatgacagaactatggtatttattacaacattcaaaactatagtattgtaacatgtgcttggaaataacatctaaaattgtagtattctagtgtaagtgtgcaaggagctagtatcatgaaaaccacggtagtattcaaaaatagtgtttccttctattgtaagtgctgaaaactttggattagaatgaag

SEQ ID NO: 13013 - DNA, 2003 bp, Zea mays
tgagattatatatgcttttattcccttatcgaagaatgcgggaggcaggaggccggcgtgttattcgtctcccgactcccctactccaaagtccaaacagggcgatctcgactcctgaaatcccagttcccaagcggaacaaaaacggcgttcgaaggaacaacgggaagaaagaaaaccgccccccacgtacacgctcccacctcgcacgcccaccgccccaccgcacttggcctcgccaaactttcccctcggcctccgcccagtcccgcacttccaccatcgcacctcgcagatgccccagtaggctccaaaaatccaaagccgtcccttcccaaccctcccttcgatccctggggcggcggccgggaccatgacgaccggatccaacggcgacggaggcggcgcggggtcctggtacccgcagcgccgcccgcactacgggtacggcggggggtccgcctccttccgcggctgctgctgctgcctcttcctgctgctcaccttcctggcgctcctcgctctggccgtcgcgctcgtcgtcgtgctcgtggtgaagccccgcaaaccgcagttcgacctcaaccaggtgtccgtgcagtacctcctggtggcctcgccgacgacgtccccggccggcgtgccccccggcgccgcctacctctccctcaacatcacgctgctcttcaccgccgagaaccccaacaaggtgggcatccggtacggcgccacggcgttcgacgtcatgtaccacggggtgccgctcggggtggcggcggtgcccgggttcgagcagcccgcgcacagcacccgcctgctccagacccgcgtcattgtcgaccgcttcaacgtgctccagaccgacgcgcaggacctcatccgcgacgccgcgatcaacgaccgcgtcgagctccgcatcaccggcgacgtcggcgccaagatcctcgtgctcgggttctcctccccgagagtgcaggtacgaatggacacgccacccgcaacgggaaccataaccaacaactcccgttcgcttccgccgcaagtgttttttggcctctgctaagcggcgaaactgacgtgatgtgtgaccgaaccccacactgcaggtgtcggtggattgcacgatcgccatcagcccgaggagccagtcgctgaaatacaagcagtgcggcgtggacgggctaagcgtgtaggaagccgtcaagccgccgccgccgccgccgccgccgcagaagctgtagtccggtggagatggttagagtgggtggatctgtgcgtcgattctaatttccctaatctgtggggtttggtttcgtcatgtgcattaggtggtaaattttgcgctcttactttaggaggaggccgctggctttgcgaattattgctgcttgcaatcagtagttatcagtgtgaccatggttatacgttcatcgatcgccatgggtaattgcttacgagctaagggaagtggtgggcaaagatgtgattatgtgatgggggcgaagaggcgatcagaatcccgtcgcttttgctgctctcctcctcatcctccggttcttgtttcgtttcgtttcgtttcggagttggtgggtctgcgctgtctgcggttcctttttctgctaatctggttcaacttcaaccatttgcggtagtggagcggccgagcgggcacgggcttgcgagattgggagggggagaccgagggagaagttaggccgggaagactgaagagtgtgggtggccttgtgcggtcaaaccgtcaagttttacgactccatgatgggtcaaatttgtgtaactgccgatttgtatgtagatcgtgccgtgacctgtgtcgtctacgtgtctcctaagtcagaccagatagttgatgtataaaaatctcagttcgcacatggcgtggtcagttttgtttgatcctggattctggtgaattcacaagggagtgagagactgccatcaggtttattggttccccatgtattgctacatatatgcttgac

SEQ ID NO: 13014 - DNA, 1633 bp, Zea mays
gtgcggcgctcgagccggccggtttctacacaagcccaacacttcgcctcgccaaactttaccctcggcctccgcccgcacttccaccaccgcaccgcacctcgcagatgccccagtaggctccaaaaatccaaagccatccctccccaggcctcccatccatctccgggagatggcggccggcaccgtgacggcccgatccaacggcgagggccacggccacggcggcgcggggtcctggtacccgcagcgccgcccgcactacgggtacggcggggggtccgcctccttccgcggctgctgctgctgcctcttcctgctgctcaccttcctggcgctcctcgccctggccatcgcgctcgtcgtcgtgctcgtggtgaagccccgcaagccgcagttcgacctcgaccaggtgtccgtgcagtacctcctcgtggcctcgccgacgcccccggccggcctgccccccgcgaccccgggcgccgcctacatctccctcaacatcacgctgctcttcaccgcccagaaccccaacaaggtgggcatccggtacggcgccaccaagttcgacgtcatgtaccacggggtgccgctcggggtggcggcggtgcccgggttcgagcagcccgcgcacagcacccgcctgctccagacccgcgtcattgtcgaccgcttcaacgtgctccaggccgacgcgcaggacctcatccgcgacgccgcgatcaacgaccgcgtcgagctccgcatcaccggcgacgtcggcgcgaagatcctcgtgctcggcttctcctccccaaaagtgcaggtgtcggtggattgcgcaatcgccatcagcccgaggagccagtcgctgaaatacaagcagtgtggcgtggacgggataagcgtgtagtgtaggaaccccaagccgccgccgccgccgcagaagctgtattgcagtggagaagtgggtggatctgtgcgtcgattctaatttccctaatttgtggggtttgatttccttcttgtgcttaggtggtaaattttgagcacttacttttggaggaggccactgattctgtgaattattgctgcttgcaatcagcaatcagtaggtatcagtatgaccatggttatacatccatcgatcgccgtgaacaattgcttaggagctaagggaagtggtgggcgtcggttcgtctgtggttgtcttgtttcgtttcgtttcggagttggtgggtctgcgctgtctgccatgtccttgtctggcggctaatcttgttcacttcatcagttcatcagcccgtagttagtggtagactggtagtggactagtggtgccggggagattgtgagggtgaagttagggcgggagagtgggtggttaatttctcacttacaagataggtggcggggtcaaaccgtcaaaattttactgcaatttacgactcgtgacggcgcaaaacggagtttgtaatgcggactttgtgtaggccgtcgcgtgacccgtgtggtctacactacacatctcctatgtcaggtcgggaagttgtatatatgtaaaaaatgtcttcaaatcttagttcgcgcatgcgacatgccctggcgtgttttatgcaatttttttctgctgaatttacagcagacttgctgc

SEQ ID NO: 13015 - DNA, 1376 bp, Zea mays
  misc_feature (1361)..(1361): n is a, c, g, or t
accatcgcacctcgcagatgccccagtaggctccaaaaatccaaagctgtcccttcccaaccctcccttcgatccctggggcggcggccgggaccatgacgaccggatccaacggcgacggaggcggcgcggggtcctggtacccgcagcgccgcccgcactacgggtacggcggggggtccgcctccttccgcggctgctgctgctgccttttcctgctgctcaccttcctggcgctcctcgctctggccgtcgcgctcgtcgtcgtgctcgtggtgaagccccgcaaaccgcagttcgacctcaaccaggtgtccgtgcagtacctcctggtggcctcgccgacgacgtccccggccggcgtgccccccggcgccgcctacctctccctcaacatcacgctgctcttcaccgccgagaaccccaacaaggtgggcatccggtacggcgccacggcgttcgacgtcatgtaccacggggtgccgctcggggtggcggcggtgcccgggttcgagcagcccgcgcacagcacccgcctgctccagacccgcgtcattgtcgaccgcttcaacgtgctccagaccgacgcgcaggacctcatccgcgacgccgcgatcaacgaccgcgtcgagctccgcatcaccggcgacgtcggcgccaagatcctcgtgctcgggttctcctccccaagagtgcaggtgtcggtggattgcacgatcgccatcagcccgaggagccagtcgctgaaatacaagcagtgcggcgtggacgggctaagcgtgtaggaaggcaagccgccgccgccgccgcagaagctgtagtccggtggagatgattagagtgggcggatctgtgcgtcgattctaatttccctaatctgtggggtttggtttcgtcatgtgcattaggtggtaaattttgcgctcttactttaggaggaggccgctggctttgcgaattattgctgcttgcaatcagtagttatcagtgtgaccatggttatacgttcatcgatcgccattggtaattgcttacgagctaagggaagtggtgggcaaagatgtgatcatgtgaggggggcgaagaggcgatcggaattccgtcgcttttgctgctctcctcatcctccggttcttgtttcgtttcgtttcggagttggtgggtctgtgctgtctgccgtgcctttttctgcctaatctggtttaacttcagccattcgcggtagtggagcggccgagcgggcaaccgggcatgcgagattgggagggaccgagggagaagtttggccgggaagactgaagagtgtgagtcagtgagtggcctggtgcggtcaaacgcctcagttgtcgactccatgatgngtcaaatttgtgtat

SEQ ID NO: 13016 - DNA, 2735 bp, Zea mays
cacagcacaagcaaacccccatgccatcgcaaacgccatagccacatgccataaattacataacataaacctaaggataaaaactatataatttataaataaaatttaatttatagacgggaaaggaggaaatgatccgcgtcaaccatatgaaggattagaatatggaagggagagaaggaaggggagggacagacactggcttagactgtgttcaccgcttaccgccggaaggccccctcccctacgatagcggctacaggagcaccctaaaacgttcaatggttaactctatcaagcaccctacgctgccgttccccctagcaagtttctttctccccctcattctgtcgtgcatctctcaccccctctaacactgtttacgtgggcctacttccaattattagtaaatgaaaaattgataggagataaaaagaaggtataaaaaatgatattttatggttgtagtggggtgtaggggaaaaatttagggggaaccgctgtacagggttaagatatagggggaaagagaacgctgacgtgacacgtgagtgagatatagggggccaaatttaggggtaaccgctgaagacagtcttagagaggacaaagtggaaattgagcggagccggagctgccacgaacagtgacttgtcgagaaagatgagatggtgagagagctgaagcgcaggcgtagcgagcgatactattatcgcgaccatgacgtaagctacggatttgtatatgaaagtgagtatgtatacagaagatagcaatgatacatcgtctcgtcctaaaagctgtcgtcgtaaacgcaaaaacattgactagtcataaaataaacgagccacattaaactttgcggaaaagggaaaatataaatacgcacatagcatttcacatcctcattttgtgtgaatatatttaatagtttttcttctatttcaatgcacgagtacatttaccagtattttatttatttaatataattattattggtttactaagtagtttttaaagagctctcgaagatgctttaattattttaaattaaaataacctgtttcagtctctccaatacagagttcgatatgcatgtgtaaatatgatcggaaaaccttttttctcatgtaggagctagtttgaaaaacttattttttttccaaaaatttattttctcaaataaaattagtttatttttaatctaatctaataataaagtttccatactaaccctaataataaaaaacaggacagaaaaacttctgtcggttacgtcaaccccctcgattcaggttcagtaccgccacacacaacatagcggcagggccacgtggcgctgacgcctcatcccctctccgttttccaccgccactcatccacaacttttttctttttcacgggttcctcccgcccgcgcggccgcgggactaagtctgttctgcttcgctcgcgggcgctcatctccactcctccgatggcgccgccacccaccagcccctcattcctccgcccgccgccgctgccacaccacccgcaccctcgcctccttttgcgacctccctccgcctctttccgcgtcgccgaaatactcggcggtcggggcctctgcaatggtgaggtcggcgtccgcaaagaactcgcatccggctccaccacctcctcgcccgcgccctctcctcctccttcgacagattctcctccgcccgcggttgatccggacgcgttcgagaaggagatgatgggcctcacaggcggcttccctggcggtgaggtcggcctcaaggacttcgtagccaagaacccgcctcctcccaagaaatcagaatcccagccccaagccacgctctccgcgccgccgcggccgccggagctgccgctgttcttgcccggcatggtggtgctggtcaagaaccccaacaacgcctaccacatgtactgcggtatcgtgcagcgcgtcagcgacggcaaggtcgcggtgctcttcgagggaggagtgtgggacaggctcatcaccttcaacctcgacgagctcgagggcagggagaagggaccccctatggccaaccccaagtccgtggtgctagaggatcttgtcgcggagctcgaggatgacgatgatgataaggaggacgaagcggccaagaagaaggaaccggagggcgcggcggcggcggcgacatgaccaggcttcttgttcctgttatacacatcctctgtatgtatgcatgtatacagctcaaataaaatatttggagctaattaaaaaggaacgataatataactcttattatgaagtatatagtttgaatgttagtgtgaattggggcatggaagaattgccatacgtttgatcaaaaaaaaaaaaaaaagcttctcttggattattaacttctaattatgataacaatgaggatgccacaagactttcagttctctgagatctgtatgttatggccatattatgcacttaaaattttgtagctgtaatggttatcaagtaggattaggatgccaatttagctagaacatgttttcttgcatgaaactggttagagcagatcaaattgtcaatttagccactatgtcgccgtgttgttaaatcattacttttcattcggttttaactggcatcaaggtttatcttcagtgttcttttgcttcgattgttgatcacttgagcacttctggaactgagttacagaaggcaggatggtatggatctggttaacaag

SEQ ID NO: 13017 - DNA, 2266 bp, Zea mays
taggatttaggaagacgatatagaagaaacactgccgattgccctatctgtttcacaaataaataataatatgagatggaaacccatgaccataaggtatatctgggccgaggcatatctatatacaactggagcagcccacaggccacaacgattctcgtcggtcgttctgtgccctatccgtcgtcggctatcgcaacagcagcgcctcttccctgtcgccctgactcctccctagcagcagaaaaccggcggcaagtcttcggtggcggcgaggtgtgttcaattcctccgctctcatccctcacacggtctgatttcttccccttccctgcgtgcaaagagccaggaaagagtggcagatcggcagtacctgcctacctggaatcggtggctcaacggctcccatcgcttcgtgcttctcccatccatgtgctccatgccagatcccgcctctcccacccatctcccaccttgctctaatcccatgcgtatctacgaatcggctatgctcgaatccctctccacccccttcttctgttgatccaattcacatctgctgctgtgtgtcatcttcaatccccctcccaatctgctgctgtagctactcgtatgaactgctgggaatctgtaccccgtattatttttaaaagaaattagtttgcattgtgctcgactgcttgttacatgtggtgggcgtatatacattcatctgctgtgccatgtgctctgttgctgcctctgcttgggagaagagtagatcagattgtccacaagttgtgctactcaatccatattactgtataaggatccgaaattgtatttcttacatttattaaaatgcaactcattcctgtcattatacttctttatatgcatatgcgccatactaattgatgatttgaaatagtaggtgtgtccgcatatctgttggtgctggtacttaacaagttaacatgtgatggtactgctttagtaaactggctcactttaattgtctttcaacagggaaggccaaggctttgcctgagagaatgcaagacccaagggatgatgatttcttggcgccaaagttgcataagaagaaggttgtctaccggccgcagccatcaggccatctgaagggtgaacctgaactgttgcggagagagtttccgcaatcatcaggcatggtccaaaagccacccaaaagaagcttgaagggtgagcctcgcacgcccccttccgacagggggaccccggattccctgccggaatctggtcctaccgacgaataccgtgcgttaaggaggaagtacctgatgctggaggaagagaactttgcactggacaaagaactgagcatggaagatgaagaaatgaaggccctagaggatgaaaagcttgcactgcttgatcagcttgttgtcttggaaggccttgtcgagccatcccagttgcagtctcaacctaggccgtaaggtgttttggtttatgtataatcgttgtcgttcattataattcagctactagtagctgttatactatctgggcttaaacagtgtgtagaaacagcatagtagacctgttacttctatcggacatcgacgaataaaaaaaactcttatgactgtttgcagggttgacaaaaaaaaaaaaagtttgtgtaaagtaagaagaatttagttgcgaaggtagttctgtgcagatgaagccttgttgcggcttacctgatgttgagctcatgatgtgaaacaggaacgatacacttgtcttcatacttcttggatggtactacgaggaaataacatggctttggttactgtcataaccaaggttttttgtacttaattctgaattatgtttttgggttttctctatacatattttatgtaatgcacttagatgcactatcggtgtgcttggttgccgtgtagtagcagccttttccgacttagccagcaccgagcacctgaggattcaggctcatttggtccggctaatttcatgcaatagacttttgtttggttattgtattagtgcatttaggctaaatacaagtgttgtttggttgtcaacatcaagaataaagatccgatagaataaacaaaataaatctctaaaatttatatagcaagtgtaatctagttttgttcgtaaaaatgctaagaacataaatttaaaattggtttagcgattgaaaatttcaagtgagatctatgacgaaaaacaaaataaaatatgatttagaaatgcctgtccaagcttcaggtgcatgcacacagcc

SEQ ID NO: 13018 - DNA, 886 bp, Zea mays
  misc_feature (10)..(10): n is a, c, g, or t
ccggccgggngaccataaggtatatctggcgccgtcgcggccctggttcgcggcgggagccgcccacggccgacaacgattctcgtcggtcgttctgtgccctatccgtcgtcggctatcgcaacagcagcgcctcttccctgtcgccctgactcctccctagcagcagaaaaccggcggcaagtcttcggtggcggcgagggaaggccaaggctttgcctgagagaatgcaagacccaagggatgatgatttcttggcgccaaagttgcataagaagaaggttgtctaccggccgcagccatcaggccatctgaagggtgaacctgaactgttgcggagagagtttccgcaatcatcaggcatggtccaaaagccacccaaaagaagcttgaagggtgagcctcgcacgcccccttccgacagggggaccccggattccctgccggaatctggtcctaccgacgaataccgtgcgttaaggaggaagtacctgatgctggaggaagagaactttgcactggacaaagaactgagcatggaagatgaagaaatgaaggccctagaggatgaaaagcttgcactgcttgatcagcttgttgtcttggaaggccttgtcgagccatcccagttgcagtctcaacctaggccgtaaggtgttttggtttatgtataatcgttgtcgttcattataattcagctactagtagctgttatactatctgggcttaaacagtgtgtagaaacagcatagtagacctgttacttctatcggacatcgacgaataaaaaaaactcttatgactgtttgcagggttgacaaattcctagtccgcacccgccaagtaagaaagatttagttgtgaaaaaaaaaaaaaaaaagcggcc

SEQ ID NO: 13019 - DNA, 1062 bp, Zea mays
  misc_feature (16)..(16): n is a, c, g, or t
gcacgagaccattacntagaacatcctaatcgaaaaaagcgcaaggcaggcaagctcctctctcaagtctcggcacctccaactacgcagcaaccaaccatgagcaccagcgatgccgccgcgaccgtgatccccatcgacgacgtgccccgccagcacggcaaggccccggccgtggacacggtcacggcggcgcctcctcctctcgctgcagcagcaccccccgctgcgacgacggcgcctcggaagacgcgggtcccgttcttccggcgcgccgaccgcggcagccggtgcgtggcgctccttgacttggtgctgagggtggcggccttcgggcccgccctcgccgccgccatcgccacgggcacctccgacgagacgctctccgtcttcacccagttcttccagttccacgcccgattcgacgacttcccggcgctcctgttcttcatggtggccaacgcgatcgcggcggggtacctggtgctgtccctccccttctccgccgtcgtcgtcctccgcccccaggccatcggcttgcgccacctcctgctcatctgcgacctgatcatagcggcgctgctgacggccgcggcggcggcggcggcggcgatcgtggacctggcgcactcggggaaccagcgcgctaactgggtgcccatctgcatgcagttccacggcttctgccagcgcaccagcggcgccgtcgtggcatccttcctcgccgtgctcgtcctcctgtttctcgtcatcttggccgccttcaccatcaggaaacgctgctgaactggatagtatgtgatgttgctgtttttgcgtcgtgcaattaataatgcaatgtggtttcagtttgtggttactcgtgtgtaattgtaaagcgtggagtggaattgcctttgtattattcgtggacacctgcttgcggaattttaaattgggcttaacttctcggcctggtttcatgtccgaaaaaaaaaaaaaaaagggccaaacagggccttgggcctgagatggtgatgtctacccaccactaccgtcaccggtcgaccggctttgtctgca

SEQ ID NO: 13020 - DNA, 2479 bp, Zea mays
  misc_feature (148)..(148): n is a, c, g, or t
attcggaattagaatatttaatctagttaaatatcttgaaagcatgtcacttatttctccaatattataacatgggcgtagcctatatgtgcggagatgcgatgagggagcttccctaatggagcaggtggcgggagctcgacgcgantaaatcggccaacaaatcacgtcgatagtgttgttgttgtatatgtatgtgttgtaggtatatgtttcatatattttttatatattgttttaatatagttatatataacatttctacatgtctgagaaaaatacataaccttttcagtttttttcttgagaagctcgtaaattacgtgccaaccttttttgctatcgtctcaaggaaattagaaagataaacaagcatgagctataaaaagagagacaaatgtatcatgtctttgagactttgaaaaaaaaggcgtggactctgaagcgattacaagggggtgcgtgcaaaaaaaaatcctttaccagccacgtaggcgactttgtggcgaagccatgtcagctaaacacgcgccacacacccatttgaacctaaatgacactagattattgtttcattttagggctagtttgggaacaccgttttcccaaggaaatccaattttcccaagggaaattagttcattttctcaagggaaaattgtaatcctttggaaaaacgatgttcccaaactagcccttaagagtttagaaacctgtctgatataggttcataagtttagggactgccagcatattttattttaaactaaacgagattatataatctagatatattataacccaatcaaacaagcccttattatctaaccaagagaattataaaaacactatatttacattcacctagccaattcaatacatatacttttgtgttttaccataatatagtttaatatatataggaattgtacgcaccggcatgtgactaatgtaaagagcagtaaattttaaaaacaaacagacaagtgagaaaacccaccgctcgtgctccacttgtgttgtgtccacacacgcgagcgaacccgacgtcccgacccctgctatacgaatctagaggtgaatccaacggcgtaacacccttctccctccacacccttcctctccaaaaaacgaacatcaaaatgcgcgagagaaacggccaaaagtcgaaaggggaaaaatgagttaaacccaaatcgacaccaaacccactccaggaacacccgcctccgccgccgccgccgccatcgccggcggccactacaagcgcggcgtccggagacagtactgcgctaccaacccctagagcctggattctgatgagccctccatggcctgtcatatctgtcccctcttcaatctccgactcttgctgctgctcggcgcggttctcgggaacggcggcctcggccggggcggcggagcggaggcttcagatcgggcggacccggacccgtactcgatcctgatgtggcacgactactcgccgccgtcgcccccgctcccgcccccggacccgccgtcgccgacggcgacatgtgagggggacctccacgggaagggtgacttccacacgcgctgcgaggtctccgaggaagtggagctggacggcgacgtctacatcacggggaacggcagcctcgtgctcctctctggcgcctccctgacctgcgagaagtacgggtgcgttatatccgccaatttctcaggcgaggtgcgcctcagccgcggcgtccgcgtcacagccggcagggtctcgctggttgccaccaacatcacggtcgccgacacggtcgtcgtgaataccaccgcgctcgctggtgatccgccagaccggaccagtggcgttcccacggggacgcacggcgacggtggcgggcacggtggtcgtggcgccagctgcttcgtcaaggaagggcagacgcaggaggattcatggggcggcgatgcctatgcatggtctgacctcgaacacccctggagctacgggagcaaagggggctcgaccagcgttgagaaggactatggtggtgacggtggtggcatcgtgtggctgtttgctgaggacctggtcatgaatggcacagttctcgccaacggtggggatagcaatgagaagggtggtggtggttctggagggagcatctttataagggctgcatcgatgtgagtgtttgtggaatgattttttgttcttctttctttatgctaagtgaattgagatatgggaatgcaagcttagttaatcaagtagtgtttgtggaatgattttctgttctgctttctttatgctaagtgatttgagatgtgggaatgcaagctgagtcaagtagaatttggaaaacagttaccaattgggaagaccagcagaataaattggtgagaaatatagtggaattaagttgaagtttgaaaaacatttaccaactgaagtccagcagaaagcattgataggtcctgtagtttaaatgaaccagac

SEQ ID NO: 13021 - DNA, 1487 bp, Zea mays
ctgaaaatcgatttacaccagcagttctcatttaccgtctgtacaaatatttttttttctattgacctctagtactggcggttttgaaaaacgacggtgtaaatagattcacaacagtctttataaagcttctatattatcctaattcagaagtcatacatttaaatttcctttgttctattggctagatttgcgagattgacatcctatagagctacacattaaacaaactcggccatctcaacaaatgggcctagctatattttcgttctgattgtttatatctctaaaccaataacaattttaaattaaatcacacttctatcgtgattgagcacccatattgtgtgtgcgcgtgctcggaaaagcaacctcagcccacaccaaaaacacgatcatagcggcatcatacgcaccccttatttctatataaaccctcccaacaacacgtaacagcccacacaaaaacccagcatcagtcaagctcgctcacacgaccatggccgcggcgatgaccggcagtactcgcgccagcggcggctccttcctcgtgcttctctttgtcgtgttggccggtgtcgtcgacgtcgcgtccgctgccaccactgcggcgagtgctactgttgccactaacagcggtgacagcaacgcggcggcgcttctgacgatgccggcgtcggcgtccacggggcagctgaatggcatcatccagtgcctgctgggctgcttcacgcaggtgttcagctgctcgttcgggtgtatgggaaagcagggcgccgacctgccgctctgcatcatcggctgcgaccagaggagcgtcgtttgtatgatccgctgcgggctcgcgccgtcgccgcccacgccctcgccaccggcgcccaagccgccgtcgcccaagccacccacgccgaaacctcccacgcccaagccgcccacgcccgcgccacccacgcccgcgcccacacctaagccgcccacacccaagcctcccacgccagcgccaccaacgcccgcaccgccgacgcccatgccaccaacgccagcgcctccagggccgccgtacactccaccgtacgccgtcaccggacgcaagaccgcaacatttgactaaacatgccgacatatgtgctagctctcgaccgatccatcgtaccaataatttatactccataaaccgagcatatatgtttataaccattaaaaaagaagcatatttcatgctatagctttttattaattaacacgatcaattctactcccgcaatgtctattagtatgtccacagtgaaggccaaattatgtctaatgagtaatatatgtacacaatataatagatcaatgtattttgatcttttaatatgatgaatgtactttgttctttttattcacatgtaacgctatttgtaagtatataattcatgcaagaaccattacactaaaaaaaaaagaaaaaaaaaaaaaaaaaaactcgagggggggcccggtac

SEQ ID NO: 13022 - DNA, 1682 bp, Zea mays
cgagccgtcgtccccagtgtgccactcgacgcgcagccaaccccaaacccttcctccctcccgacgggcgacggcgatggccgccgcgacagagaagacggctgaggacatccgccgcgagctccaggagctccagcgccagcaccgcgagatcaccgagcgcctgcgcgacccccgtggccttcgccgcggagcccctggtcctggacctgggcccccccgcccgctccgcggcttcgtgagaccccatgtgggtgcggaagtggcggatcaggctccgcagaagcgtcggctgttatcggccgtagttaaggttgatggcgctgaaaataatgaagaaggcacaaaggatgccaatggggaggggcaagaggcgggttcaggtgccactgaaggcagtgacaggaggactttcaacactggcgggttcagaagggacgggagcctgtggatgcagaggagggtggactataattcgctgccagagccagccccaagggagcttcccaggaatgaggacccaagtttggtgaggaggaataagaggatgctggggcagcttcttgtcggtacattagagaaatttcaacaagaggataaaaagctatccaactctgaggcttttctgcgcagatcagagactcagcgaaaggctgagcaaaaggttcgtgaagaaagtgaaaggctgcgacagcaggaacgtgagcaaattgcagagaagcgtaagcgtgatatgacgctccgcgctcgtgtagctgctaaggcagaagagaagaggttggagctgttgtacattcagtggactgagcatcataaaaggctgtccaatttcttaaggttatttttatttctggtccaaaagtgtccatattgacaattaaattgagggaagatacattctaattgtatgcagacctgatgtttgataactattagtgtatctgtttacgttgtatactaatgaacaatatttgttccatgtttgactcttatctcattacccccttacgtttggcaggacaaaagctgagccacctatttattacatgccaactaaaccaattattgatgatccagccattgttgagcagaacaaggaaaaggtattcgaagaatggaaatctatgcgcagggctgagctgactcagtttcaaaagcaagttgaggagcaatatctctcaaatgtggagaggcaattggagaggatccagaatgcccggaacgctcggaaggcgaacgggcctggtaacatgcaagaaatggacaaggagctggacacccacagggcggagcatggtccaaagcctcggcgagttcccgaggagggcggcaatgatgatgacgaagatgcagaggacatggctgcggaagacgagctgatggatgaagttttgggcatcaatgatgcaatcaatgaggacccatccaagccgtccgaagaagctactactgaaggtcagccagcacccgaggaagcacaataggattctttgttcatacaaggtaggcgtaccattccggcattccgtatgcttagttgccgtcttgttgggtgctgcttgtgcgtgtatttttgttagacgtcccccaatggttagactgtgttttaatattgttgttttggccttttgatgttgagaccatacaactgtcaattattatcttataattgttgtaagcta

SEQ ID NO: 13023 - DNA, 1549 bp, Zea mays
tgggtacctcgagccggccgggaggttgccaatccgagcgcagccaaacccaaaccctcctccctcccggctctcgacgggcgacggcgatggccgccgcgacagagaagacggctgaggacatccgccgcgagctccaggagctccagcgtcagcaccgcgagatcaccgagcgcctgcgcgacccccgtggccttcgccgcggcgcccccggccctggtcctggacccggggccccccgcccgctccgcggcttcgcgagacccgctgtgggtccggaatcgggggatcaacctccgcagaagcgtcggctgctatcagccgtagttaaggtggatggggctgaaaataacgaggaaggcacaaaggatgcggatgcggaggggcatgggacaggttcaggtgccactgaaggcagtgccgggaggggtttcaacaatggcgggttcagaagggatggtggcttgcggatgcagaggagagtggactataattcgctgccagagccagctccaagggagcttcccaggaatgaggacccgaatttggtgagaagaaataagaggatgctggggcagcttcttgtcggtacattagagaaatttcaacaagaagataaaaaactatctaactccgaggcttttctgcgtagatcagagactcagcgaaaggctgagcaaaaggtccgcgaagaaagtgaaaggctgcgacagaaggaacgtgagcaaattgcagagaagcgtaagcgtgatatgacgcttcgcgctcgtgtagctgctaaggcggaagaaaagaggttggagctgttgtacattcagtggactgagcaccataaaaggctgtccaatttcttaaggacaaaagctgaaccacctatttactacatgccaactaaaccaattattgacgatccagccattgttgaacagaacaaggaaaaggtattcgaagaatggaaatctatgcgcagggatgagctgactcggttccaaaagcaagttgaggagcaatatctctcaaatgtggagaggcagctggagaggatccagaatgcccggaacgctcgaaaggcgaacgggcatgctaacatgcaagaaatggacaaggagctggacacacacagggcggagcatggtccgaagactcggcgagttcctgaggagggcggtaatgatgacgacgaagacgcagaggacatggctgcggaagacgaggtgatggatgaagttctgggcatcaacgatgggatcaacgaggacccatccaagccgtccgaagaagctactactgaaggtggtgagcctgcacccgaggaagcacaataggattctttgttcacacaagctaggcacatagccgtacgtaccattccgtatgcttagttgccgtattgttgggaactgtttgtgcgtgtatttctgttagacgttccccgctggtttaggctgtgttttatatggctgttttgtctttttgaatgttgagaacatacaactgccgattattatctaatactccccgtgggaaaaaaaaaaaaaaaaaaaataat

SEQ ID NO: 13024 - DNA, 1524 bp, Zea mays
acccaaacccgagccgtcgtccccagtgtgccactcgacgcgcagccaaacccaaacccttcctcccgacgggcgacggcgatggccgccgcgacagagaagacggctgaggacatccgccgcgagctccaggagctccagcgccagcaccgcgagatcaccgagcgcctgcgcgacccccgtggccttcgccgcggcgcccccggccctggtcctggacctgggcccccccgcccgctccgcggcttcgtcagaccccatgtgggtgcggaagtggcggatcaggctccgcagaagcgtcggctgctatcggccgtagttaaggttgatggcgctgaaaataatgaagaaggcacaaaggatgccaatggggaggggcaagaggcgggttcaggtgccactgaaggcagtgacaggaggactttcaacactggcgggttcagaagggacgggagcctgtggatgcagaggagggtggactataattcgctgccagagccagctccaagggagcttcccaggaatgaggacccgagtttggtgagaaggaataagaggatgctggggcagcttcttgtcggtacattagagaaatttcaacaagaggataaaaagctatccaactctgaggcttttctgcgcagatcagagactcagcgaaaggctgagcaaaaggttcgtgaagaaagtgaaaggctgcgacagcaggaacgtgagcaaattgcagagaagcgtaagcgtgatatgacgctccgcgctcgtgtagctgctaaggcagaagagaagaggttggagctgttgtacattcagtggactgagcatcataaaaggctgtccaatttcttaaggacaaaagctgagccacctatttattacatgccaactaaaccaattattgatgatccagccattgttgagcagaacaaggaaaaggtattcgaagaatggaaatctatgcgcagggctgagctgactcagtttcaaaagcaagttgaggagcaatatctctcaaatgtggagaggcaattggagaggatccagaatgcccggaacgctcggaaggcgaacgggcctggtaacatgcaagaaatggacaaggagctggacacccacagggcggagcatggtccaaagcctcggcgagttcccgaggagggcggcaatgatgacgacgaagatgcagatgacatggctgcggaagacgagctgatggatgaagttttgggcatcaacgatggaatcaatgaggacccatccaagccgtccgaagaagctactactgaaggtcagccagcacccgaggaagcacaataggattctttgttcacacaaggtaggcgtaccattccggcattccgtatgcttagttgccgtcttgttgggtgctgtctgtgcgtgtatttttgttagacgtcccccaatggttagactgtgttttaatattgttgttttggccttttgatgttgaggccatacaactgtcaattattatcttataattgttgtaagcatactataattgta

SEQ ID NO: 13025 - DNA, 3231 bp, Zea mays
  misc_feature (3130)..(3130): n is a, c, g, or t
cggacgcgtgggccgagcgcagccaaacccaaaccctcctccctcccggctctcgacgggcgacggcgatggccgccgcgacagagaagacggctgaggacatccgccgcgagctccaggagctccagcgtcagcaccgcgagatcaccgagcgcctgcgcgacccccgtggccttcgccgcggcgcccccggccctggtcctggacccggggccccccgcccgctccgcggcttcgcgagacccgctgtgggtccggaatcgggggatcaacctccgcagaagcgtcggctgctatcagccgtagttaaggtatcttctttttctgcttcaatttcgcttctgtttccgcacgcggtaatggtctgcttgtcgaaacaataaaattatgtctggttgcttgacataacaactggaggtggatggggctgaaaataacgaggaaggcacaaaggatgcggatgcggaggggcatgggacaggttcaggtgccactgaaggcagtgccgggaggggtttcaacaatggcgggttcagaagggatggtggcttgcggatgcagaggagagtggactataattcgctgccagagccagctccaagggagcttcccaggaatgaggacccgaatttggtgagaagaaataagaggatgctggggcagcttcttgtcggtacattagagaaatttcaacaagaagataaaaaactatctaactccgaggcttttctgcgtagatcagagactcagcgaaaggctgagcaaaaggtccgcgaagaaagtgaaaggctgcgacagaaggaacgtgagcaaattgcagagaagcgtaagcgtgatatgacgcttcgcgctcgtgtagctgctaaggcggaagaaaagaggttggagctgttgtacattcagtggactgagcaccataaaaggctgtccaatttcttaaggttatttttatttctggtccaaaagtgtccatattgacaattaaattgagggaagatacattctaattatgcagacttgatgtttgataaccattagtgtatctatttacattgtatactgatgaacaatatttgttccatgtttgactctatcttattacccccttatgttggcaggacaaaagctgaaccacctatttactacatgccaactaaaccaattattgacgatccagccattgttgaacagaacaaggaaaaggtatatcctagtatcttttttctcgaaaagcgcaggagaactgcgccccaaatatatattaggaggaaagaaaaggtctaagaagacccaaaatacaagacactccttacggaggccagaagcaaccatacaggaagggatccataacacagtaaaaaactacaaaccacttagccgtagcccttaagcagtaggaggggcagccaaaaaggaaagacctttggcaccagcaatctgccatttttgcatttcctcaactaccaactcaaggagaagagtgagattgggagatattccatccaaaaccactctattccgatgtttccagatcatccaggccccaagagtgatgcgggagttcagacctctcttagtcattccagtaacaacagcagatgtcctttcccaccaatccaagaaggaagtagcagccggctgtggggctaaggagtgcaggcccaacttccttagaaggttataccagaaaactcttgtgaatacacaagacgctaacaggtgattgatagatttaggttcttgatcacataggggacatctggtaggatgattcaatcctctttttgccaacctgtccgcagtccaacacctattgtgggccactagccgtatgaagaatcgacacttttgtggagcccatgatctccaaacccttttgtaatgcccaaaggagcttgcttgacccaataaacaggcctttgtaagctgaactcgcagaatatttgccattaggtgccaaggaaaaaatgtgcttgtcttgtgcatactcatgtacttgttcctgtttcatgacttttcgtttgtgggtgaaatggtgaattaaacgttcgaaaaacgctaaaggtattcgaagaatggaaatctatgcgcagggatgagctgactcggttccaaaagcaagttgaggagcaatatctctcaaatgtggagaggcagctggagaggatccagaatgcccggaacgctcgaaaggcgaacgggcatgctaacatgcaagaaatggacaaggagctggacacacacagggcggagcatggtccgaagactcggcgagttcctgaggagggcggtaatgatgacgacgaagacgcagaggacatggctgcggaagacgaggtgatggatgaagttctgggcatcaacgatgggatcaacgaggacccatccaagccgtccgaagaagctactactgaaggtggtgagcctgcacccgaggaagcacaataggattctttgttcacacaagctaggcacatagccgtacgtaccattccgtatgcttagttgccgtattgttgggaactgtttgtgcgtgtatttctgttagacgttccccgctggtttaggctgtgttttatattgctgttttgtctttttgaatgttgagaccatacaactgtcgatcattatctcataattgttgtaaaaatactataattgataccttgatttggacgtcggtggcgttaaacgtttcgggttctgttcttcactacccgtgctgcagcctctagcgcacctgcacgttttctctcgtgccttgcccactccggatgccacagaatggttatatttttaacatgctcgcatgttttccattagtctcttttaccgttcaactcaaaagcagctaaatagaaaggtgtaaacgtgaaaataaatgggtggggtgtaaacgtggaaataaatgggtggagtcatgaagatataaataaagtctctgtcaaaattcgaacttaaaactgataccattcgaactcaaaacctctgactttgatactatgtttcaatgaatgcactaatcaattcaatctaaaaatttaaactgatgaaaaaagttagttaattcctttatacatttcgacatatgctattaaagttgttgcggagaaggtttcacctatgttgnttctccaaatagtgtagttgggcggcaacctttgccgcagagcagaggtgagtaggtgaccggaagagaaatatgatatgccaggataagaaaggaaagta

SEQ ID NO: 13026 - DNA, 1584 bp, Zea mays
gaatcaccgccccccgcctcgccggcacccctctacctcttcgctggggggctcctttccctcccctcgcgtggcgtctgtggcggctatcctcgcctcgtctcccctccccctccctagggtttatcctccaccaccacctacccaccgcctctccccaccacagataagaattatcttatcgattttttacaccggccttgaatccgatccaggagcagtcgtttggtgttggtagctgcggcagacgtctgtcctagatcgaattgactcgcgagaagaagccatgtcgacagttgctcctgcccctagcgctgctgaccagaccaccaatcttctgcagaagctgtctctggagggcaaggatggctccgacactgccaagaagccttctgggatgccatatggatctacccacgctggagatgcacagagcgctgcttcacaggtggacaggtcgataacacctctactacaggaggccatggatcctaatttcttctaccagcccagtgcatatgcctctccagcctattacttccctagtggttatgatggctcagccaatgaatgggactcaaggtatgctggtcatgaaggaatggagatgccccctactgtgtatggagacatgtaccttggatatggctatgctccatacggcccatatccttcgggttctccagtaccaactgttgggcatgatggccagtcatatggttctcagcaatatcaatacccgtctcaatattatcagcaaccaacaccaacaaacgcaaaacatggtctaaatggtgccagttctcaacctgaaccgccctctgttgccagtcagcaggcacgagttttggtagatgcaacaaaagcaactccaaacgtgagggctaatggtatgacaattgctcacaacagttcgctgccacgtaagcaaacccacctgaatgtatcggtagcaaacagtggtttatatggaagaggacctatgcaaggcagtggaccttctgcaagcaattatggtcacaatggtgttcgttctccagctcaatggtacgatggtccagtttactcgaatgggcatcagataccaactgctagttccacatcttaccgttccaattcgtcttctatgagaagtcagagccagcatccaacaacaaacctcatgggtatacatgcacagatgccttcgtctggaatgggtctgacctcacctagatatccttctaggatgtacccagacaacagattatatgggcagtatggtcagtatgggaacacactgaagggtggccttggttttggatcaaacatgtatagctcgagaaacaatgggaggtggggagttgtggataccaaatacaagcccagagggcgtgcaccttttggttttagtggtgagaaccaagatggctttaccgagctgaacagaggaccaaggtctggtggtttcaagcaccaaaaacaattcggtcctactgtaactattgctgtgaaaggccaaacccttcctttaatggggaaacagaacagtaccttttccagacaaaggcccatttaaaccaggaagggttttcctttaaccta

SEQ ID NO: 13027 - DNA, 1421 bp, Zea mays
  misc_feature (1204)..(1204): n is a, c, g, or t
  misc_feature (1207)..(1207): n is a, c, g, or t
  misc_feature (1209)..(1209): n is a, c, g, or t
gcacgagaccattaccagaacatcctaatcgaaaaattgtccattttgcaccaccgatcgatcgagctctaggctctagctagcgcgctgcatatgtgaggcaacttttcatttatctgacacacgtacttacggcccacgatggccgccgccgccggcctcccgtggtggctgctgctcctcgccgtggtcccggccgtcaccgctgcggccaccgccggcggagaggggagggcgccggcgctgttcgtgttcggcgactcgctcatcgacagcggcaacaacaacaacctcgcatcgcttgccaaggccaactacttcccctacggcatcgacttcgccggcggccccaccggccgcttctgcaacggctacaccatcgtcgacgagctcgccgagctgcttggactgcccctggtgccaccctactctgaagcctcgtccgtgcagcatgtcctgcagggcgtcaactacgcctctgccgccgccgggatcctcgacgacagtggcggcaactttgtcgggcggatcccattcaaccagcagatccagaacttcgagacgaccgtggcgcggatcgccggcgcggcgggcgcggcggcggcggcggacctggtggcgcgctccgtcctgttcgtggggatgggcagcaacgactacctcaacaactacctgatgcccaactacgacacgcggcggcggtaacggcccgcagcagttcgcggacctgctcgcgcggcagctggccgcgcagctggccaggctgcacggcgccgggggcaggcggttcgtggtggccggcgtggggtccgtgggctgcatcccgagcgtgcgcgcgcagagcctcgcggggcggtgctcgcgcgcggtggacgacctcgtgctccccttcaacgccaacgtgcgggcgctggtcgaccgcctcaacggcaacgctgccgccggccttcccggcgccagcctcacgtacctcgacaacttcgcggtgttcagggccatcctcaccgacccggccgcgttcggcttcgccgtcgtcgaccgcgggtgctgcggcatcggcaggaacgccgggcaggtcacctgcctgcccttcatgccgccgtgcgaccacagggagcgctacgtgttctgggacgcataccaccccacggcggccgtcaacgtcatcgtcgccaggctggcgttccacggcggcgctgacgtngtntngcccgtcaacgtccgtgagcttgccggcatgtgacaagatgatcggagcggacatatattctcctatatatagcaataataatttgtttggtgaattattgtatcagtagattttgtgctacaagcctccatccacaaaccatgcatgtagtagttatttgttactccgatctatttataaattcgctttgcactgaaaaaaaaaaaaaaaa

SEQ ID NO: 13028 - DNA, 1541 bp, Zea mays
  misc_feature (34)..(34): n is a, c, g, or t
ccggcagaaagcggaagttttaaagacaccgggngcctgcgtctgcgtctgcttggccccccccggtaacagcagttatcatccccatctcccgccgtcccgcgtgctaatacttgcttgcattgcctcccgtttgccccgatccaacgacgacgttcgacggccgtagccaagaaggtatctcgcccaaacaaaggccgtcaagccaccatggccgtgtccggcgagaagccgccaccgccaccgccaccggccacggcgtccggcggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctggaaaccggcgtcccgagggagaaggccaagcacaggctcgtctttgtccatgggttcgactcctgcagacacgacgcgcttccgatctccacggagcttgcgcaagagctgggcgtttacatgttgtccttcgatcgccccgggtacgccgagagcgacccgcacccggccaggaccgaggagagcatcgccctcgacatcgccgagctcgccgacaacctgcagctgggtcgcaagttctaccttgctggcttctccatgggcggcgagatcatgtggagctgcctcaagtacatcccacacaggctctccggcgtggccattctcggccccgtaggcaactactggtggcccggcttgccgtcgaacgtgtcgcgggacgcctggtaccagcagctccctcgggaccagtgggcggtctgggtcgcgcatcacctgccgtggctcacctactggtggaacacccagaagctcttcccggcctccagcgtcatcgcctacaaccctgccctcctgtcccaagaggacgagatgctcatggccaagtttggctatagagcctacatgccgcagatcaggcaacagggggagcacgagtgcctgcaccgggacatgatggtcgggttcggcaagtggagctggagcccgctgcagctggagaacccgttcgccgacgccgacgccgacgatggccagggggcggggaaggtgcacctgtggcacggcgccgaggacctcatcgtgccggtcagcctgtccaggtacatcagccagaagctgccgtgggtcgtctaccacgagctccccaagtcgggacatctcttcccgatcgccgaggggatggctgacatcattgtcaagtccctgctgctcggagacgatcatccgtcgtcgtcggcctcacagcgtcctcattctccatgaatccaggtcgtcacgtagtccgttcgcatctcgtggcccgtctctcactgtttctgtaaagggaccgatggtgcagctttctctagcgtgtagctaggatgctcttttttttttgaaaaataatggaactaagttttagcctatatatatcatctgataatgttacacaaaaaaaaaaaaaaaaa

SEQ ID NO: 13029 - DNA, 1366 bp, Zea mays
  misc_feature (10)..(10): n is a, c, g, or t
cctcgaggcncggcccgggagagcactaaaccaactacggcccccccgccgccgccccggctacatgtaaaaaaaggcttcgaggcctgcgagatgaacgcagcggagagcattcaacaaaccaaaaccgcataaccaaaatgttcagactagcgcgtggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctggaaaccggcgtcccgagggagaaggccaagcacaggctcgtctttgtccatgggttcgactcctgcagacacgacgcgcttccgatctccacggagcttgcgcaagagctgggcgtttacatgttgtccttcgatcgccccgggtacgccgagagcgacccgcacccggccaggaccgaggagagcatcgccctcgacatcgccgagctcgccgacaacctgcagctgggtcgcaagttctaccttgctggcttctccatgggcggcgagatcatgtggagctgcctcaagtacatcccacacaggctctccggcgtggccattctcggccccgtaggcaactactggtggcccggcttgccgtcgaacgtgtcgcgggacgcctggtaccagcagctccctcgggaccagtggggcggtctgggtcgcgcatcacctgccgtggctcacctactggtggaacacccagaagctcttcccggcctccagcgtcatcgcctacaaccctgccctcctgtcccaagaggacgagatgctcatggccaagtttggctatagagcctacatgccgcagatcaggcaacagggggagcacgagtgcctgcaccgggacatgatggtcgggttcggcaagtggagctggagcccgctgcagctggagaacccgttcgccgacgccgacgatggccagggggcggggaaggtgcacctgtggcacggcgccgaggacctcatcgtgccggtcagcctttccaggtacatcagccagaagctgccgtgggtcgtctaccacgagctccccaagtcgggacatctcttcccgatcgccgaggggatggctgacatcattgtcaagtccctgctgctcggagaccatcatccgtcgtcgtcggcctcacagcctcctcattctccatgaatccaggtcgtcacgtagtccgttcgcatctcgtggcccgtctctcactgtttctgtaaagggaccgaatgaccgatggtgcagctttctctagcgcgtagctaggatgctctgtctttttttt

SEQ ID NO: 13030 - DNA, 1405 bp, Zea mays
  misc_feature (1365)..(1365): n is a, c, g, or t
  misc_feature (1389)..(1389): n is a, c, g, or t
atccgtgtttggatagcagataaatttatgtccggtgttaaatttataaaacgccgcctgtaagagcatggtcgatattgtgttagcctattctgtttatatctcgaccgcgcttaagtacccgaacttagaccggcgtgtgtttggatttaaaatgtagacaaatactaactattcaaaacttcggtagtttaaactcgaatcgagttgtgccataatcttaaggtttaaatttaagattgattggtgtgaaaaaaatacgaatcgtgaagtaaattagttattgcttgacagaatgaatattcctttaagttatcctcaaccaccgcttaacattatctcctatttgccgtatcctgtattccatatcctctcgtcgttttttttcctctgcccgctggtcgcgcaagctccagctcttgtccgtaccggccaccgccccagcctgtcgatctcatctccctgtgattttttatcagccgtcggggggagaaaaatcctccctgttcttatcccctcgtcgccctgctcagattttctagccaccgctgtactgatattttggcgcgcgatgcctattccttgcgcgctcctctctgccgggcggcttcttcacgcgtgtctctctctccctggtgcctgctcgcgacaagctcctgctcccttccgtggtcgcgtgctcagctctactgcaggccgcgcccagcttctctccctcggcgctcacagctctctctctcccctagtccctgccatggccgccgttccctggtcggagtttcttctagctcggatctcctccctacggcgcccgagctccatggctgctgcgttcttcagccgacgcgtcctgccgagtccctctccatccccacggcgtcctgcttgcccagctttcatccatggccggagccctcccatgtcacgtcccagccaagcccctgcctcgatccctgtccgggcctggcggttgcgctgctctggtgcccaggttctagcgcgctcgtcatcagctcgacatctcctcgagctcgcccctgtcttcctgctcggcgcccaaattcctgctcgcctttgcgtcgcgcgcgtagcgttccgttgttcctacgcgtgctgccgcgaagctctctgttcagttcgcctccatcgcgttgtcgtgcgcgcgaaattgctcgctccccgctatcgtcgtttcctcgtgcccgctggtcgtgcgcccctgcagctccctgttcggcaaaatgtgtggaccagtgctcgtcgcgtgttgggaagatcggcaccgatgttcttgccgaatattgattggttgattttggggagatcgacgcacgcatgggtgttcgatgaatggctcaaaccggnatagccttgtcgaaatcatagctnctagtcgattcggaca

SEQ ID NO: 13031 - DNA, 891 bp, Zea mays
cacaagtctgcatattcttctctagttttttctttgctagctttcaggctgttttcaatgctacttcagacagagacgtcaatttttgtctgacgcctattgaggaccgcgggtacagtgcgttgggcacctccaggccggcaaccaactcctacccggccgccgccgccgccggtacatgtaaaaaaaggcttcgagacctgcgagatgaacgcagcggagagcattcaacaaaccaaaaccgcataaccaaaatgttcagactagcgcgtggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctggaaaccggcgtcccgagggagaaggccaagcacaggctcgtctttgtccatgggttcgactcctgcagacacgacgcgcttccgatctccacggagcttgcgcaagagctgggcgtttacatgttgtccttcgatcgccccgggtacgccgagagcgacccgcacccggccaggaccgaggagagcatcgccctcgacatcgccgagctcgccgacaacctgcagctgggtcgcaagttctaccttgctggcttctccatgggcggcgagatcatgtggagctgcctcaagtacatcccacacaggctctccggcgtggccattctcggccccgtaggcaactactggtggcccggcttgccgtcgaacgtgtcgcgggacgcctggtaccagcagctccctcgggaccagtgggcggtctgggtcgcgcatcacctgccgtggctcacctact

SEQ ID NO: 13032 - DNA, 1545 bp, Zea mays
  misc_feature (23)..(23): n is a, c, g, or t
gccatcgcggcgatcgccgagangggcgggggcaggctcaccgtgccagccgggcggtggctcaccgcgccgttcaacctcaccagccacatgactctcttcctccctcctggccctgagatcctagggattcaggatgaaagatattggcccttgatgtctccattaccatcatacggctatggaagagagcacaagggacctcgatatgggagccttatacacggccaagacctgaagcatgtgactataacaggtcataatggtaccataaatggacaaggtcaaagttggtgggtaaaatttcggagaaagctccttaatcacacaaggggtcctctggtgcagctcatgcggtcaagtaacattatcatttctaatatcactcttcgtgattctcccttctggactcttcacacgtacgactgcaagaatgttactatctcagaaaccaccatcttggctccaattgctggagctccaaatactgatgggatagatccagattcttgtgaaaatgtggtgataaaaaattgctacatttctgttggtgatgatgggatagccataaagagtggttgggaccaatatggaattgcttatggccgtccatcagctaatattactatccagaatgtcgtaatccgctctatggtcagtgctggagtatcgattggaagcgagatgtctggtggtgtctcggatgttttggtagagaatgttcatgtctgggattcacggcgaggcgtgaggataaagactgcgcctggaagaggggcctatgtaaccaatgtcatgtaccagaacataacctttgaaaacgtacgtgtcggtatagtgataaagacagactacaacgagcacccagacgaaggcttcgacccaaaggccgtccccaccatcgggaatatctcttacacctcaatccatgggcatcgtgtgcgagtaccggtcaggatacagggaagcgcacagatccctgtgaagaatgttaccttccatgacatgtcaatcggtatagtagacaagaagcaccatgttttccagtgctccttcgtccaggggcaggtcattggctacgttttccctgtgccttgcaagaacctggacctgtacgacgagaggcgtgggctggttaaacaatcaacgttacagaatatctctgatatcgactacagtttctgacaatggcatttgatcccactgtactattgctgtaggtgtattcagtattcacagccgtcacagtcctatccacacatttagaagcaaaattttgggtagcttttacactcttcacctctcagtcaggcatgtatctaaggaagatcgacttgaccatactgtctcgtagagggacgccaggaatgttgccttttcactttttttatcactgtatgattacacttggttacacgcttggcagtacatttttgatagtgcctactgttcatggcagactacatttaccttgccctttttaaaacagatgtggatgtatatgtatttggtagtttgaacctggaatggatgggccgtcttccc

SEQ ID NO: 13033 - DNA, 4675 bp, Zea mays
cattcataaaagtgaactggtggcttaagatttcgatatgtatgatcgcgatgagaacatcccaattctttcgtcatcttcatctcagcctagtggtgagacataaattgttttcgttatattgtagctaatggcttacttgctgtgagagagatagagaggtgctatttgtatgaataagtacttaaattatgaaatctgcactaatatctgtaatttattcttggcacaatatatatttaggcgctaattctatggaatatttcttttcaattttggccggtacagagagcgttgtcctcacgctgctgaattgcttatgaagaaggcaaaaagaaatatcgccctgtttagatcattgtaattgaattccattctaataataataatttagacacataccaattaggtcatgtttggctcctaggaatcgagaggaattcgaaagtaatctaataataaaatagaaagcactttctagatattggtttcaattcatgtgatccaaacaagcctttaagctaattcgattttatataaaatatatttgtacagtgttattagtaaaataccggatatatttatgtgctacacatttttattatagaggagtgaatccaagaacgtcttataagttatagagtgaaacaaattctattaatatataaaatcatttttcatcctccacccatgaattggaaagatgaaaagttaaattcaagctaaatatgttattttattaagtaaattataattttttcaaaataaatggatccgaacgctccatagagaaaagtatggacaatgttgacatgcaatgcaaccaacttttcatccatctattggcaacttattagcatgctgaaaattagcaaccattagctagctattttttagtgccagaaggtctaaataggccctgatatatatggtcttaaagtgagttggagatgtgtatgaactattagcacctattagcaacttcaaaccttgctaatatagctaatagctagtagctttttagataataattactttgttttttaggttggctagtattagttttagctgcaaacttttagcgttaatatgaacaagcatgggtgttatatttttcataaaagaaatataggcgttctgaagtcgtggtgcgctactgcgctcctacctcggtacctccagtatccgcaagctgaatgtcttattggacccacaagtcagtgtgatcatgctgcccttgccttcccctgccgcaaggcttccagccatttcgaaatttgaaatccctgacgttcccggcgcttatatatgcacgcactcctcgccagcacgcaggacgctgtccctccccttcccaccgctgcatgggcaaagccttctccctgctccggccaccgcaaccacctcgcgaggacgacacggagatgatggagctgaggaagcgcccgaggccccggcgcctcgacccggacttcctctcgtccccgcctcccatgccgccgaggaagcgggcacggaagcaggcagcggcgccgaagccggtcgaggccgcgggcgctctgaagtggcagccgccgaggaagggctccaggcgcgccacggtgggcatcgggtgtcccgtcgctgggctccatcctgcgacgtgcggccggcagccgccgctgcgcatgtcgacgcgcgtcctcttccgcccgcgccatccattcaactggtacgctatctccgtgctcgaagatggaaacgcgaattgttccgtgctgaattgggtttagttttcctgctactgcgatcggagttgatttcagttctgacttctgagtgctctgttcgatcctctggttattatttgtgtggctgtgtgcttagacgagggaattgactcgtactgacttgcacttgctcgaatttgaattttagcgtttccgaattcgtgattgcatttgcgtttctacggattttaacccctctgctgcgaatcatgcttgatttgaaagcgatcgcaactcatagattggcactttggcaggtcccgtatgtgtaagtaggttgaagctcagagatgattcgaatttcgttcgttgcattttggtgtgtatccgccttgcactgtcacagttcgaatttgatcgaagcctgcagcattagcggttcacaccagcattacaaatttcggtccagtttcatcactgaattgagttgaaatcctgagccagtatttctcaatgcaggtacgagccggacctgtggacggaggtggctaagcacctgtgcggcttcgacctactccgcctctccttgacctgccgctggttccaccgcctcctcgccgacgactccatctggcgctacgccttcttccgcgaccttaacctcaccgacgccaacccgcacgttcatcgcccgctctcccgctcctggcgctacctctactttgccgccttcggtaagcagagcaccaaaaaatacccccacccgtaaccgtaatccgcttcagttctgtcactcactgacagcaggtcccgcttagtgacacgtgtgctcccctccctcctcctcacagatggctcccacgccttctcgctctgccagaacggcgagcaccgaagtaagcgcagcgagattgtaggatttaattctaatttcgccattgccttgcgctgcgatactgtgtatttgacgtcggcgagaccgcgagacgcaggttcgtggcggatcgggtcattcgtgctggactcgccgcacatggtgctgatcgggaagctgccgctgccgaagtggctgccgtcgtgtcccgaagacgtacggctcaccatcgcgatactgggcgcctgcaagctcctcaacgtccgccctgggatctggatcactggtacgtacgtggccacatcccatggccatctttaactagcctttgccgcctgaccgtcttcagctggtctgtgttgaatgcttgcagacatgcatgtgatgcgatgccccttgtgcaaacggaacagctgccgaggtgagccggtggatggtgctggaacggggaatgcgtcctgccctgccactgctggtatatatgcctgtttgctgacttgttggtactgatttttggtacgggtggaattggtggttcagggaacaagcagatcctggacgcacgccactctgagctgttcctggagaaggcgtactgggacgagaccttggagtacgagagcctcggcgagcactttcaggacgaggaggtggccgccgccttctgtgccgttgtcaacgcgaagcagttcgcttccccatccactgcatgtacgtccgggcggcaaccatcattccagtgctgtctcttcctcccagttgcagttatctgtctgtactctgtactgtacgttttcgacagtggacagaatgatggattggtgaatcgtgattcgtgaataacatggttggcgttgatgttgccttgttcttcagctgtcctcaacagggcctggaccggaaagcacgacgacccgatgaccaggcactgtgcttccgcaaccgccgctgccatccacaccaacctccagagcaacggaggtacatacagcaaaaccaattgcgatcctcgttccagcgcagtgccaatcccgagttctgatgtgatgcgtgtcgtgctctttgggtgacaggactactatcgacgtttgaggcgatgcgggacacggccagggacgggcagatcgtgtccatacgcatctcccaggtgctcttctgatctgtacccaatgctgccttggctgctgtgatttatgatggaagtaggcctggccacactcgttctttttttttactgctattgatgcatttctgtctagattggactgcagagagaaagttggggcagatttccggcttcaatttatgtccttattagtagtatattgcacacgtactggaatctgcttgtttgcttaatggctataccacgaacgggttttgtcactgatgtgctgaaaagaatgcggatgcttttgtttcttttaatatgggtcgtgccatcttttccccgacactggcgcaatgtggttttgtcaccgatgtcttagtagtaattctcacagcgcccattcagtaatgcagaacaaaatcagatatgcaaaccgaccagctagcgacacatgattctaaatcgaaacacaatccgagtttcatagaccacaacttcaaatgggcgctgtgaacattttcaacgtgttagcaagaaacgcagcgctattctttggacataaagaacgtggttcactgtatgtacatcatgagttgggccaagtagcaatagtacctgccacacacgtggtcttttatattaattgttgccaggctgagcagcgcatctgataaatatcaaccggtgttgctcttagcaagcctaatccaaggtatccaactccaacccaaaaggctcctcgcctttggactacatggctataatcatgcaaaatgccatggatgatgacctactcctggtactgataatattggagcagtacatctctctccaaaaagatcaagcactgctacatgaacccaaaaaaaaaacatgtactgactagtgactactgagtgggaaaattgtattcgtacgtcgttgcctacttgcctttgcagctcgtgcgacctgcttttcttcccccctccccccccccaa

SEQ ID NO: 13034 - DNA, 6573 bp, Zea mays
  misc_feature (214)..(214): n is a, c, g, or t
  misc_feature (1342)..(1342): n is a, c, g, or t
  misc_feature (3788)..(3788): n is a, c, g, or t
  misc_feature (5035)..(5035): n is a, c, g, or t
  misc_feature (5217)..(5217): n is a, c, g, or t
cgtattcatcatagcttgttataccctttgttaattaattttgatggcacgatttatatgctcagatagggcgcgttacaaaaaaaaaaagagaacaagctcagtgtagcgagtgtcatccaaggttcagaagatcgcactgaacccaccattaatcttgatggcatggcacggtttatatgctcagatagggcttgctgtccggacgatgtgntactagtgttgctatttgccgggcgatgtggtactagtgttgctatttggcaccactcactagagcgtacaaaaatacaaaaaaaagagagaacaagctcagagtagcgagtgacatcacaagttaagatgatcgcactggacccaccaatgctggtgtttttcttcacagcttgtgtgccagcaaccttcacagtacagtttatatgctcagatacccttgatctctgggcggtgtggtactagtgttgctatttgctagcgattgtggcgggtgtctgccagcttagccgcgtgggctggctcgcgcaggaacctctcttctgtttctaaccatattgagcgttgcgtgggccatgttttcatgtggtgggctaaactgaacctacgagtacacaaaaggcatcagtccaaccatctcgctgcacgccggtgttgtccgatgaacccgtaacgcaaaatggaaaacagaattcgaagttgagcacgttgcgataagacatgcggtttcgaacggattccgtttccattttaccaataccattgcagcaaccaaagcaataatctagatagtacttgctatcagacaagggcacaccaaagtcttagataaaaaacaaagggacgtacaggcaggcgcatcgcgcacatgcgtggggtggcgactattgtgtgtgtgtgtgtgtgatcggccaaggtagtgcgggagcaaaagcgaacaaaagaggaggtaccgagcgaggtttacgatcgttttctaagctcgagaaaggcgacaactccggtctcctgtcatgtgcctagatcgccgtaaccaaaaagctggctgctaataacctctcctaggtctgcgccatggttaagccagcgggcttcagtaatccttatccacccgtgtgtctgtctttctctcagcctagtacgtaggacagatcgtctggtgtttcattccctcctttggctagctgttaggaaacttaccggttaacccctaagcatgtgggggctgggaaatgggggtagaaaggaaaagctaagctcggaaaagcgcagcttgcctcctcaacacccttgtcaacaaaagctacttagagcatgatgctgaagcttttctaactgctttgacagnataaggtgaaattgaactggaatcagaaatccatggtgaatcttttctccttccattccagtcgaagtcttctctcatgggcattcttgtaccgggctatcttcccaaaaaaatgtgcctgccgcctgccgggctagtaagagaattatagtagtagtagtagttaataatggagccaattacttgcactacttcaatgtccatgcctaggcatcggcatccttggccgtttgctagctgcgtcttgcaaagcgatgtgtttttactacgcgcgtgcagcttatgctatgcatgcccacataatcggtttcagatcaggcaaatcccggtaggacggacgctcggacaggcaacctgtagattattgcagggtatgtgtgtgtgtgtgtgggagaaagagaggaactggatgagcgagcaaagctgtactaaagctgagaatatatatgaccgcagtgcttgtactaaagctgtactttgtgggactagtaggcgtctgcaatcagttgcaattctgtatgtttttttcttcttctgataataagagcttcagctacgattaccatatgaatgcgtctgcatgattctgaggggtgttcactgtttctcgcactcgcagtctggcatcatcgactcattcgtatgcctctgacagaaggcgctcaataagaagaacatggagtcagctaggcatgcgtcgataggaagagtaaaaccagctaaatatgatgagagtggcagtgaggttgcaaggccatcaaactgatgttactgcgcgtcagggcaaatccccacaccatcccgtttgcgctcagagattacctgcaaagagacaagcaatagccgtcagggcaaatccccacaccatcgcatttgcgaacgcgtacgacgaacccaagaacggcagaactactacacaaagcaaaaggagacaaggagctatagagagaagttggagagagagatatcgagagaggaagaagaagcaagcgaggagaatggtgagagagcccgcaagacggcaagagccaaaaggcttggccccgccggggcccgtgattctttctttgcctttaactttcactttcctctccctcctcgctcttttcacccttttaccctgtccgatacgcctctctacttaaaaccgagacctggcgcaccggcagctccctcctcacgcaccagcacgagcgcaatggcgcaactgtactagctagccgcacagtgacatcagaggtgtgtgggtgtgggggggcggggtggggtggggagtgacacccgggggccgatgacgacgctgcacatggacccgccggcgccgcccgcgcgccgctcagtgtcgaccagctgcgacctgcacccgggcgagacgttcaccggcttctgcgccgcgtgcctgcgcgagcgcctccacggtctcgaggcgtccgccgccgccgcctccgcgccggggcgcaagtccacatcggccatccggtccctgttcgccaggccgttcgccgccggcagctcgtctgcgtccggccccgcgcagccgccggacctccggcgctgcaagtcgttctcgtgcggccgcggcggcgacgctctggccgcggcggaggtcgccagggcggacgagccgcagcggcattcgtgtgacgtgcgggggcgcagcacgctgtgggcgctgttccaccaggacgaccgtgaccgcgtccgcgacggcacggcgttccgcgcattcccagcctcctcatccaccgccatggctgcgctcgccgtcgacgcggcaccgtgcatccctgacgatttcttggacgaagacatcccaggggccctcgggcccggccgggtagtcccggtggtcgaggagggccctgccgtcgtcccgatggacatttccggcgaggtggcagccgagagcaatgcggcggcccagggaggtaaggccatcaaggaccacatcgatctggagtcggcggagaacaagaaggcttcgcccaaagacctgaaagagatcgccgggagcttctgggccgcctccgtgttcagcaagaagtggcacaagtggcgccgcaagcagaagctcaagaaggaggctaccttgagcaagggcgcggcagcggcaatgccccctccggagaagcgctctaaagcgtcgttctttggccggagccgcctccgtggggaggcaggcaccgagctcgccggtgggcggcgctcgtgcgacaccgacccgcgtttctccctggacgcctcgcgcatgtccatcgatgacgccggcttctcgtgggacgagccccgcgcgtcgtgggatggatacctgttcggcgccggcgccggcgccggcattggcctcgggcgcgcgcctccgccgctctcccgcctccctcccatcctgtccgtcctggaggacacaccggccgacatcgtcgagcgctccgacggccaaatccctgtnggaagacgacttcgaccccgagccgccaggtggggtcccttgcagaccagagactactacctggactcctccagccgcaggcggcggagcctggaacgatcaagctccgtacgcaggccgtcattcgaggtgacggatccaaggcctatggcgcccgcggtaataaatgggagggtgtccccagttggcggttcagagttctaccacttccaccacgcggaggacttgctcgaccgcggcttcagctccaactccctcatcgaggacatctccgcgagcctggaggcggcgctgtccgggtccggccccgccaagaagccacggcggtggcgcaaggcgtggagcctctgggggctcatccaccgccgcgccgccgggcgcaggggcgcggggcccgtcggacatcgccgaccgctccttctccgagccgtggccggacctgcgcgtccgcggagccaaccccaaggtgcagcggtgcaacagcaacctgagcgcccgcagctcgttcagcagcaacagcggcgggctcggcagctccaggcgcagcagctacgtggacgccagcgtgaggcggagggaggagccgcaggcgcagctggagcggaaccgcagcgcgcgctactcgcccgggcgcgccgccacggcggacaacggcatgctgcgtttctacctgacgccgatgcggagcggcactgggcggccacgcggagccggcctgccgaccaaggccggcagcgtgctccgcctgtactaggaggcgccaggttcttttgtctaatctgcatgttcctcaaggaaggagagagtctggggttggttcttgtgccataaatcttggtgtattgtaatgtaatctgtcgttcttgttcattttggggattggacatcatctcgcatgtccagtccagtcaagtcacgagggtttcttttccttccgtgagttatttgtggttccatcagcatatatggctcgacctaaatttggagggaaacacgttctaatcctgctgtcgggcctctcttttgtctctttccagacacaaggaccactttgtgtcaactctccatgctcttttggaccgtggggagagacggaggcacgacaacacaaggcggaggccaagaggtttgacacggccatggctggccggtctcgcctcgcgcggctccggctccggctccgacaccggtggtactaggctcgggcccgtccactgcacgtgattggtccttaaaggaggtcgtgnttgccgccgcctcggaaaccgttaaaggcattcctcctccggctccggctggcccgcggccgcccttgtttccccatcgttttgctggttatctgccattccctgctggtcttgcgtcgcactgccactggcaccggccgtggcagcactgcaggtgcagcacaatggcgttgggccgggcnacagcacggatccatttgtattctgagcgtgcgcgtctcgactgtggggtgtagtgttgtgccagattcagggttcagacagagacagatgttcgtgtccaccaagtgattttctttctttctttttttttccctttcccgttcaacgaactttgtaaaattaggcaatcaagaactgatcttccgagggataaatttgccagttaggaaaataagaagtaaactttgtaaaactaggcgatcgagaactaacctcgatgaataaggtacacctttttcgaaaaaaaaaaacataacttgatcttctagtttaagcggtacctagaagtaccaagtggctgagaggtgctacaacgttgtgtatgtaatggcttatggataaactaagacttggatgaaacacccatttttaataaaaaaaggttttgttttattatttcatatagtcttaatttcgagaatcatggagaattgacactgtgcaaaaaaatcacttatatttttctttaaaaaatgttgtcacatcataaaaaataaaaaaaactcttatgcgatggtttatcaagtgtaaataaaaaccctcgcatttgtagccttttctagctctctattaccaaggtacaatcatttcatattaggataatcttaggaggagtatttagttaattttcttagagcattctcgccgagtgtttcacgagagttttattctcaatgttgtgtcatgtcaatgatttagatgatgtaacgaatgattaatggataaaaaataaagatttatgaggatgaaaccatatctataatattacctagatatagtatctctttcatgttatttattatgaaatcgcactgaataaaactctcttccatgatagactatttcaaccaagatttcattttggaaacacaaataagaaacctaactaacaccaacactgagaatgatcttagaatatggaagtacccttattttatggctaagtgagtaatgttgtaattttagagaaataagtgacatgcttccatcatatttaaatatattaaatattttaattctaaataaaacaggcataaaactcagataaatgttatatataattataacaacaacgaacagtggcaactccattaaatggaaacatgaaacatagctactcagatccatttataaattaaacatggcttgtagatgaaaaaggcagattaaacacataaacataattgtttatattaagatattgctcacaaaatagcgggttgctgcactagacagccttccagcgctaagtggtgatcagagatcttcgactaacgtgacagtcctaccttaccaaatcagggttttagaacaaa

SEQ ID NO: 13035 - DNA, 2891 bp, Zea mays
  misc_feature (679)..(679): n is a, c, g, or t
gataaatcttgtttcaaacaaaccacatagcaaaagcaaaaagaatttagactagctccaacaaggacctctaaaagaccatatactctaaatttaaaggatgatgtcgtcctataccacttcaggagcgtcctctaaacggttatctaaatttagggaacaatgatgaatcttttctatatatatagtttttttaaatgatcatctatccatttgaatactttaaacaaccggtttagcaaaactaaaatatgtataatacatttgagagtataataaatatgtatctataaaaatttaaaaaataaaaatatatctaatatagatatttgcgtatagaggacgtgatttagaaaatactgttgtagaggacggagatataaggaatgaaattatttagagtagactgtaaagaataaatataaatgatagatataatacagtattatagagagacagagaacaagaagacctagccggccaagcgaggaaggagagaaagagcaaagcctggccgcgccggggcccgtgattcgcctttaactttcactttcctctctctcgccctttttacccttttatcctgtccgatacgcctccaattaaaaccgaggcctggcgcaccggcaactccctcctcgcagcagcccgtgcaatggtgcaactgtactaaccgcangagtgacgtcggggggtgtgggtgtggggggcggggggagtgacgcccggggtggcgatgacgacgctgcacatggacccgccggcgccgcctgcgcggcgttcggtgtcgaccagctgcgacctgcacccgggcgaggcgttcaccggcttctgcgccgcgtgcctgcgcgagcgcctccagggtctcgaggcgtctgccgccgcggcctccgcgccgggccgcaagtccacatcggccatccggtccctcttcgccagaccgttcgccgccggcagctcgtctgcgtccggtcccgctgagccgccggacctccggcggtgcaagtcgttctcgtgtggccacggcggggacgctcttgccgcagcagcggcggcggcggctggtgctgctgccaccagggcggacgagccgcagcggcgttcgtgtgacgtgcgggggcgcagcacgctgtgggcgctgttccaccaggacgaccgtgaccgcgtccgcgatggcacggcgttcgccgcgttcccagcctcctcatcgaccgccgcggccgcgctcgccgtcgacgtgcatcccccaccgcaggcaccgtgcatccccgacgttttctcggacgaggacatcccagtggtgatggagcccgacgagatagtcccggtggtcgagcaagaccccgtcgtcccgatggacatttctggcgaggtggaagccggaggcaatgcgcccccgcgtccgatggccatcaaggatcacatcgatctcgagtcggcgcagagcaagaaggcatcgcccaaagacctcgccggtagcttctgggtcgccgcctccgtgttcagcaagaagtggcagaagtggcggcgcaagcagaagctcaagaaggaggctgccgtgagcaaggccgccgcagcggcaatgccccctccggagaagccctccaagccgtcgttccttcgccggagtcggctccgtggggaggcaggctccgagctcgccgatggccggcgctcgtgcgacaccgacccgcgtttctccctggacgccgcgcgcatgtccatcgacgacgctggcttctcatgggacgagccccgcgcgtcctgggatgggtacctgttcggcggcggcgccggcattgggctcgggcgcgcgcctccgccgctctcccgcctccctcccatcctgtccgtcctggaggacacaccgacagacgtcgtcgagcgctccgatggccagatccccgtagaagacgacttcgaccccgacccgcccggtggctcgctacagaccagagactactacctggactcctccagccgcaggcgccggagcctggaacgttcgagctccgtacgcaggccgtccttcgaggtcacggatccaacaaggccgatgccgcccgcggtaaacgggaccgggagggagtccccgattggcggcggttcagagttctaccacttccagcacgccgaggacttgctggaccgcggcttcagctccaactcgctcatcgaggacatctccgcgagcctggaggcggcactatccgggcgcgccaagaagccgcgccggtggcgcaaggcgtggagcctgtgggggctcatccaccggcgcgccgcggggcgcaggagcggcggggggccgtcggacatcaccgaccgttccttctccgagccgtggccggacctgcgcgtccgcggagccaaccctaagatgcagcggtgcaacagcagcaacctgagcgcgcgcagctcgttcagcagcaacagcggcgggctcggcagctcccggcgcagctacgtggacgccaacggcaacgtgaggcggagggaggagcctcacgcgcaggcgcaggtggagcggacccgcagcgcgcgctactcgcccgggcgcgccgccgcggacaacggcatgctgcggttctacctgacgccgatgcggagcggcagcgggcggccgcgcggcggaggcggcctgcccagcaaggccgggcccgggcggccgctggcgacgcagtcgttcgcgcgcagcgtgctccgcctgtactaggtaggctacggcgtcaagtccaggttcctctgtctaatctgcatgttcaaggagagtctgggggttatagccataaacctttgtgtactgtactgtactgtaatgtaatctgtcgtttcatttcgggggattggataacacgcatctcgtctcataaaagaaaaaaaaaaaaaaaaaa

SEQ ID NO: 13036 - DNA, 2839 bp, Zea mays
tagcgtggtcgcggccgaggtccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattagtaagtagatttcctcaactaccctaatgcacgtgaaattttatcttgttaattgttgggtttaaatacttttagctgctacactgatgtgttttgcatgcagtgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatgggagcttacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttctgagagattcttggccaagtgccttgaggaggagcaaactagcagcgtcgccattgctatattaatagctggaatcatgtagtagtagttcatccattcattcgaagatcgtgttccaaatcaacacaagtaggggtttgcttctcctctttccaagaaaagtggttgtagcgtgagatgcaaataggtctcttgtgctagatcaagctcaataaactttaggccgtgttaggcagctgatctacttcaaaaaaaaaaaaaaaaaaaaaaaaaaaaaaaaaaa

SEQ ID NO: 13037 - DNA, 3113 bp, Zea mays
tttcctgtcctctcctctcctctccccgccacgtggctccgaaccctcacaacagtgcatcgtctctcctgtccccgccatttggttcggaactctcgcggcctcatctcctcctcgtcatcgtaacacccacgcttagagttcgtgagggtcgcccccaggggatctcgagacgtccgtttccaagagtggaccggctcgcaggcgctgctgttaccttgggtggagctcggacctgcggatcagttggattctcaagggagacggagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaataatgggcagtgcttgccaagctggcacagacgggccttcccgcaaggatgtgttagggatagggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttctgagagaaaaaaaaaaaaaaaaaaaaaaaaaaaaacctcgagaaaggggcccggtacc

SEQ ID NO: 13038 - DNA, 3997 bp, Zea mays
ctctcctctccccgccatttggctccgaaccctcacaacagtgcatcgtctctcctgtccccgccatttggttcggaactctcgcggcctcaactcctcctcgtcatcgtaacacccacgcttagagttcgtgagggtcgcccccaggggatctcgagacgtccgtttccaagagtggaccggctcgcaggcgctgctgttaccttgggtggagctcggacctgcggatcagttggattctcaagggagacggtggtttctgatttcctttctctaagcataccaaatcctttgtctcgagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaataatgggcagtgcttgccaagctggcacagacgggccttcccgcaaggatgtgttagggatagggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagacaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggtagcctgttttcagttacatgcctgttgtagctatgacttgaaatcagtaatagttatttgagggttgaagggccttccacttaatatataaaagtaagggtagggattcaaatggtttgcacaattataatcagaaaaaagatagaagtgattattaataatctctacctttggaggatataaaaatgcttatgctacttccagctatgccttttgtctttttttagaaaaacttccagttatgacttaattgttaatattgacaataccagtgtaggaatactgaaattagtcttgaaagtaagacattagttgctgctgtttgcgtgatggcccctagcttgaggatactttgccgctactcttgcggatgctttgccgctccatgtcatctctagcggacgctctgctgtcgtgctgctggatgtttgtctcgtctcctctcaggggatgctctgccactgcagtgtcttcgtctttattggcaacctggagttgatgtgcttttccttctgcaggttcagtcggttagattttaggtggagagtccttcttactgcattttctttctctggttctttgggtcggtttaggttgctaaccacttctgtgcttttgtaatatgggcgacggggtctctcagtagctttgtcataaaacaattctacttccccttaatatagtacatgtgactctgacatgttatcgaacaaaaaaaaacattgctcgctctaaattttatgagatctggcatgatttcaaactattcttcttttcaaaatcctgttttctgactgcagtttttacaagattttatggtcttgccgcttcatttttctgactgtttgcattggaccgataccttctgatggccttgtccgcctattttcaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttttgagagattcttggcc

SEQ ID NO: 13039 - DNA, 2191 bp, Zea mays
  misc_feature (623)..(623): n is a, c, g, or t
caccaccaaaccctccataaatgatagaggacaagaagctcgatgatactttgaattattttgtgaactattgtcttgttttgcactatggaactaaagtgatattgattaatcctagacaaggatggaagtgggtattcgaattgttaggacaaatttaatattttaaaatagatatgtatgaaatttgaagctaatattttcttatgttatcatgcaaattattataaataagtataaaattttgcatagattgttttatacattatttgctccctacaacaaaaggataaaaaatatccatatccgaatcatatctaaattatatatatatatatatatatatatatatatatatatatatatatatcatttgagaagatatatgataaatttaagatttaccttttatggatctttacaagctcaatgctaaaaacaagaatatgaatttatatatcagattttatatcctatttattcacaataaaataaaaagacaaaaaaaaattgatacccggataagtatccattttcatctccaatcctagacaaggtggtccttcaatctcttcctgtgtggattgccatgcatctagtgtaagtgctcatgtaatgaatcnatttagaaggacatgttagcacatagaacatttttttggatatttggtatgtagggaggctggccattttttgattttgaggagcacatttgtggatccaagtcacattgacagtaagattacattgttgtggagttccaagcaggtattaggagtcgccttgcaagaggtcgctagaccgtaagtgtggtatcaagatttgtgaaggagttgttctgtctgagctaggatacagttactaatgtggcaattctaatggagatatttttgggtgagttcacggacatgtgctctagtcgataattaataaattaagcaacaatagccattattctatttgagttgcgatgtgtgtttgattaggagggaaggacatacaaatggcatggttctccttgtcatggagatttagtagagcggctaaagctacgttcatcgctaactaattcttattagaaaaatgaaaatctcttaaaaaaaatagggttcctaagctagcctaaaaaaacatttggatgtcgaacaggcggaccccagtcccatcccaaaggtcaagcgaaatccaattaccatgattacatgaacgcagagcaaacgccccatctgtgtttgggctgcacatggcggtttcatccgtcgccctgcggtctgcggctccagtagctagcatcacgcatttcggctgagcaacgtggccgatggccgcggccggccaccgggtagtggtttcacaagcaccgaaatgcatttaatatgagaatatccagcacaaaaatcaattgaacgttttgagaacgaaaataacacccgccgatactataccataaataaagttcaagaaatccacccctgcccgccgccgcctcttccttccggccggtcttcgtttcgacatccaggaaatggctaccgcggcgcgcctcctcctcgtcgtggtgcttctctccgcggcgataccgatcccgtccttcgcgacaagcttcgtcgtcggcgacaagaggcatcgctgggctcccaacgtcaactatacagactgggcggaccgtcaccagttccacgtcggcgactggctcgaattcaggtacgagagggacaggttcgatgtggtgcaggtgaacgagacggcatacgcggcgtgcgacgccagcagccccatcctcagctacagccgcggccacaacttcgtcttccggctcaaccacacgggccggttctacttcatctgcagccgcggctactgctggagtggcatgaaggtctccgtgctcgtccagccgccgccgccgcccccgtcgctgccgccggcgtcccactcccacgcgtcaagcgccagtgcgcgtgtgcggccggcggccgggctttggtgtgcggctctctctaccttgctgggctgggcggtgctcacgccgccgctgtcgtttcgggtctggagttctggacgtccaggcgcgcacacgagtctaaactctaaagctgtttgctaatgtactacccatttcttctttttttagtatggaaataagagttccggctttagcacaaaaaaacaaaaaaaagacgattattac

SEQ ID NO: 13040 - DNA, 2406 bp, Zea mays
  misc_feature (1927)..(1927): n is a, c, g, or t
  misc_feature (2265)..(2265): n is a, c, g, or t
ggaagacgtgttctccgggcaggcggtgggccaatcccgcgttcccctgtccacggtgcacaggcgatccgacgaccgggtggagccaccgtcccggtggctgaacctgtgcggcggcgaggcccggccgtacgccgggcgggtgcacgtgcgcgtgtgcctggagggcgggtaccacgtgctggacgaggcggcgaacgtggccagcgacgtgcgcgcggcgtcgaagcagctgtcgaagccgccggtggggatgctggaggtgggcgtccgcggcgcggccaacctggtgccgatgaagatcgccaaggacggcgcgagcgggtcgacggacgcgtacgtggtgctcaagtacgggcccaagtgggcgcgcacgcgcaccatcctggaccagttcaaccctcggtggaacgagcagtacgcgtgggacgtgttcgacccctgcaccgtgctcaccatcgccgtcttcgacaacgtccggtacaaggccgccgcagccgacgatccggggaagctgcccagggactcccgcatcgggaagctccgcatccggctgtcgacgctggacaccaaccgggtgtacgccaacaccttcgcgctgacggcggtgcacccggtgggcgtgcgcaagatgggcgagctggagctggcgatccggttcacctgcccgtcgtggctgacgctgatgcaggcgtacggcagcccgctgctgccgcggatgcactacgtgaagccgctgggcgcggcgcagcaggacgtgctgcggcacacggcgatgcgcacagtgtcggggcggctggcgcggtcggagccgccgctggggccggaggtggtgcagtacctgctggacacggacacgcagtcgtggagcatgcggcggagcaaggccaactggttccgcgtggtggggtgcctgtcccacgtggcgacggcggtgcggtgggcgcaccgggtccgcacctgggcgcacccgccgacgaccgtgctggtgcacctgctgctggtggccgtggtgctgtgcccggagatgatcctgcccaccgtgtgcctgtacctgttcctggtgctgctgtggcggtaccgcgcgcgggcgcggcagccggcgggcatggacccgcggctgtcccacgtggacagcgtgagccccgacgagctggacgaggagttcgacgggctcccatcggggcgccccgccgacgtggtccggatgcggtacgaccggctgcgcgccgtggccgcgcgcgcgcagacgctgctgggggacgtggcggcgcagggggagcgcgtggaggcgctgctgtcgtggcgggacccgcgcgcgacggcggtgttcgcggtggtgtgcctgctggcggcgctggtgctgtacgcggtgccgttcaaggtgctgctgctggggatggggttctactacctccgccaccccaggttccgcggcgacatgccctccgccggcttcaacttcttccgccgcctgccgtcgctctccgaccgggtcttctagactctctctctctctctctctctctctctctctctctctctctctcgcatgctcagatcgcggtctctgcctctgctactgatctctgatcagtctagttcgtttcttgatcgtttcatcttcacttctccgtgtaatctgcctttgtcaggttgccttgttttttttatcggttgcagtcagcagcaagcctcggttgatgaggcttgttggcaacatcaataacagcagcaataataatatctattgtattcgttcgttcatctctgtttctgggtttagtacatggatgagtttgattgtgggtgagactgggaaattgactgttgcattgcatcagtcaagaacaatgctgcattgaattccagtcaaaaataaatacataaataaataaaacagtgcaaccggttttgttacagcttncgatttggttcagagccggaggtgcaggaatgagaatgccatcattgtttttcctctccgggttcttgttttccgttctgaagacgaagagctcagtccactccgtccgtctcaaactgcgagttccgcacgcgcatggcatcatcgtctaatggtggaccgagagaggattcagagcatggtagaaaagatgtgcctgaaaaatcctacacagagagaaaagatgctttgctgagaaataatcttctgctgcacttgtttggcgtggccaccagatccctgcctgctttgcttcacgtgagcgagcccttttgcttcatatggcagacaggattcanaggcaggaaatgataagaatacagacatcctcacgtcatccgtctgctactagtgctgtcgcgagagtggttgtcgtttcgttccgtttggcagtcgcctgaatgagagctgaaaaaaatgatggcagacgcggccccccc

SEQ ID NO: 13041 - DNA, 1493 bp, Zea mays
caacgccgccgggtcggccgtccacgcctcatcaggccgctccccgaggtactgctcgtcggcggagtgcgtggacagcgtgtcgatgacggtcatgaacgtggtggtctgcgtcaggctgggcagcgccgacaggaagaagcggtgcgggtcggccaccaggtgcgcgtactccgggtcgccctcggcgggcaccagccgccgcatcagcggcggccggttcgggatgtagccgcccagcgggtactgcccgaagttgagcgccgcgtgctgcgccgaggtgagccacagcagcgtcgtcagcagcgacgccaggtccgcgggcgtcgacaggcgcggccaccacggcgcgtcgcgcttgtccgcgtgccccgtctgcacggcctccctgtaccacgactgcagctcggtgtcgccctgcacggactcgtcggacgggtagtacatggccacgtaggcgtcgcaccaccgcctgatggccgaccagagcagcaacccgtcggtggcgtaggggtagtcctcgatgagcagccggagaccgtgcggctgcgtcgggtcctccacggccattcctcttctgatgagatcggcagggaggccctcctggtcaagccgccagagctcccggtacgcgaacgagctcatctccatgcagtagcggccaggggtgaacccggactcgatgacgccgtcgccgttgatgaggatctgccgcgccagcgcgttgatcttgagcgtgtaccgcatgtgaggcttgagcagcttgaagatggggtgcatcgcgctcaggtgccggtgcgccgcgatgatgaacggctccatggccgcgtgcgtcctcagccagtggttgatgagctggtggacgccggcgtcattggagcagacgtgtgccttggcgagctgccacagccagttgctggtggcgtcggcgggcggcgtgaacacccgcttggcgcgcgcgcacccgtcggtcatcggcggcaggcacagctcgatcgcgatgggcttcagcgtgcccgcggccgtcaggaagaagagcgtgcgcgtgccgtaggccttccgcccgtcctgcgcgttgatccggtccaggaacggcatgaagatgtcgtggtagtccagcatgtacagcctgtcgtcctgcagcgcctgctgcaccgacatgccgtcgagctgcccgatgatgtgctcctccgtgatggccgactccggcgggccgtacacggccgggtccagcttgctcatcggcgggaacgcctgaagacgttcgatgttgacggggttgatgccagccagcgcctgcctcgcgaactcgtcgtcccgcagccaagcaaacttgtcctctgccacacggaagggcggaaaaagaaatcttgatgatgtcgggagtgtcgtagcggaggaggccctcgctgttctcctggatcttgcgcacgaaggggatcttctggaacagctggtcctgcagggcctgcttcaggcgcggacgcgtgggt

SEQ ID NO: 13042 - DNA, 3653 bp, Zea mays
  misc_feature (3611)..(3611): n is a, c, g, or t
ctccaccatgcaatccgcgttctctgaaggaagcgtctcgaatgttctaccagtcacgccgactcgccgttttgcttcggcaagttgggagacaccgatcgagtcgacagcttaagagtgatctgttcctactctacttagagtgtagacatcgttactaaaaaaaatctcataataggaataaaaaaataaactacgcttggagcctttgcacctcacaatagtaataaaatctcataatagttagtacgatacgattcatagcagtaggcagtcgctccgtggcccgcccaattagctgcgaaagaaaagaaggaaaccggggggccatcatcgcagtggaactggactgtgttctccgggtttttcctcgctgcgttggattcccctgatcccgccgcgggccccgatttcgtgtgcccgcaccggtcgccgccagccgacacggccttaattccttcctgagacacgagtggttggtttggttgctgataaagaaaaggagacgtgtgagtgtgacacaggtcgcagctcgcacgcgtggttcggtggttgtgccacagccagtgacaggtgggcccgcacgttttccgtactactgcttgctactctgctaggttatttgtcattaattaaaacatactagtataagctcaaatgctactgccatttttaacatcctgctagagcatggctttccatgctcctttacatgcgtgcgtgccagtcatggctcctggcaagctaacgggaaggaaccgagggattttgcagtcatcttttccataggactcggttcttttacgatacgttcccctacgcaattatttcgccatgatcctcttgtgtaaagaaagtgcgagatctttggattgtattacaataagaaagtaatgtgcagcatgcaagtcttattattccaaagtgggggtcagtcttaagcacacgcctatccctttggatcacacgctcttctcaggtacaagtggaacccaccgtaccaccaccgtctgatgatcgaggtattagcttcacctagtgactagtagtatcgtagccactttttttttaatttggatggacatgcatgcagctcagagtgtagactgtgtagaatcccatgccttgttgtgtggtcgcattcactcatcagtcatcaccaccccataccgcccgtgtttctccagtcaattttttaaatgaccagactctccttctgtgtgaaagcttgggaaattttgatagcgccttcgtaccacctcataatttcgtggctgtggtcaccgcatttacgcctctcaattcgacgtccagccgaagcaagaaaagatcataggggagagtatactcggtggggcttgtggttttctggagcattcctactagtacgtagtctcctaaatgaattttgactcttttaaaaatagccgaggcggcccctcccggcccgcctccagcttcttctatgcttgcaattcttttctgcttcggtgccaagaagctgagtagtgagcactgcaggtctgtgttgtagctgccaagaaatgagcttggggacctgcccggccgcggccggcgacgcgacggcagaggagctgcttcaacgggcgcgggggctggtgccacccgcccttgccgctgcgcgcgcggccactggcttcggtgggcggtggaaggctatcgcagcgaggctggagaaggtgccaccgtgcctgtcggacctgtccagccacccctgcttttccaagaactcgctgtgtcgggagctgctgcagtcggtggctgcgactctagcagaggccgccgagctcggtgcgcgctgccacgagcctccgaaggcagggaagctgcagatgcagagcgacctcgacgctctggccgggaagctggacctcaacctcagggactgctcccttcttgtcaagactggcgtgctgtctgacgcgacggttccggcggccccggctgcgtgcgcacaggctgacgtgcgggagctgcttgccaggctgcagattgggcacgcagaggcgaagcaccgggctgtggatggcctgctcgatgctctgcgcgaggacgagaagagcgtactgtcggcgctcggccgtggcaacgtggccgccctggtgcagctgctcacggcgacggcgcccaaggtcagggagaaggccgccactgttctgtgcttgcttgccgagtctggcagctgcgagggcctactcatgtcagaaggcgcgctgccgccgctcgtccggctggccgagtccggcagcctcgttgggcgggagaaggctgtcatcacgctgcagcggctgtccatgtcggccgacatcgcccgcgcaatcgtcggccacagcggcgtccgcgctctgatcgacatgtgccagaccggggactccatcacacagtccgccgcggccggagcgctcaagaacatctccgcagtgccggaagtccggcaggcgctggccgaagaaggcgtcgtgcgagtcatggtgagcctgctggactccggcgtcgttctcggctccaaggagtacgccgcggagtgcctgcagaacctgacgtcaagcaacgacagcctgcggcgtgccgttgtgtccgagggcgggctacggagcctgcttgcctacctggacgggccgctgccgcaggaatcacccgtggcggcggtccggaacctggtgagcgcggtctcagcggacagcctggtgtcgctttgcgtgctcccgcgcctcgtccacgtgctccgtgacggttccgtgggtgctcagcaggctgccgcggcgaccatctgcaagatgtcgagctccatggacatgaagcggctggtgggcgagcacgggtgcatcccgctgctggtgcggctgctggaggccaagtcgaacggcgcacgtgaggcggcggcgcaggcggtggcgagcctgatggggtgccccccgaacgcgagggacatgaagaaggacgagaagagcgtggccaacctggtgcagctgctggacccgagcccccagaacacggccaagaagtacgccatctcctgcctgctggcgctttcgacgagcaagcggtgcaagaagctgatgatctcccacggcgctatcgggtacctgaagaagctctcggagtcggagaaggacgtggccggcgcgaagaagctgctcgagaagctggaccgaggaaggctacgcagcctgttcggcaggaagtagccaccaggcgatcgatcgttcttcatgtacaaagatcccgtccgtcctgtttgtgtcatagcctctatgactatgatgaagtgaagtgcggcaggcagctgttcgttcatgtgaagtccctaacaatggccaaacgaatttctttctagcggtcccctcgcaatgctaatataaaatttcttcatggtgtcgtgggcctcagagaacttctgaagatctgcgaaggagaaacaacgagttgccctaagcgtcaataaccggctgattggttccctgtgtctgtggcagcacgctcgctcgagtctggctagtcggacacgggcgttttggcggtacgagcagatgcaggcaattagccttcaaatagcttgttttgcatcggatcgtatagcccacaccttngatatcaatgcatacagtggtccagaacaaaacgatgcggac

SEQ ID NO: 13043 - DNA, 3630 bp, Zea mays
  misc_feature (3404)..(3404): n is a, c, g, or t
aatgaaatgattcccagatcctcctcccaatcatgcagcgatcgagttggagcaacaacgcccacgcgcgcagcggcgttcccaggatggttgtcgtttgattgatgatcggcgtccacgcgtcctgattgcagccaatctacctctggttggactctgcgtcgcggcgagcggcgccgggaggaggaggtggaggccgccggaaagtggcggtgggcgaggaggggtggcgggcggcgacacgaccggcatcggtgagagaggtttaccagcttctggtgtcctagctgccaagaaatgagctttgggagctgtccggccgtggccgggggcgcgacggcagaggagctgcttgaacgggcgcgggggctggtgccacccgccctggccgctgcgcgcgcggccactggcttcggtgggcggtggaaggctatcgcagcgaggctggggaggctgccgcagtgcctgtcggacctgtctagccacccctgcttctccaagaactcgctctgtcgggagctgttgcagtcggtggctgcaacgctagcggaggccgccgagctcggtgcgcgctgccacgagcctccgaaggcggggaagctgcagatgcagagcgacctcgacgcgctggccgggaagctggatctcaacctcagggattgctctcttcttgtcaagactggtgtgttgtctgacgcgacggttcccgcggccccggctgagacagcgtcggctgctggcgcacaggtggacgtgcgggagctgcttgccaggctgcagattgggcacgcagaggcgaagcaccgggctgtggatggcctgctcgatgctctgcgcgaggacgagaagagcgtgctgtcggcgctcggccgtggcaacgtggccgcactcgtgcagctgctcacggcgacgacacccaaggttagggagaaggccgccactgttttgtgcttgctcgccgagtctggcagctgcgagggcttactggtgtcagaaggcgcgctgccaccgctcatccggctggctgagtccggtagccttgttgggcgggagaaggccgtcatcacgctgcagcggctgtccatgtcggccgacattgcccgtgcgatcgtcggccacagcggcttccgcgctctcatcgacatgtgccagaccggggactcgatcacacagtccgccgcgtcgggagcgctcaagaacatctctgcggtgccagaagtccggcaagcgctggccgaggaaggcgtggtgcgagtcatgatcaacatcctcgactccggcgtcgttctcggctccaaggagtacgccgcggagtgcctgcagaacctcacgtcaagcaacgacaacctgcggcgcgccgtcgtgtccgagggcggcctccgtagcctgctcgcctacctcgacgggccactgccgcaggagccacccgtggccgcgctccggaacctggtcaccgttgtcccacctgacagcctggtgtcactttgcgtgctcccgcgcctcgcacacgtgctccgcgacggttccgtgggtgcccagcaggctgccgcggcgaccatctgcaaggtctccggcagcatggacatgaagcggctggtgggcgagcacgggtgcgtcctgctcctggtgcgcctgctggaggccaagtcgaacggcgctcgcgaggccgcggcgcaggcggtggcgagcctgatggggtgccccgcgaacgcgagggacgtcaagaaggacgagaagagcgtgcccaacctggtgcagctgctggacccgagcccccagaacacggccaagaagtacgccatctcctgcctgctggcgctttcggcgagcaagcggtgcaagaagctgatggtctctcacggcgccatcgggtacctgaagaagctctcggagaaggacgtggccggcgcgaggaagctgctcgagaagctggaccgcggtaggcttcgcagcctgttcagcaggaagtagcgtgatgattgatgatctctgaagcagctagcggtgaagcgatagtgtgaaggtgcacggtaacctgtacaaagatatcgtcctgtttcatagcctctatgaagtgaagtgcggcagagcggtggacagagttgcgtgatgcggcagagcgatcgtgtgaagtgttgtaatttcggtggctaatatgtgtgtaaggcccagttcgttcgttagctccctaaccagtaaccatggctgagtgaattcccaggcagcggtccctcccgtcgtaatgctaataaaatctctttagggaaagatggtttgctcagtttggttgtgaccgtttgcgattcttccgaaattgttgtcagcgcgaaagctatccccatagatagcatctatagcactgtgctgagctgcaggctggcactggtaaatcgtgcagcttcgtgcactccatattttgcagaataacagatctagtttaaacatttctcagtggatcggactttatgatctactgggccgggccgaccgacaagaggcatatacattcttcccgagttgagagtgctagtgatttcatggagtccgttttttagtttagacattgctcagtggatcggcattaacaaatagacgagcatagccgttgaacaggacccacatcgcttggccccccctctgcggtccgtttatatagtcatacaaaatttatttttataatatagagtgcactatttaccgtatttacagagtagagtttgaaataaaatatagaacacgaggtgtggttgaaaaactgacggagacaaccttaggcagttagggcaatatccaaactatagggcaaacacaacaagcaaaaagaatcaagcctcaacctatttcttctgcgccatgcaaatatgatgaggaattccaacaccaaagcttccgatctgctgcatccttctcttcatttatcaccagtaggttggctccatctaacatcagcagagtgatctgttctacgacaacctgatgttgctatctggtggtgagaagaagacgcatatatacatatatatactgcatcacgttccggaaaatcctcatcttgaaatcgaagcaatatatacgtatcatatcaggaaattcacttcaacggacccaaaggaggaaggaagatggctcagaggcagcagcgctaccgtcacctcacgccatgaaagccatggagttgagggtggcgaagcgggcccacatgtccgccgtggggagcctcggccccgtcacgctccggccgagctcctcgagcctcgacaggaggagcgcgatccggcggcacgggacgaggacgagcgccagcgggatgagccatatgcccaggtcgatcaccagcatctccgttcgttcaccactcgccccggtggtgatgcttctacgtcccggccgggggggctgagctntgatttttgagatgcgttctggcccttgggggccgatggatcctcgacgagagctttacaggctccttcgcgctatatagtggagctgcttttcaggaggcagggcagaggcgatggattttcgacgagagctttacaggctccttccacttccagttgtgtaatggaggttgtttgtctttaagatctttggcttagcttattgttggggccttcagcttccgag

SEQ ID NO: 13044 - DNA, 743 bp, Zea mays
gagcccgaaaataggacgcgcgcggcgctcgtgaaccgaacaaacctttccccaaaatttcccctcccccgcaccgaacgaactctcgatccgatcccgatccctgcagggagccgcctcggctcaccgatccggccccggatccgctcgttgctcgacgggatctctcgatcgcggtctggacaagcatgctgcatcaggagaacagtgaggctttcgggaggcaccactctgagcagcttgcatgtgtcaacatgaggggagcagataatggtcatccgaatttccttcctgagaaatgccagattgcagtttgtcctgaagttcaccgaaggggtgaaaaagttggactatttgatgaagagctggtacatggtgttcatctaaccagtccttgtgttcagtcaccattggtgccaagtggtgtcaaagaaacacctatagtggatcataacaagagacctgcatccagtgacatactggacatagttgaatgcaaacggctgaagcaggaagatcaaatcgttactaaggaagacaaccatacatctgctgaggaggattttcatgactaccccacatacacgacttgcgaaagaagctttgactcaccactatatgagagtgaggaaagtgaagatgagggtgtagattcacctctccattgttcacatgctcgcacctatgttgaagaaggtctatgggctgccagctttcatcaatctgttggtcctttttccttg

SEQ ID NO: 13045 - DNA, 904 bp, Zea mays
cccccgaggctggccggggccgccttttcttttcccgtttttataaataaatcagcccccctcgaggccgcccgggtggaccgaacaaacctttccccaaaatttccccttccccgcacaccgaacgaactctcgatctgatccctatccttgcagggctccgcctcggctcaccgatccggccccggatccgctcgtcgctcgacgggatctctcgattgtagtttagacaagcatgctgcatcaggagaacagtgagccgttcctgaggcaccactctgagcagcttgcatgtggcaacatgaggggagcagataatggtcgtccgaatttccttcctgagaagtgccagattgcagtttgccagaggggtgaaaaggttagcctatttgatgaagagctggtacatggtgtcgatctaaccaatcatactgcccagtcaccattggtgccaagtggtgtcaaggaaacaccgatagtggatcataacaagagacctgcatccagtgacatgctggacatagttgaatgcaaacggctgaagcaggaaggtcaaatcgtaactaaggaagacaaccatacatctgccgaggattttcatgagtaccccacatacacgacttgcagaagaagctttgacttaccactatctgagagtgaggatagtgaagatgaaggtgtagattcacctctccatttttcacatgctcacacctatgttgaagatgatctatggcctgccagctttcatcatgctctgggcccttttcccttgaggaaacctgttcctatcgggccaaatcatcaggctgaattacctgagtgcaggccatttggtggaagaactgaagaaggcgaaagtgtcaagtggatcagaaacggtgttgtgccaatgcctgatact

SEQ ID NO: 13046 - DNA, 1893 bp, Zea mays
aagaactctctagaacacgacgttccggagaccggaaacacatactctccagtctcactcgcgcactctcgcaagctataattccaaggcaccgccgccgcatcgatctcgggaatcgaaactcgaaaggcgcacgcggtccacgcccccggctcgcccagctcgagaagccacctgcactcctcccttctagaagcttccatttccttaggccatggaagacgactacgacttcccggcggctggcgggtacgaccccatgggaatgatggggatggggatgggaggctacggcctcggtggccccatggggatggggggctacggcctcggaggtcccatggggatggggggctacggcctaggcggcgaggacgacgacgatgccatgaaggacctgcacgccggcgccggagcaggggcaggggacgatcctcccggatcgggaaggaagggctgaagaaaaagctggtgaaggagggcgagggatgtgaccgccccggcgccggcgacgaagtcgaagttcactacacggggacgttgatagacggcaccatgttcgactccaccagggaccgcgactccccgttcaagttcacgctgggccaaggacaagttataaagggatgggatttgggcatcaagaccatgaaaaaaggcgaaaatgctgtgttcaccatcccaccagagcttgcatatggtgaagatggctcaccaccagtcatccctccaaatgccacactgcaatttgatgttgagcttctgtcatgggtgtgtatcaaggacatttccaaggatggaggcatcttaaaaaaggtagtagccaagggcgataagtgggagaaccccagagatcctgatgaagttgttgttaagtatgaagcaaggcttgaggatggaacagttgtatcgaaatctgatggtgttgagttcactgtgagagatggcgtattctgccctgccatatcaaaggctgtcaagactatgaagaaaaacgagaaggcccacctcactgtcatgccacaatatggctttggtgtgaaaggtagacaggcatctggagaagaagcttctgtgcctcctaacgcgacattgcacattgatcttcaagtggtgtcctggaggacagtcactgagttaggcagtgacaaaaagatccttaagaagatccttaaggagggcgaaggctatgattgtcccaatgattgtgcagttgtccgagtgaaacttattgggaagttggaggatggtaccttgtttgtcaagaaaggtcatgatggtgaggagccatttgagttcaagactgatgaggatcaagtgattgaagggcttgacaaagcagtactcagcatgaagaaaggagaagtatccttggtcactattcctccacatcatgcctttggaactaatgaaacaactaaagatctggctacagttccaccaaactcatatgtttactacgaaatggagcttgtctcatttgataaggagaaagattcatgggacttgaagaacgttgctgagaagattgaagcagctgctaagaagaaagaagaagggaatgtgtggtttaaaattggcaagtatgccagggcttctaagagatatgaaaaggctttgagctttgtcgagtacgatagctccttcactgaagaagagaagcagctatcgaaaccacttcagataagctgcaagctcaacaatgccgcatgtaaactaagacttaatgattacaaggaagcaaaggaactgtgtaccgaggtcctggaatctgacaacacaaacgtgaaggccttgtacagaagggcacaggcacacatgcatcttgttgatcttgatttggcagaggcagatatcaagaaagctctagaaatagatcctgacgacagggat

SEQ ID NO: 13047 - DNA, 857 bp, Zea mays
cgatgtcttttttggttcttgtgtgttcctgaacgaccgttatagataaggccagaaatgccgcacgagctacccaacgaccgccgatctctcccacacagacacaggtcacacgcacactgcagcgtggcgcggctactccccgccatggccaccacctccgtcgccgcctcctctccccatccccatctgtcccgcccccgccggcggaactccagcgccacctccagagcctcgatccggggctgcctcctgcccatccgatgctcgtccgcctcgtcgtcgcaaccgccggcaaccggcggcgaggagggagagtcggggcgccggcggctgtcgaagcagtcgtcgtgggaggacagagatgtggagggggacgactacctctaccgcctcgggaaggaggctgacaacttgaacatcaccgtcggcgcacggtccggcatcgtcgacgaactcttcgtcggaaacttcctcgggaaagactcggatatcgtgttcgactaccggcagaaggcaactagaacgttcgagtacctgcagggggattactacatcgcacctgccttcctcgataaagttgcatgccacattgtaaagaactacattgcgcatcttcttaataatatcaaggttcccctaatacttgggatctggggcggaaaaggccaagggaaaacattccagactgaacttatatttagagcaatgggtgtggagccagtaattatgtctgcaggcgaactagaatctgaaaaagcaggtgaacccgggaggctaatacgtgatagatacagaactgcctcccaaggtatccaaaaccaggggaaaatgagctgcttgatgatcaccgtcct

SEQ ID NO: 13048 - DNA, 5146 bp, Zea mays
  misc_feature (457)..(457): n is a, c, g, or t
  misc_feature (663)..(663): n is a, c, g, or t
tttggcgcagatcatatccatttaaaatatgaaccatctaagtggcccaccactcatactctcatgtttaattgtcctgtagagactacgaaataacacataatattatatattggaacaatcatatcttctatggtaacatatgacgtggcaactttgtctagacaataagctgagaatagccttatatgactgtcatacattgttttatgagtgattggccttaactcgaaacaaggtgcaatgcagaaatacgcggatacaactggtgattgctaaatttatctcaaatttagggggttatggtttatagactctgatatagccttggtgcacaatacactatctgtgagcttagaattagaaccgtagctagtgtcctacgatgtcgacttggctctatccagattttaagtcacactctgccactgatggaagtcaggtagattagcgttcntgctattttctgcacaactgtggctacagcgaggctgacctggtatactgaaagcctggcagacacgcgcacgctccccgcacgttgcagcccgccgcccgcgccatcgcctaggaaacgaaaagccaagccgggttaggcttttaagtggccgcgcttgctttttgcattagcggcgcgacgcgatgcaatcagacgtggagtancttgcgcggtgtccaactgtccactatgctctgccgcgccgctttccagagccttttagtcttgtgcgtgccgttgtggccgccggagaatgctgcatgtgtttgtgttggtagtttggtactgggagtggcgggggaatgtgctgggtttggcgggttagtagctgctggtggttgtatttgctggtgtccagcagctattcagctctgcggagccgcgtgccggctgatctcgggcctgtttggaatagattctgtgcagcttctggtgggaaaagctggatctcggtgccaaacggctggattctccaccagattctcctggaagcgcttcttcccaccacaccgtttcaacgtagatggagaatcggctctatggccgcgtcgcgaggaagcgggtgattcctgcagtacctcttcatattctgcacactagtgtgtgatgttgttcgtatgttttaggcttgagtctagcatggcaaaaggcaaggaacgtgttcgtttctaacaaaggtttaactcacgtaaattcaacacagtctatccatgcgctgctgccattgcagttgttaagtgtacctttaatcctcatgttcagatgttaacaatacgataatttggacatttaagcatatagactttagacactgatatttaataattcggtcagtcccgtaatgcactagttggttatctgtatttatcagttttctttttttaatcggaatctacaaactcataatctgtgtatccaaacactcatattctacccaccagcttctctccacagcagccgaaccaaacacccagattctgaccaccagcttatccctacagccagcttttccccacagccagcttttcagaaaagctctccagaaaaaagccgaaccaaacatacccaatagctcctggcggcggtggcgggctttctcatgctgccatgcagaatgcagcggcgagatttctaggttgccactcgccagtcgccacgcgattgtagctgttgttactttccaatgtagctgtcgtagaaggttaaaaaatataccggtggtcactaaatttgtagccatatatcatcttggttcctaaactctcaaagtgtatatctaaggtttctaaacttatgatgttgtattgttcttgtctctaattttttaacatacacattttgtctttatacttgtacggtttcgtgtgatttgaatctctaaacttattttttgtgttatcaaaggtccaaactatttagacatgtgatgacaccaaaataagtttattgggactagaaatattgggactagaaatgtacatgttgagagtttaggggctaagacaatacaacttcataagtttaagggcattagatgtgtattttaagagcttagagatcggaatatacaatgctatatgtttaaaggccgctaatgtattttacttgatgaaatattaaaagaatagattatagtgcactagggcaagcgagcaactgcatctactggcacaaagcgatatccgagcacgcgtaacccaagttcatgaaatggtagaaacatgtaaagttataaccttctcttctctcactactatgaaacaccaattttttagtttttattgttgtcccttttgctatacttatttctaggtccgaacattaacttcaacgcccacgtccattagcttgtatggttatgaaaaataagaaaaaaacgtgtataccacgttcatacatagttaatcgataaaacatatatttttgtattttattaaaaaaataatactactataaacggtgccggtagttgaggtgaagtgacagagtaaagagcgccagagtccccgttccttgtccagcactagcgcatcgatgaaaggttctctcctctgcccagaacccagataccaaaatgggaccgagagaggctaaacagaagtgacagcagcagctatccagctcacccgagaacagtttgtttactgtgaagaactgaagacacatcacattccggctgccgtcccttcccttgcatctggctctccttgcagtcgcagcctcgtacaccgcttgtgcgagcttttactcctaccccaatctccctttgctacttttggggacctccagacctctcaaatcgagagaaccaaaaacgatagagaaagagagcctgtcagcccaagaaaaggttcctcccctccttccccacctcgccctcagccctcatcatcctctaacatccgattgtgccctgtgctctgcggttctcggatccaagatttcgccggccggccgccggcggtggctccggcctccgggagcgggagaaagactggatttttcgggccatggagatgtggcctgatccgttcaggcccgggcggtggggtggcttcctgagcaggtctgattcgtatcggttcaaatgatctcggcggcttgattggtcggttccgcttccgccgggggatcggagctagggcggtggtttcttggccggccggtggattcatcggctcgggtctggtgggatcttggtggttgctggttcagcacacgagccgcaggtctgcgtagatcccctcttcgcttccgtggcggatttgtactgctagggttttggttgggtctggtggaagatgattaagcagatccttggcaggctgccgaggaagccggggaaggctggggatagccgggaagctgctgctgcggggaatggaactgagccgtcgaattcctacagtgttgcgaggagcatggacccaggtaacaaaagggctggaaatggagattacccagttccatctggtgtaattccgaatccagtgatgaatggggctgtggtgtatcactccaatgaacccttaccggcattcaaggacgtgcccatgtcagagaagcagaatttgtttgtcaagaaggtgagcctatgttgcgctgtgtatgactttgtggatccaactaagaacctcaaggagaaggaggtgaagcgccagacacttatggagcttgttgattacgtcacttccgctaatggcaagttctctgaggttgtcatgctggagatcacaaagatggtgtcaattaatttgttccggagctccagccccacacctcgtgagaacaaagccattgaaggggtcgatctggaggaggatgagcctctcatggatcctgcatggtctcacctacagatcgtgtacgaggttttcttgagatttgtagcttcacaggagacagatgcaaagttggccaagagatatatagaccattcctttatccttaggctgctagacctttttgactctgaggaccccagggaaagggactatctaaagacgatacttcatcgaatatatggtaaattcatggtccatcgaccattcatcaggaaagcaattaacaacatattctacaggtttatattcgaaacagagaaacataatggtgttgcagagttgttggagatcctgggcagtattatcaatgggtttgcccttccacttaaggaagagcacaaattgttccttgttcgtgcactgatccctcttcacaagccgaaatgtgtatctatgtaccatcagcagctatcgtattgcatcacacagtttgttgagaaggactgcaaacttgctgacacagttattaggggtttacttaaatattggcctgtgacgaacagttcaaaggaggtgatgttcttgggtgagttagaggaggttttagaggcaacacagcttgcagagttccaaagatgcatggttccactcttccgtcagattagccgtagcatgaacagctttcatttccaggtggcagagcgggctctgtttctctggaacaatgaccatattgaaaccctaattaagcaaaactacaaggtgctgttaccgatcatctatccagcactcgagagaaactccagagatcactggaaccaagctgtccgtagcctgacactgaacgtacgcaagatcttctcagaccatgattccacattcttcggggagtgcgtccagaggttcagtgacgaggagctcaagcaggcggaatctgattcaaaacgagacgccatgtggaagcgcctggaggaaatgggtgcctcaaaacctggcgggaaccatcccttaggtgcacccaatggcaaacccagtcacgctgctggctagaatacaatagcccaccgtaccagccgcatccgtgtaactcttcggctctcgtgccaagatctcctggaacctgggttgtgattttagctttgggattctttttgcgttggtttgcccctgttgtaggtgggtccgatgtgtttggttttgtaagaactgtatgttcaaaatgtacacacggaggaatttgacagatttggcatgtgtagcaacattaatcagaattactatcatatagtccaataaacaacgtcgattttgattgcagatacgcggtttgggtggcttatatatataccgacatgtccgtgtt

SEQ ID NO: 13049 - DNA, 5368 bp, Zea mays
aaatggagggctcgttgttttctgctggaacagatcaaaattaattttaatctccaaaatttatagtaattattaaagaaattcaagccagatttattcaaccctttgttccatgcgaaaggaacaggcgtgagtcgctgcctcgctggtaggtaccgcaaagtattctcggcttgcggcctgacgctagtatatgaggtgcctgctgcctgcggcctgcagccacgctagaattctctgcttgtcgaagtgcaaccaccctccacccgctctgctcgttcagttgcgctcgcacgacatgcccggacgacgcagccacagtccaccgccggagagtgcctccgggaattagagcgacggtgagacgacgaccctgatcgacgcgtggggcgccgcccaccggcgtcgcgggcagcgacgcctcttcctgggggattggcgcgctgcggccagcgccgtgaacgcccacagcgccgccgcggggcgccgcttcaaccgcaccctcgtccagtgccagacccgtgtccgcaccctcaagcacaagcagcggtacaaggaggagctcctgaagcagccggcgtcggggtggtgtcacctcccgcggctccacgcgttcctggccagccccgacgagtcgactccgggctttccggccaaggcgccggcgttcgtcaagcaggaggaggaggagaaggtggccggaggaggcattgggctggtggggagctggactgttccgaggaggccgaggaatgcggccgcagcagggacgggattctgcccgggggcggtggtgacgaagctggcggaggtgtacgagcgcgtggagctggccagaatcggcgccgagaaggtgaagacggagatgcagcaggagatgggaggtgtagaaggccatgttcagcgccctgaaggtggagcagtagaagctgaaaactactgccactgaccatgaaacatggatgcacggtagaattatgctagctccaatacttgactttagtgtagtcgacaacaacaacatatctaggagtaatgcttaccaggagtgacctttgttgctaaggaaatcatgaatgactggatgaaagattaactaaatggtcggatcgtgcatcgtaccagtacacttttagttccattttttttgtactggcactgcagttacttgctgttgctaggcgctacacgttgatgtccaatcattttagaagattactattacttggcacgagagtccgtcacggtatgacacgtcttgtcatcgtgtccaataataacgtgtctgtttagcaccgtgtcgtattcagaagtcagaaccaatgccgtagtaacagtaatcctcctcagctagtctgctctctgctgcgccccgtcgactcccgcagacgcgcgccggccgccagtccgccaccgcgcaccggccgcccgtcgcggccgcggcgaaaccaggccgtgggatggtgactgatcgcctcccaccagcgggaggacaaagtggtgaccaaccagcgtttcagtggcagcacagtaccaagccaacccaggccgatggagcagcaaaaaacctcagcgtgatcgcacgcaagcccactcacccctgcaccgcgccgcgccgcgccgtggatgcacgcatcatccacccacctatatatacacacgcgtacgacggaaccacgcagaagttatgggtggacgcgacgcgaccgactggccaatcgattgagcagcagcacaaacatcacacgctcctcacggccgcacccaaccggactcgcctcgcctccctttcgaaccagcctctctctccgccagcgcggatgtcgtcgtcgcgccgccgcccgcccccgccgccgccggcgtggacgcccgagccgtggagcgacggggagacgtccgcgctgctcgacgcatggggcccgcgccacctccgcgcgtgcggcggcgcgctccgccccgccgactggcgggcctgcgccgacgccgtcacctcccgccgcgccgcggccggccgggccccgcgcaccgtcgaccagtgcaagaaccgcctggattatctcaagaagcgcctcagggccgagcgctccaggcccaagggggccccgccgacgccgccgccggtctcggggtggctcacccgcctccgcgcgctgctgcacctcgccccctccgctcctcccgggttcgcgcaccgtcttggcgccaaaacgcccaaggtggaggaggaggaggaggtgttggacgagaagccgagcggcggggctcctctgccccgctactggccgccggtgccgaagcggccgaggacggcggtgtcgctgtcgccgttgaccgccgcctccggggaccaccctggaggcggtgggaggaattgcacggaagtggcggcggctctggataggcttgccgggacgtacgagcgggtggaggccgccaagcagagggaggccacgcggctggaggagcggcgcctggaggcgatgcgtgatctcgagatcgagcgcatgcggctcctcgtcgacgtcgccgtcaccgcctccgtcgttgtcgatggcgccgccgcgaccgccacaaccgccaccggcgacttctagttggtgaggtatggtttttgctctgggtaaacgcgtgcttgcgctagcagggaccaggtcacgaaatgattattgcgggattcacgttcgataatggttggttcatgttggaattgtgaggcagcgcggctagaaatttccacttcactatgagaatatcagctaacacatgatcactcgatttggctagacattcttaatttctagaatgggcatcgaattggttgctcatatcgtttggtatgtagtagtgtaggaatgctgatctttctgatgaaactactcattatgcaagcttacccctgctgaaatctcctgtctcacctctagcaaacagagacgattcaaatttccataagcgactgttattgttcagaaatggagtgataatctgctttgaatgcatgagaagttaatcacgtgtgactgttcgattttccagaagatacaactccgtgacagttttgttgtctttgttctcttttgcagagggacttggataactggctggccaaggtagccaattccagcctatatgtttttttcttcaaagagacgatcgcatcatggagatagaggtcacttgatgtgatgttcttctacaaagttaaatcggtttaggttacaggaaaaccttagccagatgtaggatagcacatggtgagattttttttagttctttgattgcaggtctgcagcaactgaaaagggggagaatagcctgaaaagtatcttcgttaatgtttagctatcctttggtaactagtgctgtaatccctcttgatttacagctgttcggctgctcagttgagagacattctgatcatccagtacatatgataccttggctgatttgactgataatatagtgcttatgattatgttgctcagcctatgatcatcactctgctaatgataggcaacgtgcttctggcgccgtggtgcatgttatgtactttccctgccattcatcactctaatggttggagaaggctgacaggcgataacggttccccagcagaacagcggtgcaaagatcgatcagagaaagataggcgtttcagaattttcagggcgcttcagaggtcacaacgtatatcttttttccaatacaataaaagcctgtttttcaatgtaacagagatcttacaggttccatataacctttatacatttctgttctgtttaagcagtgacttactgatcactggcttgcctccgcattcagtgatcacaactcacaaccacggttgcaaatctcgaacgaaatccgacggtaaccggctgattttctcgttcgcagccttaggcgaaaacggattttgtgaatagattttgaatatttcgttttaaatttttaaaattaaaaaaaatcagaaaaaacgtataaaaactagagattctcaggagttcagaaatatatttttatttaaaaatcatgttttgatattaaaaataaattttgtttacttaaataaatctaaacctgagaaaaacgaaaaccagcaaaataattgatgtccaccatatgcagtttaattaaaatatggcaggggcctggaaaagagcagctaggcctttttctaagtcaattgcttaatattaaaaaataaaaataggaccagctaggtaaggtgctataatataaaaggaattatagtagtgagtatcactgttattgatgtcgcatgcagacatgttcaaacgttgggtccagtcgggttgtgaaccatttagcacggtacatatcccactcatgcctaatggcaggttggccctgtttgacatgtcaagttgggggttttgggttgggtcggttttttttaggttgggttcggatttttaactctaggtcaggggttttcgggttagatcaggttttggatcaaaaatcatgatccatacttggctcgtgaattattgtgggttaaaaattatgtcacatacccacctattgtaatggtcgagtcgggtaaggccaggtttttcccggatagatcagatcgggttggtcgggttgagtggaccatgatcaagtctagtcgcatgtatgattaaattgatacttgcatgcatgtgatatgtgtttagttttgtttttaaaaccgggtgtggcaaggtttgcaacttttatatgactcgagctaataaacactaacatatgtttcatattacaactttgatatgacccgagctagtaaactcaaatttttattgcaaattatgattttgacatgcgactcacgcaggggcgaagctaggttgtatctagcggatgcaaatgcaccccctcaaaaatgcaaattctataaatgcagttaaaatttcaccatatatgcacccttagaaaaaattagtatgcatccactagaccaattgcaccctcctcaattttgctccagcttcgccactggactcacgggtcatctatgagctacgcatgatataagtgagctatacaatacaatcaacttggacaaaaccttcttccctcatcccccaaaaggtgatatgaacgaatattttgttgtttagtcacttttttgacatgatagcaaataataacttgtattgtttatacaatataaaggaaaatattatgttgtcgatgttggatattctaactggccaagctatttgcattgttacataggttaaaggtatcatatgcgagtgtggcataggggtagagatctaaaaacacaaaaggaaaatgtcactcacatttaccatcaattcgaaatgttattggttgatattatggagtttcaaag

SEQ ID NO: 13050 - DNA, 3878 bp, Zea mays
  misc_feature (2950)..(2950): n is a, c, g, or t
  misc_feature (3013)..(3013): n is a, c, g, or t
ttggtggtcagcatctgaaagctaacttcttagagtaggccgtaggaagttagtaggggcggctaacttcctagaggaggccgtaggaagttagcggctcgtttgaccgtctgcggtggtcagtatctgaaagctaacttcctacagcttttataacaaaccgtaggaagttatggttatttcctagagctaccaatagcctctcggaagttagtaatttcatacggtttgttataaaagctgtaggaagttaaaaaaccgtaggaagtttatatttttggtgtagtgtgctatcagcagtaggggctattagcgtggggttttcagcctaattgagaatggaccacgccatgacgccaaatgtattgggctggcttgggtggaggctagaaaaccaatgtttttagcccaaacgagcacaactcctgattctttttctatttcctgtgtacacataccatatacatatatattagtatgtattgatttttttaccaaaaataataggtattttatttactattaaactaatcttatttgactttaattaatagataacaatgtgtattacagtactataaatatgatagtattttttaaaacgttaaaaactgatatataaaaaataaataattcagttaaagtgttaagagggaactgaatacgaaaattgttagagataagaaaaaacaagagggaagaatacttaaacaagtaaaatttaaatatgaatagagaatatgaatacgagaggatttgagatggtgccgtccctccccttgaagtcgcagcctcgcagcaggcttgcgcaagcttttactcctcagtcctgctccatctgcctttgctacttttgggggacctccacgcccctcaaatccagagaacaaaaaggagagagagagagaaagagagagagagagagagagagggggaggcagagagcttgccatcccaagcaaaggttccctctccttccccacctcgcgctcaacccccctcatcctcccacatccgattgtgccctgcgctctgccgttctcttatccaagatttcgccggcggcggctcagggagcggacaaagattgtttttttttcgggctatggagacgaggcctgattcattcagccccgggcggtggagtggcttcctgaccgggtctgattcgtattggttcaaatgatctgggcggcttaattggttgcatccgcttccaccggggaatcggagctagggctgtggtttgttggccggctggtggatttgtcggcttgggtctggtgagatctggagggtttctggttcagcgcacgggccgcaggtctgcgtagatcccctcttcgattccgtggcggatttgtttagggttttggtttgagtctggtggaacatgattaagcagatccttggcaggctgccgaggaagccggggaaggctggggatagccgggaagctgctgctgcggggaatggaactgagccgtcgaattcctacagtgttgtgaggggcatggacccagggaacaagagggctggaaatggagactatccagttccatctggtctaacttctaacccagtgatgaatggggctgtggtgtatcactccagtgagccgttaccggcattcaaggatgtgccggcatcagagaagcagaatttgtttgtcaagaaggtgaacctatgctgtgctgtgtatgacttcgcggatccaactaagaacctcaaggagaaggaggtgaagcgtcagacacttatggagcttgttgattacatcacttctgcgaatggcaagttctcagaggttgtcatgctggagatcacaaagatggtgtcgattaatttgttccggagctccagccccacccctcgtgagaacaaggccattgaaggggttgatctggaggaggacgagcctctcatggatcctgcatggtcgcacctgcagatcgtgtatgaggttttcttgagatttgtagcatcacaggagacagatgcaaagctggccaagaggtatttagaccattccttcattcttaggctgctagacctttttgactcggaggaccccagggaaagggattatctaaagacgatacttcatcgaatatatggtaaattcatggttcatcgaccattcatcaggaaagcaattaacaacatattctacaggtttatattcgaaacagagaaacataatggtgttgcagagttgttggagatcctgggcagtattatcaatgggtttgcccttccgcttaaggaagagcacaaattattccttgttcgtgcattgatccctcttcacaagccaaaatgtgtatctatgtaccatcagcagctatcatattgcatcacacagtttgttgagaaggattgcaaacttgctgacacagttattagaggcttacttaaatattggcctgtgacaaacagctcaaaggaggtgatgttcttgggtgagttagaagaggttttagaggcaacacagcttgcagagttccaaagatgcatggttccactcttccgtcagattgcccgtagcatgaacagctctcatttccaggtctaaatcttactgtgcctatacttaactttgtcatcaatttctaccaaatttgtttgttggttcttctagtcgatggccacatgtgctcttaccacattagtttgatgatttcaggattttttttgcctgcatgtctgcattgattgccttcacctatttaattagctataattcttctcccaacgtatatgggaaaaacactggttttgtctccactctcaaggcttcccttttcagacgacgcccttaattacggtaacagcatacagatctctttctcctactgttttttgttcaaccacaccagcttgttcccaccctggcctccatcacccccagccatgctgctcactgcccacacatgccgctccaccctgnccacccctaacccaactggaggagaatgctcgagtacctccctccacaccgccggctctggcnatccggttgtctcctgctgcctcgctcgctacccctaaacctgccaccaccaccagtcttgccaccgcctgagaaaccccctcccaggctgccaggcatggaggtcttgaacgcgagggagaacatgatgttcatccaatcgggcattgacacgtgtccgtgcactcattgccatcaccacacgtgtgccatataaacttgtgcacatggactttttagttgttttgatataagctaatctatgattaataacaaaaataaaaggttggtgctaggtcaaaagttacaattacagaacaatgtatcgatttctgggtgcatactatttgtcccttttctttttctttgactttgtaggctaaagttatctcaaaattgatctcttgcatggtacttaaatctttatgtatagttaattttttttgtttaatatccttctgtataacatttctgtagaagccaccaccaggaattttatatagcaaagcagatatttagtgccactcgaattggatagcaagtacatctactaaataccccctttttttggtgcaaacctcttgctttctgattcaacagctatttgcctatatgtccacattgatcacttgcacaaatttaccttgctagaaatctactactaagtgtgggaaagatcaatgctcacggtgtctcttgctttgctgttaagataccttctatatggaccactgggtgtattatgtataatttatgtacatgctcatagtgtctcctgtttttctgttaagataccttctctccggaccattgggtgtctttagtgtattttttattatatatgtaaatgtatttcagttgttgcatatatatatatatatatata

SEQ ID NO: 13051 - DNA, 2334 bp, Zea mays
  misc_feature (1932)..(1932): n is a, c, g, or t
ctgcagccgcctgcagtagttctggaaaaaaaagcttgatctctttgaattggcccggttcgaagtgacttggtggttagattgagtctgacccaggtctgtttttgctcgagaaaagagatcatatttttaggcttactatggctcacgagctagctcgaggctagacacaacaataatttattatataaaatcttaattaatatatattatcggcactaaataaacgagtagtttatgttttttaagtttattgtacaaaactaaactattttctatattacattagtaatatatttattttaccaatctaaaatatggtacttaaattatttttatattttatattatattttggatatcgatttcatgtttatggtaagatttattggctcgacgagtcgagacaactttttagattcactagagaagcgaagcgagccagactcaactcgttacttgatcaagccacaagaagcataggcttgtaacggtccctatatgcaagcatgcagagaaactatctaatccgttagattatgatccaaccacaatgtaattatagtttatttagtttttttataaaggtaattagctgatgatgaaagattttaagtgttaaatataacctacagttatattacaatctaatgaatcacatattttgctttgacgcttatacctaaggctgcttgcattcagtcgggcccccaccgccacctgccgcaactgccgaccccacccaaatttcttcctctcctccatttcctcccttcgccatcatcccctcgggcctcggctctgctcttcttccctccccggctccccccgccgctgccccgcgcccgtggagttcttcgatcgagtcctcggagcctggagcacctcgtccaacaatccgggaccgcacgagaagagagagagggggtggtttgacacaagtcaggcacccgtcaagattcggctcgatctgctgcgggacatggagctggacagcatcgagtgcgtgtcctactccgacggcatggaggacgacgacgacacggccgccgtcacctcgtcccagctccctcgccccttcctcaaatcctcctctaccgccggtgctgccgccgccgccgccgcggccgtcaacgtggtcgtcgtctccgaccgcgccggtgccgccgggacggtagcgggagctgggccgctggtgatatctccggccacgggcgtgcatgagcttctcgagtgccccgtctgcaccaactccatgtacccgcccatccaccagtgccaaaatggtcatactctgtgttccacctgcaaaactcgggtgcacaaccgctgcccaacttgtcgacaggagctcggtgacatcaggtgtctggcattagaaaaagtggctgaatcacttgagctcccctgcagatactactctcttggatgtccagaagtcttcccatactacagcaaactaagccatgagtcacagtgtagttttaggccatacaactgtccttatgctggttctgaatgttcagttgttggggatattccttttcttgtggcacatctacgagatgatcataaagtggacatgcactctggatgcacatttaatcaccgctatgtcaagtccaacccaagagaggttgaaaatgcaacctggatgctaactgtttttcattgttttgggcagtacttctgcttgcactttgaggcatttcagcttgggttggcaccagtatacatggctttcctacgatttatgggtgacgaaaatgattctaggaattacagctatagccttgaggttggtgcaaatggcaggaagatgatatgggagggaacgccccgcagcatccgggacagccaccggaaggttagggacagccatgacggtctaataattcagcgcaacatggctctcttcttctcaggtggagnaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgccctaaattagtcagggcgtatttaaaaaaggcagccccccccccaccctggcttactccttttgtgggctgtgactaagctcccatgaatctcacgataagcatttttctcgatccaatggtgtatactgtatcgttttgggctgaaggctgcagcttttttgctgttaaaaaaaaaaaaacaccaccacccccccc

SEQ ID NO: 13052 - DNA, 1661 bp, Zea mays
ggatcccaacacattcctccctcagtccctcttccccccgtttcatcccttcacacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccagccacgggcgtgcacgagctgctcgagtgccccgtctgcaccaattccatgtacccgcctatccaccagtgccaaaatggtcatactctatgttccacctgcaaaactcgggtgcacaaccgctgcccaacttgtcgacaagagctaggtgacatcaggtgtctggcattagagaaggtggctgaatcacttgagctcccctgcaaatactactctcttggatgttcagaagtcttcccatactacagcaaactcaagcatgaatcacagtgtaattttaggccatacaactgcccttatgctggttctgaatgctcagttgttggggatatttcttttcttgtggcacatctgcgagatgatcataaagtggacatgcactctggatgtacatttaatcaccgctatgtcaagtccaacccaagagaggttgaaaatgcaacttggatgctaactgtttttcattgttttgggcagtacttttgcttgcactttgaggcatttcagcttggaatggcaccagtatacatggctttcctccggtttatgggcgatgaaaatgatgctaggaactacagctatagccttgaggttggtgcaaatggcaggaagatgatatgggagggaactccccgcagcatccgggacagccaccggaaggttagggacagccatgatggtctaataattcagcgcaacatggctctcttcttctcaggtggagaaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgccctaaattagtcagggcgtatttactgttggcaggataatgaaaatactggcttactccttttgtgggctgtgactaagctcccatgaatctcacgataagcatttttctcgatccaatggtgtatactgtatcgttttgggctgaaggctgcagcttttttgctgttatgtttgtctcggtgtatttgtgtgtctgcaaataaagtattgaacagtaactgggtaccttgcataaggtttggttggcaa

SEQ ID NO: 13053 - DNA, 1404 bp, Zea mays
  misc_feature (43)..(43): n is a, c, g, or t
cccacgcgtccggggacgcgtgggctgcaacccaagagaggtngaaaatgcaacctggatgctaactgtttttcattgttttgggcagtacttctgcttgcactttgaggcatttcagcttgggttggcaccagtatacatggctttcctacgatttatgggtgacgaaaatgattctaggaattacagctatagccttgaggttggtgcaaatggcaggaagatgatatgggagggaacgccccgcagcatccgggacagccaccggaaggttagggacagccatgacggcctaataattcagcgcaacatggctcttttcttctcaggtggagataggaaagagctgaagctgcgcgtcacaggccgtatctggaaggagcagcagaaccctgactcgggggcctgcattcccaatttgttcagctgagctgagtaacaaggatgaatccaggtctgtgcttggtgttttgtccttgccaagctgccattgcagcctgccctaaattagttaggttgttggcaggataatgaaaatacagagttcctcctgtgggctggtgaatctcatgataagcaatttctttctcgacgatacagatttgtgatgttatgtttgcctcggtgtattttgttgtctggaaataaactgttgcgcagtaactgcatttggttggctggtcattagcttgtcactctgagtttgacgtacttcatgtttaatgcgacagtggcaatgggttttatatgttcaacactggtttggtggacagggaaatagcgatgggaattattcttcttacttatccgtcaattcgtttggcaacttattgctacaggccacggggcattttggtttatgcaaaagatgaaacgaaaacatgtgtcattttctgtgcaccaacttgttgaagttaaggggcacggtgaacttctccgtcaggtacgagccgtcccagacaaccagtaaaatgctcgcgcttctcgcaggggcttccgcagcattcggtgttgacattcacaaatcctactggtatgtacaatgggtggacataccagccgatgggtttgcaaaggttgcactcgctaagccgtacaggtcagcaagcgagtagcggaagccatggaggctagagccgaggttggccaggaggcggccgaggccgtcgttgaactccgcggcgagcttgttcttgctttcgtcgcacctaattaacgcggacagaacgacggccacgccacggcatctgacccgccggcgcgcaaccgatccgatcgggggcacgttgatgaccgccagcgccagcgtggaagagtttctgttccgttccggctctcgtggttgagaaccgctgatgaattgaactctcatggaaccctccacaacaacagtagcggggggat

SEQ ID NO: 13054 - DNA, 3056 bp, Zea mays
gttttcgtctcatttctcaccacgagtccagccattcttctctccatttttctctccccacattaaggatccatcactatcctatacattgaccaagcccctcccctacctggctagtaccttcctccagtctctcccaaaccgcgcctgttgagccggcccgcccggaactctgtcattgtttccctttttcttcgttgctaggatcagacacaagagttttagtgatgatctcctcatcaacatctatctccatcacaagaagaaggtgtggacaggaagacgacacaagattcaggcgacactcccaccattgctgctgacggcgtccaaattgtcttctttctcccccctaccttggctggctggctctctagatcgaatcacgggtcaggcgctcccctgaccaaggccatgagccactacaccatgcatgcagccatcaactacgccgcgctgccacccacgtcgccgctgcaactccccctcccgtacctccctccgcctcctcctccgccgttaccgctaccgccgctgttgtcgccgccgccaccggcggcggcgtcctctgacgcgggattccagagcaggatcagccccagcgtccttctcatcatcctgatcttggccgtcatcttcttcgtctccggcctgctgcaccttctcgtccggttcctgctccgcccggcgccgcgggatcccggcgacgcgtacgggggtgacgcgaacgctaccgccttccagggtcagctccagcagctgttccacctccacgacgccggcgtcgaccagtccttcatcgacgcgctgccggtgttcctctacggcgccgtggtcggcgccggcgggaaggatcctttcgactgcgcggtctgcctctgcgagttcgcggacgacgaccgcctccgcctcctccccaagtgcagccacgcgttccacgtcgactgcatcgacacgtggctgctgtcgcactccacctgcccgctctgccgccgcagcctcctcgccgacttccccacctgcggcggcgcctgcagcccgctggtgttcgtcctcgagtccggctccgagggctcggtctccgatcgccacgacgcggcgtcctccgcgcgcctcagctttggcatggagcaggagcaggcagggcaggatcggaaacacgtcgccgctgcagaggcagcggacaagaaggacgaggtggtcgttccggtgaagctcggcaagttcagaagccaggccaccgaaggagccggcggcagcgccagccatggaagccatgacgtgaggcggtgcttctccatggggacctacgagtacgtcatggacgagagctccctgctccgcgtcgccgtgaagctgccggagaaaaagcgccccgcgactcgctctcgcatgccggggcaccgtgttgccatgtcggagtgcgactgccactccaagcgggaaggcttccgcggattcgatgcgccgcccaagcagcagcagcagctgtcgaaagcggcggtggacaagagggagagcttctccgtctccaagatatggatgcgcagcgggccgaggaggaaggacgtgccctccggcgcaacgacctcgcgccgtgcgtcgtcgttccggctctcctcggcgctccagcgcacggcgagcgacgtcggggcgacgacggcgaagcgccgggcggacgtggtgagccccgtgacggagtccgagtacaacgtgtcggcttgggacaagagcgcgagcggcagcgtcgtggattgggacgtcgagtccgcgggcggcgggcacggcctcagctccagagccgacgaggcgccgtcgttcgcccggcggacgctgctctggatcagaggccacctgtgaattgaaccgaagcgaagcagagatcttggcttctaccaccttgttcttcccctctgctctccccgtgtaagttgtagtaactgtgtgtgcatggatgcctgcgatcttctgctgcagcaacagatcgcaggaaatttgcattgcttggcgagtggatgaaatggtggatatgcgttcgaggtaaaaaaaggattacggctcgagatttctagattgtttcgcatagcatttcgcagttgtgtgtagtagattagctgtatttgctttgcatcttgctgtacatttgaaattgcttcgtagggttttatccagggtaatctataaaccgaagatctgaaatggcacaaccgtatactgcataattagctggaaagacatgatcagagatttgaaagagatgtggcctaaacaggaaagcttaattgaaacataatctttctgcgcatgtcaacacaaaacttgaactttgcataacaattcaaggaatttcctagtccgaacatctgcctcaagccactcgtagcttctctcatttcttcatttgctctgaatattttttttctgaactggaacatttactctggatctggctgtacaacagctcagggacgaggagcagaaatttgaaaaccccaattccagctgctcatgtcatttattccttgccttcttcaattgagcaacacgctaccgccatcattgcagccatgaatgccggagccagttagtaggtgctcgactttatatactcctcgtctcttcatcataagagtaacttcttgactagcaacgagccaagagggacgatgtttggattgttcgtcggtcccaatatatagtactaaaagataacgaaaatgcttttaaaagggtaaaatttaggttttgactaattgcatattcaattgatcaattccttagtgcatgtataacccacataaatgaccaacctgtattttaagaggtcaacaatggtgtagcactatgtggctatatgggtaagacacgcttaggttgtgtccagcagcatctccatcacttcccacatgctgaaaaaggggttcctgcttattgtctgcgtgtccagcatagcacgaatgcagatgtgaaaaaagcgtgttacttggtgcgtaccctaaatccgggcaccctccccgaatgcttgctactcgagctaaagcccctcccggacgcgc

SEQ ID NO: 13055 - DNA, 2827 bp, Zea mays
aagtacgaagccgcagcctccaaaactttatagccccttgatttgatccgcaccgcacgaacaacgtgccgcgacctgacgcggtagatgatttcttttagccaacaaaccaggcaaggactgggcaacagcagctgctaatcagcctctgtcaccataattaagacgctctcttggctgccttggtttggttcctgctcctccttactctctacctgaccggcgccccgcccggccagccgcgacagagtccacgacgacgatctttcttcccacccccgtctgcctccggatcccagctcccctgcccgctcggtcgactccctcgtcgccgagtccagctccgactccgagaaaaaaatcaaatcgaccgagtccgcccgtgaagccgccgacagaaggagagagcacagagcgggcgaggcaggcagcatgaagtccatgggcagccgcgacaagctcgcggcggcgtcgagcccccgccgcgtcctcttggtggtcttcgccttctgcttcgcattcgccaccttcctcaccttcctctacaccacctcccacttcacgaccgcgcccggctccggctccggctccatcgcggcctctaccaccaccaccaccaccacgacctccggctctgcgggcggcggcggcggccaaggccaagcagggcccgagtccgtgtccaagcggctgccggtcccggtgttcgaggcgctggtccacttcgcgtccatctcgaacgcgacgcaccgcatgtcggacacggacatccgggccatgtcgtccgtgctccgcgcgcgggcgccctgcaacctgctggtgttcgggctgggcgcggaatccccgctgtggctggcgctgaaccacggcgggcggaccgtgttcctggaggagaacgagttctacgtcaagtacctggagccgcggcaccccgggatggaggcgtacgacgtgtcctacacgacgaaggtgcgcgacttccgggacctgctggcggcggcgcgggcggcgagggccaaggagtgccggcccgtgcagaacctgctcttctccgagtgccgcctcgccatcaacgacctgcccaacgacctctacgacgtggcctgggacgtggtcctcatcgacgggccgtccggctggaaccccaactcgcccggccggatgccgtccatcttcaccaccgccgtgctggcgcgctccggcgccaccgcggctaagggccccaccgacgtgctcgtgcacgacttccagttcgaggtggagcaggtgctgagcagggagttcctgtgcgacgagaaccgcgtcgcgggaagcggcaccccgtcgctcggccacttcgtcatccgcgggggtggggccggggccggcgacgccttctgctctgcccaggaggacggctcgtcgggggagaagacgcgccgccgccgcagccgcaagtaaattttacttgtccgctgtccgtctatcttgccacggagacgggcagacggcattagccgccagcgacctctcacttcttcctggcgagtggatctttaccgctcctcctcacccacctgttaattaattttttctctcttgcatatacatatatgttggttgttttgtttctcgggacaagaactgtaagaacaaccctggtaatatgattgcctccatcacaaaagaaaaaaaaattgaaaaagagaaagaaaaggagaagagaagtgatgtagcaacaaccctgaaagcatatatactagctagtagctttacacatcacggttcacattacagatagagaaaaggatgtgatcatgcaatggcaaatctgacggtttgtaacgaacgatcgcttgctacttgctgctgttggtggtggcgatcgccgagcgggatccaggtccaggatgaacgaacgaacgaggaacaacggagtgtgtggtggtggtggttggatcttgtctcagaacagtggcgtctctttttttcttttattttttcccatcccgtcccgcgcgggcgatgccaagcggtaagcgagcggcctcgattcgtctcactcgcccgacccgatctgaggcgctgctgctgatgtgcatgagtcaccagatctgcgtcgcccgctcgcttgcttgtccgcgcgggccggcggcggtttcgttaaaagttgcccgtcttttgcagcaacctccgatcggaccgcccaacaactcgtgctcatctctgcctgcctgcctgaaacggggaacctgtgtcgccgaagcggccacgagcaggcagtgaccctgacccccacctcgttctgctctactctactctactccctgctctcttgcctaccctcgcactgcacacacactgacgaaaacaagcatagtgcgaacaggcagcagaacgtggaaatgggatggggacagcgtgcccgccgcggagcccggacgggacgaccaagcgttaaagggacttttttcgagcttgatgacgattgatgaccacgtcgtgccctgttctacgttgcatcgtccgtccgctacccctcctactcgccgtctgatcagacttgctgctgcttgctccttagctcccgtgtgccgtcccagcgtggctatggcctacggataggctttctcctatcctctatatggtggtaggagtagactcgcgccaacaactcgtcctagtcgtagcacaaattataatttggataacgacacggtacgagcgggcggcgttacaggctgcccccaccggacacacccaatttggtgctggtgactcttttaggcaaggcaagcccgctcgggtgacgttccaaccaccctccaactccagacgcctaccgtcg

SEQ ID NO: 13056 - DNA, 3077 bp, Zea mays
cgagatagggtatactgtatttacgtgcttttaaattcaaaaacagttttttctgagctggtgtgctaatggtctgttggtgttttctttcaataggttgatgtattcattgcctggtcattgttgctgtcccacctgcaaacactaccagcatcttccagtatcaagggagatgtgcttcaatacatacaagaaaaggtcagtccgtgcatattggattgcattttccagcatatcccagtaaaggccgctgcaccgaatgggaagttcggcgccaccgagctagcgcctgaagcagaagctgctgccaaagcttcgaagaatgccatagctacttgttctttgcttccgtacttggagtctctttggcccatcgggactttgcagatggcctcacttgcaggctcactgtacgggatgatgattaggctgctgccttcttttgtgcgcacatggtttactaccttgagagaccgttcattgtcatactcaatcgagtccttcaccaaacaatggtgcagccctcctcttcttctagatgagttttctcaggtaagacggtctttcttttggcaggatattggccctgcactgcatgtccaaatttgttttgcacagctctgatctgtctaaggtttattatttgacccttaaaactgttacacaagcaaataaaagaacccaattgggaacaagtatctcttttgtattgtagttttgtttttctatacttcgttgacctcatatgttagtgactgagcggtttcattctgtacgtctcatgagatcacataggagccttgcagttgctcgttgcactaattttaccttgttacaggttaaggagtccgtatacggcgatgagaatttctcggttagcgtcaacaggtcggctttcgagatcgttgctacatacaaaaaggaggagacaggaatcgaccttgtcatacgcctcccgagctgttaccctctgcgccacgttgatgtcgaatgcacgagaagtttgggtatcagtgaagtcaagtgcagaaaatggctgctttcgctcacgtcattcgtccgcagccaggtaattttactcagaacacagataaagagtggttgctctgtgacgttaaggatgtagctaagctgattacttgtctctgcagaatggcgcgatagcagaggcgatccgcacgtggaagagcaatttcgacaaggagtttgagggcgtggaggagtgcccaatctgttacagcattctccacaccagcaaccacaacctgccgcggctggcgtgcaagacgtgcaagccgagcggccgcccgggcaggttctacaagtggttctccacgtccaacaaatcgacttgcccgctgtgccagactccgttctagtcctagctctagacacatgcttgtttgttggttaccacaccgttcgatccttctatgtaaatggcgtgtgtacgcagcgcagtgttcagcgttttggctgttaaatactctcgaaacaggacgggacctgcagagactgagttcagaggtcttataatctacacttaccgtgaattcgctagattatttttaggttaattgaacatgaaaatgtctaaattcttaacacttaatggtcttatgaaaacaaacataaaaaactatataaaatcaactgaatctactagtgcacgtctattttcgtcaaagaccggagcatgttttttttggtggtggtggtgggccgtggggtaggagttacaaagacgataggttgatcccgcatctgtaaataatttccaaataaaaaaactggaaacgtagcaaaaaaaaaaagaaaagaaagaagaactgaaaccccaaacaccactagctaaagcacagtgttcatgcatggatttctaggattgacctacactatcacgcaaaatttccttggcattcaactacaagcatgttagcgattgaaacatgaaatctttcctcttagctttgctgcgagtgcgaccaactatagaaaatgaatatatatatatatatatatatatatatatatatatatatatatcaaataaatctgactaagtcatatttgggcttgtaaactatggggtgtttgtttagaattataatatatctagattatataataaaaaattataatcccaaataaaaaaccctctatatcaaataaaaaactatcaattacgatattatagattgtgtagaaactattaacttttggtgtagaccatatcagcatttgaggcctttgaaaattcagacttttaaaatttaaaacctaaggatttaaagtgaacatttggattctaataaacacaatctcatataaaaaacgtgctaacatacaaatttgtttgaaaattttaaaaattacccggaaactactgctcaagaagtaccgctgctcgaaaccgtggcaggctccggcccgagcgtgcgcgtgaaacttactcctcccaaactaaaggctcaacaggccatcacatggagtcacaacccaactagacggatggcctatcagcccaccaactcctgggggatagcgcgcgcgccgcgccgcgccgcgccgtcctcgtagcagcccagggcccaggctggccaacggttgcccacggccacacatccgacacgtcctcgcggtagcggcgcggcactcgttctgcggtcagagtcagaacggcctaggcgctagcgataagccccgcccaccgcgcgcgcgccgcggcaccgtaccgggatgggcgccataggcatcgtcgtcagagcgtgcgcgcctctcgctcccgccgccgcggccgcgccggcaccctccggctccagctccagggacgccgctcaggcccagcggtggagcaagcccacgaggaccggccgcgtgctcgtgctcggcggcactggccgtgtcggaggatccacggccaccgcactctccaaactccgccctgacctcggcatcctcgtcggtggcagaaaccggtaggaccggcaggagagtagccttttctcttcaggctgaaccgatgctacttactgacaggcgctggccgatttagctttgacagggagaaaggcgag

SEQ ID NO: 13057 - DNA, 1391 bp, Zea mays
  misc_feature (260)..(260): n is a, c, g, or t
cccacgcgtccggttctagatcgcgagcggccgcccgcgatctagcggacgcgtggggctttctctctacttctgtctgagcccttctgtcaactttcactggttaaaaattattcaatgggagaaagttgctcatctgctcagcaatctggcacaagccaaagtgctgagttgatgccagattcagacaagacagtgcatctaagagaggaactttcagacttaatcgagttcccaacatctgaacttctcaaaactgnatctgacagctcgagatagggttgatgtattcattgcctggtcattgttgctgtcccacctgcaaacactaccagcatcttccagtatcaagggagatgtgcttcaatacatacaagaaaaggtcagtccgtgcatattggattgcattttccagcatatcccagtaaaggccgctgcgccgagtgggaagaaaaaggacaccgagctagcgcctgaagcagaagctgctgccaaagcttcgaagaatgccatagctacttgttctttgcttccgtacttggagtctctttggcccatcgggactttgcagatggcctcacttgcaggctcactgtacgggatgatgattaggctgctgccttcttttgtgcgcacatggtttactaccttgagagaccgttcattgtcatactcaatcgagtccttcaccaaacaatggtgcagccctcctcttcttctagatgagttttctcaggttaaggagtccgtatacggcgatgagaatttctcggttagcgtcaacaggtcggctttcgagatcgttgctacatacaaaaaggaggagacaggaatcgaccttgtcatacgcctcccgagctgttaccctctgcgccacgttgatgtcgaatgcacgagaagtttgggtatcagtgaagtcaagtgcagaaaatggctgctttccctcacgtcattcgtccgcagccagaatggcgcgatagcagaggcgatccgcacgtggaagagcaatttcgacaaggagtttgagggcgtggaggagtgcccaatctgttacagcattctccacaccagcaaccacaacctgccgcggctggcgtgcaagacgtgcaagcacaagttccacggcgcctgcctctacaagtggttctccacgtccaacaaatcgacttgcccgctgtgccagactccgttctagtcctagctctagacacatgcttgtttgttggcaccgcaccgttcgatccttcgatgtaaatggcgtgtgtacgcagcgcagtgttcagcgttttggctgttagatactctcgaaacaggacgggacctgcagagactgagttcagaggtcttataatctacagttaccgtacattcgctagattatttttgcggcc

SEQ ID NO: 13058 - DNA, 3410 bp, Zea mays
ggtgtcataccttcttgctatatattttttttcatgcgaagtccatgaatgcatgctgaaggcactgatatattcactctcctttgcactggcctttcaggtctccaagccattacttagacgggcaggagatggtagagtccttaattggactacagaagatgacgattccctttgcacattgcaagaggcctttcaacgtgtcagtcctcgcctgggatttaacattgagctgaagtttgatgacagcattatgtatcacaggaaagaccttcagtgtgctcttaaagctgtattgcaagtacagtcttttcccctacttcgtatagagctcagtaaagtatcgattgatttgcattcagattcggtctattcacatccatttcagcgctaagaggtggtgtctgatgtcaaatcattttggcaggttgtttttgagcatgctaggaacagaccagtctttttttcatcgttccatcctgatgcagcacagatgatgcgggaactccagagcttgtatcctgtaatatttgaaactcctgttctatgcctgaaactctgaattgcctgtcaggtttcctcaatctgtagtgtagctagtattgcaatggctacggaattcattggcaaagttccagtcaatctttggcacatcaacttttcaagacaccaatctgactgcgaatacgcttgctgcttgcatcatagtattctgagtgcaccatagatcatctagttaccttacctttaggtagctacaaatcgataatactctatgtaaattctggaacaaatctgtgctggtatttgattgtgtataatttagatccagtttagtgtatggtagagtcgctggtgaataaaattttgctagacgaaaaaaaaaaaaaaaagaattggccaacttccccccccccccccccctcctatcaacttaagcttttcagttgtctctggtccaagtcctggcaggcacaattaaatactccatccgttcttttctatttgtcgtgttttagtttaaaaatgaaatagcgggcgacaaatattcgagaacggaggtagtaaataattgcagccgactcccgctccacgttttgagcaaataaggtgtcgtgctgaactggacaacaccgtgctgtatacacattcaaaaatactcatctgatccttgttgccccccttggcgcctggttcttttcttttcttcgagaataatcgtcttcgccgtttttctgtaccttgcatcaggtacttttcctaacagaaggagggacatcgaaacaccacgatccaaggaggaactcgtttgacgacgccgtccgggtatgcctagagtacgatctgcacgggatcgtgtcagaagcgagaggcgttctcaagaacccatccgcggtcgccagagcacaagaatctaacctcgcgcttctcacgtacgggcagctcaagtaagctaagcagcatatgtggctatatatagctaccagttcatggatcgtctcacagccttccctacaaccggatgcctgtataatctcagcaacgtgtgggaggcagtctacatccaatacctgatgggcgtgcacggcgtcatcgttgaccgggtggaggagatctcggacgccgtggccggttttggtctggggaaaccaggccttggccggggcggtgctggcgtggacggagcgaaaacgcatcaggctcaggccttctcgcagcagcagctggggttcctgctccggcttatccctgaactgattgagcagcggcactgaaggacggtacaccaccatatgtaacatcccagtttttgacccccctcgaagcggatggcaagcattcgcctttggggtcaacacttctcctgactgactgactggcaggtccgatttgacagcttaggaggtatacttgtgctgcgtgcacacactcttctgtatagtctgaaaactcgcggttccttgttggttcagtacagttacagccgaccatggaccgtggtcgatctcttgttgtttcaagtaggctcaccagaaaaaggtcagcaatatgtattgttggaaacttgtatgattgtgacgtgtgttgttaacaaccagggatgaaaaccgtaaccgaagtctattgtttccattaaagagaatattcttcgtatagattttggatcctgcccggatacctgtcttaggaagcgcaaaggaagaaagcaaagcaagaacgtgcaaatctggggggctgcagtcgcttttctcttgagacctaaggaaccggagcatgtccagtgtccagcggcgagagtcagacgctagcgctgcaaaaggcaaagcattacagtacgctatggcagttgcttagcacatgtaatgtaagcactgcaactgcacgatcaggattattcagggactcctcctgccgccgacctgagccgaaccattggtgcgccacgccaccaattcactattcagtgctccatccatgtggcccagcaggccaccccccacgtccaaaagctgtatgcggatgactcatcgagcatgcacgccctgtcagcacaagcgaaagcgagcagaacagaagcactgcgctttgagaagctagctctcccctgtcctggccattggaggaccgaaagatctcgagaacagactctgcaggcctaataacacctgaaaaggactcaaaacagcccatcgctatctgaatggcctaccctacctgatctccccgatccgtgctgggcagatcgattttgggagggggagaggaccagatcgttggcagagatccatcatccatcaccattggatggcaggggggggggggggggtcccaggctgcctcattctggcatccctgctttgcctaaatctgtcttcccgttagacatatataggttgggtgctcaggtcactgcactgcgttgcgtggcgttgctccttgttgcgttgctcaaaaggcaattgtcttctgaatggctggagtttttcttcttaccctcacgacgatttagccgtggttagctagcatgcatgagcacgtactatggttgatgatcctgctgtcaccgtggatggatttgcgtatgtggatgggtgcatgggtggatcaggggtggccaagatcacccaccatatacaacactgggctgcactgcagtgtgcagtaactgagaaaagcaatgcaagctcaaatgggtggaggagggagggtcagaaggtgcaaatgtgatgcatcatgctttcaaggaaaaaagagggggggggggggggggcatttcaatgtttttttagctttcactaatggatgctacgctcggctcaaatcctgacgttcgttcacaccgcctgccgtggtggtgatcgatcgtgggggttcaccaactccctgcggtcagacgaggccgctacgtc

SEQ ID NO: 13059 - DNA, 1619 bp, Zea mays
ttcccggtcgaccccccgtccgggaaacgggcacgacgcgggcggggcggggagccaaaatggcgctcccgggcccggcggcgacccgcgcggcggtgaggctctgccggatcgcggcgagcgcttcctcgtatttgccgtctgcggcggccgacggaaggagggagctggagctgccgttcgcgctggtggcggagcgggggatggtggtgggcggccaccgcgggatggggatgaacgcggtgggggcgccgcccggggcgcgcttcggggccgccagggagcgggagaacacgctgctctccttcggccgagccgccgcacatgctgccgtcgccttcgtcgagttcgacgtccaggtcacaaaagatggctgcccaataattttccatgacgatttcatcctaacacaagggaccggggctgtatatgaaaggcgtgttactgatcttctcttggaagatttcctctcttatgggccacaaaaagaatcttgcaaggtctccaagccattacttagacgggcaggagatggtagagtccttaattggactacagaagatgacgattccctttgcacattgcaagaggcctttcaacgtgtcagtcctcgcctgggatttaacattgagctgaagtttgatgacagcattatgtatcacaggaaagaccttcagtgtgctcttaaagctgtattgcaagttgtttttgagcatgctaggaacagaccagtctttttttcatcgttccatcctgatgcagcacagatgatgcgggaactccagagcttgtatcctgtacttttcctaacagaaggagggacatcgaaacaccacgatccaaggaggaactcgtttgacgacgccgtccgggtatgcctagagtacgatctgcacgggatcgtgtcagaagcgagaggcgttctcaagaacccatccgcggtcgccagagcacaagaatctaacctcgcgcttctcacgtacgggcagctcaacaacgtgtgggaggcagtctacatccaatacctgatgggcgtgcacggcgtcatcgttgaccgggtggaggagatctcggacgccgtggctggttttggtctggggaaaccaggcctcggccggggcggtgctggcgtggacggagcgaaaacgcatcaggctgaggccttctcgcagcagcagctggggttcctgctccggcttatccctgaactgattgagcagcggcacagaaaggacggtacaccatatgtaacatcccagtttttgaccctggaagcggatggcaagaattcgtctttggggtcaacccttgtcccgactgactgactgattgataggtccgatttgacagcgtatacttgtgctgcgtgcacacactcttctgtatagtctgaaaactcgcggttccttgttggttcagtacaggtacagccgaccatggaccgtggtcgatctcttgttgtttcaagtaggctcaccagaaaaaggtcagcaatgtattgttggaaacttgtatgattgtaacgtgtgttgttgacaaccagggatgaaaaccgtaaccgaagtctattgtttccattaaagagaatatttttcgtataaagaaaaaaaaaaaaaaaa

SEQ ID NO: 13060 - DNA, 1262 bp, Zea mays
  misc_feature (47)..(47): n is a, c, g, or t
tcgagtcagctacgtaggccccccctaggcccagccgcccagccagntcgtcggatacagaagactcctctcccttctctgcatccgttccccgccctctcgcgcatccaccgccaccgcgccgctccatgaaggacccgttcgaggcggccgtcgaggagcaggactcgccgccggactcgccggcgccgcccgaggaggaacccggcgccgcgggcctcgcggacgacgccgaggactacgacggcggcccgcccccgcgccagccgtcggcgccggcgtcgcacgcagcatcggccgcggccaaggccaagggccgggtccagagggagcagcaggaggatgacgacgacgacgaggaccagatggaggttgacctcgagaagcttcccagcagcactggcgaccctgacaagctcgccaagatgaatgctatactgtcccagtttacacaacagcagatgaaccgttatgagtcattccgaagatccggatttcagaaatctaacatgaaaaggctattggcaagcatcactggaagtcaaaagatttctatccctacatcaattgtggtatcaggaatagcaaaaatatttgttggtgagctaattgaaacagcaagagtagtcatgagtgagaggaaggattcaggacccatcaggccttgtcacatcagggaggcatacagaagattgaagcttgaagggaagatcccacggcgctctgttcctaggctcttccgctagaactgacacacatcaggcaggagtcgggacagatgtgggacaatcgttttccacgtaactgcggacctcgtcatacgtaccatgggaattgaaaacctgtgtactgtaaagttagccccccgttttgacttcatactagccgctgatgcgctgaataacaggtggtggctcctgtcacgagctagatgtcttgaaatgggtttggggaatgatttagcaagaacaaggttaggattacagggtcgggcatgcggctgggacctgcgagacgaggatctattcgaaatgcagtttgttaggatttacttacctgcttaagcctgttttcggtgaatctgtttgacactgtttgaaggatgagtttgaaatagggataagggacccagcgcagtgccgcccaaggtttgaaaaaccggggggcaaaccaaataaaccggccggctttccggttatcgggcccaaccggttttggagtttgaatttgtgaaattttaaaaaatttgaaaaattttggcg

SEQ ID NO: 13061 - DNA, 1100 bp, Zea mays
cttcccggccgcaggaatccagccgacccagcacttccccggttcctcccagcagagtcttcttctctgcatccgttccgttccccggcctctcgcacatccaccgccaccgagccgcgtgcgtcttccatgaaggacccgttcgaggcggacgtcgaggagcaggactcgccgccggagtcgccggcgccgcccgaggatgaacccggcgccgcgggccctgcggaggaccccgaggactacgacggcggcccgcccccgcgccagccgtctgccccggcgtctcacgcagccggtgccaaggccaaggcccgtgtccatagggagcagcaggaggatgacgacgaggacgaggaccagattgaggtcgacctcgagaagcttcccagcagcactggcgacccagacaagctcgctaagatgaatgctatactgtcccaatttacacaacagcagatgaaccgttatgagtcattccgaagatctggatttcagaaatctaacatgaaaaggctgttggcaagcatcactggaagtcagaagatttctatccctacttcaattgtggtatcgggaatcgccaaaatatttgttggtgagctaattgaaacagcaagagtggtcatgagcgagaggaaggattcaggacccattaggccttgccacatcagggaggcatacagaagattgaagcttgaagggaagatcccacggcgatctgttcctaggctcttccgctagaattgaagcatgtatattacacatgtgtctggagtcctgacagatgtgtgccatgaggtgaggagtttctagtaccagcttgttgcagtttctggacagaaacctgaccagactctcacagcttctgttgagaaatcctgtcaaatgtcatatcatctttaagatggaattagaaagagttaaaacgtccctaccacggggcctaaaatcgcctggggttgttatttgtactgagggctactttgaaaacctcaaatccccttcgggattggaggggattgaggtggaaatgaactaattttctcttgagtttccaaactaacactaaaagaaaatgtagaatctgatttccatgcgct

SEQ ID NO: 13062 - DNA, 1602 bp, Zea mays
ctctaaatatagagagcactctccttcattctctatatattatatatagattttctaaatccatttttactttatatacatccaaaaaagtaaaaactaaaatatgtatcatatacttgagggtatgaaaaaatctaaagtaaaacatatctctattatagatatttgacgtgtagaatgagatatagaagaagacgttgaagagaaataatatacataggtaaaagaattttgtatagaagaaaagatataaagaagcataaagaggatacatttgaagattatatgggcttcgtggtgcgacatgtcctagctggattgggccctacctctagcccgggcatgggggtctcgggcaggacgacacctctgcacatctatacatatacagcggcgcgtcgcctccccccgccgcccccccccccccccgccttcccgcgaaccagcacacagcacagcacgactcgggtgcgccgcgcacacggacggcagtgcacgcctcgccggctcaccaatcgacaccctgtccaaccagcaccacccggcgtcgtcctccctggcggggggctaggctagctagagctgtacagcgcgagagcgacgaacggcaggtcgatcggcggtcgcacgtacgtcgtcgaccgagagcagagcagacgaccgcggcgccagagatagttcgaatccgattccgacccatccatgggggttcacctgctgaagaagcagcactcgtcggcgccgtcgtcgctgggccgcggctccgggtccgggtccgggtccgcatccgggtcgtcggcgtcggcgtcgtcgatgccacccaaggggtgcatggcggtgcgcgtggtggggccttcctccgccgccgccggcggggggcgaaaggaacagcaggaggaggaggaggaggagcggttcgtggtgcccgtggggtacctgaagcacccgctgttcgtggcgctgctccaggcggcggaggaggagtacgggttcgagcagaagggcgccatcaccattccctgcggcgtggaccacttccgccgcgtgcagggcatcatccaccaccacggctccggcggcgggcaccaccatggtcaccacagcagcagcagcaaccacttccacatcgccggctgcttccgcgcctgatcggtcggtcttccatctacaccacgtggatgatggatggaaatagagaccgatccatgccccgctgggctcctctctagcgccgacgggacgacggatcgatcgaggaacaacaacaatatttactagctctaccgcttaattttctagggttttcttcttcttggttaggatttagacgcatggcctctctctggactggaccgaccgaggatcgaaggaccatggttggctcctgcctgcggccgacgcagtctaccagaggacggactggtcgctctcgcttggtcatgcggtgcgcgcggatcaatcgatcggtggatgatgatatgttttcccatgtgttttttttggagtttttaatatcttaggagtaatttggattgttgttgttgttgttattgttgttgaggatgatgaaaacaaattaaagcggaggaggaaagggaaacc

SEQ ID NO: 13063 - DNA, 8047 bp, Zea mays
tcgaggtcgtatacaaatgcaaaacactaattataaaccaaaaaagttatgttagatcgcggtttaaatagtctaaaaaatatcatcataactattatcaaaacagtttttttacaaagcagcagcccccgggtgcagctgtccagctggctcccttgtgccccggaaagtgattcgtctgcgacagcgagaacgaagccctcgaatcacaagtgccgagaaggggagatgctgggtggttagggtcattgaaagggaggcctattgccgattaattggcttttaatccgtatcaatgcccgagtaattgcagacagttttgctgccgcgagggggatggggcgggggcggtgtcagccgggcgatttaaatcttcgcttcaatgccccccccctgctgttgccattccgagcgcgccaacgcacaggcacagcacagctgctctccctccgccccgcttggctctcctctcctctgctcggcagatcagcttccgctggcttctccctctaatggccatgtccagcgcctgcacctgcaccacaccacgcggaaatattaaggccggccgtccttcgccaaacaatttggcactggaacgtacccgctgtacttaccgacacagagacactctccgggctcctgccggcccatcacccatgggatggccgagacccgtcgaaatcacttgcgtccaaagacacggcacagctggacgaccgtagcagcagcacgaattgtcgcattgggattcatggcactccttcctaactactagtacgtagtgtttgatttcagagagcgagcggtccagtggtatcggctcactcccccgcccgtctgaaaatgacccgacgagcaggcgaccactcgctcccgccgctttgtcgtccatgggccatggccaggctctgtactccgcgcgcctgcagcgagctaggagtagcgtggatggatggatccagtgatccagtccaagctcagctcagccccgcgtagtagtactactgcgtgcatggtcatggttgaagcatttagctaggcaggcgcgtgaagcgaagtgaagtgcagtccagcgacgacggaccggacggagcgccaaccaaccacaaccactactcggctcgtcctttaaatccgcctcctaaaattccagctgctgagcgcctggtgattaaaggaagggcttcaatgccgtatagtgcctagagagaaatcgagttttaagtgtccatgaatggcggttgttgccatggcgtcgcaggcccatatgaatacggcggtgagctgttccaggtctggtggtgttctcgggctcggccggtcacctcacccccggcagtcaatgtcgtcgtatggtgacggaggcgcacgctgccgccggtacggtgcgcgcgtactccacatcaggtcgcctgctagtccaccaccgccactctggtcgcctcgtgtgtcacactcgccgactgtatctatctgaaaaatgaaatcgaacagatgattgtcctagttctaggactaggaaacagaatgggactacgtagcacacacagtatatcggctgaaagtgcacaaatgcccgtagttcgttcctctgtgtgtgtgtgtgtgtgatttaattggaagggaatgggcttctacgattcctcgcatctctattgctaactggagggaagggagcagcgatctgtggttttttagcctgttggaaagagtggcttttacaagttggatcttccaaaccgctagccgccgattgaagcgaatgaatagagcaacaggctagaggaccacgagtggcgagctgaccaagaagctgatgtgctacggcagaagatgagaagagatcgacaaacggcaaggctctggaatagagggcagatcgaagcgaccgtgggttgggcctgtttgtaccatgcaatgtatatacgaaaaatcgaaaggcctttgtagcgtagtacgcttatactactggccgtgtgcgctccggtccgcttcggctcgtgcgccctgcctgtctggactggactatggagtcgccgtgtggctgtcatggatcacctgaaaccttccttcctccatccatgcccatactacaggctacagcatagcgaaccgccagcctagaggagacgaccatggatgggccaacttggaccgagctcgtagcccacggaccaccaccaccagtccaccacccagcccatatcggtccttgaactccctgcaggtcgctgcagtcgccagtcctgagtccatcatcatcacctgaaatgctgaaactattctgcatcctcatccccagtccccacactactacaacctgtcactcgtgcatggctttttacactgcactataccggccgccattacctctccgccacctgaaatttaagacgtacctccacacttgccccgaggcaaaaggggaaaaaaaaagaaagactgacctttcgttttgatcatgatctgctcccaaaaccaagaatagagatcgagcgggcatccacatccatgcaccgccgcagtggtctgcccggatcaggaccaggcacgcaggtacagatggccgaagcgtcgaaaaaggcatggctgggcggggcggggcgggcgagagcctgcgaggctcacggcctgccgcagtccgctcggcaaagggtcgacgactcggcggggggaagcggagcctggagccaagccaagggcaccgtcatcatgagccgtgccgtccctactctagactgcgcgctcggctcatcagccgctgaggtctcaggcggcgggtgcagcgccggagcggcacagcgcgcaggtatatatgtatatatctactgtgctcgcaccgtgcaagccgaacagtacaagtgggctagctggcccagtggccacagcactctggttcacatggaactcttctgcactctgtctagtgctagtgcctactactgtacgatcgagtatgctgtatatctcgagctgcagcagtaatcactgccacacttccgggttattttcttttggcccggtatagtatactccctccgttcgtattgacactgcaaggggatttgaatgacaaaggctaaaacagcaaaaacattagcggaccaacgaagcttacctagctagctacagaccgtttgaatcgaagctgacattattcttcatcgtatatagaccttctgaataatacctgttaagaactatcgagagaaagagcatgtgaaggttgtacgtaaaacaccatcaaattttgataggaaaacatgacaaacaacaataagataaataatatatttttgactgattggatgttcgacaccccagtcatgtaatccctatttttgtaatagagcgagagggatggtcttattccattgaaaaaaaactaatatagtgctactatcatatcgttttatatagtaataaggggtgcagggagcagacctttttttttttgaaaattacgacatggatacggattgatctcgacaccctctgcaaggagccaaggagcaaagcttggtacgagtagaccttgctactctgcacccccccccccccccccccgagatacccccatacgtcgctttcttcgggaaatctcttgccaggcatagctaatatttggaatcaagagagaaaaattcaaacagttgctttgctccgtccactgtggtctcccactgtcatggacagtggtgctctgatggcgtgggggctaccagcacagcacagcaggcactgctcgcaaaccatgcaagaagcaatgatggcgaataggctggggaggtgcaacgaaggtacaagaaagcttggcgggttgccgtccctggccgactctgctactactgctagtgagcaagacaaggctagctttcatatggactgtgtgccaatcttttcggtagatttgggcgtctgtgatgccgctgctgcctttttttgtgccctgtgctctgtcggtaaaaaaaaaacgtctcctttcttcgtccctgatcgagcaacagccacgcttgcataagctcgttttaccgagtttttactgttagcccaacaactttccggaaacagttttcaagcagcatttcttgcacaaactgaagtagtactacggaagagagacgagttgtagctttcaccgcggtcgcgcccgagcccgatctgattgctccgcctgagcgtcctccacaaggaaacaagacaaacgaacttgtcttaaatccttgatacatacatgttcccctattagctctcgtccgtgcatcctacgagccctaccgcccctacgacctgctggaccatcaataatgctgacgacgcaattacgtagccatcgttatctaacgctaacaggctatcttcctttttttttaagaaaaggtcgacactagtagcgggaaaaaagtaggtaaggattctgcggatgcttacgatgtgcttatcaaaaaaactcgtatgatcatttaaaacactgtttatactatacaatatactatatatagagtaaagtttaaatatgaatataaaaatggataaattgctgaaaatagctttattggactgagaaaaccgatacagatatcaattaagctgatggccattctgttccttatagatagacctccgaacacctcttagaagaactcgtcacagagaaacacgtggagtttatcctaaaggacgatacgataacatctggtctggctgatttgccgaattttagggacatatatatatttgtccctgctgctctacttcaaatttgagcctgtggcgtttccagaatcgttttcatgtgatcatgtcagccactagtgtgtaccacggcgttaacctttattcgattatctccacgactccaccccaaattggaaacctataccaccctgcaggatgcatatagctgttccaagacaatgcaatttagcatcatgtagatcggataggctacaccaaagcggaaatgatcgtcgtcggtccgatccagatagtgatgtgatgtactttccgcattccaaataaattaaccttttagtttagatacgaaaagtaaaaaatgtgaaaaggagtggtcataaaaaacgaagagagtcaaagagaagcagagatatagagtggaaaataaaagaagataaaagtacgttgaaaaataaaaaaaaaattataccgtctaattggttggtcgcatcgtctcgctctatgtcactacgtgcatttaatttatctgagcatttgtttaattaactaatatctagagcatgagttacatgagttgatgcaaaacaaattattttgaagctctttagctgcatctactattacacaaaaatactcgtttctggtcggtctggatcgggcgagcgtgccaatcagccggataatggattttggtgaaaaaaaataaatcctataacactaacgactaattatctatttaggaggacagagggagggagcagacgacaacgaggcaagagattatggagcggtccggccttggcggcaaaattcggaaaaggaaaatattccttttgccaacagcacacagcagcgtgagtaaacgccgatacgcagtacggggcccggcgagatgtcgtccaaacttttttttttttgcagcggcgaaggcacgtccaatctcccacagtaaatggaagagacgacgacgaccgggggaaagtgtggagaacagaacgcaacaggcagagctttcagaagggcggaggagaaacggaaagaggggctagtagcccttcacggcaggcgccaggcggccctgctgcttgcttgcttgctcctctcacgtcatgggtaaatgcaggtgtgcagcgtgggtctggtcgtctctctggtttcggcttgcattgccgcccggttgcgtgctaggtccatgcctgttgcactgcactgtccgctttttagtcgacagcggcgcgccactgttttagctgcatcaccaactcagcactgtacattgttcctgggccggcgacgtgagtttcctcacggatactttgtcctttgacagtagcagcgagaatactagtaggccactgatctgatcatcactgggagcgggggaaaaaacgccagtagcacgaaccaacgaaatactaggaacgcaagcggccggagaccatcttttccgtgaaatgaatctttgacgtgctagtgttcgttgaaaagacaccgaaaccttcgcggtgaaaaacaaaggcaaggtcctacgacgcagcgcaggtaaggtacccctgcaaatcagacattttgtcctcctgtccctcctgcgttgcaaattgcacgcgcaagtgtcggtctttcaagcctgctggatcgtctgtgtacacgatgggactggtgctgtgacgtgaaactacaactgttccagcaccagtcccaagtgctcacgccccacgcggccgcaccgtgcgttgcgtggctgcgagcagatggagtgcgtcgcagaagatcccgcccgtttcctgctcacctttttccctcgcaaactcctttaaaaccaagctgccctgcccagcccagccgtccgcccttgtctcgctctcgcacaaaaaagtctgcaagcagggttaaggcgcgcaccaacctttccctcctacctctactcctgttcctcgggttcatcctcacctcgagcgctgctgcggccatggtgaccagaaggttggctctgagctccctcttccacggcaaggcaagggacacttcgtccttaccaccgccgcctcctcctcctcccgcaccagcctgggcatggccgtccagcaagaacccaagaacgacgcagccgcaggcagcagcagcagcagcagcagcaggcgccaggaccgtcgcctccatcgtcctcgactccgccgactcgtccttcacggcctcctccgcgctgcaggaggactgctgctgctccgacagcctctccacggcgtccgaggcgtcggcgtcggcgtcggcggcgtgcgacgacgcggcggcggacgacgccgtcgtcgtgcgcggggtccgctccgaccggctcctcttcgacccaggcgcgtcggccaccaactccatcctcgaggagaagtctgccaccaaacgggagcaggcgttcggcggcgccgtggccgtcgcgttcgagtccgccgacccgtacgtggacttccgggcgtccatggaggagatggtggccgcgcacgggatcggccgccactggggctggctggaggagatgctgggctggtacctgcgagccaacgacggcgacacgcactgcgccatcgtggcggccttcatcgacgtcgtcgtcgtcgccgccgtagccgccgacccggctcgctcttcgcagcaggcctcatctcgcacgtcgtttgcgacgggggagttggaggtggcagacaagggcaaaccagatggagccggagcgctcgccgtgtcatgtttggattaagctgagctaaatcttcacagtttatttgcattaccttattatatatgtagtactactacgtgttaatctcgtcgttctaaaatgtgtagagactagagaagagtactagtgtacggttctcttgacgatcaacctatgtcgttgacccacctagacgtacgagtacgatcgatcaacctatgcagattattctgtgttaaacaagatcgaggggcgaaccgtacgtaccatgcacgcacgcatggactacggacgggtcacgagtccatggcgaacgagcaaaacgggtactcctgtccatccccatgccctacgagtagagtttattagatgtcataagttttactttgttttagaaaaaaagagagaaatgttaacatctaccacgtaccaatattactatatcaagctacatttcatgtcgactttaattaacgaaactaatatgttattgtagctattgattcagtttttttcttttctgtaagcttagtaaagcaagaggattcgattcttctgtgtgcaaagatgcaccgataaaaagacgaagccagatagatgcatgcaaatggtgccgaccggtagtagtgcagactgcag

SEQ ID NO: 13064 - DNA, 1814 bp, Zea mays
gggcattcgtggccccccgccggccggggcctcaccgagttcgtcggtcgtcacctgatattttttccgacggacacacaagcatatatacatacacgccgacatagggatgatggcttcctctagtcctcagcgtgcagccggcgccgccgtcgccggcgtgctgctggtggcggctgccgccctgtgctcgtgcggcgccatggcgcagctgaccgcggactactacgactgcacatgccctgacgcctacaacatcgtgaagcaggtcctgatcgaggcgcacaagtccgacgtgcgcatctacgccagcctcacccgcctccacttccacgactgcttcgtccagggctgcgatggctcggtgctcctggacgccgttccgggggtggccaactccactgagaagctggcgccggccaacaacaactcggcgcgagggttcccggtggtggacaaagtgaaggcggcgctggaggacgcctgccccggcgtcgtctcctgcgccgacatcctcgccctcgccgcagagatctcggtcgaactgtccggaggaccaaagtgggcagtgcttcttgggaggctagacagcaagaaggccgacttcaagagcgcggagaacctgccgtcgccgttcgacaacctgacggtgctggagcagaagttcgcggccgtgggcctccacaccgtggacctggtggccctctcgggagctcacacgttcgggcgggtccagtgccagttcgtcacggggcggctgtacaacttcagcggcacgaaccggccggaccccacgctcaactccggctaccgggcgttcctggcccagaggtgcccccagaacggcagcccctcggccctcaacgacctggaccccacgacgccgaacctgttcgacaaccactactacaccaacctggaggtgaaccggggcttcctcggctcggaccaggagctcaagtcggcgccgcaggcgcagggcgtcaccgcgcccgtcgtcgaccagttcgccaccagccaggccgccttcttcagcagcttcgcgcagtccatgatcaacatgggcaacatccagccgctcaccgacccggccaagggagaggtccgctgcgactgccgggtggctaatgatgattaatccacgacgacgacgtgtgtagttagaaacggacgtgaatgcatgtgcatgtgcccggccgggtcgttagtacaccgacaagcaagagtgcactagcgctatggatcggactatatggtgcacaactgcacatgcatgcatataatatcagggcctcgtcgtttcgaattgtttgctgtcgacttcaattaatagtttctcataaatgtgcaataaagaggaacccaatttctcctgttaaaaaaaaaaaaaaacaccagcggccgccgcagccaacaataatactcattgttgcatgcatgcatgatactgtcctcgatcttttgggggcaagtgtgcgccagcggccacagccaacctcccactcccacagccttcctcctctcttcccccgtggccccgtctctctctcacacagtcacagtactcagcgcgtcccattgaacgtctgatgcttcttttggatccgtccgatatgaaaaatgctcagcgattggccgattgcccagatgtggatgcggataggagacgttatccgtatcggggcccacccggttataggtttgcttccggacaggtatccagcagcatgcgggacggaagacagataaaagactagcggcaggatcctaaacatccgaattatatgataaatttaatattgtaatatagatat

SEQ ID NO: 13065 - DNA, 2593 bp, Zea mays
tctctcataattcctctccggttcccccgcgtgatctgtctcgtgcggcaaggcgtacgcgtcctctcccgcccccgccaggccggccgccgccgtcgccctaagccaggtgcccaggtattcgtcggtcccttcgccaggcctccctcgcttgccgccaacgagcacccactagactgtagactacaattgcatcctgaagaataaaatggaccaacatgattccatggctgactcaccaaggaggcggcacaaccttttgcgtgacaaggtccaattggtgaaaaggaaggattcagatcgctatgagatcgtccgcttccatgatccactgtcttttgagaaaggcttctttgttgtgatccgtgcttgccagcttttggcacagcacaatgacgggataatatttgttggtgttgctggcccctctggtgctgggaagactgtgttcactgagaaggtggtcaatttcatgcctgatgttgctgtgatatcaatggacaactataatgacgcaactcgcatagtcgatggcaattttgatgatccacgtctgacagactatgacacactgctggaaaatatacatggtctgaaggaaggaaggtcagttcaggttccaatatatgatttcaagtcaagctgccggactggttatagaacagttgatgtccctagctcccgaattgttatcattgaaggtatttatgcactgagtgagaagttacggccagtgatagacttgcgtgtttctgtccactgggtggtgttcattttgacctagtcaagagggttttaagggatatacagcgagctggccaggagcctgaagaaataattcatcagatctctgaaacggtttatccaatgtacaaggctttcatcgaaccaggtttggagaccgcacatattaagatcatcaacaagttcaacccattttcagggttccaaaatcctatgtacattctaaagtcaccaaggtctctagggacctgagaaaatcaaggctgtgcttggtgatgatcatacggaaagcaacgaagaaacttatgatatatatctgcttccacctggtgaagacccagaagcatgccaatcttacttgagaatgcggaatagggaagggaaatataatctaatgtttgaggaatgggtgaccgacaattcttttatcatatcaccaaggatcacttttgaagtcagtgttcgtcttcttggtggtttgatggcattgggatatactatagcagctatactgaagagaagcactcgtgttttttctgatggcaaggcaactgttaaaattgattggctggaacaacttaacagacaatatatacaagtgcaaggaagagatcggctttatgttaaatctgtagcggatcagttaggtttggatggttcttacataccacgcacatatattgaacaaattcagctggagaaattgattaatgatgttatggcgttaccagaagatttgaagacaaagctcagcatcgacgatgagctggtctcaagtccaaaggaagcctttttcccgtgtttcggctgatcggagaaacaaacttatgaagagtgcacgagaccattacctagaacatcctaatcgaaaaaatattgtgaaattgagtaaactaacagaaaccaataggaggtttggtggagggcgggcccttgaaccgcctgctatcaaccagggtgcaatcacccagctttcagaacagatatcaacattgaatgaaaggatggatgagtttacctctcgagttgaagaactcaactcgaaatttacagtgaaaaaacatttgcccagtcagcagaacttagctcttccaaatgatgcttgcaatggttccacgcctacaaatctctttgtctctcatttaggcaatggtactctgatacctcattcttcatcatcaaaccaactttcaaaggattccccgatgatagaagagattatgaacataacaagaggtcagcgccaggttatacatcagctcgacaatctgacaaatctgcttcacgagcatttggtcttaacacgccagactaataataccgccagcaggaaccgggtgctggatagcgacacactcatctgtccacttatttgcctgactgttgccagtatcggttacttcatgtttaaaggtctcagtaggggctgaccaaagtgagttggcccaaacatgtgctccgaggctcaccaccaagttttggcagaactggagctaaaggaagacagttctcgcaccgtttacatcaggaagatcatatctaacagcttacggtcttattaagacaggtaaacccatataccagcacatggaacaaagctttcgcttttcagggagttattactcccaaacgcagaaaatggtgtaccagaagcatacacttctgtaacaggcactggcagttcccagtgccaataaattttggaggttaaaataatgctcagataatgtcgaagaaattatgagagatctataagtttaactgaacattgtcgttgtcggaaaaaaaaaaaaaaaaattgtctgtgtcgtgatttctgagtgcgagcactatctcatgatgccatctg

SEQ ID NO: 13066 - DNA, 1106 bp, Zea mays
cgctccttgatccactcctcctgcagctcctctccccagcctccctctctttctctgtccttggtcctctccccagcagcctccctctctttctctatccttggtcctctccagataacctgacgcagtggtcacgcttgacaaggagagagaccgcccgtccggcagctgatccgcgcccgcccggccgggagcgcgcgcaggcgaaggatggaacaatacgacgggctctttcctcccgcctacgtggacgactcctcatccctcctcctggtgcccaacgccaacggcactgcgcaggaggagagaccgagagcgcggcgcaggaggcgtcgagcagcgaggtgcggcggcggcggcggcgagctggacggaggaggggaccacaagaagcggcggctgaccgacgagcaggtagagatgctggagctgagcttccgggaggagcggaagctggagaccggccggaaggtgcacctggccgccgagctcgggctcgaccccaagcaggtcgccgtctggttccagaaccgccgcgcccgccacaagagcaagctgctcgaggaggagttcgccaagctcaagcaggcacacgacgccgccatcctccacaaatgccaccttgagaacgaggtgatgaggctgaaggacaagctggtgctcgccgaggaggagctgacgcgtttcagatccgcgggcaaccacgcggtctccggtgacggcggagacgtcatggcccgtgccgtctgcagcgggagcccgagctcatcgttctcgactggcacctgccagcagcccggaggaggcggcggcggcggcggcgatcacctgggggacgacgacctgctctatgttcctgactatgcctacgctgacagcagcgtggtcgagtggtttagcctgtatggactgatgtaatcgatggtatgccatcgtcgtcggcagattaattctagctagctactcatcgtagcgtgtcattgctgtgctgaattgctgatttctatgtgcgccctcttaatcatatgtacataaatcaagctatcaattactggcaaaatatagccagctagcagcaactagtactttaaaaaaaaaaaaaaaag

SEQ ID NO: 13067 - DNA, 854 bp, Zea mays
gcacccctctcacttaacaccccagctggtgccttgccctgtggtcctcgctccttgatccactcctcctgcagctcctcctcgcacagcacgtctcctctccccagcctccctctctttctctgtccttggtcctctccccagcagcctccctctctctttctctatccctggtcctctccagataacctgacacagtggtcacgcttgacaaggagagagaaaggcgttgcagcagctgatccgcgcccgcccggccgggagcgcaggcgaaggatggaacaatacgacgggctctttcctcccgcctacgtggactcctcctcatccctcctcctggtgcccaacgccaacggcactgcgcaggaggagagaccgagagcgcggcgcaggaggcgtcgagcagcgaggtgcggcggcggcggcggcgagctggacggaggaggggaccacaagaagcggcggctgaccgacgagcaggtagagatgctggagctgagcttccgggaggagcggaagctggagaccggccggaaggtgcacctggccgccgagctcgggctcgaccccaagcaggtcgccgtctggttccagaaccgccgcgcccgccacaagagcaagctgctcgaggaggagttcgccaagctcaagcaggcacacgacgccgccatcctccacaaatgccaccttgagaacgaggtgatgaggctgaaggacaagctggtgctcgccgaggaggagctgacgcgtttcagatccgcgggcaaccacgcggtctccggtgacggcggagacgtcatggcccgtgccgtctgcagcgggagcccgagctcatcgttctcgactggcacctg

SEQ ID NO: 13068 - DNA, 10644 bp, Zea mays
  misc_feature (6069)..(6069): n is a, c, g, or t
atcagccgccgaaaataatagtggccgccgaaaatcgtgcacagtgttgttgtgaccaaaatacaagaacttcaatatgggcggcagcacgtcatccgttcgatttattgctagatgttgcatgcggtatgagattagttgttaacgactgtgaaacttgcttgtccatgtgttttgttaacatttgcagctggtatagttagtagtaccagtccacatcgcagaactttcaggagagaataataaaagtgatggatgcatggggtggcgaagaagggtaatgaaagcacacaacaagctagggaaaaagaatttacgatatcccaccactgcacgccaataagatccgttgacgttgaagcagcgatgatgatatgcaagagctagtttttgcgcggatccaaggagataataagtataagttggaggttgggaagcaggggcgtggcttgtccgggagtaagggcgcctccgcttgtttaatcgcccccgcatcatttaacaaaagcaagcggagatcatggagcatgtgaggggacgatcgatcgagcatcacatgatgatggggatggattaggtagtgttgcctcgcctcgcctcgcctagctaattaattaactactcccgtcctgatcatcagttcatgctgatcccttcagctaatctcggctgggaacagcctagctagctagctatagctagctcgatgtgcgtgtaaaggacatggttatacttatatacactgcctcgatcgggacacagctaagctcggctgatgagtgccattaagaaattctagtctccttaacgccctgcagataggcacgcttgttctcttatgacgagaaagttctagggcacccttgttaattagtttagattgtttgaaaaggagatgcttcaaggcggtggcggtggtggcgatataaagaatctgggaaaggtataagctgccgttgaataactattaattcatgagcatttagtttgggatcccgcgcgttagtatctggctatctggtaataacaagtcggtcgtcgacgtgcttgtcgttattatttgcttgcttcctctagttttttttttcttcttcaccacactgcactgcaataggggtcaaccaccgagaaagctaccagcagcgcagggcggcaggcacagcgcagcacgcatatgcatcgccgggcggctgacaacgcagaggtgagagataataatcttggcgcgcgcggggcggattgcaggttccttgcaccagcggcagcatcgatctcctcgtccttgtggacccgccgccgccgccgccgtgcgtggcgccggccccctacccctacacatgcattgccgagagcgtccatccatggcggcggatctcctcccgcatcctcgcgagctgacgacgcgtctaccggaaacgggggcgagggatggagggggccggggtcggggccggataggataagccttaccggaaacgcgctaggcacaggtcaacacgggtggtggacgggaccgggaacttgccggtaatggaaggagggcgggtagtacttggcctgcgcgcctgcccgggtacatgcatcgaccgcgctgtagctgtagctgtcccgtcccgtcctgggcagcagatctctccctcaccaccaggcgtcagcaggccggccatggcatgcgcttcatcggatgccgtgactgagttggattcgaacacatccgagatccggtcctggtttttacaccttgtaccgtggctttacagttgggaggaatggagggtggcatcagcttgcagccctaagtggactgaccggaacgggacagacgcatggccgagtcgataagctacccctttcctggcagtgaatcgtacgaccggatagactcggggatttcctgcatccagcgaaaagctgcactgcatgcacccgatcgaagcgaagtgttcgggtccaacaacgaagtgcagtcaaacaaaaaagttactggattctttcagtagaataaaaaacagtagtagtagtagagtagaatttccactggtgcgtagtagtaggagtactgcacatagtactgcccagattgtaccccaaatcccgaaacgctctcccgctccgagaacagatcagtactggcggcggcagtcgcagttgacagcaggtcgtcagcagcagctctgcagcggcggccagtagacagcgggacgcccccccctgcgcgcaggctgctcctccgtggccccactcctcagccactcagtgccgcctcttccgaggactgactaatcagcctgtggacagtggcgcgtttggaatcccggagcgcacgaaaagcagagatggcgctgcgcggccactgcagttttcttccccggatcggcgggccgcggccgccgggtgccgacacgtccggggcgcgggggcgtgtggtccctggcgcccgagcctcgccccgggcgacgcgtggggacgggggtggatacctgtgcgtcccgtccactggcatcggccgctgcccgttggcgactggcgcgatccagccagcccccaggcgcggcgccagctgccagtgcaggccatgtgcctacgtcccctgtctcccgggctagctacgcgcctacgcccacagtgccctctcctgtcctgctgctacggctacggccggggctgactctctggcacggcactgactgcctcgcctcgcctcgcctcctttgctttgctttgctttgcttgcgcagctgatcctagccttatccactgttcctttcccctccccctgcctggctcgcctcgccagaaagcatttccccccatccttgctgactcgccgagttatcttctaatctttcttgctggatctgttgtgtgcgtgctcatggatatgctctaatcctttgatggcaaggcattggcatcggcatgtccgcgagaataagatgcaacgtatctcgcatactacggtgtgtgactgggcgtgttcttcatcggtgcagtatgatagtctgcatctttgcttttgggggcgagacttcgcgcgttgtttgtttagttgtggtcctagacctttgattaaaggatggggttttccggcccagttaggaaaacaggattgaaggggtttccaactcaaactgcaaccacttcatgcactagtgttcacttcaatagatcatgtacaacctagatactatgttggtgttctccaaacgctagatacatctaagaaacttgttaatacaatccaatgtatctaaatattttgttcactagaaattctcaagaaatgactcgtttatatgggttgtataggtggaaccacatcttacacttaaattaccatgctagagacgttacttcactaagatatacgtctcttgtgtgtttttttttcatttacctccttggatactccttaagaaacatgcatttatatggtttgtacatgcacttaaatacattgggttgtatgaacgggatttctaaaagtatctagtgcttggagaaccacaccataatatgtaggttgtacatgtcctacgtaactaactttgagacaccacgcttcgctaatgggatagctaggttaaatggtcgagctgtacaccacgaaataacacgctagctccctataaagactattatgtgtgtgtgtgggtgtgacttagagaatctcctgcccgatcttttcaaataaagtgatggccctttccaggagcaagcgccaccttgtcgaccactcttgtgtctgcctagaaggtcgtgcgctcccaagtaatctccaaattaagcactgacatatatattcgtgcacccggcccctactccctccctcgatgcaaagctttcaggggactgggatcaaagacaggaaaaacaaagaaagggacatcgagatcagagaataatacataaggcccggccggccgggcactttggaacaaattaaaggaagaatatagatgaattataaagcgttcaaaccatatagaaacatcgctctctttgaagttaatgctttggaacaacgaatatcggattctctaaaaataaatcttgtgatattcctatgaaattatttgtttttttagtaattttgcaggatttattctgctggttggagtgttggacctcttgaaaaccttccttttgcgtacgtacgtcgctcacctagttttccttacactacatttaaacgttcgttctggaagttttgtatatttttgccggttcataggatttaagatactattacgacattattctattccttcatagtttttcctaaacctgggttttcagaatttagcgttccaaagataccctgacactggaatggagtagctagtagataagagataagacatggaaagcagttagaaatacgtgtacaaccaagtgcacatacgacacatgtctctttctattattagcatgccagccaatgtcgttttctccaaaccacacgagacgataagaatgtactcgccgttccaaaaaaaattaatccttgttttttattagtcaaataattttaaagttaactagacttacatataaaagtattgagtgtaaatgttaaatttaaatttaactaaccttacatatacaacaaatattttctaatgggtatcaaaccagagtattctcaaattatgatatcaaataagcattattagtagatttatcatgacatatatttttacaatctatttacttcgcattataaatatcaatatttgctctatatatttgtttacaatttatgcacgttttcaagaatgcaatcaagtttttgtttggttgttgccatttgccaagtgtaaatgttgttaatgaaatcgaattacattatattgtggccgtagataatactaaatcagatcgtgcatggtctttgtttggatttgaaaggtagaggaaatcagttgagtgcgataggctgcaggcaccaatctttacggagtgacgaacgcacgacgacggagtccacatccactcccccagcgacgaacctgcagtgctagagccgctccccaagcgacgagaaagcgtgcgcaggtccaccactttcctcgcgttgcgtcggctcttggccttgccattcccggcgaccgccgcccgcggggccgcctctacttgccggcctgcagtttctgcatctgctcggtgcacattgcgcggaggtgcgtgatgatgtacttctagcgcgcattgcttgctgctctaggtctttatcgtcaccgctcgtcaaagccgttcttctgaccatggctcctgaggaccaccgccttcttcttaatgaccacaaccactgctttaggattaggaacgacggcggcggtgttgaatccgggaacctcctggggtcgctaattttgtgggagagggacgtgacttctctgttggtcgaagcgcgtagctcgtcgaccacggatgcatctagctacgaaggcgtgctgtgtgaggaagaagggctcaaggtctatagtggcggcagcagtatcacggcggataaggcttgggacgaccgcgaacggatttgaatgattggattacaagtactccctccgtttctttttatttatcgttggatagtgtaaaattgaactatccagcgacaaataaaaagaaacggagggagtacctaatatcaggagtctgaccaaaattaatcaatattctttatcctctataatctgattacaatacattttttggaccaaacaccatgttagaattacattatattcttctttagatagagttactaagtatttattggttcatctatcctctattgcatattatctattatattaatacaacagaatttaaaattatttctcacattatcaagagctgtaaaaaatacgagtttaataaaaaaaaggaaaagattattcatatttggattttactaagattaacggttttaatccaaccgaacgaaaagaatacctggcccgtcattaactatattttatagagatctcatagtttaaatctaacaaaaaagtccgattaataaattgaatttacttatttttaaatattaaaccacaaaatttnttggcccatcttccatttcgtttgtctatttgtttgttttccctgcaccgtctttctgatcttcttcatggttactttattttcatttttgttctaaactgttatgcataacaatacgatttttttctggtttttatagtaaacatcaaaaaaatccgacatcatagatctttagatatttggtctttctttaataaacaattattctcattattaaattatatctgtactagcatatagcgcatgctaacgctacgatgcccgcggaggggaaagagaggggttgatagatgcggcacatttaagggcgatggggcggaggggacttcgggacgagaggtcgcaagggaggggaagcaggagggatgatccaaataatattttacatttgatttgagtaagaaagatgtggttatccggcatcttaaccattggttttgatgatgtaaagtcagtgtgcaatttatttggtagatttagtgcatggatgttatgagtgtagggatgatttggctgagtgagttttgcaaagtttaaactggtgcattgtatagtggtgcaaaaatgcattttgattgtgaataaaatttattttattagaaacttgtccagccagtagtttaactaattaaatcctgaatggccaacttagtctaaataattatgtcatcagggtatacacatataacactgcaatccttaacacatcgcatataaaattgagagaggtatctcgtcataataatcagcagacatatcagtgtaactccttggcgacatcaatcatagattagaattatatatatttatggctcttcaaagaaaagccgtaatattataccaatgtacgagattaatcgaaatatcatatatcgttggatttacaatgatctaacgttttaacaaaagagcatatatcaagtactattaacatatatgtaaacttagactacttataaagtaaaaaattactccctccattcgtttttatttgtcgccgtttagttaaaaatgagctagtggggcgacaaatattcgaaaacggaagtagaattatatttatataatgttgttaaaaaggagcctatatgttcgctctgatatatggtaaaaatttatagggttagctgaaaataaaagagtatacattgtcggattctttgatgacaattaaggaccattagcaagtaatgatttaaaaatcttaaatttataagacaattgatttttaaaaaaaaacataagggaatcggcaatgattttgtccatactatgggataactgagaatactactgatatttggtgtatatgcagaaatttcacgataaaggagcattagtgaaataaaaagaaagatagttgatggaattgtgaaattaagaaaactagtcaatggtagcagtccagactttgtgcaagtggatgtagttgggagagggaaaaaataaagatgacgattataatcaaacaaaaaaaatttgcatataaaaattaagagccaattgctataaaaactagtttagcgcgctatttgtatgtgccacgttgctagttgtgaagtgtattcttagataaatctatttagagacataaaatattgacactttttcgtataaatttagttacacttgattttttttgacttggaacaaatgcacaattgcacccttttatcttttcgacagatggagtagtcctgcagcagacacacggtaccctttggactttggtacaccagtaagcgcatgacacagtggtgcccccatcctgttcatcagcagcagccacatatgtagctttccccccaaagaaaaaacaaagttggagcaggtggttttacatccatagccggtctgcctcagaaagcaccaccccccgacccggccggccagccggccggcgaaccccaccgcctccggcgttgcgcgcctttgctagccctatatattactcctaggtctctctcgagacccgcaccccagcttacttaacaccccagctggtgccttgccctgtggtcctcgctccttgatccactcctcctgcagctcctcctcgcacagcacgtctcctctccccagcctccctctctttctctgtccttggtcctctccccagcagcctccctctctctttctctatccctggtcctctccagataacctgacacagtggtcacgcttgacaaggagagagaaaggcgttgcagcagctgatccgcgcccgcccggccgggagcgcaggcgaaggatggaacaatacgacgggctctttcctcccgcctacgtggactcctcctcatccctcctcctggtgcccaacgccaacggtgcgcagtagtcgtacattctctttctcacagttgtgtagctgtaggtacttcgtctctgcaactgcgcagctcatcatcagtaccggcctacccgctacctgcaggacatgcacctgctacatgaatggcaattgatgtgtattctgtgcggtttgcaggcactgcgcaggaggagagaccgagagcgcggcgcaggaggcgtcgagcagcgaggtgcggcggcggcggtggcgagctggacggaggaggggaccacaagaagcggcggctgaccgacgagcaggtagagatgctggagctgagcttccgggaggagcggaagctggagaccggccggaaggtgcacctggccgccgagctcgggctcgaccccaagcaggtcgccgtctggttccagaaccgccgcgcccgccacaagagcaagctgctcgaggaggagttcgccaagctcaagcaggcacacgacgccgccatcctccacaaatgccaccttgagaacgaggtacatgccatcctacctctcactctttgcctgtgctccaatcctcttctctgttcatcccccatgcgccatggatcattgacggcgttgcagtatatatataatactgagcatgcatttcgtgggcacatgcacggctggcaggtgatgaggctgaaggacaagctggtgctcgccgaggaggagctgacgcgtttcagatccgcgggcaaccacgcggtctccggtgatggcggagacgtcatggcccgtgccgtctgcagcggtagcccgagctcatcgttctcgactggcacctgccagcagcccggaggaggcggcggcggcggcggcgatcacctgggggacgacgacctgctctatgttcctgactatgcctacgctgacagcagcgtggtcgagtggtttagcctgtatggactgatgtaatcgatggtatggtatgccatcgtcgtcggcagattaattctagctagctactcatcgtagcgtgtcattgctgtgctgaattgctgatttctatgtgcgccctcttaatcatatgtacataaatcaagctatcaattactggcaaaatatagccagctagcagcaactagtactttaattcagatgtgtgttcttactgctacccccattggaatctttttttttcttgactactatagtctttcgtgggctgatgggagtacactatgcatgtgctagctgacaatcacattcttgctacttcctttgttccggattacagggcatttcaatatttgaaaaaaaatcaacaagtcttaaatttaattaaaattgtataaaaactaaagaattgtaacatcatatactaccaaatataacaatatttatttgatattataaatattgttattttattgtacaaacttggtcaagcttaagatacttcgactctaaaaaaaactacagcgtgacttataatttaagacgaaaagtgtacgtcagaagatgtagcatttgaacaacaaatatagaatttcgaagttcacgtggaatggaatccatactactatgtggattgatcgatcgatgtagtaaacaacaaccaattttgctatattataccctcgtgaaaatctactttgccacaccttttcctctatactcttcataaatactatctttacttcaaattgtaagccattttgtttttctacatagatacttcaaattggtgtaattgttagttggaattagtttggctaaaaaaatcgatgtggataagaaatatttcacctgattcttacaaacacatttaatctagttgtgaaactaaacatctggaaattttcttgtgacacgttcaaaatatctcgggtgtaggtagggatggtaatggatcacgtacgattcaattggttttttcatgatttgtttgataccttaattaattttagttaaaaatcaaataaaaatagagtatggtccaaaaacattttgatctgatctcctagaatttccatgtcgactagaataaaggacatcaataccctctgtgttaaaatatgtgcatttttgtctatgcatttagacaagtcgtcccaaaattaaagtgcctctataatgacttattgtacatgcatcgcactatgccagatagcagaaaagtttgtgtcatatgccagtttccggttagcactacacaatcgaatataatgcaccttcttccaagtgtctttgataatgtaagtgtttatcaactcccatgctcct

SEQ ID NO: 13069 - DNA, 2412 bp, Zea mays
  misc_feature (2400)..(2400): n is a, c, g, or t
  misc_feature (2404)..(2404): n is a, c, g, or t
  misc_feature (2409)..(2409): n is a, c, g, or t
aggcttttatattaaataacatgtccctccgcacttctttcatataaaagttgtaaattttctattacgtaaaacctgtaagctatctattatgtaaaggttgtaaggtatttggttgaattaagtataaaatagctaccaaacagatctattttttcctaatttaaaaggcaaaaagtccaaaaataagaatccatcttaaaaaaccagagctaaaaacaaaatccaagacacacccaaaactatactacacgaagctgcttaaacagcttcaggcttattatgttcattcactttctgctttttaacaacggaagcaccttcagacgttcaaccaaatagtggtaacatcctgctgctacgcagaaatcctcatctaatatatctcaagcatccagagaacacttgatttctgagttttactatcaggcaaacatacggtcttttttttctatctgacaaacggacactcagaccggagcggacgagctgtgagcgaagaagctggctacggacggagctggagaggagagctagaatggcggggggcagcgacggagaagcaggctgcggtagtggagtcggcatgcgagtgactcggcgaggctacgagcggcgtcagagaaaaagactagtagactgcggcaaggtatggcgagagccatagctggccatactggcgctccgccgcaagctatccaacccgccggaaggtcccatgcagactcgtcgccaagacagtgctgtcccgagacatccgcctgttctgctgtgcgctgccatcgctcggcctccccgtcggcaagcacatcttcatgtatggccggatctgcccacttctgtctcctggtgaaggtaccaaacggatctacccacttcgacctctctgaagcaacaaagacagggagagagaggtggagagtagatctatccaaccgaagagaagcttgccggagtagagcttgccagtgtctcgcttgcgccgccgccgtcgctcgctcactcgcttccagggttttttccagaccatacgactcctggatccgatccagaacctcctcaagtcaaaaaaaaaatccaaacccataggctagaattctaatgggcttaaacgaacacgaaaaaaaataggatcctggatttttattagacctggattttaatctggattggttcctattccagactcaaactggtctagttaggcacaaccgaatgaggccttattagaaacaacccgtgactcccggcacctcggcaacccaagtacccaacgatatctgtgactagccatccgcgtcagctggccaacgccgaccaccacgacacgaaccaactgatggattcttttccgcgtaacgatcaattaatcagccgccccctaattcgttcgcaccgcgtgtgtgtttaaaacctaccagaagagtgatgccaccggcaacggtttgtcgtgcgtacacctactgacctacaccaaacagcatacaccccggcctactgacttttcttctgtctagaattcgtcaacgaggacttgggttgggttttgggtccttaatttgaaaacacaaaacagtggcaaaaccgcgcgcttggattggatggatacagaattacagatacagtacgagtcgctctctccgttccccgtccaaaccaatcgagcacgtacatatattcacaaccaccgcagctcccacctccatttctcctcccactcccaaccaaaccgtcgctaactatcactagtcgccgtgtggtggtcgtcgtcatatccctcgcctctgcctcgaccgcccgatcgcccatagcctgctggcctgctctgctagccatggaccggtccaagtcgtacgcgggcgggcgcatgcagatcgagccgtactacggcggcggcggcggcggaggaggaggcgcgcgggcggacttccggtcctactcctacagcgccggcgggacggggccgtcgtcctactcgtacaaccagtacgagtacggaggcccgggggcgggtgaggaggaggtgaagcggagcaagtcgaagcggcggtggctggcggacccggacatggaccgcaagcgccgcgtggcggcgtacaaggcgtacggcgtggagggcagggtgaagggctccctccgcaagagcttcaggtgggtcaaggaccgctacctcgacctcgtctacggttggtcctgatcctcagagcacgcacaccaccgctctccatggttgttgtttggctctcgtagatgttgttcatccttcctggtgatgtgaaaccaaccagtacagtgtatgtattcatgagatgtgtgactcaagaggttgtttcagaccaaattggtacagataaattcatcgttcaggtgatcaatgagcgtacgtggtaaaaaaaaaanaaanaaaanaaa

SEQ ID NO: 13070 - DNA, 3952 bp, Zea mays
  misc_feature (993)..(993): n is a, c, g, or t
ccccccaagtccccgggaatcccggaggggattaaagtttccaaactagcccttagtaaataaaagttgcatcaatagattcacatttgaacaaacagattttgaagcaattgatgacataatgtaagagtaatccaaaatcaacatcgaagtatgcttctaaatattttcccccaaatcctaacacaccttgtaaacagaaatagataagtgtagacacctgtatttcaagtttcaacatttagggtaccatatagtgcagcagtgcatgtaaatgtaggtgagaaaatagaataaaaactaaatcagtacaagaggggagatcctaaaactgtatgattaatatttgttgggattttcctctcctaagtttgaaaaactgtgcactaaaaagtaaaatccctatatataatgcatgtttccattccccaccaacatgtagccaactttatcagtatgacactaacaaaaggtgtgctttatcatgggagaggataagtggataaccaatctattggatatgagcattgtgtaactctatcacatgggaaaagaagaacatgatctgatagaaggcacatcaacaaacaccattgaacaaaatatgaagtatcctggtttaaaactgatactagcagaatctactaataaactaccacatctgttacaaattgtaagtcgttctggcttttataggtacatagattttgctacacacctacatatgcagtatgtcaagatacatagtaaaatctatgtatctaaaaaagataaaacaacttacaatttggaccagagggagtagattaataccccttgacgttattgttctaggttcgcagacaactacatttattttaacccatgaggcatgatccaattttcacatgctaccttcaacactagagagctagaagctatcaaaagtgccacaaactcagcaaaaaattccaccaatcagcgttgaactcaatcacgtcaatagccatactntagcttcatcattaaaatcaccaaaagtaaatcagaccttatcgattcacaaatttgcaaacccgaccaaggggtgagagtaccggtattatgtcccaacatggctaataaacccaaactgcaaacatgccggcactcgaactcatgacctctaaagttcctcatagtaacttgcttgtcaaagataaaaatccaacatattaaatggttaaaatgtattttcaattaggaaacttaatctgttggtccctgtttagacaatgttggtaatgtaggcatcaaaatcatcttgtaccctactgtactatgttctctgaatctctggagttatgttgggggtaagaagtccatagaccgatgatataaaattcttggaaatctgcatgcttatgttcaaaggggaactctctggcagcatcagatgagtgtttaagaaacattaccaattccacacgcacagatgccataaccagcctctaagcgtactgtactatactaatctaattacaaaacggatctgcaccctgttcgcatcccttggaccaagaacatgtctcaagactatcccacacttctcaaattctcgcagcaccatgttagtatcaccaggaaaaaatccgaaaacggtgacccactcctcctcgtcgacccgtccagcagccggagccgaatctctgggcatctccggccgcgccacctccctggggggcggcagcgtgatcagcgctaccttctgctgctgtgactgctgacccgacggcgtcgtcggggactgctgctggtactgcacgacgccatccatcggtgatccctccctgggattctcctccctcgagggggtccaccatgccgaggggcccggcgagccgttggaccgcagcggcgaggaaaagagaacggctccacgcgggggctgaggcgagggggtcgtcgtcgcctgcggaggcgtggccggctgcctggagggggagaggtgggagaggtcgtcgagggagagcagcggcggaggcggcggcggggtggaggcctgcgcctctcgccgcatcgaagccggtgggaggcgaaacgacgaggagatcggggacgagaggtcccgcaggaacggcgggtggcggcgacggtgatccggcctggaggcactcatgacggtggcggagagctgaaaccctagcaagagaaagtggagttccactgccgagtgcgccttgggtttttggaagcctcacgtgtgtgaatgtcccggcccgaacagaacgcttgtgtcaccaacatgtggaccctagaactttacaggtcccacatgtcggagtgctggcgttttgattctcggctctactcgaaggcgatgaagaaattaagaatacgccaggctccttgtcgctcgtaaaatggaggtcgcgacggcgacggaggcgtctgcgccggcggcaagcggcggcgcggcggggcagggccacccgttcccgtggctagacgctgccatctctgagccctactacttcctgcatctcctcgccttcttctcttactttgcggcccgcagcgcggcgctctccgccgacgacggaggggagctccacgaccgcctcctccgtagggtaagcttcggagatccccgtgtgcccgatccggatcgtgtcattcggttggttgttgagttgtgttggctcatccgctcatgcgaatcggtgttgatgtgcttggttttgcaggagatccaggcagtgctcgtgttcctggtgctcttcgtagtgaaggtgtgatgatcaattccagctagaattctattgcgagcttattttctgagtagcatgcttggatttggtgttaaaattggtgggagtagctgttctgttgctctaaaacgtggattgcaatgctgttatgcgtgccttcatatttgttatgttacacggataaggactttgggtgtttcttctatcttttgcattttataaaccagtcaacctgcgacttgagatgttaaacttgatgtctcagtaaattttaaaacaaaagggtcacattgttaggcgattgcatggattgcttttgtggtagaattaggtttgctatgaggttagattgcatcatattgaaagatgcaagattcgttgaagtaatagcaatgcaggttggtatgtgagagacaatgttatgctattccttgtgggatactttctcttattgcaaatatgcatatagatttgcttgtgcctttatctttttgccattagaagtcgattatccacacactataggaatttcttgctattccttgtgtgatacttctccatatttatggcaaatatgcatagagtcccaagtacaccttatctttttttctttgctcgaagtggattatttgcatgctcgaggaatgttcattgctgaagttccacattgattcgtaagaaaagaaattttcctaggtggatttttattatttttgtgcttcgttctccacatgctcaaatgcacaatcagattatcacaatatttattttggagtctattttggtatggcttgatgattgtgtaaaagctcgtgatgatgtatgttttacagcatctccaacagtgacctaaatgagtgcctcaaattaaaatatagggctttttctaaaaaaagtacttcaatcgtgccttattttaacaaaaaatgtcaaaaagatatagggcaacagttaaagtgccatagatatattgcacttcttgggctgcctcgtccttgcgttctacccaactaaacattcatggaactcttccccgtcgcatagaaccggccctcccttctcctagcccaggtctggactctcgcgctgcccatgtccaaagccaccagcagaagacgccttccgccgcccctgacaccggccatggggcgccgctaagcagcggcaatgggtcgtcgcccctcaagccatcatgttgctgccgctccagggccctgcaggag

SEQ ID NO: 13071 - DNA, 1842 bp, Zea mays
gcagggtaggtttgtagtgctgtttaaacaagtattatatcttgacaaattttatttctactctaactggcgcagatttgtccggaaaccgtgccggcgttcagacttgggagcgcaggcaggaccgtatcgttaactgctgcaaagcatgtcattaaccgagcggtttcatattattttgagcaggttagtgacgacggtttgacttctccacactttcgataaccttgaccacttgttccgataatctgatttttaatgcttacgatttcaatgtttcgttgtataacgtaccgacccttgagaatgtctgcgaaagactgtacgccgagctgacaaaagcaaaaggtcaaacccaacttttcgttgtctccggtaggggaacaattcatagttcatttccaatttgacttttgaagtcagcatagctggcgccggcgcccccaagctcacatccttcataaatgtcgtgggcatgtgacatgtccaacaaaatacaagtcaggttcatgacgtcgtttcagacatgatttgcaacgcatcaatacaaccgtttgaatttcgcgatgctagctcgcagcatcatataacggtcgcattgacacccagtggttcaaccacggtgatcacgtaacgtttttaccgtaacatcgataagtgaacctcattctggcctagagttttcccagaaggaacccctcaaaaaaaaacccggcaccatttgggtgagcaacgcaacttaaaggccgaacatcaagtccatgactttggacaggacagattttgtaggcgacgcaacggccccagacgcgccaaggttgctgctgtcgttgcagctgccattcgtcagagtgttgctaggtagaggtgctagtgcattcctggttgcaaatccacttggcgctacaggttgcgatgtgaacgtggctgtagcgctcccctggtagttctcgttggtgttctcgttcaggtactgcagctgccacggatccactggcttcacaccaatgataagaacactgtttagctgctgcccatgcttggcgagcgctttctgcgcatcatgccggctctgatacaagatatgcacccagttcgcatcccttggaccaagaacatgtctcaagactatcccacacttctcaaattctcgcagcaccatgttagtatcaccaggaaaaaatccgaaaacggtgacccactcctcctcgtcgacccgtccagcagccggagccgaatctctgggcatctccggccgcgccacctccctggggggcggcagcgtgatcagcgctaccttctgctgctgtgactgctgacccgacggcgtcgtcggggactgctgctggtactgcacgacgccatccatcggtgatccctccctgggattctcctccctcgagggggtccaccatgccgaggggcccggcgagccgttggaccgcagcggcgaggaaaagagaacggctccacgcgggggctgaggcgagggggtcgtcgtcgcctgcggaggcgtggccggctgcctggagggggagaggtgggagaggtcgtcgagggagagcagcggcggaggcggcggcggggtggaggcctgcgcctctcgccgcatcgaagccggtgggaggcgaaacgacgaggagatcggggacgagaggtcccgcaggaacggcgggtggcggcgacggtgatccggcctggaggcactcatgacggtggcggagagctgaaaccctagcaagagaaagtggagttccactgccgagtgcgccttgggtttttggaagcctcccctgtgccgaagccctcgaggcacccagaacgcttgtgtcaccaacatgt

SEQ ID NO: 13072 - DNA, 1009 bp, Zea mays
ctaggactttacaggtcccacatgtcggagtgctggcgttttgattctcggctctactcgaaggcgatgaagaaattaagaatacgccaggctccttgtcgctcgtaaaatggaggtcgcgacggcgacggaggcgtctgcgccggcggcaagcggcggcgcggcggggcagagccacccgttcccgtggctagacgctgccatctctgagccctactacttcctgcacctcctcgccttcttctcttactttgcggcccgcagcgcggcgctctccgccgacgacggaggggagctccacgaccgcctcctccgtagggagatccaggcagtgctcgtgttcctggtgctcttcgtagtgaagattgtgaaagaggaaacctgggaagcagtaattgctgactcgttgctttatgcgaagggtttattgctggcagttactttggttattgattgttggctggcctttgcctactttctgggatttcttgttatatatgctgtagctcaacagccaccttatgatggcctaggccattcaaatcacttgaccccattgcaacttgaaagtctgctaactgaagagccaacatcacgattttggctggtagaattccgaacttcattttcagcaaaatgtgtacaagcaagcagcattctgcctgaactttctatcgtgtactccaacaagaacatctcttttggaacaattgaccttgggcatttcccaaatgctgcagcaaagtttgggatatccatgtgggatcatctccccacttacatattgtttgacaaggtgactgaagtttctcggtttccagaaatcaacaaaatgaatcaaaagtatttgtgccaaaagttactaaggttattttcatcacctttgttctcatggtttatcgtatttttcccttttatagatcaatctacatgagtgtatattatctgtaatgttttgatcaacatgtcctttggtaagggttaatgctacttaaaaattatacaacta

SEQ ID NO: 13073 - DNA, 1280 bp, Zea mays
gcacgagctcgtgccgaattcggcacatttttttgattctcggccctgcggccggccggggaagaaattaaagaatacgccaggctccttgtcgctcgtaaaatggaggtcgcgacggcgacggaggcgtctgcgccggcggcaagcggcggcgcggcggggcagagccacccgttcccgtggctagacgctgccatctctgagccctactacttcctgcacctcctcgccttcttctcttactttgcggcccgcagcgcggcgctctccgccgacgacggaggggagctccacgaccgcctcctccgtagggagatccaggcagtgctcgtgttcctggtgctcttcgtagtgaagattgtgaaagaggaaacctgggaagcagtaattgctgactcgttgctttatgcgaagggtttattgctggcagttactttggttattgattgttggctggcctttgcctactttctgggatttcttgttatatatgctgtagctcaacagccaccttatgatggcctaggccattcaaatcacttgaccccattgcaacttgaaagtctgctaactgaagagccaacatcacgattttggctggtagaattccgaacttcattttcagcaaaatgtgtacaagcaagcagcattctgcctgaactttctatcgtgtactccaacaagaacatctcttttggaacaattgaccttgggcatttcccaaatgctgcagcaaagtttgggatatccatgtgggatcatctccccacttacatattgtttgacaaggtgactgaagtttctcggtttccagaaatcacaagtgaatcaaaagtatttgtgccaaaagttactaagaaacttctttgccagcattttgatctcgacagacgattgattggatacctatccacctgatctgtcaccgatcccatatgcctcaaaggatggggacatctcccttttttgtcgctgaaccggacatctgtgtgtcagcagcaatcacttcaggggggtatcgtgagccttgtattattcgccgaactgcttattcccttttaattaagtcccagtaaactttgtggcggaaaaacacacacacacacacaaccaatttctgtctaatctgtctgatactgaattatagaatttcactaccatgcagaggtttctgtaatgatttgccgactatgttttgtcacattgtgactgcagcagcagtcaattcagacagcatccacttccactgaaaaaaaaaaaaaaaaaaggcccctagggcc

SEQ ID NO: 13074 - DNA, 2575 bp, Zea mays
cagtgcagggtccctccctctagttaatcgtcgtgcaatcgtcatcgttttctctgccaagtgccaacggctagccagctccacaccacacctgagcgacgtcggacaggtgttggcagcagccgcgttcccccgtcggggccaacgaaggatgtcaaatgctaaattttaatgtgccgactcagcagctctgatagccagcttctctccagagagattcaatgatgatggcagatggcgcggggctcttgtcaatgaatgagggacaaaaaccaaagaaaaaaaaagaggctaatgatttctctcgacgtcgagtcgccttgtctggctccgttttctgtcgttgggacgtttgtgtcacaacagcacttgaataatggatacaccgtgctttagtgacacttttttttggggggttggctcctctggcgagtgaggtacgtgcgcaaaccgtttccacatgtttaaacgatcgctgctaattatgcgtgtactggtaacgagacaaaaacatgtcatggatctataaaaaaaataatacaagatgtcgtgtatggtatgtgaatgacgaccggagacggctggctttgtcgcgattaaataaagtatatttatgtatttatttgtttgattatatatgagaagtatatatattccagcttagacaagttctttttttgtgtactgtattgctactatttaattcgcaaagacattgcttttctttttcgtaaaggtactcgtggttcgttgacatctagtagttttatgattttatctgcaggggcagagaccgccatctggggcaggtaggtttgtagtgctgtttaaacaagtattatatcttgacaaattttataccgtatcgttaactgcaaagcatgtcattaaccgagcggtttcatattattttgagcaggttagtgatgacggtttgacttatccacactttcgatagaggtcaaccttgaccacttgttccgataatctgatttttaatgcttacgatttcaatgtttcattgtataacgtaccgacccttgagaatgtctgcgaaagactgtacgccgagctgacaaaagcaaaaggtcaaacccaacttttcgttgtctccgggaggggaacaattcatattccatttccaatttgacttttttttttttttttttttggcgcccccaagctcacatccttcataaatgtcgtgggcatgtgacatgtccaacaaaatacaagtcaggttcatgacgtcgtttcagacatgatttgcaacgcatcaatacaaccgtttgaatttcgcgatgctagctcgcagcatcatataacggtcgcattgacacccagtggttcaaccacggtgatcacgtaacgtttttaccgtaacatcgataagtgaacctcattctggcctagagttttcccagaaggaacccctcaaaaaaaaacccggcaccatttgggtgagcaacgcaacttaaaggccgaacatcaagtccatgactttggacaggacagattttgtaggcgacgcaacggccccagacgcgccaaggttgctgctgtcgttgcagctgccattcgtcagagtgttgctaggtagaggtgctagtgcattcctggttgcaaatccacttggcgctacaggttgcgatgtgaacgtggctgtagcgctcccctggtagttctcgttggtgttctcgttcaggtactgcagctgccacggatccactggcttcacaccaatgataagaacactgtttagctgctgcccatgcttggcgagcgctttctgcgcatcatgccggctctgatacaagaaatgcacccaacacacaactcagcaaagataatagcagtgaccgcaagtccacaaaggaaaaagtgcactaacaacagcaaaggtaaatggcatctcaaacagaaaatgtgtggttagttgcttttatgataacagaacatgtcatttttttacttttagacatcttgtttaactgttcgtcttattcatttttttgtatataaatgttatttattttgttatgacttattttaccataagagatactttaataatgtcatttattttattatttgcacaaaagaactgaataatacagaatagtcaaacatgaaatctacacatcaaaagtgtcatctattttgggacggagggagcactgtattagtttaggtctattctcagtgatgactatctgttcgcatctacacgtcaaacatgaaaatgtgtgaatagagctgttaatagttacctgatacaagatatgcacccagttcgcatcccttggaccaagaacatgtctcaagactatcccacacttctcaaattctcgcagcaccatgttagtatcaccaggaaaaaatctgaaataaaaaaagagatggaatggaagactaataaaaaatggaataaattataacactaaaacaccattaacatccaaccatcacacccattcaagctattcagatgttcagagaatcaagcgcgcaagggcattctggtggtggtggcttatggatagcatgatttttcaaaagcacatgatcaaccaaa

SEQ ID NO: 13075 - DNA, 6209 bp, Zea mays
  misc_feature (1816)..(1816): n is a, c, g, or t
  misc_feature (2280)..(2280): n is a, c, g, or t
  misc_feature (2621)..(2621): n is a, c, g, or t
agaaatggtgaaaccaaactatcgctgagaatggcctattgtatcttattttttttgctacccaaagtaatgaaaatattgctttctgtatgccttgtttgggacgacttcacttcaaaaattgcaacttctgtttttcaacttcaccataaaacagcttcaatatattgttaaggtggatttcaagagtttttagcttgcacatggactccagcttctataatataattaatttgtgtgagtttcaataattacctttgatgattagtggactatgatgagttggggagagagacatggataagtagatcgtgtaaccaatggggtggtgggtaattttgtgtagcttcatgaggatgtatgaaaacaatgtttttaatgcaccatttgagaagctgcaaaaaaatcttgaaactaccctctagtttcatttttttaaaagctacaagtagtaaattcatgaagtgaagccctcccaaacccctcccaaacaggcccttacaagtatctcaagtttaataaatatttcaacacacaatataaatagatattattagactgattatgatatatatttatatatttaacatattaaatctactttaacaaaaaatgacaagttaagaattctgtctttatttgtatggagcaaatagataatataccataatttttattagtcagttgcccatatgttactacgatttctatattcagaatatttataatatttattctttgttgcacacaaatggttgtgagcccaaatgattacaatctaggcgtgggaggggcgggacggttcgaacacccagcaccgggagatgacgcacgaaggggagaaactcttacttaagctcttgtttagacacgagtattcaccctcaatccaccatgtattgagatagattagagtaaaacttaaactaatttatacctgaaactatttcaatgtatatgaattgaaggtgaatacgagagtattcaaataaggtctaaatacagtagagatatacactccgaatctatcacaccatttttgaccataggccaaaggccactagctagttgctagtttagaaacttaaatccttttgagatcccttcttctttttcagtgtgagaaatacctccagaaatacctctccgtatgtgcctcctctttcttccaaattagccctcgaggggcagagacgggtcaaaactccactgtgagcacaagtagtataggctatagcaccgtactgcgtagtgtactgtacaggagtccagccaacacacggacgcctccgatttgatatttgattgttgcagagatggatttgatctgtatactgtagcaggtactcctatctgatattctgacgaagacggcggggcggtcggtggccgtacggtggcggttggatgcgcctccgagtccgagcccgcacgaagcttcgtggcagcttccagttcctcctcactgtcatgggatgggcgcatggcagcaccctctccatttgtccagtacagctatttggagctgccgcgtgcacgtggagacggcgcaccgctcgcggtgggtcgatctgtcagtgttgctcacgcgcatcgcctgcccgacgtcgcgtgtactatactatttatgatatgtagtaggcaggcatgtagcatggcaggcaagtgacgaccgacccagtcatggcctcgcgccgcgtttaaggtttgcacgcggcgattgcttatctggattccccggccgccaactgcgctgcacgttgatagcagatcagcagcctctatcgaaacctaggatttatagtcaagacgatcnatcgatctggattgtgagcactcctcaaaaaaaaattatagaacggtacatatatgattatagatcgaacgcgctttttgatacattgatcaacatgattttgtatctctgtcgtcctttagcttccatatttacactatatatctcggttgtatactttatcttcctggcttagttgataggctggttaataggtttaaaaccttggttattttaactctttatgatagacataggaatacacttacgctcggtttggatcattagaattgaatccattctaataacaataatttaggcatatattaattaagctaattcggttttatgtaaaatatatttatataatgttattaacaagatgtcagagatatttatgagctatatatatttttactgtaaaagagcgagactaagatggtcatgtaaagcaactgctaagcaactactgaatgaaagtaggnataagccacacatggtgaaaagcatcatgtctatagaagattaaatctatatcagatacgagatggaaactcgtcgtgtttttcggtgcgaatcgttctaaaacgtagtcggtgatgagattgaggccaaaggcctgatgaagatcgtatacaacgttgcaacgcagattaactcgacggacagccgcgtgatcgttgcctaaagccatgatttgccctaacccatgcaagttcttcaatacaacgatgttttagagatactgcttgcagcgtcaacacgacgacgtcgggggatagagatcgcctaataagacaagaatgaacattatagattgattttnaattttatatattataatataaatagggccttggtataaacatcttttcagcaactcataattaaaccaatccactgaagatcatcaattcagctataattgggcgtaccaatgatttggtcaggtacgtaccttaacatcgaacccagcctggtacggtaaccgtgtctcagcttattatcttggaacaaaatgaagccgcggaggcttcccctcatctgcccatgcacgcacgcaccggccggcagcgctagatgtttcgaccgcagcacgattatgctatgccgggccgcagtccagcgcggctgcgtcccaaaccgccgacgaaactaaccttgaggcagctacctccccggagatccggccggatgctcccccgccaaaatctccggctcccgcagcgagatcgcacggccgacaacgtacgcgtccccgccccgcccgcccgtacggtggcgacgagccctggcggccggcaagcgtgtcgagccaggcgaggcttagcttgcttttgtcgcgcccgggctggcgcagcagcgccctcggctcccgggctaatgcggatttgggcggcggtttggcagcgtcggcgtgccagccagttcgtcgtgcgcggctaccaccacccatcagcaccttccacagccacgtacccaacgtttatgtcgtgtctccactcttggtcttggcgccgcgtagatcggcatcagcttggggatggggtgagtgacttcttttccgtcgaaaattccctctccactcgtcgtacctggaacgtagtactagtgtatctttgggttaataattcgaggcaaaatcaccatgcttatcacaagaacatcgtgtcaatttacatatatatttgagtccagtactccagtgtatctaccagtaccagtatatacgcacccttcttctacagactacactcaaaatgcacgctagtattattccactgtactaccatcaggaatgttctccttgagaaccataacaggtgaaccactgtttattcctaatcactgtgaatgggctccttcgtggtaccttccggggtgagatcagagaggggcacaaaccatgcatgctaatatcctaacgagttcgaattattggattcgtaataatctataaggccttgccaatcgagaatacgtccaaaggaatctatggagaaccaaacaaacacgtatccagtcatgcagagcactaaaaataatcgaccatgcagggcccagggaatacggtgcacggtgcaggacacctttgtcctgcggcgcgaacgttatatgctccatcgataataatgctagaactactacacggatatcgatcgttacacgaaattcgtgtgggaagtaggattattaggctgtctttagcagctcttttatcctattttttattttttattttactatgtacaagactgtgggtaccttggcaaccattgctctttagttcttgccgaatcatttagactttattcgtttatttctacgccacatgaattcaatagaattgaaaaaaacatatattaacttgctatgaatttaaacctacaaattccctccaatccacatgaatttgagtggacccttaccattatccaatccccaagccagcgagatagctatgactttaaaagatgccagcacggcacaatcacaacccccctcccccagggtccactcccacttggcgcgctatatataccatgcgagcagctggcctccggcactcccacccatcaggagtcatccccaccagcaccagttgcaatcaatcagctagcgcctagcaggagcagcaaaccaatcaaggagcccccacgtccaccaccgacgacgaagacgacaccgtcatgggcaacagcttgcggtgctgcctggcctgcatggtcccctgcggcgccctggacgtggtccgcgtcgtgcacctcagcgggcgcgtcgacgagttcagctgcccggtggccgcggccaccgtgctcgccgcgaaccccgcccacacgctcaccacggcgtggtccccctccggcgcgcccgggtgcggctcccggaagctcgccatcgtgtcgcccgactccgacctcaagcgcggccgcatctacttcctcatcccgtccgcgaccctgcccgccgaccggaggagcaagaagcagagcagcaagcggccgagccagagccagagccagagccagagccgcctccgccaccacgccaagaagcagagcgccggtggcacggcggagcaggacaactacctgagggagctgctctccgaaaaggccgcgtcgggcggcggtcaccggaggcggcgcagcggcgcccgcgtcggcgtgtggaggccgcggctcgagagcatcgtcgaggaggcctccgactagatcgacggcggctccaagagctctcggtcttatattcttttggttttccttctgatctgccgatgcgaacaccacgacgatcggtcgaggaccgagtctccggcaggctctcgcctcacgatcccccctcgacactgtgttgcgttgtgtccagggatgagcggtcttagctcgggagatgagggggaaaactgtgacaaaaataactgcttatagcagcaccaacctgtacaggaagattttgttcagttcatccaaaatttcaaacacatttctcggttgtccacttttctctgtctgccttgtttgttcctactcgaaacgaaaactaacatggagacagctcaatgggtaaattaacttttttttaaaaaaaacttgcgtcgttgtaatcagttctaaatcgacataacatgggccacacgtcggggattgtgttcttctcagagtcactcacaggccatttcggtgtgcgcaatagcacatgcagtcgcataatttggagagaggttcgatgggttcgtccgattcccacgtcagtgtcctactttctctatcctggaatataaataatctacttttgtcctaagtcagactatagtaattttgatcaaatttataaaagaatcatttaattagatatatgataaaaatttatcttttatcttttgatgcggtagatgctaatattttataatagaatctttcgataaagtttgatatagtttggcgtaggataaatttagatctttttatattttaggacggaggggagcctccgtttggatgttgatattgaagaacaaggaattaaaccgggttcaataccaaatcaatcatggtggtgctctttattggaaaagtgagtttctagttatagtctctaattctaaacctcaattctatacacaatcaaacaacagaattttagaaagctagttgcaattgttaattccgtgctctatccaaacggggtattagagaccgccaatataacatgtaccagcggatgaagcagctgtggcattgggcaatgattcggtctttgggccgaaaggccttttgggcgtcatgctttgtttaggacgaagtgcaaacggcttgtggtgtggtctctgggcccgtacaggaggcatacgaagtaacgaaactgtgtatgtgccagttgacttgaacatattaatttgcagtcaacttag

SEQ ID NO: 13076 - DNA, 946 bp, Zea mays
gccggccgggtcgggatcacaaggagtcatccccaccagcaccagttgcaatcaatcagctagcgcctagcaggagcagcaaaccaatcaaggagcccccacgtccaccaccgacgacgaagacgacaccgtcatgggcaacagcttgcggtgctgcctggcctgcatggtcccctgcggcgccctggacgtggtccgcgtcgtgcacctcagcgggcgcgtcgacgagttcagctgcccggtggccgcggccaccgtgctcgccgcgaaccccgcccacacgctcaccacgggcgtggtccccctccggcgcgcccgggtgcggctcccggaagctcgccatcgtgtcgcccgactccgacctcaagcgcggccgcatctacttcctcatcccgtccgcgaccctgcccgccgaccggaggaccaagaagcagagcagcaagcggccgatccagagccagagccgccgccgccacgccaagaagcagagcgccggtggcacggcggagcaggacaactacctgagggagctgctctccgacaaggccgcgtcgggcggcggccaccggaggcggcgcagcggcgcccgcgtcggcgtgtggaggccgcggctcgagagcatcgtcgaggaggcctccgactagatcgacgacggctccaagagctctcggtcttatattcttttggttttccttctgatctgccgatgcgaacaccacgacgatcggtcgaggactgagtctccggccggctctcgcctcacgatccccctcgacgctgtgttgcgttgtgtccagggatgagcggtcttagctcgggagatgaggggaaaaactgtgacaaaaataactgcatgtagcagcaccaacctgtacaggagaagatttggttcagttcatccaaaatttcaaacacatttctcggttgttcaaaaaaaaaaaaaaat

SEQ ID NO: 13077 - DNA, 841 bp, Zea mays
  misc_feature (44)..(44): n is a, c, g, or t
  misc_feature (833)..(833): n is a, c, g, or t
gtcgggatatggatgattacactttcgtgtactgtctagaattngtagaaacagctgaaccgaaatcagtagttatctttaactgaactcatagtctaagaattacggtatgtactatacttggatatgagcttgccatcttcttaaaagttacataaaacgctgctgcggcaactgtcgtcttcttaagatctgaatggagcattgaactctgcacaccgcacagttttattgaatcccatagccagcgagatggctttaaagatggctggcaggtggcaggatggcacaagtaacccccccggctccactcccacttggcgcgctatatataagagcagctgccctccgccactccaatcacaaggcgtgtcatctcatcccaagttcgggacaccaccggcagcaaaccaatcaagaaggcagaagcctagctgtgccgcgtgcccccacgtccagcggtcgagcaccaaccaccaccaccacctccgacgacgacgacgacgacatcgtcatgggcaacagcttgcggtgctgcctggcctgcatggtcccgtgcggcgccctcgacgtggtccgcatcgtgcacctcagcgggcacgtcgaggagttcagctgcccggtggccgcggccgccgtgctcgccgcgaaccccaaccacacgctcaccacggcgtggtccccctccggcgcgccggggtgcggctccaggaagctcgtcatcgtgtcgcgcgactccgacctcaggcgcggccgcatctacttcctcatcccgtccgcgacgctgccggccgaccggaggggcaagaagcagagcagcagcagcaggcggnccggcccg

SEQ ID NO: 13078 - DNA, 1575 bp, Zea mays
atcaatcaacatcctcctccacccgaaccaatcttgtagcatttccttccgctgcgaacacccaaacggcagctttctactaggggaagagaaacgttttcttgtctcaacgatcgatgcgtcgaccgcacgagcagctgcctagattggcgtcaggtctcgctctactggcctgcctcgccgtgctcgctcgttctcgcgttgccggcgctggtggcatgccggcgaccttcatcttcggcgactcgctcgtggacgccggcaacaacaactacatcgtctccctgtcgaaggccaacttccccccgaacggcatcgacttcttgggccaccagcccaccggccggtacacgaacggccggaccatcgtcgacattctagggcaagagatgggactgggagggttcgtgccgccgtacatggccccggagaccacgggcgacgccgtgatgagaggcgtcaactacgcgtccggcggcggagggatcctcaacgaaaccggcagtatcttcggtgggcgcctgaatctggacgcccagatcgacaactacgcgaacagccgccacgacctgatggcgcggcacggggaaggtggaaagcggtgagcctgctgcggggcgcgctcttctcggtcaccataggctccaacgacttcatcaacaactacctcacgcccatcttctccgtgccggagcgcgccacgacgccgccggtcgccttcatcagcgccatgatcgccaagtaccgccaacagctcaccaggctgtacctcctggatgcccgcaagatcgtggtggcgaacgtggggccgatcggctgcatcccgtaccagcgcgagacgaacccgtcggccggcacggcctgcgccgagttcccgaaccggctggcgcgggcattcaaccggcggctcagggccctggtggacgagctgagcgccgccctccccggctcgcgcttcgtctacgccgacgtctaccgcatcttctccgacatcgtcgccaactacggatcccacgggttcgaggtggcggactcggcgtgctgctacgtcggcgggcggttcggcgggctgctgccgtgcgggccgacgtcgctgtactgcgcggacaggtcaaagtatgtgttctgggacccctaccaccccagcgaggcggccaacgcgctcatcgcccgccggatcctcgacggcggacccatggacatctcgccggtcaacgtacgccagctcatcgtcacttgagttcaaccgttggatcaccagccggtgctacggctcagcgctacatattgatttgcattcactttttccgaaaagagattagtttgccttttttcaacaaaaaaaagagatcagtttggggtgattcaaactccggtgtaacatcatttttcgtgtttagatagctagtagtaggcagtagcacagtatcttatctcgtgcgcgttgttctatttttatctctgtgccgtgcgttctagttcaccatttgaactcttgagacgtgaacttatgaaatgttttaggggttgtttggatacatcaactaattttaggggtgtttgttttctagggac

SEQ ID NO: 13079 - DNA, 1483 bp, Zea mays
  misc_feature (18)..(18): n is a, c, g, or t
cgtcagcgatttcgccgncccaccacctgccgcgttcccctcgcccctcgaggccggcaggccgggaataatcccctcctcccctcccctcgccgcccatctcctccgcccctttttgaccccccctccgaatccgcaccagggcctgcggcggtatactcggttccctgccccccccacgaccacgccgccgcctcctccccacgcccgcccggcgctcccggaaccgccgcattcacatgatgtatcatgcgaagaatttttctgtgccctttgctccgcagagggcacaggataatgagcatgcaggtaatattggaggtattggtggacccaacataagcaaccctgctaatcctgtaggaagtgggaaacaacgtctacggtggacatcggatcttcataatcgctttgtggatgccatcgcccagcttggtggaccagacagagctacacctaaaggggttctcactgtgatgggtgtaccagggatcacaatttatcatgtgaagagccatctgcagaagtatcgccttgcaaagtatatacccgactctcctgctgaaggttccaaggacgaaaagaaagattcgagtgattccctctcgaacacggattctgcaccaggattgcaaatcaatgaggcactaaagatgcaaatggaggttcagaagcgactacatgagcaactcgaggttcaaagacaactgcaactaagaattgaagcacaaggaagatacttgcagatgatcattgaggagcaacaaaagcttggtggatcaattaaagcttctgaggatcagaagctttctgattcacctccaagcttagatgactacccagagagcatgcaaccttctcccaagaaaccaaggatagatgcattatcaccagattcagagcgcgatacaacacaacctgaattcgaatcccatttgatcggtccgtgggatcacggcattgcattcccagtggaggagttcaaagcagaccctgctatgagcaagtcataaggcaaacttcaccttgacagaaaattttcagagttgacctctccacgagatgatcattctcatgtgaatatatattatcttaacaacagaatgttgtacgggtttttgaccctgcacctgatcccttcagccacgtccagttattcttatcactgtagtatccatcaacaagtcctgtaattatgaggatggtgttacagagtttctagcaagcatttccatcgagggaatggccctgagttgatccatgtagcaagaaagagaacatgcttacaagcaatatatttgctgtgaaaagggcacgcccctggatcttcctgaagttatgttgataaaaaaaagattatggcaaaaaaaaaaaaaaaaaaaaatttatattggcttcgtctcatgtatccacaatgcagccagctaggcaacatgttactatgttaggtcctgtctctccggcttctgcaggtcgactctaa

SEQ ID NO: 13080 - DNA, 1996 bp, Zea mays
  misc_feature (1299)..(1299): n is a, c, g, or t
gtttttcctttgttgcgacttgcgactctccttcatcttcatgcaggatttagggttcacagatcgccttacaacttataggagagatgagacgaggaagtatcaaataataaagctttatgccaacgataatttacgcagatgacttagacgctatgacttaacatgtcatctatagagagaacctataaagttactagtgctaagacagatcgtaattgtaaccagcagttcgttacttgcataccagttgcatgtatacttaatggtcaagtcaagaagctccattaattccagtaaacttaaaaagcctccacttggccttcaattgaaacaccactattattaatactctatgctattaagataaagaatcacactgcataggcgcaagcactataaataccccagccgtccgcgcccgcgcgcgccatctcaactactactactcactagcggtagctcacaatggcaggcacaaagctagtatcactggggctcattgttctcatgagcatggggttagcaaatgctgtgagggtggctagattctctactgctgatgggagtggacaaggagggggagggggtggcggttacgtgaatggtgcgggatcaggggtcgggtctggcaccggagtaggtgacagtagtccggagggtgtccatgcaagtgctggagggggtggcgcaggtggtggaactagccagtatggtggatctgcatatggtgtagggttagggtcaggttcggcgagtagcacgtacagtgatagtgatggagggtcttccagtgctggtggtgctggcgggggcggtggtggcggaaaagctggaggttcttgggactccagcgctcaagggtctggtagtggcgtcggttctggctctgcctattctaacaggtatccgtatgggccaagatatgcaggtgcaactgctaatggcaacggtggcggcacggggaacagccagaatggcggtgctggcggcggtaaaggttctggatctgggttcggcgatgccattccctgatttctgtatcgagtgaatctaaagctggagcccatcgccctttcttgttttggagtcacaggattactgtttttgttttgttttttttcttttctagctgtgttgtgcttttgttagaatttgaattaataaagggcccggctgttcatgtaacagtagcagtctagtgtaagcctgtaaaggtgcagcttatgcgaagatgtaagcctgccagtttatgaaagaaatcatactcgctcctttgtcggtcaaaaaaaaaaaatnaagattttttttagacagaaagttgtttggagttattaagttcatcagatgcatactgccctacaccatgcacatcacatggatgtgatctatcagtgaaattactaaattagcttatgtcacatataatacaggtcacttacattggtagctctaacttggccaatccagccttgaacatgagtagcaagaagttcgtgatgagtgatgacatcaaaaaggtcatcttgtgcataggccttaattcctgtgcataggctcttttgtcaagcagaaatcatctccctgaaaagcaaaataattaatatcatcagtaccagctcaagcatggttcgaaaataaaaagctgcaattccagtaaccactcttcatatagagactgatccttgctttgcctccccaaaacatagcctatggttacggtctggcccttatagcacaatcctcaatccttggccaatctcactaaggttccttcttaggacaaggccgtgggggcagtttttaccccacccctgtcggcttcttttaagaaaagtgaacttacattggataaccaatgagcgtcaagattgtaggatgatttgaaggccaaaaaatgcaaagaaaagtaaaaaaaactactagaacctgcattacagattgtggtaaagttgtcaaaacttgcaagtaataagacctactcaaataccagctc

SEQ ID NO: 13081 - DNA, 1613 bp, Zea mays
gcacgagatggattgaagcctgatcatggacatagtccggccgccggatctgccttctcttctgccgttcccccggcgagctctttctctctcgtgcggcaactgggctattggcgaccgccaacgccgacgattacatttacaccaagtgcccaagccgtcttcgactacaccaggtgccaagttttcttcgcgtccttcacccgcgacgagcacccaccaggcatagagagagatggcaagtctaaccggcctcaccgcgaaccctaatccgaacaagtcattcgagatactgccgaacccaggtgactctgtctccagcctcagctttagtcccaagagtaatctgcttgtggcaacctcctgggataaccaggtgaggtgctgggagattgttggtggtaacagtcagccaaaggcgtccatttctcatgatcagccggttctctgctcggcttggaaggatgatggaactactgtcttctctggaggctgtgacaagcaggtcaaaatgtggcctcttctgtcaggtgggcagcctcagacggttgctatgcatgatgcccctgtcaaggaggtcgcctggattcctcagatgaatcttcttgtatccggaagctgggataagactttaaggtactgggatacaaggcaatcaaatcctgtgcatattcagcaacttcctgaacgttgctatgctcttactgtgaattatccccttatgattgttggaactgctgaccgtcatcttgttgtcttcaatttgcagaatcctcagacggagttcaagcgaatccaatcaccactaaaataccagacacggtgccttgctgcattccctgatcaacaagggtttttggttggttcaatagaaggaagagttggcgttcatcatatcgatgacgcacagcaaagcaaaaacttcacattcaaatgccacagggaaggaaatgatatattctctgtcaattcactcaacttccaccctgtccatcacacatttgcaactgctggatctgacggtgctttcaacttctgggataaggatagcaagcagaggctaaaggcttttagtagatgcccccttcccattccttgcagtaccttcaacagtgatggttccatatttgcttatgcggtttgctatgactggagccgtggggccgaaaatcacaaccctgcagctgcaaagacatccatctatctccacagtccacaggaaaccgaggtcaaaggaaagccgcgcattgcaacaggcaggaagtgattgcattgaaggtgttgcaaggaaccatgatgtcatccagcagttttgtcatgcctccctcctgtcttggaagtctggtagagtgtaaatttcagctaacttatgcgccgattatagggtttctgtagtacctggtgtttgtggtgtcttcaaaatagattctgtcgacgttctgtgatgatctccttactgcttatttctggcagtaaaatcagtgtatcttaaaaaggttgtgatgtaaattttcgtgcatatggaccccgatactaatggagttttacttcacagataaaaaaaaaaaaaaaaaaaaacgacacgagtcctcccccgcctcgtgcccactgct

SEQ ID NO: 13082 - DNA, 965 bp, Zea mays
gcacgagaccattacctagaacatcctaatcgaaaaatttagtgtagattaagcctgcatgctgcaagaacccggccggcgaatgcagcaatagccacccagctggtggcggtccgtcgttgagcagcacgcacgcgcgcacagtactgatcccttctccgaatcatcaaccaataatgggcggaggaagggagctcgccgccggccgttatttccccctgcaacggcggcggtcgtctagtcgtcgccgtcctcttctcgtcatcctactgctcgccgtcgtcgccagcggtcaagcacccgccgcctctggcagcatcttcggcggcgactcggcgtcatcggagtgcagccgagcgtgcgagtcccagcgctgcacggcgccgctgatgcgctacggcaagtactgcggcgtgtcctacacggggtgccccggcgaggccccctgcgacgccctcgacgcctgctgcatgctccacgacgcctgcgtccaggccacggacaacgactacctcaacatgtggtgcaaccagagcctgctggactgcgtggccgcagccaggcctacggcgatggcggacacgttcgaggggaaccggtgcaacgtcacggacgtcgccgacgagatcaccgccatcgtggaggccgccgtgtacgccaggggcatcctgcacaagccctagcactagcagtagcctggaccagtaagctcgatcgctcctacgtcatccgggtggatggagcgaccggcggctggcctatacaagtttggtggggtggtggattctgtgttggatggtagttcatggtttgtcgcaggcgaagtccacgtctttgacgtacatatatatatattagttcctgagtttacacggcctggaaaagtgtacagacctcaataaagtactgtcaatatatgtccttgggagggtagttcagacaaaaaaaaaaaaaaaaggccccta

SEQ ID NO: 13083 - DNA, 1740 bp, Zea mays
cattgggtacctcgaggccggccgggaaaaaggtacgaagcagatagttgcacgtgggccactcccacagccacctccttctctccggtagcagtaacgcagaagaggcaaacgggcagccagctagatctcgcgtccccgctgcgactgtgaagccaccatcgtcagatcggacaaggcgccggagcctcagcaatccctgagcagactagaggagtagctaaggcaaagggaggtggcaaagatgctgccgacgaccgcgtccaaggggcgcggggcctcccgctccgccccgccgctcttcggtccctacctccgccgcatcgtcaagtggcaacaaatggatattgaatacacattttggcaaatggttcatctctgtacttcaccaaaagtagtctatcagcacaccaaatatcacaagcaaacaaagaaccagtgggcccgtgatgatcctgcatttgttgttattctgattcttttcctcgtgtttgcaacatcagcttactgtgcagcatatggagagagtgcctcacatgctgctctaacaatcacttcggttgtgtttctccatttcttgtttgctgggatagttttggccacactttgctggttccttacaaattcttacttgagagaggaacctaacagccatgttgttgagcaacgcgtggagtggctctatgcatttgacgttcattgtaactcgttctttcctgcgtttgtcatcctatatgtggtgcagtattttctgtcgcctctattggtcgcgcatggcttctttccagctttgttatctaatctactcttcgtggtggcaatttcttattatcactacctgaactttctaggatatgatgttcttccatttctagatagaacaacattcttcctgtatccgattggtctcgtcatcatcctgtctccacttatgatactaatagggtttaatccgacaagatactttctaagcttgtacttcggttaaagtctacggctagaatgccatgtacaagcaaaaatatggtgattggcgataactaatggcagatctggatacatactctgtagtaaagcattttagatatcttgtgtgaacgggggcgagtgaagttcagtaaagctcggagcattctatggatgtatcaggtgcctgtggcaaggctaacaatggaagacatatagtcttttgattggtatcaaatatcctttttgggtgtcaatttgttgttcataatatgagctgtttgcgttactttgggcccagtgaccagtgtatacttgtagtagaactgctacgtagagtctattgtactatcacatcggcatcagaattgcatcaagttctaccaccagtcatctctttgtcatgtttactgcaacatgaaaaaaaatttctcgttctcgctaaagctcaatttctcgccggtaatcatggcaatagcgccttttcccttcttccatgctagtaacacgcataaaaatttctctggcaaacctgtttggactcctggtctaggttctccccaaagttcaaacaatccccagacaaacgcaggcaacccttccacgtctatactcgttccccttccaccaaaacaaacaaaacatttataaactccgaacttttattcccttgtttgaattatacccccaacctttactgtttacctcatacttgtatccactacttatgaaattaagtcatgtttgaatgcactgtagctaatagttagctgc

SEQ ID NO: 13084 - DNA, 550 bp, Zea mays
acacccacctctttttattcacactccggccgcctctcgctcttccggtcttcccccatctccgtgaaaccaacgccccccagcccagcggccgcgcgaatggaggttgctgcggcgaaccaactcctccccatggcgctgggccccaactccccgtcgtcctccacctcctcctcctctccctcgtccgccgccgccgccgcctcctccccgtcgccgcgccagcagcacccccacgcgcccgcgccgccgtcgcccacgcccaggcccgtgccgcgcatcatcgacaccacgcccttccccaccaccttcgtgcaggccgacaccgccagcttcaagcaggtcgtccagaggctcaccggctccgacacgccgccgccgccccacaaagcccgtcaagagctacccccaccaccacggcagcgggcccataaagccggccttcactgtgtacgagcgccggatcggtcagagcaacctcaagatgatcgcgccgctggccatggcggtgaacgcgacgccgcctgatgcgctgtcgaccagcatgatc

SEQ ID NO: 13085 - DNA, 1223 bp, Zea mays
ctcgaggccggccgggccgggaatccgtcctccattgatgatcaacaacaataatcctcatatcgtctccctctagcttactagctactgcctagctagcttgtcccgatactagctagctagctatcgcgctggacgaccggccttgagctctatctctggtgatctggtccggccatcacaaagcgatcgatcgagatatgggcaccatggtggtggcgcagctaaagccctcctccttgttggccgcgctcgtccttttgctgctcctcacgtcggcaatggcggcgaactactggaacagtgggacggcgacgttctacggcggcgccgacggctccggtaccatgggtggcgcgtgcggctacgacaacctgtacaacgcgggctacggagtgctgaacgccgcgctgagccaggtgctgttcaacgacggcgcctcgtgcggccagtgctacagcatcaggtgcgacgccagcaggtccgtgtggtgcaagcccggcaccagcgtcaccgtcacggccaccaacctgtgcccacccaactacgcgctccccaacggcggctggtgcggcccgccgcggccccacttcgacatgtcccagccggcgtgggagaacatcggcgtctaccgcggcggcatcatccccgtcctctaccagcgggtgtcatgctccaggcagggaggcgtgcgcttcaggatcaccgggtccaagtacttccagctggtcctcatcaccaacgtcgccggcagcggctccgtccagtccatgtcggtgaaggggacgagcaccggctggatcgccatgacgcgcaactggggtgcgcagtggcagagcaactcggcgttgctcacccaggcgctctccttcaccgtcacctccaccgccggccagacgctgtacatcaacaacgtcgtgccggcgtggtgggacctcggcatgacattcgccaccaacgcgcagtttgactattagctccatctccatctcggaaccgcataatcgcatgtgagctagtgtgtgtgccagcccggccggcctctgaaaatttaattcaccaaaatcagttgacctagctaatgtgggttgatctggattttgatctgtgatcgcgcttttttttgtcgaattagtttctactaccctgaacatatatatgtacactccagtataatgtattgtcgtcggccggttcagttgtgcaaaaaaaaaaaaaaaaaa

SEQ ID NO: 13086 - DNA, 865 bp, Zea mays
  misc_feature (659)..(659): n is a, c, g, or t
  misc_feature (697)..(697): n is a, c, g, or t
  misc_feature (788)..(788): n is a, c, g, or t
cctcgagccggcctggccgggatgtcatctcatctcctcgcgacaagtccagaactcggttattgatctccattgccagtccacatcaacggtcgtcgtcatgaaaatgaacatgtccctggttctgtgcgtagccttctcggcgtgcctggcttccctcgccgccgcgggctggtctcccggcaccgccacattctacggcggagccgacggctcaggcaccatgggcggcgcgtgcgggtacgacaacctgtacaacgccgggtacggcgtgaacaacgcggcgctgagcgcgacgctgttcaacgacggcgcgtcgtgcgggcagtgctacctcatcacctgcgacacgtcgcgtctgggcggccaatcctgcaaacccggcagctccatcacggtgtccgccaccaacctgtgcccggccaactacgcgctgcccaacggcgggtggtgcggcccggggcggccccacttcgacatgtcgcagccggcgtgggagcacatccgcatctacggggccggcgtcatcccggtgctgtaccagcaggtcaagtgctcgcgcaccggcggcgtgcgcttcagcctcgccggctcgcagtacttcctgctcgtcaacgtccagaacctcggaggcagtggctccgtgggagctgcctggngtgagggcgacagaacgaactggatccagatgtccagnaactggggcgccaactggcaggcgctcgccgggctcgtcggccaggggctcagcttcgccgtcaccaccaccggcgggcagtacattcagntctggaacgtcgcgcctgggtggtggcagttcggacagacctacacacgacccagaaattctactactgaaacctgc

SEQ ID NO: 13087 - DNA, 1943 bp, Zea mays
gccgagaaaaaatcctcgcccgcaacaccatttccgaacgggtcgcgcccgagcccgatatgcccgcgaagcccaggcccagccagacccaaagcgatgcgacggagatcgtgagatcgcgcgccgcagcctcctcccccgcccccgccgccggcgatgacctccgcagtcctcgccggccggaatgaggtccaccaggcgcatcagcaccaccgccaatgggctggcgcccgcgtcccgctcatgcccaagccgtcctccaaccctaaccctaggcgccaccgcgcgggcccaaaccctatccccagtggctcgccgccggagccgcgggccgctccggccgtcgcggccgagccctcgccgtcgccttcggggcacctgaacttcaggccgtcggaaatgacccccgccgaggcccggcacctccgcgcgcggctcaccagcgagctctgccgcgtccgcgctttcctctcccgcatcgactcgtggcaggacgggccagccgccggcccccgggccccgagccccccgcgcgcggcccgtccccgccgccggcgctggtggaggcgatgcggaagcggtgcgcggacatcctgatgcggctgcggaggtcgaagaagagcgtgtggttcaactccccggtcgacgtggagggcctcaagctgcacgactaccgcgccatcatccggagccccatggatctcggcaccgtcaagcagaacctcaccgccggccggtacccctcgcacgaggcgttcgctggcgacgtccggctcaccttcaacaacgcgctgcggtacaacccgcccgaccaccacgtgcacaggtacgccggcaacctcctcgcctcgttcgaggggatgtacaaggaggccgtctcgtggttcgagcagcagcgccagcagctcgagccaccaatgcagcccgatttgccgccgccgccacagctcccggtcgtctctgtgccagtgcaagcgcccccgaggatgggtgggggcgggaggaggcccaagcccaaggcccgggagccaaacaagagggagatggacgaggaggagaagcagaagctgagggtagagatcgagaacttacccgaggagaagatgctgaatgtgctgcagattgtgcagaagaggaacagcgatccagcgttcactggggaggttgtcgagctcgatttcgacgagctggatatggagaccctctgggagctcgatcggttcgtggtcaattggaggaaggctctgaagaagagccagcggaactctatggtgaatggcgatgctgccgcggcggtgaatggagacgccatcgatgtgacagttgttccggacgacgacgacatggtcgaggttgctgtcaatccgtccgtggcggtcgagatcggagagtcggctgacgttccagagaaagaaatggaggccgagatggtcgacgattacgtggatataggcgacgagatgccgacagtgaattaccagtcagtggagatcgagagggattccccggcggctgccagcagctcaagcggatcaggaagtggctcgtcttcatccagcgattccgactcggactccgattctgacggggacgatgccagcgccccgcactaggtgtggctgttgttgctgttttatctgactgtactgtaggattagcgatgagtaggtgactgaaaaggttccatttgatgaggcgttttgaagaacggtatagagaagcctgtagggaactcttgttcatgcaatgcaagtggttgtgttcgtctgtgtatgtgtgggtgcagcatttaggttgtcggtacttgggtgatgggtaggtggtagatgcttgggtagattgggaggcttctgtaaagaggggaatataagctggaacaaagaggaaaagtagcaatgccggccggggcatttcttcatgaaaaaaaaaaaaaaaaatccgga

SEQ ID NO: 13088 - DNA, 930 bp, Zea mays
ggcgattgggatcaccggccgggatctttatcctcgtctctgttccggcgttcgtcatctctgatctccatctcccttaccgatccgatcgtcaagcaagctaagccaccctgacatggcatcttcacccccctcctccgcctcgctacggcagaggccagccgcggcggcggcggcggcggcgacgcccgatcagcagcacgagccaccacgtctcgaagacggcctcctcccgaaccaaggcggatccccggcgacatcggcgctgtcccaggcgctgtcctccacggcgaacctggccaacctgctcccgaccggcacgctgctggccttcaacctgctggcgccgacgttcacgaaccacggcgcgtgcgacgccaccacgtcgctcctcacgcggggcctcctggcgctcctcgccctcgccagcgcgctggcctgcttcaccgactccctcaggtccccgcacgacggccgcgtctactacggcgtcgccacccgcacgggcctctggctcatcgactacccgccgggcgcgccgccgctgccccagggtgccaccgggcgctacaggctcgcgttcatcgacttcgtgcacgccgcgctgtccgccgccgtcttcggggtcgtcgccgccagggaccgggacgtcgtcgcctgcctgtacgggcccacgccggacagggccacgcaggacctgctcgacgttctgccgctcggcgttggcgtgctctgcagcctcctcttcgtcgccttcccaaccaccaggcacggcatcggataccccgtcgtcgccgccgccaccgccacttcctcccaacaatagtttaatttaatttaatttcttcaaggctttaatgccttaatgtaacttcgtgcctatgtactattcatatttttttcaccaaaaaaaaaaaaaaaaaagcggcc

SEQ ID NO: 13089 - DNA, 2781 bp, Zea mays
ttttttttttttttttagttttaattttaattctagtatgcctatgaaaaaaaataatccgtgaatccctgaacgaaattagttagattttagacacgcgaagggggtgggtagacgaaacagcagagcaatctcccgccacgcgcttccacaaccaaccaccaccttgcttattgctgctcgcttccttctctacagatacaagctattgcttacgtgctgcttcatctttatcctcgtctctgttcgtcatctccatctcccttaccgatccgatcgtcaagcaagctaagccaccctgacatggcatcttcacccccctcctccgcctcgctacggcagaggccagccgccgcggcggcgacgcccgatcagcagcacgagccaccacgtctcgaagacggcctcctcccgaaccaaggcggatccccggcgacatcggcgctgtcccaggcgctgtcctccacggcaaacctggccaacctgctcccgaccggcacgctgctggccttcaacctgctggcgccgacgttcacgaaccacggcgcgtgcgacgccaccacgtcgctcctcacgcggggcctcctggcgctcctcgccctcgccagcgcgctggcctgcttcaccgactccctcaagtccccgcacgacggccgcgtctactacggcgtcgccacccgcacgggcctctggctcatcgactacccgccgggcgcgccgccgctgcccgagggtgccaccgggcgctacaggctcgcgttcatcgacttcgtgcacgccgcgctgtccgccgccgtcttcggggtcgtcgccgccagggacagggacgtcgtcgtctgcctgtacgggcccacgccggacagggccacgcaggacctgctcgacgttctgccgctcggcgttggcgtgctctgcagcctcctcttcgtcgccttcccaaccaccaggcacggcatcggataccccgtcgtcgccaatgccgtcgccgcagccaccgccacttcctcctaacaatagtttaatttaatttaatttcttcgaggctttaatgccttaatgtaactgcgttcgtatgtactattcatattttttttcatcaatcaaaacgacaacaacacacgttcacggagggagaacctaacgtggaagcaaagcaaatatacgttggcaattggcatgccactaccagctcagaggttgaagctcacacgtcacgtcacgtcacagatcaaatcactaaatcaggcaggctgtgttcggttgggcctgcaacggcccagaccaaatcgatctggccacgcagcctggcccgactgttttttttcttttcttttggaaccgaaccgacctcgcgctagggttactcgcgcacgacgcctacatctgtcaaccacaacccaagcgctcccccctccccgtcgcctgcaggatctcctcgggccaaggaatcgttcccctccggcgaccttcctccctccctccgttccgtttcgggtgagtctacacgcacggcaccgcaccgcaccgcaccggatctttctccggccggatccgccatcgattttggtcgcgcgccagtcaatcggcggatgcggatggaatctaatggccggatctacgccgtccttgccttaatccttccccgcgacgcccgccatgatcctcctcgcctgacctctcctctctcgtttccagtccttccactgtatcaccggcaaagcaaaggatcggaggccactccgcccggaggagcaaggtaagccggctgcctctgtatctgtctgtgctatgctctaggttgggattagttctgtcctgcaaattcgccccctttgctgtcttcaacgaggtcaaaagaaagggaataaaggatactatcaaacggcgtgaaatcattgctcagggctgcctgtatgcttgctactatgtgtgcgtacaagatgcttgtgtttaggcgtgcccaccacctgtcacctatggccccttggctgaaatagacaaaattaggatggcaaaccttaggttcagttttccacaatgatcatcgacgccgtgcatgtgcgtgagagaaccccctatttttccacttgtgcacaatgattaggacacggcgtttgcttacagataccattaacagctccgtcgaggaactagttaccatgtttcaccaggccagagtcgtaggtttaggttggtgctctgttttaggtggggtttggaaacagtcggtcattacttgcacatagttttgtatgctattacaaatctatgtggagagatatgattcggttaccgtccttgatgtctaccctaaatttgcaaacagccaaaggttcaacctgtaatagtatccttccaaacttagatgtgtcatacatgtactaatgcaagaataatgttttttaattgaccatgaaattggtcttgtgcctttatggatatataaatcatcggttaaaatgcagacatatggctgcttggtctattattttatcaacaacaaacttggtgatgatgtcgtccgtttccggtgacttccacacataactttttacttattctttagtggcacatctttgtataccggtctactcttcattttatctgggtttcttcccatagcttgttgagcattgatgcaaaatgggtttgaacaattatgttgagccaggacaccttggctttggtttttaggggaatcagaccctttagctctaatttaatcttattattaatgccatgggaattgaccttcatgtaaacagaccctaattacttttt

SEQ ID NO: 13090 - DNA, 1582 bp, Zea mays
cgctgacgcagcccattcattggctcggacgccaaaacctttgccgttaaataccccgcgccccccccccgtccgcccggagccagctccaagctagctttgctttagcctcggtcttcgccattcttaatccagtgctccccaccacgccaatggaggctccgctcctcctaccaatctccaccgcctcatcctgcatcgagatcgccgagggcgccgtgccatcgggccctcgtgctcgctcgtcctcgtccatgccttcggcccagagcttcgtcctccgcgtggtgaccgtggtcgccgtggcgtgcgcgtccctgttcgcgcagcacgaggccggcaaaggcttcgccgtgtccgtcgcgaacgacctgccgcggggcagcgccgcggcgcggcgcttcgacctcctcctggtgtccaacggccgcgccgagcgcgcgctcctgcgcgccagccgcgccgtggagcgcgcgctgttcccggacccgtcgttcccgcgcaggcaggtccgccgcgtcaccgtccggatggctgcgcgcaacctcaccggcgccgcggtgcactccgcggcgcccggggagtacgtggtctcgctgggccccggcctcgcgtcctccgcgcccgccgccgaggccgcgctgcgccgcgccatcgcgcgcgtgtggctctgggacggccgcggcgccgccccggcgcgcgtcaccgagtccatggttgactacctcgcctccgccgcggccgaggtcgaggtcgaggtcgaggcgcctccatcggctgccgggtgcggcatgtcggcgcggctcctgaggcttctggaggcgcggcgcgagggcttcgtggcaaggctgaaccgggcgatgagggaccggtggagcgacgccgctgtggacgcggcgctcggcgcgccggcccggctcgcctgccacgaccagaagaagggagcgacggcgctgaccggccgcggcaccaccacctctccacgttggacgccggacgccgctcgtgggtccagcgtggcaacgtgaggctggaagcgaagggcagttctggtattggtgtcttagattgaaattaaaactggtcccgcgggtggtaggcgtgggccatggccgcggccctaatggtggctggaggtgagtgagtggtcgttgtcatgcatgtaaaaatggtagatggctgggacggggaggatgagggcccccccggtggcttcatcatttggcttgagcatgagagcatccatccagatccatagtggattgtaaatgacaggtagtgctataaaaatatggttccattccatgccatagcaaacgcgatgtgagaaatagattttttgttttatctttgcctgtgacgtggatgaacgcggcggttgataatgatcgacgaagaagaaagaagtcgactacgagcagggtacgtgctgatcttatcgctccgatccttcgccgtcacgttcaaatacgccccctcccgggtatataattgtctatatgtataaggtggtatagagaaaaaaaagtgtccactatgacttctttctcccccccccacacacccaacaaacacacgagtt

SEQ ID NO: 13091 - DNA, 1859 bp, Zea mays
ttttttttttttttttttcgttacttatacaaccatactttaatgtcatgcacaaatcattaattacataagaggtctgcaccagaacaattgtactacaaagaacacaaacactagccctggccccctccataccagaaggtcgatcaactacttttaacaccccagcaccttccacccccagcttacatacacatggtgctaacagacacccagaaagccagtttgttatctactactaactgtgtaatccacgcctacgcaaacccacgtctcagaaagagctacatacttacaattaccactacctctacgtaaatcacccaacaacagaactcggatcatccaaattttcaaatcctattgttaacaacctcccctaagccaaagaatgagcattgccagctcctgaggcactgtcccctgagctcctcgactcagaaccactggacgacgaagagccactgccagaaccacgagagccagtcgcaccttcagcgtccttctcgatttccatggattggtaagtggctgttggcatctcatccccaatatcaacatactcatccacctgctcagccattgtagcgctcctcacaggtttctctctctccacatcatcattgtcaaccaacgcaagcacattgctgacaggtgcagtgtcattctcagccacagcagcactggttacatcagcagcgccaccattcatcaacacagcacgctgagatttcttgagcgccttgttgaagttagctacgaaacgatcaagctcccactgtgtctcaacatccatctcatcaatatcaagctcgatctcatcccccagcatctccggattgttgttcctcttgcgcacaatctgtagcacattatgcatcttctcttcgggcaaactctccagccccaccctgagcatgttcttctcctccaggctcatctccctcttgttaggctccctggccttgggcttccgcatcctcacattccctgccctcggcttaaccttggcctcaacaggctcagctgcgggtggaggtgtcaattcaggcggcactggccttggcggctcagggcgtttgcagtcttcctcgaagcaagcgagcgcctccttgtacatcctctcgaagtaggcgaggagggcgccagcgaaggtgtggacctcgtggccgaccgggttgtaccgcagcgcgttggtgaaggtgaggcggacgtcggccgcgaagtcgtcgtgcgaggcgtacctcccggcggcgaggccctccttgacggtgccgaggtccatggggcgcttgatgacggcgtggtagtcgtggaggccgaggcgctccacctcgacgggcgcgttgaaccacacgctccgcttgtccttgcgcagcctggtgaggatctgcccgcaccgcttccgcacctcgccgcggagccccgcgggcggcgggccctgctgctgccaggtgtcgatgcgggagaggagggcgcgcacctgggtgagctcccccgcgaggcggtcccggagcgcgcgggcctcgcgcgggcccagggacgccgggcggaacgtcacgtatccggccgccggcgaggaggctgccgcccgcggcttggacttggacccgtcggcgcgcgggtggggctggctggggttagggttgggaggtatgggcgcgagtggggcgcgcgtctccccccagccgtggtggcgcgccccgccctgtccggccagtagggcggaggccatcgccggtgccggcgagttcccgcgagctcgactggtgcgctggcaattcggatccgagagagagagagagagagagcacgggagtcgggaggggtgaggggagtggagtaactatttgggattt

SEQ ID NO: 13092 - DNA, 1842 bp, Zea mays
ttttttttttttttttcacccaacaaatgatactgcattgttacttataaaaccatactttaatgtcatgcacaaagcatcaattacgagaaggtcgatcaaccctaccattaagaacacagacattagccctggcccccttcatacgagaaggtcgatcagctacttttaacacaccagtaccttccacctccagcttacatacacatggtgctgtactgctgtcagacacccacaaagccagtttgttatctactactaacgtaatcaaagcctaagcagacacccatgtctcagaaacagctacacacttacaattacctgcacacgaactcggatcattcagattttcaaatcctattgttaccaacctcccctaagtcaaagaatgagcattgccagctcctgaggcactgtcccctgagctcctcgactcagaaccactggacgatgaagagccactgccagaaccaccagagccagtcgtaccttcagcgtccttctcgatctccatggattggtaagtggctgctggcatttcatccccaatatcaacatactcatccacctgctcagccactgtagtgctcttcacaggttcctcactctccgcatcgtcattgccaaccaatgtaggcacatcgcccacaggtgcagtgtcatcctcagccacagcagtactggttacatcagcaacgccaccattcaacatcgcagcacgctgggacttcttgagcgccttgttgaagttagtaacgaaacgatcaagctcccactgtgtctcaacatccatctcatcaatatcaagctcgatctcatccccaagcatctccgggttgttgttcctcttgcgcacgatctgaagcacattgtgcatcttctcttcgggcaggctcaccagccccagcctgagcatgttcttctcctccaggctcatctccctcttgttaggctccctcgccttgggcttccgcatcctcacattccctgctctcgtcttagccttcgcctcgacaggctcaactgccggcggaggtggcagctcagccgccactggcctcggcggctcaaggcgcttgcgctcttcctctaaacaaacgagcgcctccttgtacatcctctcgaagtaggcgaggagggcgccagcgaacgtgtgaacctcgtggccgaccgggttgtaccgcagcgcgttggtgaaggtgaggcggacgtcggccgcgaagtcgtcgtgcgaggcgtacctcccggcggcgaggccctccttgacggtgccgagatccatggggcgcttgatgacggcatggtagtcgtggaggccgaggcgctccacctcgacgggcgcgttgaaccacacgctgcgcttgtccttgcgcagcctgctgaggatctggccgcaccgcttccgcatcgccccgcggagcaccgcgcgcggcggcgggccctgctgctgccaggtgtcgatgcgggagaggagggcgcggacctggccgagctccaccgcgaggcggtcccggagcgcgcgggcctcgcggtggcccagggacgccgggcggaacttcacgtagccggccgccgcccgcggcttggacttggacccgtcggcgcgcgggtggggctggctgggactagggttggggggtatgggctcgagcggggcgcgcgtctccccccagttgtggtggtggccccctccccgtccggccaaaagggaggaggccatcgccggcgccggcgaggtcccgcgagctcgactggtgcgctggcaattcggatcctggggagagggagagagcacgggagcgggagagagagagggaggatgcaggttggcgggcggatctg

SEQ ID NO: 13093 - DNA, 1190 bp, Zea mays
  misc_feature (1173)..(1173): n is a, c, g, or t
gcacgagaccattacctagaacatcctaatcgaaaaagcatcagcaaaaacccgcaccggaagacagaaaaccacaatacaaggcacgcaacgaatccggtccgaaattccccaaatccccacgccggccgcgtcatgctccggccattcctctcccgtcaccgctctgccgccgccgcccgtgccgccaccgcagcagccgcgggcgccgcggttatgcgacccgcgtcctcctcccgctcctctgccggtggaggcgggggccaccaccactatcacaatcacagcggcggccacaacgtctccgtctcgccgccgacgtgtacgacgtgcaggcacgctccatcgtcggccacgctcgatctcctcatcctgctgctcgtgctcttctcgctcgccttcctgctcgcctcctcactctcgcacgtcgcgcgctcgctctccccgctgctcgccacgccgcccgccgtcgccgcgctcgcccacgccaccgccgcgctgccctacttggccgcggcggccgtgctcgccgccaccgcgttcctttcttgcagccggctcccgcggcgccggtgccgcaacccgcgctgccgtggcctgcggaaggcgctggagttcgacgtccagttgcagaccgaggatgccgtgcgcgcttgtgccgggagcaccgttggcggcgccgacgcatccatgtggcgcgagatcgaggcgctgccgtggaagggcggccagggcggaaacaacccagactacgagtgccttcgcgccgagctgcgccggatggcaccgccaaacggccgagccgtgctgctcttccgcagccggtgtggttgccctgttgctaagcttgaaggatggggcgcccccaagaccaagcggcgcaacaagaagggcacgcaaggttcgttcaatgaccgaggggtgaggtgaacacaagtctgatctcgccagttgcaacaatgttgctttagactgccatgttaaataattctccgagcaaaagatacacccattacaatttacaagtgggttgccccatgattgtattgttagacgggagttcggtgaaccccaacagatatactgatacaaagacaaaagacgtaataaaggacaatcaaagcgtaaacattggcgaagaaaaaaaaaaaaaaagcggccaaaaaaaaaaangaaaaaaaaaaaaaaaa

SEQ ID NO: 13094 - DNA, 1208 bp, Zea mays
gcgattaaggaaataagggggaaaaggaggaaggtccaagcggcggcagcagcaaaaacccgctccgaaaggcagaacgccacaataaacaaggcacgcaacgaatccgatcccgatttaattcgcccaaatccgtcgattaatccccacgccggccgcgtcatgctccggccattcctctcccctcccctcaccgctctgccgccgccccctgcctccaccgcagcagccgcgggcgccgcggcgatgcgacccgcatcctcctcctcctcctcctcccgctcctcggccggcggaggcggggcccaccaccaccaacacaaccacggcggccacagcatctccgtctctccgccgacgtgcaggcacgccccatcgtcggccacgctcgatctcctcatcctgcttctcgtgctcttctcgctcgccttcctgctcgcctcctcgctctcgcacgtcgcgcgctcgctctccccgctgctcgccacgccgcccgccgccgccgcgctcgcctacgccaccgccgcactgccttacctggccgcggcggccgtgctcgccgccaccgcgttcctctcctgtcgccggctcccgcggcgccggtgccgcaacccgcgctgccgcggcctgcggaaggcgctggagttcgacgtccagctgcagaccgagggggcccttcgcgccggcgccggaagcaccgccggcggcgccgaagcatccatgtggcgcgagatcgaggcgctgccgtggaagggcggccagggcggaaacaacccagactacgagtgccttcgcgccgaactccgccggatggcgccgcctaacggccgagccgtgctgctcttccgcaaccggtgtggctgccctgttgctaaactcgaagggtggggcgcccccaagagcaaacggcgcaacaagaagggcacgcaaggttcgttccatgaccgagggctgaggtgaacgcaagtccggtgtcgccagttgcaaacttgcaacacgctttagactgccatgttgaataataccttctagcaaaagatacgccaatcacagtttacatgtgggttgcgccatgattgtattgttacgggtgttcggtgaaccctaacagttatgtcgatacaaagacgagacgcaacaatagaactgttaataaaggacaatggacttgtttcaaaaaaaagaaaaaaaaaaaaaaaaaagcggcc

SEQ ID NO: 13095 - DNA, 2113 bp, Zea mays
actttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgaggatgtgggagttttctgttgcgctgtatatgattcgcatttggcctgactcgcttctctttgcggccatctacggcgtcgtggagacatcctctctcgtggtgctcggtcccgtggtggggacgctcgttggaagggccacataccttcaggttttgggcatctggctgctgtcgcaaagcatatccttgattgtcgctggaacctcggtgaccaccctgctcatgtatgccaacctgagagccacaagcttcccggcattcatggcgctggtcgccgttaccaacgtctccggcgctctagctgccctctcagctctcgccggcaccatactgatcgagagagaatgggtggtggtgatctcgagcgggcatcctccgtcggtgcggacggggatcaactcggtggtccggcggatcgacctgggctgctcgctgctggcccccgtgctgtcggctctcgtcatcagcctcgcgtcgactcaggcctctgcggctgtgctggcgctgtccaccgccgcctcggcggggctgcagtactgcctcttcgtctccgtctacaacggcgtgcccgccctcgccgcgccaagacagcccagagcttcggacgcagagcgcccgccgccagtaccgatgaccgtcgcgccggccgaggccgagccgacgcaggcgttggattggagggcgaggctggcagataagctctccgtcgcgtccggttgggagtcgtgggtggtgtacgcgaggcaggacgtcgcgcttcccggggtggcgctcgcattcctctacttcacagttctcagctttggtacgctgatgaccgcgacacttgactggaaaggcatacctgcatacgtgatcagtttggcgcggggcttcagcgccattgttgggatcggagcgaccctgctgtacccgctcgtgcactcccgggtgtccacgctccggacggggctgtggtccatctggatgcagtggtgctgcctgctgctgtgcgtggcctccgtctgggcggccaccggcgtggcgtccgcgtggatgctcatggccggcgtggcggcctcgcgcctgggcctctggacgttcgacctcgccgtgatgcagctgatgcaggacggcgtgcccgaccacgagcggtgcgtcgtgagcggtgtgcagaatgcgctgcagtccgtgttcgacctgctcacctacgtcgtggccatcgtcatctccgacccaaaggatttcagcaagatgatcgtgctctccttctcccttgttacctgcgccgcagtcatgtacacggtgcacgcctaccgagcacagaaagcagcgtgcacctcttccacctcgacatgacatgatcctggaaaagaagtgcgagactgcaaggtgtacggatgaaaactgagcggcttatgtatgattgattgcctccatggttttatcctagaccactgtatgcgttaattttatctgaacctatgtttggttacttgtatgtggagacacagacttagagtggtaatggatcacgatccgaataccgcttcacaaaaagttaggtacttaaataattttagttcaaaaatgaataataatagggcctgaccctaatccgatttgatctttaaattttttagtgtaaaatctagaacccattaccacccctgcgcagactgcacgagccaatacgaaacaaatcattttggagctatttagttgcattcggtatatccgaaacgagcgtatctggtcggtcacgctcacgagcctgatttcctaggcgcagcgaaccaatcaggcttgtgaatagcaaacgattttgagactaacgaccccctaatttgtgtttccactgctcttagtcttcttagttttcatgccctcaacattttggggggggggggggggggg

SEQ ID NO: 13096 - DNA, 869 bp, Zea mays
ggatggccggactcgagctcgctccatccatccatccataagtggagtggagtgaataattcaacaccaacacacacaaattcgttcgcagcaagtaatggcgagaacgagagagaagctgacgctcctggtggccgcagtcgccgtgggcctcttgctagccggcggcgcgggcgcgggcgtggcgtcggcggcttgtggccgtgaggggcggcggcgcgtgcacctgcggctgtacatgcacgacgtgatcggcgggccgaaccggacggccatccgcctcatctggggcgtgggcccgccgcacgcgtccatgccggggcgcaccttcggcgacacggtggccatcgacgacctcgtcacggacgggcccggcgtcggcgcagactccaggcccgtcggccgcgcgcagggcacctacatgctgagctcgcagcacgaggaggtgatcgtggtcagcatcaccgtcgtcctcaccgcggggccgtacaacggcagcaccctcgtggtggccggccgcgacaggatctacgaccagacgagggagctcgcggtggtcggcggcaccgggggactccgcggggcctccgggtacgtgctgtggacgacggccaaggtgtggtcggaggtgcacatggtgctggagctcgacgtgcacgcgtccgtgccactgcccgacgaggaccacgacgacaacgacgttctcgttcttggcagtagggatgcgtagtaagatagacatggtctgtatctgtccctgtctacctccgatcccatcaatgaataaataaacaaatataaaaggagcttgaattttagctcaaaaaaaaaaaaaaaaaaaaaaaaaaaaaataaaaaaaaaaaaaaaa

SEQ ID NO: 13097 - DNA, 3096 bp, Zea mays
  misc_feature (2366)..(2366): n is a, c, g, or t
gagcaaagagatatgacatacagaatacatctttatttgaattggctaatactacttgtattatactcccttcgtatcaatttataatctgtttgatatttttatttcaagtttgattagctcatcttatttaaaaaatcataattgttattaatcgttactgtgatgacgtttagtatgtaatactccctccattccaaattataattcgtttgactttgatatcccaagtttgatcggcccgtcttatttaatttttttacgaaaaatgaaaatttcaaaaacatatttaaattatattatatgctaaacaatatcatagcaataatatgatttttttaataagacgagtcggttaaatttggaataaaaaagttaaatgaattataaattagaacgataggagtatactttaaatataactttatatttatttatttttatgaaaaaattgaataagacgaaaagatcaaacatgttagtttttttaaaaaaaagtcatatgaattataaattgagagggcccgtctgtgtccccagcacccagcagacgaacacaagagtcccatcccatcccatcccatagaaactgtgcggtgatcctgctctccccttcgttacacgcaacgcatacgcatggcatatgctcccacagattcgcttctcccgggccttccctcctgttctgctgctgctcgaatgctccaactaacacccacctccctccctatattaagctgcccgtcgctaatgattcagcctcctcttattctcattcgattacacacacacacggagagatcaaattgatacactgcgatctcgatcaaacaaatcaaaaaaaaaaaaaaatcttgcgagacattactgaccgatgaagttcggcaagcgcctcaagaagcagatcgaggagagcctgccggagtggcggagccagttcctcaactacaaggagctgaagcggcgcgtgaatgccgtgtcctcccgcgggtcggcggcggatccgtcgtcgtccagcgccgcggaggccgacttcctgacgctcctggacgccgagatcgacaagttcaacgccttcttcctggagcgggaggaggagttcgtgatccggcagagggagctccaggagcgcatcgggcgtgcgggcgggcccgaggccacgctggcgcgcgtccggcgcgaggtggtggacttgcacggcgagatggtgctgctgctcaactacagcagcgtcaactacacgggcctcgccaagatcctcaagaagttcgacaagcgcaccggcggcgtgctccgcctccccgtcatcgcgcgggtgctgcggcagcccttcttcaccaccgacctcatctccgagctggtcagggactgcgaggccgcgatggaggccgtcttcccgcccgccgccagcagggacctccacgggcgccaggcgctggccgtcgccgggcagggcatcttccgcaacaccgtcgccgctctgctcaccatgcaggaggtgcgcagcgggagctccaccgtcggccatttctcgctgccgcccatgcagccgctgccggagtcggactggctcgtccagtccgttgacagcacgccgacggcgtcgcccctcatccccacccagtgactgacgacaccatggtccacttccagttccatggcactacagtgctacaccactgcggggcgtattatatagtatgcaatatatatacgagaaggcacaataatctacatactgtagtggtgctctgtatgcggctgatgtgtacagtagtagtatttttttttctccttttgttgatgaggtgttcttttctgctccctttcttattttaccatcttttaccgaagaagaagaataataataataataataataataataataataataataataataataataataataataataataataataataataataataattagtactactaggactagtaggagtaaagaatgttgtaacaaggaagatcaataggctttgttcttgcagtgtaattttatttaccggcaaattgagacgtacactgcttcgaattctctgtatatgatcgtttgcatttttcttcttcaatcagcagtcggctccctaaaattaatggcgtctgggctgtgtttcaactgtgttctgcgatatctatagttcaaatgtattgatcgatttggttactttcatgaggaagaaaaagaacaagtataacaacgacacaatctgagtaaagtaaaacaagcttgtgtgattactgtgtccgtacgtccttcaaacaatcaagactacagctctgtgatatagacattgtaacatgagctgagcaacaaattccatggatttctggtgtctngaaaaataataaaagtaatgacagttagggttaagaaaaagctcatagcaaaactacaatcgaaataaaataataacaggaacccgtcttcgcggacgcggatccgctgacgtaactgcagatgaagttgagcttactgcgtgtgggtcttgtcgcacgcggtgcccacacgtcagtgctcccacccaacgtcagcggcgggatcccgatcctatcttcacaccccgtctccaatgaaacacctcgacattgtggtggggctaacaaagactaatgctagcaggtacatattaccgagaaaactgttgaacaccaaaaaataacggacggtccgaccctagggtctagacgacccgcgctctataatcagattgatttggtcgattatcattatctcatatgtaattatgtatctaattacgtagaatttgttgtctatcgtctagaaacgggtccagacctcccctatatatatacgaagaggtacgaccgattgaaaaatccccgaacacaatccaatcaaatcaatctactttatttacttttttttatcattcttaccctatgagtagatgtaacatagctctagttgtagctttcagcatatccatctcaaccagggtcgggccagagaaatttgaggccctgtgccaaatctagaaaaaaaatggtacagccgactgcaaaccagaatgttgcagcccctcacaaaaaaagaggattgacccca

SEQ ID NO: 13098 - DNA, 5422 bp, Zea mays
  misc_feature (2734)..(2734): n is a, c, g, or t
gggcgagaacagtgcggctgccggatggtgcttggtggcgccgtggaggcgtgttggcgggcggcggcgtccgaaccggatgtcccctggacgtagaggggagcggagttcaggtggagaatggaggcttgcgtagttgcattggaagctagaagtctgatggcttcggctggagctggactgagagaggtgaggttcggtgagagacttgcggagcaggctgctggactgtgggctaaaaatattagaatggggtcgaaagatttttgggccacaccctggaccatggccatgggcctaattctagcctagagcgtcatgtcaaaactatttatatagcgctgccgccgcccacctcgaggcaacgatacccaaaatcctacgcagagacatgagtggcggcggcggcggcggcggggaggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcggcccaccctggcccctgccgccgcctcaaagttgactggccgtacgacgacggcgagtcgtacaaccactggctccagtctcccgccttggtcggtcttcaggagctcgggatcgagccagagtactcttccttgtggctagacaagaaaacactgccgcggggagacaacacgagagcactgccagagcgggcattattccagttcgctcccacgctgcgcctcctaaggattggctaccataccttcccctctgtcggtgccgtggcggcgctccggttgccacacctcgagctcatctcgttctgctgcgtggacatctcggaagccacgctccactggatgctcgccgcctgccctgtgctcagaaccctcgtcctcgacggctgcacaggcttcgccacagtccggatcaactcacccaccattacaagctttgccatctcacctgcggattcatccataacgaacgactacgacccgtacttcttggactacgactacgaaaatccgacggtgagggtgacgacgtggcaagtcatcatcgaggatgcccctctcctagagaagctggtcctctgccgccgctcggctgctgttgaatctttccagctactagtggtcagcgctccaagaataagggtcctgggatccctgtccttcagcatccccaagttggagattggtggcaccgtctttcaacccaccgtgcgccgtgtcaaccgtgtggggcctgacgatgttatcatggagaagcgcttgctgatgcaggccgtcatgctggcgacgactctgcgaaccgtcaagattttggcgctggaagatgcagattccatcgacgtcgtcagcgactacttgaagtgttttccatgcttggaaaagctatacatctcggttagctctttctcaacttcaattttcgtttcatcacaggcttatgtacatgctccatggttgctgctaaatctttgcagtttctgttgcatttggcttaatcactcttgcctaactaaaagttaccagtttctcagatcatatttcactcaaacaacatttgtcttagattatttggctaaaacaacaattggcccaggcaacatgacatttattttggggctattgcaaccgctgggcataaacctaggagaaaatcccttcaatgccatccaaaacgataacaattccttcaatgccatcgaaaaatacgcgttctctctaatatcatcagttttaattggtttttggacaacatggcatctaaggttctaaaaattaaaactgatggcattgaagggaacacacatttttcgatggtattgaagggattgttatagttttgaatggcattgaagggtgtgaatgttgcatttagggaaattcagagatatcacactatctactatgggttcagatttacaaatccagattccactaggtcaagtaaaatgtaagactacaaagaaaattaaatctgcatagtgaacatcaaccaggttaaaattctaaatgaaactgaaacttaaaatacattcacataacagttgctttgctcagacaacgaatttactttatttttcagtgtagatattccatacatgattcttcatagccaaaccaaaattgaaattaagtcttcctacattgtagtataaaagaagatactgtcatggtaaatctacctggcaactataagtattattcttgtttgataatgataataagaccattaatcatcgttcttgttttttgacatcatgtcactgttgccagaatgtgaagtcatgaagacttaacacgatgtcctggcatggcaactatacccaatcagataggttcacgatcctccaccgttacaatccctccacaccctttatttcctatcacttaactaaaacacttgattgactcacatatcctctaagccccagaactgctttgccacttgcagaattcttgaaaaattaattcaccgatacataacttggtaacttcgaagcagcatgacattgcaacaaaagcactctagtggtatctaatatagtaataccctatccatggggccgtggccatggccacaaaccattattttggctaaattcacgctcctgattgtttcatctntagttctataagaacacaaaattgccagtttatgttgcatcaatgcttatttctcttggctatcgaaaaaatattctttcatttgttatgttatattcaggcatcacaaggatacagaagtgctggaagctatgataaacagaatcccatcgagtgccttgagcgtcatcttaaaatggtagcattagatggatatgacggcatgggaccacatgtcaagtttgcccaattctttgttcgaaatgcccagttgctagagttaatgaagttcagaatctttagaaactaccactgtgaacctgggaaaaccaaggcatggattgaggatcagcaaaggcaactgcaagtcaggagcatgacttcccgacctgtgaagtttaagtttgtacatgattctagatataatcaggatgtttactgtggtgaggatatcagtgacctgtcagagcacatccacgatgacccatttgatcaatggtttgaatcagagaaggaagccccccggcatgctgaaggaaaagaagatgctatagtttggaactccagccaaaggcttgattcatttgatcaaagctgaataagaacctcgtcctgaacttttatttaattcgttatgtttgtgtgctttcagttgataacatcacattttctgttttgatgcttcagtaccacatcatattgttcacttaatatctctcattaaacagctgtctttccacaaacttcatatcccctgctcgaaaataaggcaaagtattaggtgcataccaagttttcatgcaaacttcgtgcagaccaactaacagaagtaaaaaaaatcttaaaaaaattatagatgtacttcattgtttactttatgtaatatccaaattgtaaaacatatgaaaagagtttatctcgttacatgatttgccacctactcattatatcttgagaataattatatttaaagtaaataattagataaaagcacatcaataagctatgcatcatgttgaagttcttgttttcttgtgcatttaaataataataacaataatattggtagaaatataataatgagatgataatatgaattagcccctaaattgaaatttgggcttgaaaatggaaaagaaggaagagagagatactataaaaatacaaaataaaatttataaataaaattcgtactggtatgttcaaattgaatatctaatttgaggaccaatttgccacaataatctgaggaccaatttgccacaaaaatttggaaatttaaacttggagtttgattggaaataggaaataaaacaaaaggaaaataggaaaaagaagcataccctatatgggttgaccgcctcactgtgggcccattgctctttccttccacgcgcttggtccaggcagccatggagagtgtggatcactggcacgcgggcccgcctcgttatccacccatacgcgccctccgatacatgctcgacgtcgactggtgggccgactatgtcagtcgcgttccatcatctgtcgctggagcgcgggtccgctgtttcagtctcggactgactccacggacttgggggaataattgctgccaacgagggcccagctatcatcggctctagagcactgttggtcgtcctcccctgccgtaaccacgcagccgctgcggacgccgccatcgccgcgcgtaatccgccagctcggcgtgaccatccctgcgggatataaaaccgtagtgcccagggactcgttcgctccctattctcgcttactccccgctcgccgcgccgtcatcgaagaaagagagaaccagctccgtcgtgtgggggagtgccgctgcaccggggagtcatccgcaccgtccctgaccccagcgagttgctggcgagaagtcagattggttcaaggaatactaccgcaacccttacccgccggggaatcctcggagccacctcaattcgtcgccggagttgagccccaccatagatccgcctttccccgtcgtcacgcgcgccagtgctcggattccggtatgtgagtccccctgggtgtttgcccaaccctttccttcacgttctgcgggtcggtcgtgttaggcgcagacagcaacagagacggacagggtatgcgatttattctttcttgctttccaagttcagttgtgtctattgccaaaagccactttacaatattgcagatgctttccttttatacttgagaacaaaaagcaaaaccacagtctaacaaccctgtaattctattacatccagttggcaccaatgtattttggattaacttccttgctcgcgtacctcttcttaatttctggacagcttcaacttctatcttcccttcatctccaacagcttcatctcctgtcccttcctggtccggtccacctttagagttgttaacatattcccccctggagagacagcttgtccccaagctggtgctgcagggaattgttgcttcagcacagcttcatcttcccacgtagccagagagacatcccaatccgaccatttaaccaacacctgagaaattgctttgcctccacgccaaaccaacttggagtccaatatctgttcaggcacttgcaaaccagttgacagatcaggtactgacaagctaacaggtgtattggaaccaacttgaggcttcaactgagaaacatggaataccggatgaatacccacaacc

SEQ ID NO: 13099 - DNA, 1786 bp, Zea mays
aacgatacccaaaatcctacgcagagacatgagtggcggcggcggcggcggcggggaggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcggcccaccctggcccctgccgccgcctcaaagttgactggccgtacgacgacggcgagtcgtacaaccactggctccagtctcccgccttggtcggtcttcaggagctcgggatcgagccagagtactcttccttgtggctagacaagaaaacactgccgcggggagacaacacgagagcactgccagagcgggcattattccagttcgctcccacgctgcgcctcctaaggattggctaccataccttcccctctgtcggtgccgtggcggcgctccggttgccacacctcgagctcatctcgttctgctgcgtggacatctcggaagccacgctccactggatgctcgccgcctgccctgtgctcagaaccctcgtcctcgacggctgcacaggcttcgccacagtccggatcaactcacccaccattacaagctttgccatctcacctgcggattcatccataacgaacgactacgacccgtacttcttggactacgactacgaaaatccgacggtgagggtgacgacgtggcaagtcatcatcgaggatgcccctctcctagagaagctggtcctctgccgccgctcggctgctgttgaatctttccagctactagtggtcagcgctccaagaataagggtcctgggatccctgtccttcagcatccccaagttggagattggtggcaccgtctttcaacccaccgtgcgccgtgtcaaccgtgtggggcctgacgatgttatcatggagaagcgcttgctgatgcaggccgtcatgctggcgacgactctgcgaaccgtcaagattttggcgctggaagatgcagattccatcgacatcgtcagcgactacttgaagtgttttccatgcttggaaaagctatacatctcggcatcacaaggatacagaagtgctggaagctatgataaacagaatcccatcgagtgccttgagcgtcatcttaaaatggtagcattagatggatatgacggcatgggaccacatgtcaagtttgcccaattctttgttcgaaatgcccagttgctagagttaatgaagttcagaatctttagaaactaccactgtgaacctgggaaaaccaaggcatggattgaggatcagcaaaggcaactgcaagtcaggagcatgacttcccgacctgtgaagtttaagtttgtacatgattctagatataatcaggatgtttactgtggtgaggatatcagtgacctgtcagagcacatccacgatgacccatttgatcaatggtttgaatcagagaaggaagccccccggcatgctgaaggaaaagaagatgctatagtttggaactccagccaaaggcttgattcatttgatcaaagctgaataagaacctcgtcctgaacttttatttaattcgttatgtttgtgtgctttcagttgataacatcacattttctgttttgatgcttcagtaccacatcatattgttcacttaatatctctcattaaacagctgtctttccacaaacttcaaaaaaaaaaaaaaaa

SEQ ID NO: 13100 - DNA, 1476 bp, Zea mays
gcacgagaccattacctagaacatcctaatcgaaaaggggtcccccgggcccgcccggacaaactcaaaccctgctacccatgaccgccgccgccgccgccgcccgcgcggcgcgccggcacttctcttctcggctccagactaccacctcgcgccttctccatgcaagtgattctcaggcagcggcgcgggagacatccgggagcttcatccaccccgccgctgtcgtccacccggatgcagccatcgggcaggctgtctcaataggtcccttttgcactgttgggccttcagccagagttggtgacacctgtcagttacatgccgggagccatgtcatgggagatactgagctaggggagggatgcattattcaaactggtgctattgttggtgcagatatccctggacggacaattattggggaaaacaatgtcatcggacactatgctgttgttggtgcaaaatgccaagatttgaaatataagactggagatgaatgctttctacatattggtagaaataatgagatcagagagtactgctctgttcaccgctcttctaaatcttgtgactgcacggttattggtgacaataatctcattatgggttcgtctcatattgctcatgattgcaagattggtaacaataacatctttgctaataatactctatttgctggtcatgtaattgttgaagattgggctcacactgcaggggctgttgttgtccatcaattttgtcatattgggtcatattcatttcttggcggaggctccgtggttgcacaagatgtgccaaggtacatgatggttgcaggtgatagagcagaactccgtggtctaaatattgaaggtctcaggcgcaatggattctccgaccaagaggtccgtaggttgaggaaagcttatcagagagtatttatgccaactataactagcaagagtagctttgaagacagactggctgaattggagcaggaagttgagctgtcggaatctcctgctgtgtcctgcatggtcgaatcgatccgcatgtcgtttgttcaaggacatcgggggatttgcaaattcagaagttggaacagctcttgaatgtgccaattcttaaattatcttggcagttacctcagacgttacttaggtgcatattcaatcttggcatcgatctactatatactatactatacccgaacagatgatgcattgccaagaccctgaaagttggattaatccatgtcaaatctgagtgaccaacaagatgttcttcgcatgcacgtatgggaacattctagaagccctgtatacgtgtgaatgttcacggtaccaagtagtgcgctaatttgctagaatgtacatgttggcctggatcagaggttcaaatctgtataatattgccataagttgccccaaacttttcaacgattattctttgggataaagaattaaacctttcttgacaaaaaaaaaaaaaaaa

SEQ ID NO: 13101 - DNA, 6116 bp, Zea mays
  misc_feature (4493)..(4493): n is a, c, g, or t
aacgacaccagctaattttacgaagaacctcttctacctggggagaaaggtggaaggggttttcacaaaattggtgctactgttagatacgaaatagatgttttagatttaaaatatgcacacgagcaccgtacctctttgagcaccagatataatgtcggttggaaaagggatggggacagatgtggacaggcaaccaacaaacctcacgggatgaacattctgtggtcgctcctgaagtttcctttgaaccaacaagtgaccggcaccggcctttacaattccaattcccaagagcctttttttttcttctctgtagcagcagtgagcgtttttgaccaaaagggcaacgccccctgtttcattataagaaatagaagcagcagtgagcgtggatgagatgattttgtattttcacttttagttagtatataaaagaagaggacggtgccatgtccatctgagactatcatgagtattcacgagcaccttcttttcagtccatcggcaatgccatccaactggaggacatcatctatcaggcactgcaccaagcactggccgtctcaaacaaacgtccatttctccaggcctcaacagagcagcgagcaggtgactttagctgccgatgcgtgcaagcccccgttcagatcgggaaacggcagcgctgttaggcagcagcacacgttattggcaggcacgtccgagtgttcctgtgcatctctatctatctatctggccatgctgctgaaccgtccgagatcgcttttgcttcgctgagtcgcgtctcgtctgcctgtccagagatggagcaaactgacgcagacacttcacagtttattattgtttttttttccagaggaagaaaataatagtatccattagtttggggaataattgttcaatcatgcatgcaggcattcgggggaagggaagccttgctgaaatggcgggtcagatgatgcaggcttgaagcgtagtcaatggtaggtctggtggcggttgttaaggaggagcggtttctcttgtgtgtcggatcaatttaagactctgcagtccgtctcatgaactcttgtttcttgtacaggagcagaaactcggttgtctgaaacatccagcggttctttctctcgtgcccccgccccttcaagagctgaaaccgcgtctacgatcctcagcctctcacccctgttggtttctggaatccatcacgtcgctatcggattattacagctccatctgcttggagagcaagagctccatgcatccagcgcatgtgcatgtaccatgaacattttgcagacgcacacgcgatgcctctgacttcagtcggatagcgatgcgtttacatctcgtgttgggatgttcatgtatctacttcaatgattcaatctatgtgtgtgatgaagtggatcagcatgaaatccaacttggactctgtattaatctattccaatgcatagtatgttgcattgcatctgcagtcgaggtttgtttgattggagtgcacacgtggtcgctccacgccacaccttctggagctttctctggtagagttttcttggagcaccaccgagcgcagcggttggatgcctctgcagatcatccaaacttaactacgccattgtttgttccgttgttgccgataagaatgacaactagatatgcatgcatgttagggtttcttttctctaaaggaggcatttatcttatcttaggaccattttgtcgcgtctttgtactttcggccacgtctctttctcagcttcagttgttcctctcgtcacctgttctagaataccgcaagtacagactacagaccggagtaaattaatctgttctcgaatttgtggtccactagtttatttttttagctagaatataataaataaataaaatatgtttaacaacaagggcaacaaaattgatactctctccgccctaaaaaagtcagactttagttttgattttctacaagcacttatctagatttaaaacttgaagggcaacatttttgacaaagggagtacatagtctttctccatattttctagaagaaaaaaaagaggaagggatggatacagcggtgggatgaccctaccgttccagatcctataaagccctgtgaaatcttctctaaaatttgatcctatatttttattatgtatttctagtttcgttattcattgatgttttaatataagtctaatttaaaccattatatttgtctattgtaagcggtttagtcagtctcctaatattttttttctgggctccgtaggaaaaaagttatcgtattcaaagagcaggtaagccagagcatgcgagcttcgtttcaaaatagatgtcgttgtcgtttctcagtaatcagatgttttcaattttaactctaaccgtacctgtattttgttaatgcaggacagaacaactgtggagtcatcgataacgataaccatctgccatgggcaggctggagacagcacacgacgacgaccgagagacgatacgacacgcgatcaccccccacctcgaaaaaaactgaaataaaaagctacgcttttccccttccctggtgctttacaccgcagagaatcccgtcaacccatggccaccacaccgctgcttgcactagatactaggcttgctctcctcgaggccggccggcgtcttctcggcttcacgccttgccttgctgctgatgctactccatttcctcccccggtacagcctgacccaacaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgccggatggcgcggctcagccgcacgttccgtggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccaagaaggaactgtacgcgcggctttgccgtcggaaccgtttcgacggcggcaaaaaggttcttattcgccttcttcaagagttacatgtcacctctcttttctgtgtggttatgcttaaattgtactccctccgtttcgttttagttgtcgctagatagtttcaaaattgaactatccagcgacagctaaaaagaaacggagggagtagctaagtagtatggttgcagagtcacgttctgattgctttgattaagctatatggaatctgttgaatcagtttgtgagacaacatcaaatcgcgcagacatcaaatcagtttgtgtttggacgttttggactctgattagcatattgattttgccactgctcagacattagatttgggtgccacattgtgcaggagttctggctggacaagggcggtggaggtctatgtatgtcaatttcttcaagggcgctttcaataacaggcattgatgataggaggtattggaacttcattcccagtgatgaatcaaggtacttcaatctactagcaatcaaaatctccttggcaattttctactgatcatgctttattatatataaataaaaaccccagaatcttgaagcatatatttggttaccggattgcatgtattattatttggcggtgttggggattgcatatatcattcacatcttgtttgcttcaaccatgtttagtgacctggtgtatatgacgctcaacatagtgagtgtgttgaatcgagtacttggagaaaataggacatatgctagctttaatgcctatccagttattgcttcaactgtacgtgctcgttattttacctgcaccgcttgtgcagattccgcacggttgcgtacctctcgcaaatctggtggtttgaagtgagaggggaggttgaattcttcttcccagaaggcacgtacagcctattctaccgcattcatctcggccgaccattcaagngtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaacctcagcacctctcgcagaaaaaagcgccctggacttacgtgtagactcgtcgaacaagttgctgctgctgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcctatcaacttgcactaccaaaccatttgtcggcctaaatttccactaacattccgaattaacaggatttgtcatgcacatgcacctattttttttttttttttaaggataggaactacacataatgtcttgttcttgattgcgctgttgttgccagaggacgagagctggaatatgccacacaatgcaaacatgcttctgcagctctgtcactgttcaattcaggcgtgacattgttattaaactcaatgaaagattgtgcccgggttcaattcaggcgtgacattgttattaaactcaatgaaagattgtgcccggggctgacgaatgtacggctagggcaacaacttgagagaggacaccgactgtccagccaccatcctaaaatcatccttccgcctcaagaatcaagaaattattatgcatcatctccattccgtcggtatggcatgcaccgatgatctttggaagcattcttcctcctccgcttttctatgaaggcatcaagctttcctgcctcttgcgagcaatgaacacaaatgttaagaaccgggacaaataccccacattgttcaaaaagaactcccagaaaaccttgtaaactttaccttgagctcattgtacttgttcaacagcttccttttcgcgaagctcagctggctaagaaaatgaaagggggagtaaccatcaggttccggttcggagggtctccgtttcggcctcgtgcgacagacagtgcggaaaggaaggaggcattgggattgaggactcacatttcttcagatagtatggtcattttccggccttcgctcgctgcttccctctctttcttgatatgctcacgcaagatctctgattcaactttttttttgggaaatgtatggtagatatttattaatataaagaataaagaggacaaagagcatgagcagtcgctcccaagacataaatcagaagttaactaaactagagcacagggaaaagaactatctgctatctataggaatttacaagcgaggagaaaagagttgatttctcttcagaaaagatctatga

SEQ ID NO: 13102 - DNA, 1024 bp, Zea mays
gtaccctcgggctcgccgggacaccgcagagatcccgtcacccatggccacccaccgctgcttgcactagatactaggcttgctctcatcctttccactcgtcgtcttccacggcttccacgccttgccttgctgctgatgctactccatttcctcccccggtacagcctgacccaacaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagcctttttcggcagggcatctgctagagccggccggttgaagcaggggagcgagaggaggagggcagccgaacaggagcgtcgcagtggtggttaagcagcagcaacgacgacgacgacgacgacgctgagaggtttccccgttcccgacggcacgtccaccgaggcggcgccatcacgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgtcggatggcgcggctcagccgcacgttccgcggcgccgcgtccggggacggtgtctgggagtccaagctaccgaggaactacgcgcgcctcctcgccgttgctgcggccggcgatgggggaagcggggcaggccgccgggtccgcgcccggaggcggagccgctgcccaagaaggaactgtacgcgcggctttgccgtcggaaccgtttcgacggcggcaaaaaggagttc

SEQ ID NO: 13103 - DNA, 1793 bp, Zea mays
gcggcttccacgcctttccttgctgctgatgctactccatttcctcccccggtacagcctgacccaaaaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgccggatggcgcggctcagccgcacgttccgtggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccaagaaggaactgtacgcgcggctttgccgtcggaaccgtttcgacggcggcaaaaaggagttctggctggacaagggcggtggaggtctatgtatgtcaatttcttcaagggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaaccgcagcacctcgcgcagaaaaaagcgccctggacttacgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcctatcaaaataaaaaaaaaaaccatttgtcggccaatataatttataaataatttaatttaatattatatttttttttattttatatttttatattttatgatatt

SEQ ID NO: 13104 - DNA, 1064 bp, Zea mays
tttttttttttttttttttcttggttgctcgtctgttttttttttttttttttttttggttcacaactcacttcactcatcagagattttggaaatacccaatacatagtagacgttcagatatcctagagtacacacgagggtgctaacaaaaataatctgaaacatatatggttcagcataacagcgacaagatagtcatacagagccctgagatacctcactcgctaacagaaagagacccctgcctatgaggagacctgctaacaatggggcttgcactccttgatctgttgacagctggggaacgcgacaaagatctctcccgaggtcgaggagccggggaccttgaatagtgctttcgcttaggtgctggcgagtagcttcggctttgggaccgtgatctacccctaggagaaccgttcaacccaggtgaccttgagcgcaacctcccatcataagaacggcctctgccacttattttttccctggccctcatgtcagaaggcttcttcctgttttcctctgcaaaaacaacagcaatttcccttccaagcagcatcttcccatccatatagtactttgcatcagaagcatcctcaggatcaaagtattggatgaacccaaatcctctaggttcccgagtgtagtaatcctttggcagatatatgtctttaacggggccaaattttccaaatggtctacgaaggtcatcaggcctacaatcccgacgaagattcctcaccaaaagactagttgggaggtccctatcagtatcacggcctccataccgaccacgaggacttgggctgcgagttcttctcctgtagcctcttggtggcgatggactgtgattatagcttctccccatgttgttctcggcggagcaaatcgggcgagggcactggcggcagactatcagcaatcgccaatcaggcggcgcaatcctctccgctctggaaccggaggcgtacctttcctctttgtcttagggcacgggggagggggggggagcggctggttgtctcctgtctccggaagcttccgaggcccgaaagcgcgac

SEQ ID NO: 13105 - DNA, 6559 bp, Zea mays
  misc_feature (2115)..(2115): n is a, c, g, or t
gcaatagttgtgtggagtgattctctgaaataaaataggagactgagatagctcgaaaaaaattagttttacctgattcacttttagcaatgaattattatatacatagagttcactgttaataaacatagagaattagtttaagtcaaagaatcactttccgaatagaatcacggaccgtttggatctattattttagaggaattggaacttacttaataaagtagtttatttggcttggatttaacgttcaaccactttccaaagcttagatataagtctatcttaaattcataggtgaagcatgagaaatgattttttatgtatcaatagaatatgtttatactctgcaacttatgacgtgctcttcgactcactaatctatagtaaaaatacagcatataaatatctctcatgtattgtttataatagtatataaatatatttcgcataaaaccatattagcttaattgatctttgcctaatttactattaggtcatgtttacatctattcattttggaggaattgaaatttacttaataaactagtctagttatcttggaattttttgacatttcaccagtttccaaagctcagatgtaagtctatctcaaaatctatagggtagagtatgtgaaataattttatgtacgaacggaatacgtatctactctgcaaattataagatgctctccggctcatttctctatagtaaaaatgttgcacataaatatctcccacgtatttgataataatagttatatcagcttaattgatctttggctaaattactattattattagaatgaaaaaatcaatttagaacacaagaggaagcgccacaagcacaagtatcgtccagcatctaaattgactttttccaaggctataagaacattcaaatgcgatctaataaatagcttcattacatgaaaaaaaaaggacaaccatcggattctattttgcagccagaaatcttcgaagacaggacgaaatagttactctcagtttgttaaaaaatacagtcgattttagtttttattattttagaggaattagaaattacagccagaattttatttgcccgctctttctcaccgaggaaggacaatttagaacctggcgctgaatggatgcgcggtatatcagacaacatggcagcacgacgttccacatctccttttcagctgtaaacggcggcgaccttccctctctctctctctctctctctctctttttcatcatattgtcgaccgagtgtagctagagtcttaccactttattactgcggactgctgcgtttaattaacttatggttaccatgcatagacaccaagtagtggagtattctttcttcgcatcttttctgcaattcttcttcctcttcttcttttttttttagagagcgagcgagagagataggagctagtttcttcttcttttcttattagagagcaacgaggcagtcgaacaggcttgagcgactccaacaacttcaatgcagtgcaaccactactgttacgtacgtcccgcgtccacgggattacggaaataaacctgttccaaaagagacatgtgaaaccgactccgatctatctggtcagacggcgcgtgtacacgtaacactcggcccaggtgtgacgcgtctgtaccttccatgcatgtgtaaatcgagcttagctcagtcaggatagagtgctagactaaaattttgtagtgtgcccagtgaattccttctcgcttaataattaacgaagaggccaacactcaacagggtgtagttccagagagtctttggagaaaaaaacatacaacgacaaggccggacggttcgggtcttcgctaccagtctaccactcgctcggatttttttgagcacgtgaagtggcctctgtattagaacaggtagagcctgcttctcttctagatcaattattattatgcagctaatccagggaaccgaacaacaacgcacgaggagattgaataaacggtgacacaggaagacacaaccgaaccaaccgacgacgaaagcacccgctaccgtgtgacgaaaaaggcaatggaagtgtctgcgctgcgcctgcgtggctgcgtgcaccagcaataatancgacaaagatcgagttctaaaacaaatcaaacgggtcgttagttgcgcctgcaagtacgagctgttaagttgttggcgcctagcacgtacgaccccgtccaccgtagattccatacactgccctgccctaccctaccgtataccaggcatataaaaccgagaaaaacaaatagtacacacaccataacatgccctaccactccgataaagaacgggtccggttccgtccacaggccagttgttggcgcgtcctcttcggctacgacgacgaccgagccaggctgcgccaatcggtaccgttataaatacaaacctctcacttaaaaccaaatagttttttatttgtcgcaatttagttcaaaaataaactaacggacgacaaatactcaagaacagaggttgtacaatctccatacgtaagagctgtacatgcttatgtagcgagtcatgcatggaaggtcatagaaggtaacggacgggctttttcttaaaccttcgttatcctagctgatgatcactcacactgaaagcgacttccaccaatcaccaccgaacaatctggctaggtcattccaattaccaacaataataagcacaaaccctcacctgacttttatggagctcaatggatgcacactagctaaattactctcttatgtaccaataagatcgctagccaagcggattttaagctctcaactctctcgctagccagtgattgtatctcacactcgatatgggtcgcttcatcgattaaattgggccagagcactagtatagcccatttggcggcgtatttattagaacccttcactggattgtgtaaagcttcaaatgttactatatggcttaaaacggtcgaaaagggtgtggtacaaccgacttaatgaataccttctctagaatggatgcactaacgatgattattgtccatgtatttttcatgaaaagttccaaatgagattttgcattatatctacttaagttgatggtatgcaatcaactaaaaaaaaagagttcaagtttaaggatatggcctaaatttaccaaattttttttttgcttaggcttacatatttagcaccttttgactagacttttaatacatcaacctgacaatatctggaaagtaatagaaaattttaatatggacaaatcatatctctctattgtcatccagtccttagaaatagggaccaatcatattagacaacgagattttggacaaaaaaaatatagggcatggatttccatgcatcaatgttatattggagcacttatctatctcatttttgtactacttcacagtttgttttactttattcgtaaaaactcgcaaccaaatacatcatggattcgcacatcagcgatcaccaacgccatatgatacgtttcacggagctttcaccggctaactaacccaccccagccgggccgcgggccggcatcaccaatgattcaagcactcgctcctaattaaatgacctcccgaattagcgattaacctcccggtcccggctactacacacaaagtcaaaaaggcgacgcttccccaaccttcacccacctcgaagtcgaagccacgcctttccacgcccgcacaaagccgctgcctgctcgccctttatataccctgccaccacgccgtgcctccgtgtcctccgcctcggccccgtgggcgccccttcgccagcgccagcgaccgacaccttctctaggcccattccaaggctctcctcaccgctgctagctcccaggctgctcagagcgccggccgacgagcgtagcgctccgtggtccgtgcggcgctcgaggacgtacggtacgagatcgacgacgcgggtggttccgactcggtcgtcatggggctgagggagagcttgttcgggtgcttcggggccggcggccaggagcaggggcaggagcccgcggcggcggggccggcgagcaggcgccccggcggcgttgggaagcggacgctgcggcggctgagcacggccaacctgcggtccctgtcgctgcaggacctgtcgcggaagctggagacgacgaagctgcacgccttcacgctggacgagctcaaggccgccacgaagaacttctccaccaccaacttcctcggcgagggcggcttcggccccgtctacaagggcttcgtggacggccgcctccgcccgggcctccagccgcagcacgtcgccgtgaagtacctcgacagcgacggcgtccaggggcaccgcgagtggctggtgcgtcacgtccccccacttttccctcctctaatgaattgaatctgacgaaccctgatctgatctggttgcgctgccttgtttcgccaggcggaggtggtgtacctcgggatgctgagccatccgcacctggtcaagctggtgggcttctgcaaccaggacgaccaccggatgctggtgtacgagtacatgccggggcaaagcctcgagagccatctcttcaagagtaagctaccatacattcgcctgctaccacaccacaccacacagccttttttttgtaatttggactggacgccacagactattaacagcagctcctgctacatgtgtctgcctgcagatctcctcgcgtcgctgccgtggtcgacgcggctcaagatcgccgtcggcgcggccaaggggctggcgttcctgcacgaggccgagacgcccgtcatctaccgcgacttcaaggcctccaatattctcctcgactcggtaataaagaagcccgcctcaccaagtccaatctcttctcttcttcccccccacccaccccccagcatcaaccacattggatgctttattagtccttgtcacactctatattttttattttcgctataactaaattgtttcttaccaacacgcccaacaaccgtgctaattgcatgctcgcacgttgtcaaactaccgttccgtgccgaagcctcgcttctttatagaattcccgttctggaatagtagacgtacactcctgctcaaaatccgatttgttttgcacctaccgacaaattagtagtagcaagcaaacaaaaacctctgttttttttcttcttttatcctagacgccggcccaacctagcttgaaaattatagtgctgtgattagttcggatttttggaacgtgatgcttttgtagcaacaagttggcgaaacgcaaccaacaaacaactgttgctgacctcgagtttgtcatatggatgtggtggtgaattcatttccaggactacacggcgaagctgtcggatttcgggctggcgaaggaggggccgcagggggacgcgacgcacgtgacgacgcgggtgatgggcacgcacgggtacgcggcgcccgagtacatcctgacgggccacctgacggcgaagagcgacgtgtacagcttcggcgtggtgctgctggagctgctcacgggccgccgctccgtcgacaagagccggcgcgggcgcgagcagaacctcgtggactgggcgcgcccctacctccgccgcgccgaccgcctgcaccgcttcatggacccggggctggagatgcagtactcggcgcgcgccgcggagaaggccgccggggtggcgcaccagtgcctgcagagcgtgcccaaggcgcgccccaccatgcgcgacgtcgtcgacgcgctcgagccgctgctggcgctcgacgacgacgtgcccatgggcccgttcgtgttcacggtcggtggagccgccgccgaggccgaggccgcgccggcgcaggccggtgtcgccggcgacgacaatgcggacgcggaggcggccggcaggcagggcaagaggcacgtcatgtcggccgtccacgcggagagcccactgcggagccggtacgccagcgccgtgaagagaccagagagcccgccgaccctgagcagggcatgagtgccattgcaaatttgcaagtgtacatagctcgctgacagattgctcatggattcttttgttttttcctcctgttttcttggtgatgctgtcaattcgttctctcaagaatttcaagggggagagttttgtgtttccgttttaggggggttgtgttatcattgtccccttgacgagaatacctcaagttgcgagaggtgtttgtgtaccgaaagctggaggcaacatgtgtactcttgcaaacgatgatcaaagaaacattggcatcgttcctctttgtgtatgaatgcgctcagatcatggttggagcctggaggctggtaggtaagaaaccacaaaggctttcgcttttgacctagaaatgaggtggtccaaggacacatgtgggccatgtggccgagcacgagagcactagcctgtattttctcgaccaactacaaccaccacacagatgaaagcaacaaaatctttaattagatatcctaataaagttaaagataaagtatcctatacctataactaatacttcatcctaaaata

SEQ ID NO: 13106 - DNA, 1370 bp, Zea mays
gaatttctttggtttttttgtttgtttgttttggttcacgtcgtgttcagtgttcaatgtgaccgatcaggacgggagtaagcttcataacagggaggtcattgaccatattcagaaatgcctggaatcagacggctaccttgttcctccggcgaacggttatgcgctgccggaagacccggtcgcctccgttgagctgacgggcgcggaccgcccgggcctcctctcggaggtgtgcgccgtgctcgccgccctgagctgcaacatcgtgaaggccgaggtgtggacgcacgacgggcgcaccgccgccgtgatccaggtcaccgacgaggccaccgggcgcgccgtccacgacgcgggccggctgtccagggtgcaggagcttctccgcgacgtgatgcggggcgacggcacgtgcaaccacggcggcacgggaatctccgcggagaggcgcctgcatacgctgatgctggacagcgtcggcggcggcggtgccgaggaggctggtggcggcggtgacgagaggggtggatgtggcgtggcgaagcccaaggtcgtggtgatggactgcgcggagaggcggtacacggtggtgatcctgcggtgcagggaccggccgaagctgctgttcgacacgctgtgcgcgctcgccgacctgcagtacgtcgtgttccacggcacggtcgacgccgagggagccagcaaggacaaggaggcctaccaagagtactacatccggcacgtcgacggccacccggtgcgctccgacgccgagcgggcccgcctcgtccggtgcctagaggccgccgtcgagaggcgcgcgtccaacgggctggagctagaggtgtggacggaggacagggtggggctgctgtcggagatcacgcgcgtgttccgggagaacagcctctccatcatccgggcggcgatcacgaccagggacggcaaggccgaggacacgttctacgtgtcggacgcgtacggcaaccccgtcgacggcaggaccatggacgcggtgggggagcagctcgggcacgccgtgctgagggtgaagcgcggcggccacgacgcgcccgtcaagcacgaggccgagggcggcgcggtgtccgtccttggcagcctgctcaagagctcgttccagggcctgagactcatcagatcctactcgtaagccgtaatcgaagaacataataactccgattagttataaagccctgggccttgtacatatataaaatctcacgtaggttaggaaatagtgaagcagcacggcattgtaaatatcagaccagtcgcatggtaaatatcataccgttacaagtgcataaatctcattacattacagcaaaaaaaaaaaaaaaaaagcggcc

SEQ ID NO: 13107 - DNA, 4216 bp, Zea mays
ttgctaaaagtttcaaccttaagtttctaaagttttgaatcatagttctttggtttgggagtgataaagttgaagtgttgtgaatataaaatttattagaacatggtgccaatatatgtggtagcaaccttggtatcgagatctttgaagttgatcttgttgtcacgatctatgatactaagattctacagtgctatggtcatgatggagtatacttcaatggtgccatgataccttgatgtcctgtctatatttatagatcgacgaccctataaatataataatactataaaattctatttggatcctctaaaactaataattagctactaaaattagttgtaaagtttccaaacacctctagctaataccatagctaattgttagctaactcatagttaacaattagttcattagttagctaactatcagacctagaggttccaaacataacctaaatagatatgcaaatacaagatttaaaaaaaaagacaaataaaaaatggttgcaccgagccaggtggacggtgtgtttgtgttgttgcctgtgtattcccatcggtctagtgaccttctacaaacgtaacccgacactagctgcgttctaagactctcttcaacaatgaactttataccgttctgtaacctaaatctggcaaacacaacctcctctatagcgtccaacagcgaattgtaaagcttccgctaaaatagcgatcggtacttgcacacgttattcttggcgaatcactgtgcacacgctattcggccaaccgagcgcggcttcgccactaagacaccgaattgcgcgcatagacagctacgacgagggtgtcgtcggtaacgggcgtgacatgtaactgaagctcccgaacatggcaaagattggggcagacggtgacgaagtcgttggcaggcggcgtgaagaaggttggatgcggtagagtgaaggtgctcggccagggaggagcactacgagcacggagaagctcggttgcagacgttaatgtggttaattaggtgtcacgatgacacgatgtagaggagatcggctgcggcactgctctggtcttggtgtggcctaacctgctcgacgagaggcacatgacctgctcgacgagaggcacatgaacggaaaaaggaaaatcccaacaacctcaacaccgtcgttgtaaaaggtatttattaatacaaataaaaagttaatttaaatttctaaaggtcttattttttgagaaaatacagttttgattttttttaaatattgaagaaaaaagtgtagagaatagatatagaggatgaaatttagagtacattgccggagacgaggaatatataaagaacataatattttagaatgtgctgtaaaagacaattaatattattttagaggataaaatttagaggacattgctcaagacagtataatatactacgtgcgttcgtcctttctctataagttgattagactatttaaatgacatggtaaatttattaaattaattaagagtatatttaatactcataattaatatttaaatatttgatagcataagaactcaacttaagtcaatcacaaggcaagcagtcaagcgccacggcgcggtcgcgcaacccaacggccgcatcacgaggggatcgcgtgcactgaccctcgcgccgcgagccccttccgccgcgtcgcccttctcaccttctcctccgatttgggtccgtccgacgcgctggtctgcttgctctcgtgctttgtcggtcccgtccgtatggccgtatcggtcgcgccagccagaggcggacacctggagagcccctgccggtggcaacgcgtgtcctctcaacgtggcacccagcgcttgcccatgcaggacacgtatcccccagcctccgctttgcagctcgagggtataaatgtggtcccctgcagggccttcccgcactcacacagacaacaacgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggtgatgagatgagacgcgcgcgcaccgcgcttccagccgccgtgcccgcgcgttgctcgctccgtcgtccttttgcagttacctactccacacgatagagtggacactaacgttggctgctgcatcgcaggagaagacgggtcaagtgatgggggcggcgcaggagaaagggagggaggccaagcacaaggcgtccgacgccgccgaccgcgccatggggatgggccacgacgccagggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggtgagatgcacggtgatgcctagtcattgttagcttctctcccgtctttgctactgcgaaaatgggttattcgatctcaaaatacattcgttcttcggctgttcaggcaggggagaaggtgatgagcacggccgtgggggccaaggacacggttgtcagcacggccgtgggggccaaggacacggttgtcagcaccgccccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttattttcaaaaaaaaaaaaaaaagtccgactgtcattcgtctgccctctgatcctgttggcttgccttgctgctttgcatttttggtggtactgccgtactggtacctgtcaacctcctcttatttttacgacgacatgacaaaagcatgcaaatcgaatgttcagttttatgcacttagggctattggaaaaaatacaaatcagagaaatagagttaccaaaataaccacgacgcaaatgactaaccacagcagcacacagatgattccaagacctgaagaacaggtccgagatgtaaagcagatttatgtaccgtcttacctctgaaagaaatcagagatcagatgtttatcagcaccggtgcctggtaaaacctgaagttggttggtaccggtggccttcaacttaagcctaaaacaagtactggtgactaaacaacttaagctaaaagttgactaaataatttaaactaaaagttaaagatgcctaaacttaacctcagcatcggtatctaaagcagccccggtgcctaagacttaggaagtgtattgggtagaacgttactcgataccggtggctaaacaacttaagttaaaaagttaaacttaatcggtaccggtggctaaacttaattagtaccaatggttaaacttaagctactggctaaacaacttaataccggtggctaaacaacttaagccaaaagttaaacttaactgataatctcggtgactaaacttaattgctatataccccctgattgggtatattgtgaggtttttaatggtcatcaaacatctgagtatctacccctatagtatgtcccttaaaaaattgttatggattggagggtaaaattaaatctcttcgtattcaatttatgtcccttaaaaaattgttatggattggagggtaaaattaaatctcttcgtattcaaaattgaatacgaccttcaatccataacaaaccgaacttggtcttaacgggtaatctcctctttttagtggttctatttgctacagttga

SEQ ID NO: 13108 - DNA, 1029 bp, Zea mays
aatacacagacaacaacgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttattttcaaaaaaaa

SEQ ID NO: 13109 - DNA, 1268 bp, Zea mays
  misc_feature (29)..(29): n is a, c, g, or t
  misc_feature (44)..(46): n is a, c, g, or t
  misc_feature (49)..(51): n is a, c, g, or t
  misc_feature (56)..(56): n is a, c, g, or t
  misc_feature (1255)..(1255): n is a, c, g, or t
ttctgtcagtttagactttattgcatagnttttcaaaattttgnnnagnnnaaganttttttccgtttaaacataatcgaaaacatttcgccagtcgccatcgagctctcgcttccgccgcccgctgccgctgtatcaccccggtgctgagccctaggatgtgactggcggacgtctctatggccgagccgtaggtggaggcgacacctcggcgccgtgggagatgaaggacgatgacaccgagggtgtaggcgagagcacctgtcccccgccgccgaccgaggaggctcctcctcggccgccggcggcggcggcgactcgcacggttacactgacatcgagaaggaggtcttcgaccgtctcatggagaagagaatctcggaggtcgtcgcggacccggtggccttccgcgaagagctccaccgccacttcgagcgcctgccgctgagctacgccatcgatgtgaacatcgacaaggcggaggacatgctgctgcaccagaggattctcaacgaatgcgctgaccctgaaaatcgccccatcttccatgtgggcttcctgaactgcatcccgccctcgttggatccacagtataacactcaatccatctctacgagcgaaaacggtaattgtgggggttctcaggattccactttgagaaaatttgagccatgcgaagggatcgaggacctcagtttaactggacaaaaggttgtgggtgactatgtggccggttcttcgaggggagatgtagaaatcctccatgttcatgaaattattttttctaccattgacaaaccaaagctcctcgctcagctatctgctttgttatctgaagttggactgaacatccgtgaagctcatgtcttctcaacgactgatggcttttgtttggatgtatttgttgttgatgactgggatacaaaggaaacagatactttgctacagattctcaaggagacagcggcacgaaatcatgcctcattatcaaacccaaccaattctgcagcctcagaaagagtactggaactacaagagaagattggtgattcaaatattgacaggaatttcattgatattatatatggattagctggttcatatttttattgctacaatgttattgctactacttatccacttcatcatacgaaaaataaaataattaactaccaaaaaaaaaaaaaaaaaaaaaaaaaaaaaaagcttatcgatccgcccgaccttccgaggggggggcccggtacccattcgnccctatattattg

SEQ ID NO: 13110 - DNA, 1191 bp, Zea mays
cattgggtacctcgacccgcccggcaaaaaacccctcggatgcccccgcccccgcccccgcccacccatttcgccagtcgccatcgagctctcgcttccgccgcccgctgccgctgtatcaccccggtgctgagccctaggatgtgactggcggacgtctctatggccgagccgtaggtggaggcggcacctcggcgccgtgggagatggaggacgatgacaccgagggtgtaggcgagagcacctgtccccccgccgccgaccgaggaggctcctcctcggccggcggcggcggcggcgactcgcacagttacactgacatcgagaaggaggtcttcgaccgtctcatggagaagagaatcccggaggtcgtcgcggacccggtggccttccgcgaagagctccgccgccacttcgagcgcctgccgctgagctacgccgtcgatgtgaacgtcgacaaggcggaggacgtgctgctgcaccggaggattctcaacgagtgcgctcaccctgaaaatcgccccatcttccatgtgggcttcctgaactgcatcccgccctcggtggatccacagtataacactcagtccatctctacgagcgaaaacggtaattgtgggggttctcaggattccactttgagaaaatttgagccatgcgaagggatcgaggacctcagtttaactggacaaaaggttgtgggtgactatgtggccggttcttcgaggggagatgtagaaatcctccatgttcatgaaattattttttctaccattgacaaaccaaagctcctcgctcagctatctgctttgttgtctgaagttggactgaacatccgtgaagctcatgtcttctcaacgactgatggcttttgtttggatgtatttgttgttgatggctgggatacaaaggtgatttaccatagtatgattgtgtagtgctagcttgcttatctatgtatacttggagcatgttctgtaatctgtaggaaccatttttttccctgaaagaaactacagcaaccatttaggtcgcttgaacgttattgtcaaaaacataattaccagctggataatgtcatcattttgtccaattaaaatttaaaaaaaaaaaaaaaaaaaaaaaaaaaaaaaaaaaaaaaaaaaaaaaaaaaggggggagcgatataaaaaaaaccaggggtgaccccct

SEQ ID NO: 13111 - DNA, 2438 bp, Zea mays
  misc_feature (648)..(648): n is a, c, g, or t
  misc_feature (702)..(702): n is a, c, g, or t
  misc_feature (710)..(710): n is a, c, g, or t
gttgttgcaatacattttgttcatttttttctatttcttctttactaacaacatattctagttcctagctacattcttaagtaccatagtgctataaacattttttatcctacattattccacttaagaaattgaattttctgcataaaaaaattatatgtccagtagtgttgtcttataaaagcataaagtgattaaaattaaaaccattattgatatcttatttttcaaaaaaaaatataagcttatagaaagtgaattaatttcatggtaaattaatatagtttaaattgaattattagtgttattactatgtttattatcaatgaaacatttttcatggttgatataacttagtgttacttattttagtattttttatataattctagttaacttttagtttttgatttaaaaaaacgagaattgtgtccttttgtggagtgagtataaagaaagtaatatctgttcatcataatttggttttttaaggtacgtgaaacttgctttatatttggactcaagctatgtctaaatacatagtaaaaaagcaatatttctagaaaagacaaaacatcttataatttagaatcaaggaaatatatagattttatgtgcagtgagaagccatttacaatggaacgttcnacgttgggccaatagatattttgcgatatgatgatgggcatatttttgcatggntgtccctncactagctatagtttgatgatacgatacgctgcacacaccattgggttgtaccatgttagtgtagcaacagtagaaacccaattgtggccgtgaaccatgataatactaggtagagtgctagctagaggtttcaggctattgatgcgtgaattaaactttctgttgtgttgcgaggaaacgagtattgtgaaatatttgaaacggttttttttgtgaaagatttgaaacggtatttttgttgtgaaataaagatcaaggctaaataaattcaaactaataaaacatattaattgacggcctgaagcccccgcccccatggccccatgccatagcatcaggtcccacatgacatgaggccgcgcctccctctatgttggctccctgccttcgccgttgtcgtcgctcccgaactccctctcctcccctgttacaaatacccccacccgcccggacagcttcccagcacactcgcagctcgcacatctcatggtgtcctaagaacggcaagagccagctctgcctagcagcagcgcacagccacgtccatggacgccagcccgaccccaccgctccccctccgcgccccaactcccagcattgacctccccgctggcaaggacagggccgacgcggcggccagcaaggccgcggccgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaggtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcacccgcaccctccgccaagatttcgagccagtggggcgggtgtaccagaggttcgccccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggc

SEQ ID NO: 13112 - DNA, 6624 bp, Zea mays
  misc_feature (1279)..(1279): n is a, c, g, or t
  misc_feature (4872)..(4872): n is a, c, g, or t
  misc_feature (6025)..(6025): n is a, c, g, or t
  misc_feature (6069)..(6069): n is a, c, g, or t
ttgcatgcctgcagaaattcagtcagttagttacctgccactactctggcgcaagataagaatgtcatgcaccagatgtgcctcaattaggctgtatatctgcgaaactgggaatcagggtcaatttcgtgcttcttatcgttgcgactctgtaaaagttcagagttgcagagtatagcaaaagaacaccaccatgtcctttgttctcgctctctagcccattgtttctgcccagctaaagaaaaccaccaggatatatatgttaatttttcacaggcagttcgattataactttctagtgatctaatcgatacctactgttgactttaggaacagaagtttttccacaccagaaaagttgctatctggatttgatgggatgctgattttcctttacgacaatataaaagctattatgttgaattacttgccgacattttcattcaataattattacattgactgaagttgtttcccctgttttcttttcagctatgattattcaggctatggtgcctctacaggaaaagtaagtccctgaaatcctgagtgatttcaagggtagaattgtggtcctcttgtttcttgaatttgacattgagtcgcccttctggattaaattgtcatgtcgtatcttcaccaattggttttcttgaacaatcaccaattcttcttgtcttgagatcatgatgtctccttgtatatgattgtgccacattgttagggatgattactactagcaactgttagattggattgttccctatccttttagcgtatcaatcccatgttttcaatagatgtatgggcactctttctcatagcgaggaattattgaacactatcatccttagccgcatcaaggacaggactttggcaaatgtatggttagcccctttcaattttcacctacatcatcaatacttcccaaggaagggggaacggctgatcattgctttcttcatctagaccatgatggcacctttgttctgtagccattctttttccaaagtttttaaactaagggaccatcagcttaggtaatcatgcctactcaagaacttgcttggaccgtgaatgataaagttgcatgtgttcttgttctcataagtcacacatagatttatgtactaacggacacttcgatttagaaaaataataaataatggtaggtaccttctggtctatgcattgtgcacctagctgtatctgtttcccagattgtatgtaatgctggactaacttagttccctgtggtctaacacagccatcagagtanaacacatacaatgacatagaggccgtttatgattgcttgaaaaaggagtatgggatagaagaagaggatttaatcttgtatgggcaatcagttggaagtggaccgacattgcatttagcctcacgtctggaaaatataagaggggttgtgcttcacagtggtatactctctggcatacgggttctgtatccagtcaaagtgacactttggttcgacatcttcaaggtaagtttgcgccataatttgacaatttcactcctgctccagaacagctagcgtttactcagttatcctaatctgggtgactttcatatattttacagaacatcgacaaaataaagcaggttgactgccctgtgttggtcatacatgtgagtaggcttctgacctcgtgttcttaatctgaagtcatctaactttccttcactgtgagtgccttgctagcgtctgtattgatatagatgcctcttatacagttctgtgattttgtccctttctttttagaaaccaaattctgatgagctgtagccgcagatatttgactaatctgtcttactcacagcaagttattgacctatagcatttttcttgtatgttggtgtatcttgagtctgttttgacttgcgaataatcctcacttgtaataaatagcttgttcttcttgcaagtttaattttaagattctgaagaactaccactaccaagtagtagcagttccaactgtttgtgtcttgacttcgtgaatgaatcgtatatacatacatggcagggcacagccgatgagatcgtggacttcacgcatggcaagcggctgtgggagctagccaaggagaagtacgagccgctgtggatcaaaggcggtgggcattgcaacctggagacgtacccggagtacatcaggcacctgcgcaagttcataaacgccatggagaagctggcaaaggacagcaaggcggccagggcgccgccgtcgtcgagcatggccgacgaagtaagacgcaccaagtgcttgagattcgggaagagatgaggctggcggcgaggccatgcgggtctcggccgtctttagctgcgtacgccagtcactaaccccctgctgcattgcattgcattgctttgctgctgctcgtgccgtgtgcaagtcgaaggagcgatgtcactggtcgtcgatgaggaaggaagggactaaggaaagcaggcaggtgaatggggattgtttgcctgttgagttgtacgtgctgctctctctgcagagcgtcgacgacctgggaaggaaacgcagcagcaaccctaggtcatgtatgatccgtgtgagctgagttcagagtagagtagacagaaagacctgtggctgctgcagtgtgctgcagatcgggggagatgcctttgctttcctagtggttgtgcaaaggaattcgtagcgtaatttttctttctcatttttctcctacctgtattgtagtcactgtgcaaaggaattcgttttgattgattgattgattggttgctgcaacaaagtgaagtgcgctgtgacacttgacgacgtagaggctagaaacgagaccctgacgagtgacgaccatattgtttccttgcggcaatgttcgggtccgaccagaggagaccctgacaagtgacaccatcttccttgcggcaatcagtgctgttgagaactactaatcttccgtagatgcttcgagccaactcaaagagactatctttatcttttctaatctatataaatagagagtttcttgtctaagtgactatttaaatatacccatcttctatttcagtttcctcgctagccaaatataaaaaacgtgctttaaagtgcagataagatataaaaagtttgttaaagattaatagataacgtgagttttgtgcaaatgactcttcagatgataatgtagaaagtgaaatttagaaagattattggagatgttttagagcaactttaaaagactatattttttttccaattaacacaaatagagatttttgtaaaaaatatcgtccaacaacttatcttcaaaagaatgttggagatgttttcttctattatatatttttcgctacccaaagatagaaaacacgaataactcttttaagtgcaaacaagatacagaaatagctcttagaaattggaaagatatagaaaatgtttttttatgtaaatgagtctctaaatgatattttagacagtaaaatttaaaaagattttgggagatactcttagggggctcaaatgccgatatcgtatatatgtgatatttttgtgctatactacgggcacagtaactgtaactttctgcatgcgacccaagacagagagtgtgttaattattgatgggcgcataagagcatgtacagctctaatttataatattgtacggtactttaagtataagatatgactaaaacacaatataatatagtaaatttgtttagagcctatatcttactatatttattgtaccaattagaacatttaataaatgaaattgactaatcagctaatctcctgtctcgagcatagattcaagaataatgtcttcgtcaagatacgtgttttgaatttaactagcacgacccgtttcctttcactcgtaaaaagagacgggccgttttgtgggtggaatgacggtaacgggccgagacaaccagcccagttgcgtcctgatctcatctcacacatgcccgtagtagcctgtaggctgtgattgaaagacaagcgtcgttgggctgttggtcgggcgtgcactcgagccgctgggccggggaaccttgcgagaggcatgacttctcgctcgccctctctaggtctcaccgcatgcagacgacgacgacacagatctccatgtttgtgccgttgtgcgtaggcttgcagttgcaggggggcagcaggcatgcacgctgctgcgaggctgcagcctcgcctggccagtagccgccacatagcacagcatgtgcaacctgtgcaagcacgcacgctgctgcgaggcttggcgctctgcacgcagctggcgctagcgacctctgcccgcaaaatgacgggataaacaagccatctttgtcgtcttttgttcattagaataagctagcttgctagcttggttttaactcgttatctgaaacaagttaaaaagttagcgtagttgagcttatttacgaactcaagttggtttactaaactcgtgagtcaagataaaaaaatatataaaatatattagttatatttatagtagtagtagcaatgatacaaaagtaacacattaaatagctttaaatcaaacgtaaaccaatatatcataacatatatacaagtataacaatacaccttactattacgccatatatcaatggtcgacactctataccccatacataatgcatccataattatccatatatccattaaaaacaaagtgataaagttataataatctcaggttcataggtgtcacagtggacaaacatcggatatgtaaagtaccaaaaagaagagattggagagagtcagagcgtaagtatcgatgtgttcaacatgggtacaacaaaaaaccaacacataaacaaattagagagtnttagctaggccgcaacgtgtgtaatccactatgtcctcttgtactcattgactgatgaacataaaggtgaaaaagattacaagctcaagtttcaactaagcgtcatgatttcctacctcccctttccactttgtttaggtgggagttctatcctattgatcctaatccacctttatacatgtctttagatgttgtgagcgagtcaataaatgagagtgaaagaatcccctatcagcgagagtttccaaatctctcctatgggaccctcgaaatgttactctcctccctctttatagatcaatgaggagagagagagagaggttacatcagttggaccatgcacccgaccatctaagactcatccaccttgatcttatcctattagtgaagtcatacataaaccatgccttcagttgtgccatagtgtactggagatgtccttcttcagcgattgttaaacctgttgcaggggactcacatgttatatcacatctaaaaacaacgagccctataccgtcgagaaatgacatagctggtaggtggtatagccttatgttcttaataatacttcttggtacacttgacatacgcacacatggctatatagtcgatgcacgtatcaaatagtggttttcgagtacactgttatctgagcagtagcaatagtgcgcctgtcaaattgtattcttgcacatcacatttattgtggcgtacgggagaatcatcagatatgctagtgttatagacctactagtaggccctagacatggggtccatgtttcaaggtcataataccctcgtggaactagacacatccttctatcgtatgaacatttttatactttgtcacgtcaagtcccttgtttgcatgggagcccttgatcctcagaaggttcgaggcacgatcattcatgttaagcgagattgcaggtcttaggaccccaaggggttagcagagggcccgaagcatctaaatccttcattggcacccaagggcacaagggacacttaggacttaggtatttcatgagcttcccatggcacaaggggcatgtgtccttagattgttctggctaggaacatcatagagcattgtgccttaatccatatttatggattgacattgtaagtgtgggagctctttgtacattanaatgcatcgagccccttagtggttcttaacgggatttagtgtanatgtcatttcttctaatcgtgtagcatcattggcagtggaaaagttgtaaccactaagattgtatacgtctaaggtatggttagagttttgttgtcgccgtttctgaaggcatgcggcaccaaggaaggacaaggagaagaagtagatgaaaaaatatggtaaaaggagatagtagatatgtttttagaagttggcatcctgaatcagacgtgatccagccatatgtagagggggtggtattatctaatatgaaacaagtctgaaacatgttctctatgtttctcacatagcaaatagaccaaaaaacaattttgaaaccaaattggcttgaacttagtagaaaagttggctaaactggttttcatgggctcaggcgctatagacagacaaaaaacaagatcggttaacttagccaacttggggctcataataaattatgagcagttgcgtaatgtttttagggctagtttggtaactttatttttccgggattcttattttcccatagaaaataaactaattccccttacgaaaataaaatcacttgagaaata

SEQ ID NO: 13113 - DNA, 1074 bp, Zea mays
  misc_feature (41)..(41): n is a, c, g, or t
  misc_feature (96)..(96): n is a, c, g, or t
tcatgagctatgattattcaggctatggtgcctctacaggnaaaaccatcagagtgcaacacatacaatgacatagaggccgtttatgattgcttngaaaaaggagtatgggatagaagaagaggatttaatcttgtatgggcaatcagttggaagtggaccgacattgcatttagcctcacgtctggaaaatataagaggggttgtgcttcacagtggtatactctctggcatacgggttctgtatccagtcaaagtgacactttggttcgacatcttcaagaacatcgacaaaataaagcaggttgactgccctgtgttggtcatacatggcacagccgatgagatcgtggacttcacgcatggcaagcggctgtgggagctagccaaggagaagtacgagccgctgtggatcaaaggcggtgggcattgcaacctggagacgtacccggagtacatcaggcacctgcgcaagttcataaacgccatggagaagctggcaaaggacagcaaggcggccagggcgccgccgccgtcgagcatggccgacgaagtaagacgcaccaagtgcttgagattcgggaagagatgaggctggcggcgaggccatgcgggtctcggccgtctttagctgcgtacgccagtcactaaccctgctgcattgcattgcattgaattgctttgctgctgctcgtgccgtgtgcaagtcgaaggagcgatgtcactggtcgtcgatgaggaaggaagggactaaggaaagcaggcaggtgaatggggattgtttgcctgttgagttgtacgtgctgctctctctgcagacgtcgacgacctgggaaggaaacgcagcagcaaccctaggtcatgtatgatccgtgtgagctgagttcagagtagagtagacagaaagacctgcgcccccccccagtgtgctgcagatcgggagatgcctttgctttcctagtggttgtgcaaaggaattcgtagcgtaattttctttctcatttttcctacctgtattgtagtcattgtgcaaaggaatcgttttgattgattgattgaaaaaaaacccccccc

SEQ ID NO: 13114 - DNA, 3763 bp, Zea mays
cacggcggcctgcgtgccggaccatgtctaggccgtgctaaggcgtgctgggccatgggctgtatatcgggcccggcccggtttggacatgtatactcaaaaggacggggaagacgaggccgcaactccgcgggagcaacagccagccaaccacctctcgttggaacctgcgactgcgagttccacctccgcccgcccgctcgcccacgctcacgcccggaataggcagttgcagcagccagccagccccgcgcgccccgccatcgtgggaggaggcccatgccgcgggggcagcagggggaagggtagaatgggcaacgtcacgtcgtcggtggcggcgcggctggccttcttcccgccggagccggccacgtacggcgtcgagcccgcggccgagaacggcgccctgctgcggatgacgggggtgttgccggacgcgggcgtcgaggtgcgcgcgctgcccaccagggccggcacgcgcgtcgtctccgccttctggcgccaccccgcggcgcggctcacgctgctctactcccacggcaacgccgccgacctcggccagatgctcggcctcttcctcgagctccgcgcgcacctccgcgtcaacatcatgaggtcggtgagctcacatacgccgctctcccctccactccattacttttgctgctcgacttttggctcctcttcgttgtttgtacgccatccaattacgaacacacgtatcatccctatcctcttttgtttgcaacaacttagacagttgctaactgatttgaggagatctgattttgtccgtgttattgagcaatcggttcaattttaaaactctatctgtgaactcatgtagtcatgtgctcttgtagtcttgcttaattttcctttcctgaacagtgaatagttcgggcaggcctgcaggcctgcaaaagtacagctttagtgtctccgttgttttctgcatggcggttataatctgtcgtgatctccttgcaacgaatcctaggctagaaaaacaaccaagtaatctctctacttcctcttccttaccatgtagagaaggcatgtgatctcatgccttatgaacagtaccaattattgtactagtacatcgtttcacaggtctttgttgtgttgctgataaatgctgcaccggcctgttgtaccttcgccgtccttgccttcagaaatttcagttagttacgggtcaccactctgacacaagatcaaaatgtatatgtggggctctaactatgttgtatgtatatatgcgagaccgcgaatctgggtcaatttcgtgcctcttgtcaaagttgagagcaaagcaaaactcaaaagagcgccatgtcctttgttcttctagcccattggtttttgcccaaccaaagataacccaccacctttaaaaaaaaaggataacccaccaggatatatctgctactcttgtatcaagtctaagtttcatcacaggcagatggatgtataactttctagtgatctacacgacacctactgtatgactttatgaacaaaagttttttcacaccagaaaagttgctatctggatttgatgggatactttgctgacttttctcttcacagcaatataaatgtcattactattatgctaaccttttcattcaataattgttacattgactaaaagctgttccctctgttttcttttcagctatgattattcaggctacggtgcttctacaggaaaagtaagtccccgaaatcctaagtgatttcaagcgtagaagtgtggttaggttctcttgttgcttgaatttgacgttgagttgtccatctggattaaattgtcacgtcatatagtcctttttccattgaacaatcaccgattgtttttgtctcgagatcattttgtctcctgtttatgactgggccacattgacagggatgactcctactagccactgttagattggactgttccctatccttttagcataatcaatcctatgtcttcaatagatccatgagcaccctttcgcatagccacgaattattgaacactctatcatcgaggccatctctagtaggccatgtaaacgaccgtacaaaataatgtttgcaaagtgaagtttgaaataaagagtgaaataggaagtctgctggagatagtctttagccttatcaagaacaggacttcggcaaatgtctggttaaggggtgtttggttcctacctactaaactttagtgacacttttagtcctaaaataccaaacgaggtgactaaaataggtatttcaaataggatttctagaggttcaagtttagtcactaaagtttagaagagtgactaaaagaaccaaacaccccagtctctttcaattttcacctacatcatcaatgctccccaaggaagggggaacgattgaccattgctttcttgatctagaccatgatggtacctttgttccggtagccatactctttacagaagtttttaaacttagggaccatcagcttaggtaatcatgcctactcaagaaattgctcggaccgtgaacagtaatgttgcatgtgtgcttgttcccataagtcacacatagctttatgaactaatgaacatttcaatttagaagataataaatgatggtaggcacgttcctgtctatgtactatgcacctagctgtatctgttttccagattgtatgtatgtaatccagactaaccgagttccctttgtggtctaacacagccatcagagtacaacacctacaatgacatagaggctgtttatgattgcttgagaacggagtatgggatagaagaagaggatctaatcctgtatgggcaatccgttggaagtggaccaacgttgcatctagcctcacgtctcgagaagttaagaggggttgtcctccacagcggcatactctctggcatacgggttctgtatccagtgaaagtgacgctttggttcggcatcttcaaggtatgttaatttgcaccaccataatttgatttgatgatttctccctcctactgcagaacagcgttgaccttgttatcctagtctggttaactttcatgtgttttacagaacatcgacaaaataaagcaggtggactgccctgtgttagtcatacatgtgagtaggcttctattctgaccaccaagtagtttctactgtctgtatatatgttgactttgtgaaccaaccgtgtatccatccatatggcagggcacagccgacgacatcgtggacttggctcacggcaagcggctgtgggagctagccaaggacaagtatgagccgctgtggatcaaaggcggtgggcactgcaacctggagacgtacccggagtacatcaggcacatgcgcaagttcataagcgccatggagaagctggccaaggacagcagcaaggcggcccaggcgccgccgccgtcgagcatggccgccgaagaaagacacaccaagtgcttgagattcgggaagagatgaggtaccgtatcggccttctttagctgtgtacgcccagtcaagtcacgaaaacgctgatgcactgcgttgccttgctgccgctgctttcgtgtgcaagtccaagaagcgatagcacaggtcgtcagtgagccggccaggcggatggatggatggaggtttcctgttgagtttcatggactctctctttctctctctgcagatgccggcgacctggacctgggaaggaaacgcggtgcagcagcaaccctgtggctgctgtagtaaactgtacttcccggccggcctcgag

SEQ ID NO: 13115 - DNA, 1482 bp, Zea mays
atactcaaaaggacgggggaagacgaggccgcagctccgcgggagcaacagccagccaaccacctctcgttggaacctgcgactgcgagttccacctccgcccgcccgctcgcccacgctcacgcccggaataggcagttgcagcagccagccagccccgcgcgccccgccatcgtgggaggaggcccatgccgcgggggcagcagggggaagggtagaatgggcaacgtcacgtcgtcggtggcggcgcggctggccttcttcccgccggagccggccacgtacggcgtcgagcccgcggccgagaacggcgccctgctgcggatgacgggggtgtcgccggacgcgggcgtcgaggtgcgcgcgctgcccaccagggccggcacgcgcgtcgtctccgccttctggcgccaccccgcggcgcggctcacgctgctctactcccacggcaacgccgccgacctcggccagatgctcggtctcttcctcgagctccgcgcgcacctccgcgtcaacatcatgagctatgattattcaggctacggtgcttctacaggaaaaccatcagagtacaacacctacaatgacatagaggctgtttatgattgcttgagaacggagtatgggatagaagaagaggatctaatcctgtatgggcaatccgttggaagtggaccaacgttgcatctagcctcacgtctcgagaagttaagaggggttgtcctccacagcggcatactctctggcatacgggttctgtatccagtgaaagtgacgctttggttcgacatcttcaagaacatcgacaaaataaagcaggtggactgccctgtgttagtcatacatggcacagccgacgacatcgtggacttggctcacggcaagcggctgtgggagctagccaaggacaagtacgagccgctgtggatcaaaggcggtgggcactgcaacctggagacgtacccggagtacattaggcacatgcgcaagttcataagcgccatggagaagctggccaaggacagcagcaaggcggcccaggcgccgccgccgtcgagcatggccgccgaagaaagacacaccaagtgcttgagattcgggaagagatgagatgccggcgacctggacctgggaaggaaacgcggtgcagcagcaaccctagttcgtgtatcatccgtgtgagattgagttcagacttcagagtagagagtagacagagtggagtgacagacagacctgtggctgctgtagtatgctgtacgtgctggagttcaggactagagagatgtctttgttttcctaggggcgccacggattagcctgttcgcagctgaattttttcttgtttttttttctgttttcgctatctgtattgtagtcactgtgcaaaaaaaatcgttttgattgattggctgcaaaaagtgaagtgcgctattgcgctgtgactaaaaaaaaaaaaaaaaaaaaaagtcgacgcggccg

SEQ ID NO: 13116 - DNA, 3662 bp, Zea mays
  misc_feature (505)..(505): n is a, c, g, or t
ctattcctgacattctgcataggacggttgcagcctggaatttccgtggagagctagttacatcgtttgaggaccacgagttgtggcatcctaactgcaatacgaataacatatacatcactgctggccacgacttgatcatctcatattgcaaggtctcaaagcagagggcagattgtgttgacagtgaggctggggaaggtacagttaaattccactctaaaatttgtgatttcttggtgatacttcctatagccatcaaaataaaacctgccgtaccttttcagttctgtccatgggatcaattaacatgagcgacatctttactggaaagtgcgtcgccaagatctcccccgctgaccctactctcacaattgctcctcggaggagaggcgacgatagcagatctaccatccgcagtactgtcccggaagctcttgaggacatcactgctctcttctacgacgaggaccgcaatgaaatctacaccggaaacagcaagggnctggtgcatgtctggtcaaattaaccttgacatccaccccctaccttgtacatacctcctgtacctgcactcgtatttcccctcgtaggcggctaggcggctttgtttccgtctcaatgtatgttgattgaggccaatactagagtacccaaacccctagggctgatttaataaccaaggaattggaggggattgtacgggaggaatccactcgctatttaaaattgaatagcgaggggattcttctccatggatcttctccaattcactggtaaacaaatcagaccttgtagaacagagatgtaatttcatgtctgattatagcgggagtgtaacttcctagacattatatcattggtaaaagaatctgatgtagagtattgtttttggtgtaaaatgttttcacataaggtggtttattccaaaatctgttcaaagttttcgagcatttggaagtttcttcctatagcgccagttctgatgtgaatttcccctgttgctgtgtgattcacatttaaagtagttggccatcttagaaaaagagaatctgggcccacaagtcatctcattttagtattggacatgcattatctgttcctatccaatgattgttaccattagcgtgcctctcacactcattactgaactacccaaccatttgccagcagtaataatttaactacgagtaagtttttccaccgacgatggcacagcaaaccccaacgagcccatgacacgtggacccccactcatcttgtccccaccactcagtagcacgcagcgtgcgggcaacaccacaccaccacccacggccaccaggcagcagcccaccgccgtgtcctagcttcgtaacgacacaaccggccgggttatccctatcgccagcaagccgccaccaaaaacaacacgcccggacggaaaggtccgccacggacacagcgacacgcacgtctccctcccctagtcccctcttcgccgtccgggtcgggtgtttgcgaagcgagacaagccaccggtcgccgcgcgactagggtttggttgcgatggagccggcctcctcgtccgcgcttccttctcctcctccggccgaggcgaggcggacgccgccggaggagctgaagctgcggcggaggacgcttgagacggtgctggagcagtgccagcgcgcgctcgagatgatgcatgaggacggtctggggacggctgcggagggggcaagcttcaaggaggtggaggtggaggaggaggaggaggaggaggagggcagcggcgacagcggcggggtcgagagggcgccgcccccaccgccctcggaggccgactacgaggcggacgaggtgaggggaggagatctcgctgtgcatctcgtactttgttgttgcctgagggttcgtagcaatttgggttcgggtattcgtgctggtggctcgattgacgcctgacggggttagtttgcggcagttaggcgtttcctgatatgtggatgagagtagcttaagtgattaagctgaaccggaggttgctgcgcccgggactagctcagatctacatgaaattgctacaaatggagtggtcgcgcctcaatgattgtcttgctgttttgtggtattacgtgctgagtcagcagatgagtatggcgtttggatacagattggattggggatagggatacatactggtatatataaggcttggttaggaatacatgtatcagtatgatagtatgtaatacattttccatgtttgtttaccactgggttaaggattgagaaatattctttgaaaagtcaaaatacccaaagaaaaagagaataaaaatcaaaagcaacaacatgcatcagtggcatgttaccttctcggtgttgcttacttgcttgacggaaagcccgctggctagtggttggcttttgcaagcaccactgcctctcgctgtccaccacgacggcctcaccgctaccgaagcccccctcggtgcgggcacttaagcgatggcgaactgcacggaccccttgcgaagagcatccatgggacgaacccacaaacctggtgaagatattgtgacccaagatctactagcgcccggtgaaccttctggacggagcaatgctttggcctcaccccggagacggtagtcggcaacgccatggagctcgaccacactggcgcatagagactgctggcggggactgagagctagggagggatatgggtcaacttgctgatgaacgccgtcgtcggagctccgtccatccacgatccacgcacggggcgttgtgcgatgtcagcagcagtggctggctgaatcgatctccactttgcatggacccttatcatgttcataacccaccctctctgttgggatgtattctctgggttacgacaccttggtatcccaaacctgaaccagtgtgtttttccaaacccacaaaccaaacatgggttgaagggctgttgggttgttatatccctatcccagccttcatatcccaacaaccaaacgccacctgaagctcaaacttggcagcgaagcagttgctatatgtagtgggaagatttaaatgagattgcatagcagatgacgccatgaacttggtagttgctacgaattttggtaactgatttgtaattccagagtttttcacttcatggatttagcaaataaataaatagcagacaattcatagactttggagtagtttgatgtgttacaatgaattccttgtgcaacatggatccagactattcttggtgtgaagcttataccaattaaattctgttttcctggtcatcagtttgagctaaactgttttctctggcacttcaactgtggtctaaacagctttgtggcagccatgtatgttacatattgatgatagcataagtaagtttaggctttcactgtgctcatcgttttattttttcaagttgccctaagttttttgcatcttcattaacttgcagctatgcaatcttctgaaatcaagggttcaatcgcctgaatttctcgagaagctagatactcttcagaagtcagtatatcaacatggtgcaggtgcatttgctgtgcatgattaccctttgctggattcagaatttaaccgtgattatttttgtaatgcatgcatgcactgtcttgcccacaatttagaaaccccca

SEQ ID NO: 13117 - DNA, 1349 bp, Zea mays
gacggaaaggtccgccacggacacagcgacacgcacgtctccctcccctagtcccctcttcgccgtccgggtcgggtgtttgcgaagcgagacaagccaccggtcgccgcgcgactagggtttggttgcgatggagccggcctcctcgtccgcgcttccttctcctcctccggccgaggcgaggcggacgccgccggaggagctgaagctgcggcggaggacgcttgagacggtgctggagcagtgccagcgcgcgctcgagatgatgcatgaggacggtctggggacggctgcggagggggcaagcttcaaggaggtggaggtggaggaggaggaggaggaggaggagggcagcggcgacagcggcggggtcgagagggcgccgcccccaccgccctcggaggccgactacgaggcggacgagctatgcaatcttctgaaatcaagggttcaatcgcctgaatttctcgagaagctagatactcttcagaagtcagtatatcaacatggtgcagtggatgaaacagtatcatgggatattataagtgcggcagatatatgggatgataagagtatgaacgttagtgatgattcagaggacggatatgttcttgttaagcaagaggacatagtcgatggtattgcatgcttcatggctgcatacttgctgtcgctgaaacaaactaaggacctgacacccaaccaacttcaacaagctcttagcaagacattttcagctaaaaagaggaaaagcaaactgcagaaggcatgggatggaacgaaagttgtttataatatagcatcatggagcgcgacggctattggtatctaccagaatcctgcgattgtgcaagcagcaactgcagccttctggacatcctgtcgtgtaatatccaagtttctgtgactagtcatggctggacctggacggtgcaaatatgcaaacattgtgtggctgtggcctctccgtttctaaagatcaaccgaagatgaaaaaagttgccaaactccgtggcgtgcttagattatgatgtaaataggctgcaagttcgttgattgatttaacagcgacatcagttactggtgatgagcaatatggggctgttcgacagtatctcacccatataatctaaaggtatgaatggacacaccaccatctatttgccaataccagctgtatccgacaatcaagaaccgatgtacataagccctcccgcgcaacattggtatatcagtgtgattgtaaatatttcgattcatttgaataaattcgctcgcatgtgtttcaccccttcgcaggaatatacaatgctctaattgctatcaaaaaaaaaaaaaaaaaagcggcc

SEQ ID NO: 13118 - DNA, 1288 bp, Zea mays
  misc_feature (4)..(4): n is a, c, g, or t
cggncgcgtgggcggacgcgtgggctcagttgcgttgtgggtgatccactcgttcttccctccacgcgccaaaaccccagccacggccatctcctcctccactcctcccgtagtcccgttcgtccacatccaaaagcttcctaggagaaaaaaagaacagttatttgcagcgggaaccctaacaaatcactcgctacaagcgagcgagggagagatgtctctccagtgcgtggcgcccccggtccgagcactcgccgtgctaccagcgccagccccccctcgccgccggacaaaccatgtgtccctataccttccgagccggcggccagggctcgccgtcgccccggtccgtgcggcggactcgtcctctccgcccaccgtgcccgcctccgcggccggcaaggctgtcgtcccggacgacgagttctccctcgccaaggtctctttcggtgtgatcgggctggggcttgggctctcgctcctgtcgtacggattcgggtcgtatttcaacctgcttcctggttcggagtggtcagctttgctgctaacctacgggtttcctctcacaatcatcggcatggccttgaagtatgcagaactgaaaccagtaccctgcataacctacgctgatgcctttgctctaagagaaaagtgtgctacccctattctgaagcaggtcaggagtgatgttacacgttttagatatggtgatgaacaacacttggatgaagcactgcagagaatctttcaatatggtttgggtgggggcattcctagacgtaatgcacctatattacaaaagattcgagaggaagtaactgacgatgggaaatacagtttagtactcgtatttcaagccaaagcattggagctatctgattttgagaagagacaggctaaattcacctccttttttggtcctgggattaaggcagaaatcgatgcaggaaaaggtggcggtgatctatatgaagttcgtctaatctcagacactgtttagaaacaatctttgtgaattttctctattacaaaactaaacttttttctttttttttctttgatccgctgattttgcatatatgatgttaatagcatcagattttacccttgtttcagaaaaaaaatctgagcttccatgtatattggttgttgatccttggccatgacctgacaccttcatacactccatggacatgtgtgaagaaaaagttgttgtaatattagatgtaaatgaactttgattgggaacgctgtccatatagttgaaaggtatttagctgtttttttc

SEQ ID NO: 13119 - DNA, 786 bp, Zea mays
  misc_feature (566)..(566): n is a, c, g, or t
gcaaaaccccggccggccgggctcctgcccgcgcagtcttcagcacgcacaccaatcgcccacaagcgctcgcaggagaggtcgaaaccctagcttttgcggcgacggcggcggcggcgagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgaatatctccagaagctttgttcaatgtgcaaccaaatgcgatgtccgtttgctctggttagcttaaaaccaacgcttccaataatcctattggtgtcttagtttccccttatagtgttatttgctcggcttgaacatggcaacggaaatgaaacttgaactacctatggtactgtcatcaatttgagacccccatgattgacaaatttaaaaaaaaaaaaaaaaaaaaaaaaccaagccccgaacccgccccatacccccgccgccgccgccgccatgccgcccaagctcgacccgtcgncaggtggtggaggtcttcgtccgggtgacgggcggcgaggtcggcgcggcgtcgtccctggcgcccaagatcggcccgctcgggctctccccgaagaagatcggcgaggacatcgccaaggagacggccaagggactggaagggcctgcgcgtcaccgtcaagctcaccgtccagaacgccagccaaaggtctccgtcgtcccctcgccgccgcgctcgt

SEQ ID NO: 13120 - DNA, 698 bp, Zea mays
gacgtgcggccgcccgcccaactgggcgggggcccccccgcccggccgggcagtcttcagcacgcacaccaatcgcccacaagcgctcgcaggagaggtcgaaaccctagcttttgcggcggcggcgagagaagatgatctacgacgtgaactcccccctcttccgttccttcctcagccagaagggcggcgccgacaagaggaaaatggaggagcataaaccaaaggagcagaggcccaaggctaacgagaacaagcctgtgatgaacgaatgaatatctccagaagctttgttcaatgtgcaaccaagtccgatgtccgtttgctctggtcagcttaaaaccaacgcttccaataatcctatattggtgacttagtttccccttatagtgttatttgctcggcttgaacatggcaacggaaatgaaacttgaactacctatggtactgtcatcaatttgagactcccatggttgacaactttagtaaaaaaaaaaaaaaaaaaaagcggcccagccgtcgtggttggtacagaattgtgggatgccgtcatgttttcatgcttgcttgcttcacattcttgccctcttgtaattgattgagcaagtagtatctactgtcggtagggaagtggaatagtaggtcataggacggatcttcggccgctgcataagatcgaaaatccataactctgcttg

SEQ ID NO: 13121 - DNA, 555 bp, Zea mays
ttaggttgcccgcggtacgcgcgggcagtcttcagcacgcacaccaatcgcccacaagcgctcgcaggagaggacgaaaccctagcttttgcggcggcggcggcggcggcgagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgaatatctccagaagctttgttcaatgtgcaaccaagtccgatgtccgtttgctctggtcagcttaaaaccaacgcttccaataatcctattggtgtcttagtttccccttatagtgttatttgctctgcttgaacatggcaacagtgcaatggaaatgaaacttgaactgcctatggtactgtcatcaatttgagacccccatgattgacaacttttgtgccgctctcctgttacagccgtcgtggttggtacagaattgtgggatgccgtcatgttttcatgcttgcttgcttcac

SEQ ID NO: 13122 - DNA, 5641 bp, Zea mays
  misc_feature (3323)..(3323): n is a, c, g, or t
ttgggggaccctccgggctggccggattaaacaattactagttttggttttctctattgtcttacattctatcatttttcgtatgttcaaagaaaatgttattaatcttcttttctggtattttctaatcataccgcacctaattaggtttttatttgtgtttttcaattgtcctggctcctgagacatgaacttattgtatctatgtttttcataaagtagataataatgccttttcttttatgtacattctggaatgcactcctaatcaaccagaagcatgttgtactgatttgaaatgcaacgaggaataatgaatgtttattgtgacactaagaattgccaaagaatgtagttaaatacttaaatttgtttgcatatgcagaaaacatgttatggaccacctgggatagtgcaacagatggtagtagtagccatagattgggttagatttggaacttaaaatgtacaaacaagttgcacttaggagatttaggttttgtgctgccacatacagggctttcgataggggggagaatgctcacttatatgttatataagcatatattctaatcatccaaacctctatgtgaaagcaattgcttggggtcgttttgggagcttaaggtgaaaggaaatcattgtgcaatgaaacagcagggttttgtaaacctaaaaccatacatttaaaaaggcagcgagtcttgtgaaacaacacattataataatgaaaaatactttcacgtcaattacaacgagtcttgtgaagttgattatcgttatgtggttttgattttccgtattctttccagcaagttatttgatttgtgtcttgcttgctccggatgatgacaggaaaatggaggagcataaaccaaaggagcagaggcccaaggccaacgagaacaagcctgtgatgaacgaatgaatatctccagaagctttgttcaatgtgcaaccaagtccgatgtccgtttgctctggtcagcttaaaaccaacgcttccaataatcctatattggtgtcttagtttccccttatagtgttatttgctcggcttgaacatggcaacagtgcaatggaaatgaaacttgaactgcctatggtactgtcatcaatttgagactcccatggttgacaacttttgtgcagctctcctgttacagccgtcgtggttggtacagaattgtgggatgcgtcatgttttcatgctgctgcttgcttcacattcttgccctattgtaatgatggagcaagcagtatctactgtaggtcataggacggatctttcggccgttgcatagcatcgaaatccgtagctctgtttgttgcatggagtcatcgtcatggtctaatttgttttggctccccaaatttttgcgctgttgctggcctttttggtgttgcatgcgaagcctgaaagcgttgatcctggtttgcctctgttgctctagctactgtttgtttgattgacgtctgcttttgctttgcttctacatgtttgtactattgagtactggactgctacgatacacttcatgttcggaaggtcgtatcatgccgtttttgtcttgcatgggctagatgctgaaaataaccttctgctgttgtgttgcacgctaaaacataggagtactagtgtactactgaaggacatactgtcagtagaaactagcttgcagttatttgatgtgaaaccgtaacgccaatagtttgaggtgaccttggatcgcctgcatggctgcctgtcctctcttgaattggtttaggcttaggactctcgtcattagtcacctacggtacgtggatcgtccaactcggcccagttcatgcactgcacgatgctggagagatcttcccactcttttctgtccgccgtggcggcataggacagccagcttgctgccttgctcttcatcattccttggatgtcatggcagatttaaggtagtgttggttgcggagtacggtgtgagagagcggctctgttttcaatttgttgttgtttggtggttctatgtcggaccgagtgactctaaaaaaaatattgtgtttaaatgttgaactatcctgctctctcgggtggagccgctctctgacatggagccgttttatcgcaactgcaactggctctaaaaccaaacactacttaagtattattctcggtggttatcgtacctaacaatcttgtgccccctttagagtacagagatttcagaagaaccatacacaaaattcacagaaatcaattcatttcatagaaaaatcatatgaaagaggaaatattactgcattctaaagagggcctcggcgtattcacatgtttatgttcagcagcaatatcttgggcaatcagatgaggcaaggcaaggcacctagcgctagcagctcaagcagggacaatgagcggccacgctacaggggttggcccccttcctctaggcctagcttcggcaaaactgactgaatatatgtctaagagacaattacgatatataagaacgtcaacaactgtttaggataaaaagtttattaccgataatctatattggtttgaatgtagtcgatgtgctggtgcgtagcgtacaccttttttaaagtagcattggagctaggttatgcataatttttttacctagatggtttgcatattgacgatatgcataataatttagatctacttttttctttgattgtagcacggattgggactgcggtagttgtcgggatagcacacaacttgtttgcccatatcggttggaatcactatcggagcataaactcagttcacttttcacgtgattggatgtccagctcgtgggcgcaaggctcgcggcggcctggatgcgcagggatcctctctcccccatatctccacgcgtacaaactgatacaccaaaaagcctctgagttgcatcagtgcgtgcaagctcgtctccacgcacaccgcccaccaaacatcggctaagtgtggtgaacagaacgcggagggcctgaacgcacgcgactggccatccaatcacgcggtttgtctccggatcactcgcacaacttacatgtaccggatcgaatcgtcatcagggctaacaacatgtgtaactataaggttgggaagaacaacctatccgagttagatgtgcttcgttctatcccatacgattgtcaatatgattgaaaatagagatagttggaatgtctcaatttggaaacgccatttacatatagcgcatagattgatttcttggtaagtcttttgcgtctaacttaattctataagtttagtataaggaccacgacgtcatttctggttagcttggctcttntataaggatcatgatgttgtaagctgttcacaaatctatatcaatattaaagaatggaaatttctttctttcgtctcttacttgttcatcccatcttttcctcatccctctttctatctagagtctagacccatcatctcaagcacgtgtatatgtaataatacacgaggcaacagttcaaaggacatcaacaagaggcgccaaaactctagcacaatccacaatgcacatgacacgttggcgtgctgtggttgtttcttacatcaaatcgggcacttaaaatgattagggcttgttcgatttaaggtggattgagatggacaatccatctcaaaccgaacaaggccttaaaagtgaaaaccgcagtttcatagttttttttttttttttggaacgtcaaaacagttcgaagaacactcgtgtaatttactcctcattctaacagaaggcaaaacacgttctttcaaaagaaatacataacagagtatcatcacagcgcagcattgggtgcatataacatagtttggctagcagctccagcaaaatctagcagaaggaaaattttccctcccctgtttggtttatgacaaggatgccttctttcaccgcctctccttcgtgggagtttttgtttttgtttttgtttttactgaaaactgaggtcagaagaacctgttctcgttactctgaaccccacatgtcaccactttgctcggtttgatcttgcgtatgtaccacacgagcccccaaatgcctatggctgcagagaccgaggcgacagcgcttgctgcaagaaaatcgcccaaagctgtatcagccaacatttaggttgatttgattaagccgctgtgactgtgagtagcttatctcgtcaaagaatccatccaacagcaagaacagtcaacaacaaattaaagaacagtactggaactggaaaatttctcgcaacaaaaatggaatgcatgataaataaataaaatgggagtactactagtaatactgtgcgaaagcgtagttctcaccagcgacgactcctgctgatccatgatgtcctgagctgtggccatctgcaatgattcatacatggatcagatcatgatacagattgatctaaaagaaaataaatgggactgtgccggacgcacctgcgcagtccgtggtggagttgcgcccgtcgccgcagatgcagacgaagtccctggtggccgggtcgaagccgcacgtcccgccgtcgccgcggcgcttgtcctggcactgcaggcaccgcgtggtgacggggacctcgaagtccacgcgcaccccgtacgccggcacctggtcgtagggcgggaacgacctgtccccggcggcgccccagtacacgctggtgtacgccccgcagtgccgcagcatggcgcgcagcgactcggcggcgcgcggccggtacgcgcagcagctctggttactgccctcctccagcgcgcagcccggcagggttccggcacaggtaccccgcgctgtcgcacgccgagtcgcagcgccccgggtaccggtcgcagctggccggccggggcgccacgatcacgcgcgcctcgtcgcagtcgaagaagaggtactcgttcctcggggacagcgagaagcgcgtgctcgtgtccaggctgaagggcgccgcgtgcaccgaggtgaagggccgcgcgcacgtccacatggacgggtccgtcaccaccaggtgcgggtccgagtagtccgcgccgcccaccgggtacgtgcccgacggcgtgcgcaggcggagcgtcgcgttgtccgcgcaggtcagcatgttgcggtagtacgggctgccgcacccgtcgtcgatgcccagcgggtagcgcaccgggatgtcgccgcagctctcacggcagagccggccgccggctgtcgtcgatggcagcaccatcaccatgacggcgacgattgcaagcgtcgtcgacgctaacgcgtggagatgggggtgaggaatgatctcctccattggcgatcgaaagaaatgtcgcagtgcgagtgagagagagtatgctttgccacattttggatcgcctgtttgcgtgagtatgcaagcaacgaatcaagcaaaagatgggaggagtgtacagctgtttagtttaaggttaggctaggctaatgcttttacttttgcttttcacagctttcattctttcacgtgttgcttttctctctcttaattaacgtctagctcatgcttaactaaggtgtggccgaaggagatccaataaataaaaatctaagtttgcttctcaaatcttcacccccaaaacactagagacatgtttggttgtata

SEQ ID NO: 13123 - DNA, 1377 bp, Zea mays
  misc_feature (118)..(118): n is a, c, g, or t
  misc_feature (233)..(233): n is a, c, g, or t
  misc_feature (1195)..(1195): n is a, c, g, or t
  misc_feature (1210)..(1210): n is a, c, g, or t
  misc_feature (1239)..(1239): n is a, c, g, or t
  misc_feature (1260)..(1260): n is a, c, g, or t
  misc_feature (1272)..(1272): n is a, c, g, or t
  misc_feature (1283)..(1283): n is a, c, g, or t
  misc_feature (1292)..(1292): n is a, c, g, or t
  misc_feature (1317)..(1317): n is a, c, g, or t
  misc_feature (1330)..(1330): n is a, c, g, or t
  misc_feature (1377)..(1377): n is a, c, g, or t
ggggcggcgctatagaatagtgatccccggctgcagaatcgccgaggccattcctagacatctatttaaaaaaaattattagcatttaggggtttcaacaaccccttgggtgcttcanccaggttgggtggaagtggaagtcaccaatttctcatccggccccaattagctcacgagcgtggctaagctgatcgccggcgactgagcgacgttccgcagctaccgccaaatcnaaagagaggaccatgtgcgattgtgcgagtgcgatccggtccctttcgtggagtgacctcgacgaactgggccataactagtcaagccaggggcataagggctttaacccctggtgcactgactgggccgacataggttcaatggagaaatcataaggcccaacgctcgcgagctaaaacctcagagaaaaaaaagggtgactcactgactccactgctccacccaaaaaaatggcggcggcgccggaggagctgctctgcgcggcggcgaagtccggtgaagagggcgaagtcgctaaactccttgcttcaggagctgacgcgacccacttcgatgccgacggcttgacgccgctgatgcacgcgtccgcgggggggcacgccgccgttgcgcgcctcctcctcgactgcggtgcgccctggaacgcgctctccccctcgggcctctcggcaggggacctagcctccgaccccgacacctacgacctcctcctcgaccacgccctccgctccgagctcgtcctgggcaccgtcgcgcggcggcaagcggcccccgcgaacggtcccccggccgagagctacctcgaatccagggtctcgttcagcgaggagagggtgatggacgcggagagcaaggcggtgatgatggcgtgggagcggccgctgatggaggcgcacgcgcgggcggtgtgccaaggcggcggcaaggtgctcaacgtggggttcggcatggggctcgtggacgaagcgatacagaggtacgggcccgaggagccccccattgtcggggcccacccggaggggtacgagcggatgctcccgctcgaaaggaaagaccctataaaaagaaggaccccgctccgccaatggagagaccccacgctcggcctgaggacctaccccgagcaccccccccaaacaggcttttgagtggtacggggacccaaaggaataatcggaancccgagcagcccgtnccttgaactggggggagtagagccggagncggggggaagaggggggaganaaggaaggaggncggggcggggncggagaagnggaggggccgtcggcggaccacacncaacggccgcctnaggccccccacggccgcgcggagggcgtttttggaggaaagcgggcn

SEQ ID NO: 13124 - DNA, 918 bp, Zea mays
  misc_feature (819)..(819): n is a, c, g, or t
  misc_feature (842)..(843): n is a, c, g, or t
  misc_feature (847)..(849): n is a, c, g, or t
  misc_feature (912)..(912): n is a, c, g, or t
tccacgttcccactttattgtgtttaaacacctagaacatcctaatctaaaaaaatttaattagacatctagaggctatcaacaaacaccttgcgtgccttcaaccaggtgtggtggaagtggaagtcaccaatttctcatccggcaccaattagctcacgagcgttgctaagctgatcggcggcgactgagcgacgttacgcagctaccgccaaatcaaagagaggaacatgtgcgattgtgcgagtgcgatccggtccctttcgtggagtgacctcgacgaactgggccataactagtcaaggcaggggcataagggctttaaccctggtgcactgactgggccgacataggttcaatggagaaatcataaggcccaacgctcgcgagctaaaacctcagagaaaaaaaagggtgactcactgactccactgctccacccaaaaaaatggcggcggcgccggaggagctgctctgcgcggcggcgaagtccggtgaagagggcgaagtcgctaaactccttgcttcaggagctgacgcgacccacttcgatgccgacggcttgacgccgctgatgcacgcgtccgcgggggggcaacgccgccgttgcgcgcctcctcctcgactgcggtgcgccctggaacgcgctctccccctcgggcctctcggcaggggacctagcctccgaccccgacacctacgacctcctcctcgaccacgccatccgctccgagctcgtcctgggcaccgtcgcgcggcggcaagcggcccccgcgaaccgtccccccgccgagagctacctcgaatcccaggtctccntcaacgaggaaaggtgatggacnncgannnacaagcgtgatgatggcgtgggaacgccgctgatggagccccccccccggcgtggtgccaggncgcgaa

SEQ ID NO: 13125 - DNA, 1569 bp, Zea mays
ctcgaggccggccggagctcaacagccaccggagagcacggaggaaaagcatctccaaaaaccctagctcccatcccctcgctgggaagtctcgtcggcggcggcggcggagatgggcaaggcgaaggggaagcagcgtcaggacaagttctaccacctcgccaaggagcaagggtaccggagtcgcgcggcgttcaagctgctccagctcgacgcgcggttccgcttcctcccgacggcgcgctcggtgcttgacctctgcgccgcgccgggagggtgggtccaggtggccgtcaaccatgctcccgtgggtgccttcgttgtcggcgtcgacctcgttcccatacgccccatccgcggggcccactcgctcaccgaggacatcaccgccaccaagtgccgcgccgcggtgcggaggctcatggactccaacggcgtctccgctttcgacgtcgtgctccacgacgggtcgcccaacgtcggtggtgcctgggcgcaggaggctacatcgcagtcggcgctcgtcatagacgcactgcgcctcgctaccatgttcctcgctcccaagggcgccttcatcacgaaggtttttaggtctcaagattacaacgctattatgtactgtcttaaacagttgtttgagaaggtcgaggcgactaaacctacggcaagtcggtctacatctgctgaaatttatatcatttgcctgaaatacaaggctcctgcaaagattcaaccagaacttctcgatataaagcacttgttcagtgtggttccagaacagaccaaatctagggatgttatggatggtaggaaaaaaagacaccgtgatgggtatgaagaagggaatacaacattacggaaagttggtttggcatcagactttatatggtctgacacccaggcgccactagagtttttgggctcttacaatgcaatttcattcgataatccagaatccctgcccataaagaatcatgagcttacaacagatgatataaaaaatttctgtgaggacttgcttctgttggataaacatagtttcaagcatattttaaaatggcgaattcgtttacgaaaatcactgtcagcgtcatcacaagtcaccccaaaggtcaatgatgctgtggagagcacaaaggtcatggatgatgatgtacttctacaggaaatggaagaattgactagtgtcattgatagaaagaaaaaaaaaaaaaaaaagcgtttgtcaaagcgtcgagcaaaggataaagcacgcaaggccacaggaatgcagattgatgctacaggagatgattatggtgatcctgacttgttttctattagtgtaatcaagggtggaaaagaacttgaagctgttgaatcagcagaggttgatgtgcaaaatgaaattggagacagtgagaatgaggatactcaagctcgtgaacactccgatgaggaaatggattctgatgaggaacagcagaggtatgatgcccagcttgaggagatgcttgatgaagcttatgagcgctttgtaactagaaagggtggtgaaataaaacaagaacgcaagcgtgcgaaacg

SEQ ID NO: 13126 - DNA, 1002 bp, Zea mays
  misc_feature (969)..(969): n is a, c, g, or t
gcacgagaccattacctagaacatcctaatcgaaaaatttttccgatagggcgcccatacgggcctcctgttctagttattataacttgaaaattgaaagtaatcatcagcaccatatatacgccggtgtgaagcggccgcgcgaggtgctagtttcgttctcatctccgtttctctggattgtcccccgctcccctcttccggtcttccccatgtcggatgcgtataggaaagccaagcccggccgcctcgtcttcaagggcggcgaagccgcctccatccacaagccaaagaagcacaagaagaataagaagcccgcgtcggacgccctcgccgacggcgacatcgaggccgcggccgcggagggtgctgaaggcggcggaggtgccggcagcggcactggcgacgactacaccatcgacgcggcgaagaagatgaagtacgaggaactcttccctgtggagtcgaagaagttcgggtatgaccccgacaacgccgcccgcgctgccgcccggaaccgcaccgtcgaggaagccctcgacgaccgcgtccgcaagaaggccgaccgctactgcaaatgaggttcactcattggtcattgctgttgtttgcagctgtattgctcagtgtattgaagatggcctctttggagaattatgatccttcacggcatgttgtttagtagtcaaagtactagtcaagcattttccttatgcatatttgtactagtaattagcaaacataaggattcttgcacatgttattccgataaacttgttctgccctctttgggttgtttaagagaatactaccgcctggagattgtttattttgtagtgctgtgttttatgctaatggttagcaacttaatagagaccagaaggtgaaattgagtagtaaaaaaaaaaaaaaaaaaaaaaaaaaaaaaaaaaaaaaaaaaaaaaaaaaaaaaaaaaaaaaaaaaaaaanaagggccaaaaaaaaaaaaaaaattttgcggcc

SEQ ID NO: 13127 - DNA, 1284 bp, Zea mays
tgcatattgccgcagtggcgtgcatttcccatataccaaaattgtgtactttaatttaggattagtaaaactgtggttgcctaggaactgtgttgtaacccactgacacccttagttaagcaccaaaggatgtcaggggctactgtgcctatttctgactttattttgtaaggctaagttcctcgaagatcagctataatggatattagttgctgattggaactttgatagtgaacttttgaaattttcgttggcataataaatctgagtacatttctctgaaagaagcaaattgattttccttaagtttgatgtgattgttgttggtcccaattactgtgaactgctttggagcttttggggtatctgtagtaatttttgagaaataactcaataactgagatttgatcaagatgcaaagttaatgaaatgtaatacattctgggataggggtagtatttagatctgcatgtgtttctaagctacaaataacatggagtgcgagggtattgtttgcatatagtgaactaaattaggatgcagcaatgccagtccaatcctgtttccataagcattgttgaagtagccatgcactgttcagtcatgcatctgtactcaggtaatacaaagttcagttttgttcatgcattgaaatggtctgctctagaacatgtagcttttggtttaatttagatccactgcatgtcacttgggcgaaatcttctgttcatcgattcctttcatctgtcttcctaaagatgtactctctctgttcttttttatttgttgcattttagttcaaaaatgaactagcggaccacaaatattcgagaacggaagtagtatatgccaatccgtgtcattttactaattaaattcttggtattatttgtgttcattctcagatggctgttatattgtatatgcgtattgcttaatgggttgaatgtcttacgaattgcttcacatgatgtgttgaaactggctgtgcaatttatttacccaataggtatgcttattccttcacagtttaatgcatggccttatgtgtttactgcaggcgtttgcattaataactacatttcgggtgtgtgctaatttgcctttctaacccctatccgaatgtgctaatttgcctttttaacccccgttgacctattggattgtgccttcgccttttgcaattctttgaagtccctgcttattgcgtgcagatgtgtggtgctcttgccattttttcgactgctttgtcgttctgcgtcagtctgtgtttgcatgtctgct

SEQ ID NO: 13128 - DNA, 1164 bp, Zea mays
  misc_feature (1140)..(1140): n is a, c, g, or t
ctggccgggaatttatttacccataggtatgcttattccttcacagtttaattcatggccttatgtgtttactgcagtggtttgcattaataactacatttcggtgtgtgctaatttgcctttctaacccctgtcgacctatcggaatgtgctaatttgcctttttaacccccgttgacctattggattgtgccttcgccttttgcaattctttgaagtccctgcttattgcgtgccagatgtgtgttgctcttgccattttttcgactgctttgtcgtttctgcgtcagtctgtgtttgcatgtctgctgcgtcgtgaacgtttttttgtatcagccgtgcgttattgcactttgcctgttccattttttttatattcagggctagttttagtttgacaaccctattttccctcgggattttaataaatggaagggaaattagttcgttttcgttttctcaagggaaaatgggaatcccttggaggaattgagtttccaaaatagccctggtacgatatttacatgtgtttgccagcagtgtgaatcttcatactaagggttagtttagaaacttaaatcccctttccgattcctagagattgagtggaaattgactaatatcgcactcaatccccggaatcccctgtgttctggaactagccctaaatggtttatatgaatattctgttcttaccgagttgtgaactgctgaactctagttctgtgtatttgttacgacacctagcactagcaggcatcaggactctaggtgtgacacttgaaattgttacagattaagacgcactggcggtaccctgcgctcagttgctcgatactcgaggcttgtaggtgattgtatccagtagtttgaagaactggttatctaattatttattttccgtggatccaccattttggatacgcttcatcaatatataaaagagctccaattatgaaagttaggagaaaatggcgatctctaaactattcttgagttgtcgtccagctcccaagactaatggaattgcagtttaatgtctctgatatattgtaacgtgtcatctcgctccaaacttatacgttggtctgctgttacatgccagttctgtaaggagaaatggcaccgattactacttgnttagattggacaagctctctcctc

SEQ ID NO: 13129 - DNA, 2583 bp, Zea mays
  misc_feature (17)..(17): n is a, c, g, or t
cccacgcgtttctaaanagtactctctctgttcttttttacggggggcgggggagttcaaaaatggactagcggaccacaaatattccagaacggaagtagtatatgccaatccgtgtcattttactaattaaattcttggtattatttgtgttcattctcagatggctgttatattgtatatgcgtattgcttaatgggttgaatgttttacgaattgcttcacatgatgtgttgaaactggctgtgcaatttatttacccaataggtatgcttattccttcacagtttaatgcatggccttatgtgtttactgcagtggtttgcattaataactacatttcggtgtgtgctaatttgcctttctaacccctgtcgacctatcggaatgtgctaatttgcctttttaacccccgttgacctattggattgtgccttcgccttttgcaattctttgaagtccctgcttattgcgtgccagatgtgtgttgctcttgccattttttcgactgctttgtcgtttctgcgtcagtctgtgtttgcatgtctgctgcgtcgtgaacgtttttttgtatcagccgtgcgttattgcactttgcctgttccattttttttaatatttagagctagtttggcaacttcatttttccaaaggattttaagaaatggaagggaaatgagttcattttctctttgggaaaatgagaatcccttagaggaatggagttcctaaattagcccttatacgatatttacatgtgtttgccatcagtgtgaatcttcatactaagggttaatttggaaacttaaatcccctttcggaatcctagagattgagtggagattgactaatatcgcactcaatccccggaatcccctaagttctggaactagccctaaatggtttatatgaatattctcttctaccgagttgtgaactgctgaactctagttctgtgtatctgttacgacacttagcactgtgacacttgaaattgttacagattaagacgcactgacgataccctgcgctcagttgctcgatactcgaggcttgtaggtgattgtatccagtagtttgaagaactggttatctaattatttatgtactgtggatccaccattttggatacgcttcatcaatataaaagagctccaattatgaaagctaggagaaaatggcgatctctaaactattcttgagttgtcgtccagctcccaagactaatggaattgcagcttaatgtctctgatattatattgtaacgtgtcatctcgctccaagcttatacgttggtctgctgttacatgccagttctgtaaggagaaatggcaccgattactggaaattttacaaattggccctactacttgtttagattggacaagctctctcctcgtctctatttaatctcttcctctgtttttctctatttgccccttcgttcactctttctcctcccttttcttgtctcgttatcgtctgctacgccaaaccctagccccaaatcagtagcttgaagctgcccacagcgctccaaattgggatccacagattctgcattcatgaagtgggtggggtaaacggcttggggaattgtgtgtgctatcgtcatttaggcgcaggacgaaagggaagccaccgttgattactcctagactgaattgtaggcaaattgttgaggttcacgcggccatagtcgctatgacaatttctacatggccccagacacagggtaagttgaactgaagagctctgctccaaagaagctttgttaactacgttgtgttctttgttaacctcctgcccattttggcaccgggaggaaagttgcttgtatgctttgcaggatagctaaggaaaaggacattcttgcactgggacgacaacaaaggaagcgcacggagctgggcaattctcagtttagatgctcaagttgggactttggtgggtttaggttatggtcgtcaaaatgcctcgtatttgctaggcagagctgttctttggatgttgttggctgtggtgattgagaaggaataaatgtcatgtaatataaagagtactatgtaacgcacaccaccttttgttagaatgtgaactaccttttgctacaatgtgagatcaaatgtttgagtgaaaaaatgtcttgccattagtgaatatgaggtgatggacacaagtaggtgttggagataacaagagagttgccaatagcagcatctgttttgcttgccttcgtagtagcacggccaccttttcttgttggtcttcacatcatcacttttcttgttagtcttgacatccttgattttcccaactttgttgcagttgtcacaggagtacgcaagcttgctggtttttctataaatgcagagtcatgtgcaaccaataggtccatcatgcttgtgtgagttggctataaaggataatgtaataaagtgaagcatttgtgcaatatgaagtaaaaacatggaattgtatgtctggttaaatgctcaaaaggatctggaggaccattcttgttctttgtattcaaaaggagctagtggaccattcttcctgttctcggtattcaaaggaaat

SEQ ID NO: 13130 - DNA, 2031 bp, Zea mays
ttccgcgccgccggcccggccgggctctcgattaaagcaaaacagaggaataggggaggaaaaaatatttcgataggtctgcggtctgcctgcggctgcggcgccccttgattcatccccggctcgccttcgccggcggtgtcggaacagccagctcgcgctcgccggaggtgtcagggaacagctaggccgcgctcggtttccctttctcttcgcaggattggagccgctgggtcctgaactgcgcggcctgtttcagcgtgaatagcaatcaccatggggtctggatcactaacaatgaagcagaagaaacgagtgaaacatgcaaagaataagtacttgaaacctggtgccttggctcagattcgttatagtaggagtacgagcagggacatcgggaagaaaagaattctgttgaatgcgaaagatgagctggagttgcctccacaacctgaggttctcttagaaagcagtacaacaattttgtcccctgcaagactcaattttaagccatttggtagcaataaggggcagatattgccaaagactccaaagactcctgatgcatctgcgtttgatggtgattcaaatcttgaatcacttccacttgatttgctggtaaagatcatgtgttgcttacaccacgacgaacttaaggtggtttttcatgtttcaaaaaggattcgaaaagcagttgaacttgctagacagtaccatttcaactataccactccagatcggagcagacaggagttgctcctgaacagaacccctcttccaacagagcattggcccttcttaagaattgatggcaaggacgtccgcgtttccaccccaaggacaccaagggctccgaaacatgcctctcgcctttcacgcctcaagctggttgacgtgaagccaatcacagctgtccttttccaggagtctcctacccttttcccttcgaagcgtctccgatgctcgatgccaccaccaaggctggcaagacctgcgtgtaaagctgcaccttcgcctagagttttgcggtacgaggaggagctttgcgaggcggtggcgcagaataagcttctctgaagatgcaagaagtgcatggctttcgtctttagtgtatagcttatctgtgtcaagcccctagtttgaattttgcctaagctgccgtcttagattattgtcgtcaggttagtttttagactagtgccagactgtcttatattatacctgtaataagtatggagcctagctgctttattccatgagtttgtatatatcacataataaaatggacccctttttaatgccaaaaaaaaaaaaaaaaacccgtgcccgggcaaaagtggcgcttttcttattttcgtcattaggattctgcaggcgttgctttttctatgtttcaccttctgtcagttgaaatcagattgctgggtccttgaagagcagaggatttgtgaggcctgaatgaactcagtgtgtgtttgcctttgtgtttgtcaactgtcactgcctgtcctgattcagttttcatttatgcaatacaagcaaacaactgtcactacatgtacccattacaaactgggatatgatattggaccggtgatttctggagtcgtagttcacctacaagatcaaattcagcaaaagcctctgaaagcatggaccgcgctgtcatagcgccgaaatctccagcgctgcgctgtcatggcatccatctcagacgtcagaccccgtatcggtttatgatctgtgccatgaggaggtcgtagcccctctccgtgaggtggtaggtgtcccagaagaggaacttgctggggtccctgcagggttccgccgtgtaccggttgcacgtcagcgtcacctcgaacacccccgtgccgcagcacccccggttcgtcacgttgaatccgtaggcgtcagggcgctggatcatgtcgagcagcggcgtgtagaggtcgatgtactggagcacggaggccgggagcgcgtcgctgccgttgagccgcttgatctccttctccagcgccgcgttgaaca

SEQ ID NO: 13131 - DNA, 734 bp, Zea mays
ctagttctctcaaaagcgccggcgccgttcatctccccccccctctctctctctctctctctccccttcctctcgagttcgagtctcgatatcggcaaagcaggggacctacctattgtgcggctgcggcgcccgtcgttgattcatccgctggctcgcgctcgccggtggcgccggggaacagccagctcgagctcgctttcgcttcgcatcatgggagccgctgggttctgagctgcgcggccggcctgtttcagctgagatgaaactggaaaagaatcaaagttctgcatcacctgccacttcgaattttagagtgaatagcaattgccatggggtctggatcagggacactgaagcagaagaaacgagtgaaacatgcaaagaacaaatacttgaaacctggtgccctcgctcagattcgctatagcaggagtacaagcagggacattgggaagaaaaggattttgttgaatgcgaaagatgagctggagttacctccacagcctgaggttctcttagaaagcaatacactagttttgtcccctgcaagactcaattttgagccatttggtagtaatacagggcaggtattgccaaagactccaaggactccaaatgcatctgtgtcctgtggtgattcagggcttgaatcacttcctcttgatttgctgatcaagatcatgtgttgcttgcaccatgacgaactgaaagttgttttccatgtttcaaaa

SEQ ID NO: 13132 - DNA, 3370 bp, Zea mays
  misc_feature (50)..(50): n is a, c, g, or t
  misc_feature (2905)..(2905): n is a, c, g, or t
gctccgcggtgaggttggcgtagcggccgatgttgaagcggtcggcctgntggaagcggttgaggccgaagagcgcgagcgcggcgccgaagacgagcaggtggaggaggaagaccaccagccagaacacgtcccggcactgccgcctgggccacgccgcggggcccgccgccgccgccgccaccgacacggcccccgccgctgcgggggggctagggttcccgctgccgtggcaggaggaggtggaggaagaggacatggctgcgattggcggttggggaggtaggatcgggcggtatgaggaatggggaggattaacgagacacgtcctagagcaattagcgatgcggggagtagtggcaactggctaactgctcggcgctggtggtggactggtggtggtggtgactggtgcgactagggggagtaaccgtttcggtcatcggggagacgatgacctgcgcgagcgaactgccgggtgactgacggcgacgtcgcgcggaattccaggggagcaagggaagccggaagcggacgcggtttggactttcggaggagcgactgagggaggcggctggcaacgcgagtacgcgacgaatgggaagcccaaccaagttgcagaaacagccacggagagggttcggggttttcgtgttggggcggagcgcgaccggcgtccggcgtccggctggggcctgggagcgccgtgggcactttggacgcgaggatagctgcttggatatgacggaaatgccgagtggttgcttcggcgctggcgatttgcatttgctgcgctggatccagcgttcctcttccaacggcaacgcaaatatgatgatgacgggcgttgtccctgccggtccccctgcacgctgcactgcacggctgtagtagcagcacacgagatgtgcgtgtgaatgtgtgattattgcactccagcttcgtgacatctcatctcatgccccttcaatcaaagccaacgcctaaaaaatgacgatgtctgaagctgaaatgtcatcaagggagccaacgaatgtttttaaggcaaagttttgtttaccctactttaatgttcttccgtggcacgtgacatacctctcaataacaaagcagctgtgataactctgtccaccatgaaatctgcaagttcaatcttttcgaaagtactcgtacaagtaatttgtggatatagtccgtcttattgattaaccacatcatcttgtcatatattgactttatttgagcgtttttttttggttgtttatatatcaaaagcgtagggcgcacgagtgaatgtaaaacaaattattgtaagatttttagttgcattcggttatatgctcagaacttcagtttccagctggccaggctcatgtacacgatacattcataggtgtgttattggatatgtatgtcgagaatcatgtgcacatgataaatagtgtataaattaaagtataattatttatcttaaatttaccgttattctgtttattttgcaaataacaccctaaaagcgtgataatctgcactgcttatcgcaggtccatccacaaatctctccagggaccaggggaacggttgtcccgaatcgccggccgcgcggggccgctctgatgcaccaggcggtggtgacggccaccgggaccgggccccagcccccgctgccacaggcgtcggcggctcgcccccgggcgagcggagtaagaagcagcggacgcaggagccgtcctcaagctccagcgtggttggcgagtgctcgtcttcgtcctcgcaggctctgccgccaccgctgccggagcagttgctgcaggacgcaggagtgggcgagcagccgcctccaggccccgagcccgcagggggcgagcaggcgagggtgccggatctcggggaggacctggtgttcgaggtgctgatgcgagcggaggcccggacactggcggccgcggcgtgcgtgagccgcgggtggcggctgctggcgagggacgagcggttgtgggaggcggcgtgcgtgcgggagtgggcctgcactggattctccgagcagatgcttcgcagtgtcgtgcttccgcttggcggcttccggcgcctacacgagatgtacatccgtccggtccagcggcgtgctgctggagcgccgcgcgggcagcagaggcggcagttgccggtgaggatgggccgggatcaggtccaagtctcactgtctctgctctcgacctcattcttcctgaagatgcctaatgctcctccacctcctcctaaggacaaggataaagatggagataagaatggaggtggccagtgtgggtgatcactgatcaagtttgtgaaaaataggagcttacctcccatgcagcatcaccacaagctgcttatgttatgtaggtgattatgttgtggttcttcactgtatttgtggcagtaaagaggtgatcaagtcatttggattggtgggcagagaagactattcagataggtgcggatgtactgatcgggaggcaaataaggtgagcgagattggatggaattcattgcaatagcgtattggatgactaccaagtctgtgtgttgtacctaaattacacacgaaatgggctcatctgtaaagtttccatgccatatatgtgaatatgcgaggtgccaagagagatgcagcatgctctttgtgctgttgtgccatgggaataagggtgagcctcttagggcttcatcatgctctttgtgctgttgtgccatgagagtaagtgtgagtctcttagggcttgtttagttgtatggggattaaaggggattgagggacatacaattccttgctagttaattttggagggggattgagaggcatacaattccttattgttctgtttgaaatccttctcttacacgtgggaaggattggacttanggtctgtttgcaagctcacattttttaagaaattggtttatagaaactagagtggtttcaaatatactactttatgtcctagtttatataaactggagtctttgtttcttaaaaaccaagaagctactctctcctagctaaaaccagcttttatttgtttaattacatcatgctcttattggtttcgtggaatttacatctattgccaccgttttttaaaataaaggaagggtatattaataattgcgtatcaaaaagctaaaaactggtttgttaaaaattgagttccaaacacctcaacccaactttatttttcataaatcagtttctacaaattgtttttttttaaaaaaaaactgatgtgcttccaaacagactcttagctatttaatcttataatatatcttagaccctgtttggcagcaacttaacttttaagaatccagtttatatctccaatttcca

SEQ ID NO: 13133 - DNA, 1099 bp, Zea mays
ttttttttttttttttgggataaataatgtataaaataaagtataattatttatcttaaatttaccgttattctgattattttgcaaataacaccctacaagcgtgataatctgcactgcttatcgcacgtccatccacaaatctctccagggaccaggggaacggtcgtcccgaatcgccggccatgaagtgccgctctgatgcaccaggcggtggtgacggccaccgggaccgggtcccagcccccgctgccacaggcgtcggcggctcgcccccgggcgagcggagtaagaagcagcggacgcaggagccgtcctcaagctccagcgtggatggcgagtgctcgtcttcgacttcgtcctcgcaggctctgccgccgccgctgccggagcagttgccgcaggacgcaggagtgggcgagcagccgcctccaggacccgaggccgcagggggcgagcaggcgagggtgccggatctcggggaggacctggtgttcgaggtgctgatgcgagcggaggcccggacactggcggccgcggcgtgcgtgagccgcgggtggcggctgctggcgagggacgagcggttgtgggaggcggcgtgcgtgcgggagtgggcctgcactggattctccgagcagatgcttcgcagtgtcgtgcttccgcttggcggcttccggcgcctacacgagatgtacatccgtccggtccagcggcgtgctgctggagcgccgcgcgggcagcagaggcggcagttgccggtgaggatgggccgggatcaggtccaagtctcactgtctctgctctcgacctcattcttcctgaagatgcctaatgctcctccacctcctcctcccatgcagcatcaccacaagctgcttatgttatgtaggtgattatgttgtggttcttcactgtatttgtggcagtaaagaggtgatcaagtcatttggattggtgggcagagaagactattcagataggtgcggatgtactgatcgggaggcaaataaggtgagcgagattggatggaattcattgcaatagcgtattggatgactaccaagtctgtgtgttgtacctaaattacacacgaaatgtt

SEQ ID NO: 13134 - DNA, 751 bp, Zea mays
  misc_feature (1)..(1): n is a, c, g, or t
  misc_feature (8)..(8): n is a, c, g, or t
ncggccgnagagccgtaccagctgttcgcggacccggcggcggcggccgccgtgacgccggcgctgctgcacttcttgccgcccaagagcgaggagcagcagagctactctgggtcatcgtcgctgtcctcgtcgtcgtcgtctgtagtgttcgacgcggcgccgcccgtgggcctgcggctggacctcaacctggcgctgccgccggccgagatggtgatgtgattgctgccgtccaggaggctaatcgattgctcagttaattagtcaccattagtagctaatcgatcaaggcagccgtcaggcagaggtgtaaataggatgcagatttgctcggttttcgttgactgtgatggcatggtttgtttcttcgctgcgagtcacgcaacaatgcaaaagcaaaatgaaaagagagagggagagggataattatgccccagcggctctcattttattccctggattcacttctgagctctcgttttattttttactcgacccgcttctgaaacctctcaaggtctgagagctgaaccgtaacgtgtcacgcagcgtggagttcgcagacgcaggcacggggacgccgacgacagcacgaatggatggatggataccgtagagcagctacagccacatggcccacatgggcatcgcagaagcatcgatcaatagactgggagcgccgccgccgcctgaacgcgtcgctgggcggctgggcaagcacggtgaggtttcgctgcaggggtaccga

SEQ ID NO: 13135 - DNA, 490 bp, Zea mays
gtcgctgtcgtcgtcttcgtcgtcgtcgtctgtggtgttcgacgcgccgccgcccgtgggcctgcggctggacctcaacctggcgctgccgccggccgagatggtgatgtgattgctgccgtccaggaggctaatcgattgctcagttaattagtcaccattagtagctaatcgatcaaggcagccgtcaggcaggtgtaaataggatgcagatttgctcggttttcgtttgactgtggtggcatggtttgcttcttcgctgcgactctgcgagtcacgcaacaatgcaaaagcaaaatgaaaaaaagaaagagagagggggataattatggcccagcggctctcattttattccttcgattcacttctgagctctcgttttattttttacttgacccacttctgaaacctctcaagttctgagagctgaaccgtaatgtgtgagacatcgcccgtttgtgtcggattggcaccttagaactattcctaa

SEQ ID NO: 13136 - DNA, 1404 bp, Zea mays
ataccgaacccggacgcgcctcgtcgtagcgaggcgatgaccagcgcagctgcagcatcctttcttgccataaaaaaccccgcgactctggtcagagagggagagcgagctagaagcctagaaccggcaggaagccagacgagcggagccaccacgcgtgagctgcaacgtaggcggcgggggcatggcgggccggctggcggggcgaggcgggaggccgctgctaggcggaagtggcgggggcgggaagcggggcgggaggccgtcgatggcggtcgtggcggcgctgctgctggcgtgcgcggcgctgctcctgctcctggccctcggcgcgctatcgctgcccggggcctccgacggctccggaggacgcggtgcggggctctcgctctcgcgcccccgctcgcgcttccgcagatccgccttcgactcggggctagagacgcgtggggagaagggggagccgtggacggaggtgctgtcgtgggagccccgcgcgttcgtgtaccacaacttcctctccaaggaagaatgtgaccatttgatttcactggcaaagcctcatatgaagaagtcaacagtagttgattcagcaactggaggcagcaaggacagcagggtgcggacaagttcaggaatgtttcttagaagagggcaggacaaaattattcggacaattgagaaaaggatagcagattacaccttcatacctgtagagcagggtgagggtcttcaagttctccactatgaagttgggcagaagtatgaacctcactttgattacttccatgatgattacaacaccaagaatggaggccagcgtatagcaactcttcttatgtatctttcggatgttgaagatggtggcgagactgtgttcccttcgtcgacaacaaacagcagctcgtcaccattttataatgagctgtctgaatgtgcaaagggtggtctatctgttaaaccaaagatgggagatgcgcttctgttctggagcatgaagcctgatgggtccctagatcccacaagcctgcatggtggatgcccagttataaaaggcaacaaatggtcatcgacgaagtggatgcgtgttcatgagtacaaagtttagatacaaaaagacacagacctgaggtcatgcaccggttcaaatgcgtggacattttggcacatgtcgagagtttcgattttccatagaggattaatttacagttcatcttttctagctgttactcaggcaatgtcttaggctccgtgttgtacattaacatgttaggctgatgaacataaacgataaacctgatgattcagagatggatgtgttgggtgtatgccattgcccttgttcgaatcaagataggatgtcttattgatgttgaaaaaaaaaaaaaaaaaaaaaaaaaaaaa

SEQ ID NO: 13137 - DNA, 1187 bp, Zea mays
attcggctcgagggatgcctatctactggactgggacacgcggtaccggatcgctctgggtgctgccgaaggcctgcggtatcttcacagcgactgcaagccgcaggtcattcaccgcgatatcaaatcgaacaacatactgcttgatgagatgatggaggctcatgtgggggacttcggtttggccaaacttattgacatttccaactctagatcgatgtctgctgttgctggttcctatggctacattgctccagagtacgccttcaccatgaaggtcactgagaagtgtgatgtctacagtttcggggtagttttgttggaactgctgacggggcaatctccaatccagcctcttgagaaaggaggagaccttgtgaatctggtgaggcggatgatgaacaaaatgatgccgaacacagaagtgttcgacagcaggctggacctgagctcgaggagagtcgtggaagagatgtccctggtgctaaaaatcgcgctgttctgcaccaacgagtcaccgttcgataggcctagcatgagagaagtcatttccatgctgatcgacgctagagcgtcctcctacgactcattctcttcgccagcatctgaggcacctatagaatatgattcgtccccaaaaaattagaggccagtgtcgtcaatctattttaccagtcatgcatcgagggagcatccatagatcaacttcgctcgtagctgaagaccatcctagtctgaaatattgtgttccaagaagttgttggctatagcctgactccaaatggaaaagagaccggtctttctgaccaagactaaccaccagttgaaggctagaagcatgtgaagtgaagttattcactcctactacacctcagctagctagtgctctttcaatggaggcagacacctttgagtgttccttttctgaaacactcagctaggcaaggctgatacgttcacttcagcagaacatacagattcaactatcgctagctttaacactgtacatactacatagaccatagtgcggctactattaaataatgatgatgacagattattaatctctggattgattttgtgcttctttttaacttgttactaactgtaatgacatggtaaaaaaagtgaataattaccgtgttcgtcggagtcgaaccaaaaaaaaaaaaaaaaactcgagaaga

SEQ ID NO: 13138 - DNA, 3718 bp, Zea mays
ataatatacccaaagatttagctttaaataggagtgtatgaaaaacaactatacatgtgaccgaaccttgacttgtggattgcctagtagggctgatagtagtacactggagaccataacaaaaggtagacttaaggtataaaagatgtataccatggtagataatttacagttttcttactattacagtcaacaaaacaaagaataagtcaatgttcaagtggtgctgatgtttgcaattcaatattcttcgtcacgtacttcaccatagactgatggaacaaagctaagaagtaagctgaatagaaaagggaaaggtacaagggctgccattgcttgcaaggggattgaacgtccaagaagaacaagcgatgatcgctttattgatcaagtgcatatgttttcttgctcctttctatgtacacttcagcccacatcttaatttatctttctgatgtcggggttaacaaattcaccttgcatgtctgaaatacatggatctcactgaggaaatattgctgcactaggtgctccacagacatttttttgttttgcttttgtcctatggaagtggagaaacatgaggggaaagtgttttctccaatttataggatattagatctagaagactagggccgtgtttgggactgcttttgatgaaattatcgagtgctggccgctagaattgtgccaaatagagcatgacacaggcaattcttttcaccgcacaaggcacacgccgcaagtttgaactggccactccatcctgatgccgcggctcctggtcggccgcccgactcctcctgcagatacaaacacagcctaggactgtagaaaatcaattttctaacaaagattaatgatgaatgccagttcttttaaacatgtcatgttcaataaccgattaacagctttgcattttagcagtcaatcattggcatcttccttgcttaattcatgatgttgtatgtaacacagtgctatgtaaaggtggatgtctcctacaaagagaagaggacttggtcgccgtggtcatggtcgtggaaggggtgccacggcagaaaaggatatggatcatctcgatatctctgtaccttcttcaccaagtactacctctgacagagaagatcagcctctgttgattccaagacaatccccagcttgctatgtaggaccgtcagaagtatccaccatgttactgaaccctaagatcaaccatcgttccgatgcgatttttggtgatcaggtttgtttgatgacattattttttccatgtccaattataagttacatgagactgaattatacaactccactgaatctgaacgttgcaggctgtggagcagctgaagttacgtcatcacaagcctctgaaatttcatgagagatatcgtccttacctgagagatgcaggtttgcttgggctctcacaaatttgccagaagatgcctcagttggacaaagcattgataactgcccttgttgagcgttggaggccagagacccatagcttccatttggcatctggggagataactgttacacttcaagatgttgcaatgttgtttgctcttcctattgatggtcgtccggtttgttctaccactgatcatgattatgcgcaagtggtccttgattgtttaggcctggatgcaaggggtccagcaatgcctggaaagtctttcctgcattacaaatggcttaagaaacacttttatgaattaccagaggaggtggatgatatgacagttgaaaggcatgttcgggcatatatactgagccttttatgtggggtgctctttccagatgggacaggaaggatgagtctgatatatcttcctctgatcgctgatctttcacgtgttagcacatacagctgggcttctgcagttctggcattcctgtaccgatctctttgctcggttgcctcctcccacaatatcaagaatattggtggttcattgcttctcttgcagctttggagttgggagcgctttcatgttggcagaccattggttcggtcacctttatgcacagagatgggcattgaacatgacttacctccaatcggcttccgttgggtggggtcacgcacacaaagtgagagtgctaatcgctgccttaagcagtacagagatgaactgaacgttcagcgagttgatcaggtgaagtgggaaccctacctgcaggtagagtcctcaaccttacccccactttgtacaagagacgcagacctgtggcttacacaagctccattaataaacttccctatagttgaaatgtatttgcccgagcgagtgatgcggcaatttgggcttcggcagtgcattccaccacctttccggcctacactacagtcgttacatcgtatcagtagacgtggcaaagaacgagagaactgggaagaaacacaccatgagtatatccaggaatgggaagcacgacgacagcgcatatttcgagatacagagcaatatgatccatcttcttatgaggagtatctgcgctggtactcaggagcaacacggcggtaccttgtcccagcaaccagtgacgacggtgaagcgggaccttcagctccaactgacgatttctcagatcttcagtaccaagccaaatctccaataatccgcaaagcagttgataaactggaaagcatggttaagaaagccaagagagccatgacaaccacagctgatacaaccactcaagccttggttgctgagtttctgcttggctttgaggatgtgttacaagatcttggcgagatccagaataatagtggttcaactgttccaccttttcacttggatagtccacattttgatgcagccgcaagtcaacagacacctcaacctttgcttgaagctgaggaaaatttagataccaacaacccaagaagcacaactagagggagatgaagaacttaacacagtggagcgtgcttcattggcactggagcctgtggaagagttaaacgacttctccaacgacgtgctccctggaaatctttcactgggcgtggaggaagactgtgattcagccacaccagccaatgggatttgtgatgcagccactcccatgaccgatttggttgttcctcggtcagatgagggtctccatcaagatcaacatctagaagaccacaccgaaattgagccggctacattgatggtggagcctaagtgtgaggagggcgatggttccagcttcgtgctcccaccaagccctccagaactgatgctcgaggaacaggacgattcagggttaatagctctaggtactggatcatgtaccgaacagcagagccttggagtaggagaggctgaggatcaggaaaaccctcgcacaggcacagctcagcatggcatcatgatagtggagcgtacgggtgaggaaaacagcagttgcaatggcgtttattcttcctgcccaccgtcatctgtcattgttgaatcgagcagtgattatctgtgttagttatgtagggagtagaagctttttttatatttaaagatctgacatgagattgttagttcctttgttgctggtggcatggggtttgattctgtaacttgtttcgtcgtgattgtcttgataatatgagggtcttgaaaaccgggggccgttatacgccgacccagttggagtgtaatcctcagcgttccgttatacagcctcgtttgtctcctgccaaaaaaaaaaaaaaaaagcggcc

SEQ ID NO: 13139 - DNA, 1184 bp, Zea mays
cccacgcgtccggaaggcacagattctggcttggcttcagtattaaattcactggaggggtgcctaaaaccatgtgggtctgaagctagcatattagaggatttatcaaagtcttccatcgtggtgcccacacggagaaatcttgttgagaatgaccgtgttttgctgaaccgtgcacatcgtgctcaacaagaatatgaaagagtggccaactattgtcttaaattagctggcgaacaagaaaaggtggtgagtgaaagatggcttccggaactgagaaatgcagttcaagaagctcgaaggtgttttgatgactgccagcgtgttaggggtctggttgatgagtggtacgagcagccagccgccacaattgtggattgggtaacgatagatggacagagcgttggtgcctggatcaacctcgtgaagcaactccacatggagatctccagacggacgttggccatgtcatcggtaggagacgactgaagcaaccagccgtgacctgcggctttggaagttcggaggctcctttatgggttcggtttggcgccaagatatcttctatctactcgatagccttttcccattgtagtttatacgtctctctctctggtttggtctgtaattagttcctaacatgttccttttgtatgttgtcaattgtcatgtgctggttgtcacttggctcaaacgatcagtgttggtgttgtgcctttgctgatttgggttgtttgtatgttgtcaatggtcatgtgcgtgttgtcatttggctcaaacgatcagggttggtgttgtggctttgatgatttgcgcacatgtgtgttcaatcagtccgggaattgtttcagttataacgttcatgtaacttagggtatgtttggcaccaaaatatgtttggcccattttgttatggcttgcttgttaaccttgatggttatcatcttgtcatttttttctttgaggagatagggtgtggtagccttcttgttcaactaggtgtgtgactgtacgttgtcacatgagttaaaaattagtataaatatatgaggacatatctggtgcacataaaagcttagtgcacatgatgcacatattaaatcatcactatccatcttagatctaacgtctctagttgatcatcgtaatttataaataacaccttccaccactacatccaccac

SEQ ID NO: 13140 - DNA, 1550 bp, Zea mays
actaaactagtgcggggtataaagctctctccctccgcgcttccgaacagttcacgacgactccagaggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaggtgaagaaggtgctccagaacatcagcggcgtgtaccgatgcgaaatcgatgcccggagcaacaaggtcgtggcgacggtctcgacggagctcgacccctacatgctggtcgccaagctgcgcaagtccggcaagcaggcggagctgtggccggagcagccggtgcagcagcaggagcagccggcaccaccagctgagagccaaaggcaggaggagcccaagaacaaccagcctgcggagccgggcagacccagcgaacctgccgaggagcgcggcgccgccgccgacacggccgaggccgccgcggcggagccgagcaacccgcaaccttcgccgccggagcccaagccgagcgccggcggagaggccccgaatccggcggcccaggacagcaaagaaaacgccagcgccgatgacgtcggcggcggcgacgagaccgccgcggcaccggcaccggcaccggcaccggcgcagcagggacccagcgaggcgaaggggaaagcgaaatcgaagcagcatacggcggagatggaggagaggcagcccgtggacgccagagtgactgtggagtacgaccaccgaggcgtcggtgggggctacgtgagccgcatgccgccgccggcagtcatgagctacaaccaggggcgcccgagcgtgagcgcgtcctactacgcccccgccccggctccggcgccggcgccgatgccgatggggaggcccgggccgtcgcagggctacatcgacgagcactacacgccgtcttacagcagcagtagcaacaactactactcctccaaccggtcgccggcgtacgagccgtactactacagcgctccgcagccggcgccgtatagctaccagtaccagtaccagccggcttcttcgtccgaggattactactacagcgcgccgccgcagaggagcgccttctcgccgccgcgggagggctacggcgacatgttcaacgacgagaacgccaattcttgcaccgtcatgtgaagggaggatgcatgcaaacatggaagtagtagctagtttacttacagttccttattaatcaagcgactcttcccctctctctctctctatatatatctgtgtgtgttagtagattttagaatcagtaattaagtacgagtaaggagatgtattaaaagcactgttcagtcttgatggcgctgaataagttgagagctgagcttgaatgcttgatgcatgtaccaaccattatagatagaggggagaatctgaggatctgaatgaacagctctggtgttcatcccagcaaaattttgtaatgtacgacccggtcaaaatggatacttccaatctcttcaacttgttc

SEQ ID NO: 13141 - DNA, 2722 bp, Zea mays
tgaattctggtcctgagcatgcgtatagtttacattcagttttatttataaaacttggtgtcacacattgtttgcgtatagtttacattcagttttatttaccaaaatctgccgatcatcctatttatgtcatcacacaggcatttggttagatcaaagtaggacatagcgtaagatgaaatcgcttgtggtattagctttgatgaaagtctacttcatttccatcttttaatagcaacttctccttccaaccatgcatgaatccgctaccgtagcctttctttaagttacgaaagtaagcttgctttttgattttctccatgtaaactagcaaacccaagcacttggcatacatagcttattcatggcttcgggtgccccctgtagaacatgtatagaatcctttatatgtccccggcccgtgtgtctgtgttcttactgaacaaaagaaggtttccccttgtttatcatttccccgaacaagactacagtataaccgtacgacatgccgcagatgaattgcattcaggagaaacaaggaatcagaccccaacaatagatgcgagttatactcggagctgttgcacatggtggaaaataaaaaccggacaactacaaacctgcagtagtaactgttttttagggaggatttacgttttctttttgacgtttccttttctggcccgtttgtgatgcagtggaaaactgggccgaaaacaaaactcgttgtcggacccgaaacaaagctcagcataaacctgcccgaactgagctaccacgctgcacgcccagtaccaccaaatcgatggcccatattggatccatattgtttccttttctggttctggacttctggaacacgggaagcgggaagcgggaaccggagaaactcgccgagaggacggcaatgctccccacacgggtcccttccctgctcgcccatgccgtgcggtgcggttgcagagttaacttgccggcgacagactccgcgcccctccagctcggcgccgtgcgcggccaggacggcgcattcgatgctgcagtgctgggccgccgtggtggttgcggtgccttatttgccgtatccgtacctgcaaacacaagctgcgagcagctgaaccgtccgcctgtttatattaacaaccgtgtggttaacaaccgtcacatagatgtgatttaacacacaaacccacaccaattgatgtgaaacccacacaatcccatcgtcacgacgccaagatcgtgtgcgagtgcgactgtgcgcacgtctccgtctcgcttgttttaagcacggcaagggaagaggacgacgacgggtggacgcttggacaaacagccttgtcgtgtactctctctttctctcctcccacagttccgctcgattcgaagagtccagcgccacacgacatcctccgcgcggccggccatgggggaagctgcggatccagcgacggggagggtgtcaccgccgatgtcgtggcgtacgcggctctccgtgctcgccgcggggtacctcaccgacgccacgcgccgcgccgacggcacagtcaaccgccgcctgctcggcatgctcgacaagggcgtggcggcgtccgcggtcccgcgcaacggcgtcgcctcgcgggacgtgaccatcgacccggccgtgcccctccgcgcgcgcctcttctacccctgcgctcccgccgccgccgaggacgacgacgcgggggcggagcgtccggcggtgcccgtcgtcgtgttcttccacggcggcggcttcgcgtacctctccgcggcatcccccgcctacgacgctgcgtgccgccgcatcgccaggtacgccggcgcggcggtgctgtccgtcgactaccgccgctcgcccgagcaccggttccccgccgcctacgacgacggcttcgcggccctccgcttcctcgacggcgggcccgaccccgaccccggcgcgatcgcgggcgccccgccgatcgacgccgcgcgctgcttcctcgcgggggacagcgctggcggtaacatcgcgcaccacgtcgcccgccgctacgcgctggacccttccgccttcgcgaacctccgcctcgccggcctcatcgccatccagcccttcttcggcggccaggagcgcacgcccgccgagctgcggctcgtcggcgcgcccatcgtctccgttccgcgcaccgactggatgtggcgcgcgttccttccccacggcgcggaccgcacccacgaggcgtcatcccccgacgtcgccaccgcgggcatcgacggcgcccctgatttcccgcctgccacggtcgtcatcggcgggtacgacccgctgcaggactggcagcgccggtactgcgacgcgttgcgcggtaaggggaaggaggtgcgggtgctcgagtaccccgacgccatccacgccttctacgtgttcccggagttcgcggagtccaaggacctcatgctacggatcaaggagatcgtcgccagcagcgagtgatgggggacggacggcgtgggcgcgcgcagctgtcgctcagatgcgtggtggatgtatctgcgactgtgctaagtggctagggtcagtgttgtggttgtggactggacggtgctgtctagtgtgtgacgtggttcgtcgtgtgggacgcgccacaattaaactagtgttaaataatgatgcgatcggcaatgataattctaattttcgtgtttgaaaaaaaaaaaaaaaaaacggcacgag

SEQ ID NO: 13142 - DNA, 1387 bp, Zea mays
gtccaaacagaacctaaagtgctacaccatggacgctcgtcgctcggtcctttgtttgaggatactgacgctcgtatctaactagtaatcgtatgggccggaccaaaatttcggatgcagcccaacatagctagttttcgctgaagcttctggcccaacatggcccgatcgccgccggcgagcgggtcttttctgctcgtactccccccggccggccggggccctatatcctaaccagaatcaaacggtccaaaccccaagcccctcctcgcctcctcggccacgcatggggaacgcgcggcgccccgccgctgactcggcggcggcgtcggaccgggaggtcggatttgcgaagctacatggcgagtgcttcgagtactacatgcagacctactccatcgttctaggtcgccatagccgccgtcgcagcaagggccccgtcgccgccccgccggaggccgacgacggcgtcgacgtggacctcggcgccctcggagcaggcatgaacgtctcccgccgccacgcgcgcattttctacgacttcctgcgccgccgtttcgcgcttgaggtgcttggtaagaacggctgcctcgtcgagggcgtgcaccacgtccccgggtccgcccccgtcaagctcgactcccaggacctcctccagatgggggacaccaagttctacttcctcctcccctcccgctccgtcttcgacgccggcatcacgcgccgggcctccgccgttcagcgcgcgatcccgccgcctccgtctgatgatgacgaggatgaggatgaacatgaagaggccgtggcagcggcgaagcgtcggagggacggttataacggatcaaaatcttacagggaagcagatgatcaactattgcttcagttggaagagaaagatgtcatctcatctgctgctactatcttgtctgatctctgtggacctcaggaatggatttctataaacaagcttcatgaagtgatgtttgataagtacggcggtatgtggcaccacagcagggtgcgaaaatacctgacatccgaagactttgcggaggctgaaactgacggcaggctatggcatggacttgcgttgctgctgagaaagtaccctgagcatttcgtgatcaacattaggaaaggtgggggcttgatcactgagttcgtctctttggtctcgctacagtcttgagaatttctcaaaacacactgctgcaaggcggtggtgttgtatagctcggagtattcttttgctaccttttgtaaaaaaaggagttagggtaaaagggatttgtgcttaagtatttggctatttagccaagttataagagtgaggctatacaatagtggtatcttatctaaaaaaaaaaaaaaaatgcggcctattttt

SEQ ID NO: 13143 - DNA, 464 bp, Zea mays
atgatcaaaaggaccatttggtgcgctgctctatattatgtgcttggcagttccttgttgcagttattgtttaaaacttcttgagatgtttgataagtacggcggtatgtggcaccacagcagggtgcgaaaatacctgacatccgaagactttgcggaggctgaaactgacggcaggctatggcatggacttgcgttgctgctgagaaagtaccctgagcatttcgtgatcaacattaggaaaggtgggggcttgatcactgagttcgtctctttggtctcgctacagtcttgagaatttctcaaaacacactgcagcaaggcggtggtgttgtatagctccgagtattcttttgctaccttttgtaaaaaaaagagttagggtaaaagggatttgtgcttaagtatttggctatttagccaagttataagagtgaggctatacaacagtggtatcttattta

SEQ ID NO: 13144 - DNA, 1715 bp, Zea mays
  misc_feature (1406)..(1406): n is a, c, g, or t
ccccctggaggccccgactgaataaggactcacaagctgtcgtcatacaaacgggccacactttcatgctcaagtcggccttattttcttaaaggaattagacgggtttgtatgatatatctaaagtcttaaaatgtgacccggtttcgacgcctccccgcacttcgcgggctcctgaccgcgcgcgtgccgacgcgtgtgcgctggccggacccgagcttttcgtttgattcagcagaaccgttcgcgttgacatccgccctcttcccctcttcgactcacggcccacccactgcacgcgcaagcgagagggcggctccgcctccgtcccatggatggccgccggcgccacctcatggtgttcacggccgcggtcactgctaggtggtggtcccggcgtgctagatctcacgcctccagggcaggctccctcacatgggtcaccgtttcctcatggtgttcacgggcgcgctcatcgctcgcagcgtggaggcgtcgatctgcatctatgatcgggagctcttctgcgaggtggacaatgcctcctcctctctggccaatacttctctaccagtcgcctgctcccgaggggaggggcgctgggatacaggcccgcagatggcgtcgactgtgcaggcggccatgatcgacgaagcctcctcagatccgtgctcatcgccaccagggtgatagcctttgtatctcgatcctgctcagcatctcggtggtcgtgcggtgccagctggttcggtcggggcagcaggcgctcctggcacccgcctatccccgagggcgcgaccaaagggagtccacgacgaggaagcgacagggccgaaatcagatatgaatgccattggagggttagtactaaattcttgttgatatttatagttttctctatttacataggtacaataagccggcgaagtttcgtggtggaatcagcagggtgcccaccggccggcgaggccccggctgcccgaccggccagccagtcggagtcgggccgggtggtctccgtcgcagggtacgtttccctatctgaatctctctgtctgtcttcttctccgagacgcaggaaaccatttcgtcgagataattttagagctttttttgttttgttttgccccaaccgtcaatctttgtgcagagtggtgtgatacgtaatgctcgagtagagttgttgagacgtacctgggatgttgggggtaatttcttgagatttagaactaggaggaaactgaaagtcgccaacttgcctatgaagtttgagttcccaggttgcctatgaattacatatttgcatccattaggtggctccattttattttgtaggaataccagagattttccttcggagcatccaatcggctcagcggggcaaaacctgcgattcgaattcctantgaaaactaactagataacccttttggattgctggtgttcttaaacaaaacgaagatgaaagatagtagtacattgcagctggggtgacaagtgttggataaacccatgaattggcctcgttgaattccttaaattctcaacaaaatgttataggattctacagaagcacataggtgataggtcgaatttcgttcatgtctccttaaacaaaaagggcaaatatttttcattacgttgtgcgctatgctaactgaaatgttcaggtcttgtaggaaactaatagcaaatacagtaccctctgcacatga

SEQ ID NO: 13145 - DNA, 2579 bp, Zea mays
atccgccctcttcccctcttcgactcacggcccacccactgcacgcgcaagcgagagggcggctccgcctccgtcccatggatggccgccggcgccacctcatggtgttcacggccgcggtcactgctaggtggtggtcccggcgtgctagatctcacgcctccagggcaggctccctcacatgggtcaccgtttcctcatggtgttcacgggcgcgctcatcgctcgcagcgtggaggcgtcgatctgcatctatgatcgggagctcttctgcgaggtggacaatgcctcctcctctctggccaatacttctctaccagtcgcctgctcccgaggggaggggcgctgggatacaggcccgcagatggcgtcgactgtgcaggcggccatgatcgacgaagcctcctcagatccgtgctcatcgccaccagggtgatagcctttgtatctcgatcctgctcagcatctcggtggtcgtgcggtgccagctggttcggtcggggtagcaggcgctcctggcacccgcctatccccgagggcgcgaccaaagggagtccacgatgaggaagcgacagggccgaaatcagacatgaatgccattggagggttagtactaaattcttgttgatatttatagttttctctatttacataggtacaataagccggcgaagtttcgtggtggaatcagcggggtgcccatcggccggcgaggccccggctgcccggccggccagccagtcggagtcgagccgggtggtctccatcgcagggctatcaactttagatcttgaacatgggacccaaatcactggcctggagcacaatatcaagaaaactagcttatgattgcagatctcacccatgggtttaatgagtcaaaaaatcaaaattttcacggaaggtcgatgatgaggtatatgatgctttggccgaacaccttctttctatcttggaggatattgaaaatttgattcaaagtaagcctttcctgttggtgctgtttcgggacattgatcgttgcatggtcatgttcttctattgtagacttgcagttatcaaagttgggttggttttgaatgtcctgcactaggacatgttaattcttgaacatcgccaattatgtttgtggtctggttgctttcactcttgattttaattttaaaaaaacatagttgccctaaaaaaaaaaaaaaattttttgggtcaagcgtattaactactaatttgcttccaagagaatctgtagtgattgttcagttatctagcttgggaatggataaatatattcaagaaagtctatatagccaccagatgtctataaactatagagatgagactgtttaggatatagttttgaagaaaacatcttatcattcatttttttcacaatgataatgataaaaagattaccgtttgttttcatgtacatgaatgttttttttgcatcgttgtattgtatatccttacttgtaaacaatatttatttaacatttgtccaagtaccaaattaccgcaaggttgtgtctggtttatgcacaatagccgaggattaaaatttgcattacatagaaatattttgaaataagttttttttggagaagtatatcttccatgtcacttacaattatgagtgttaaaatgatcctaaatgttcatgccttagcaacgccaacaaaattccactttgtgatcctgaattgaggactaagacagtaatcagttcaagcagtaccattttgtgttatcgagtggagggtaatgaccttaaacatgtcccttctttacgcatatatagaaatttctgaggatgctaggattctttttgaagaaagtgaaaaatcgagtcattgttctgaaatgctgaaagaatatcgtcccagtaccatatatatacctcccattgtgatatgtcccttgtggctcctcactcctgtttttccttgtgcttgatgggtgccttcctcgtgatggatagggcaccgataggatgcccgaaggggcgctgcctgatctagtctcattaagaactactaagatatccggggtcactagtgcccggaatgtcccaggctagaacaatttaagcccttaagcctctcatatcctagggcgcttacgaacaacccaagtcattaggcacctcatgcccccatgagcttgcaaagtatctaagtttctagggccctcatgctcgggtgcgctaatgaaggatatacgtgccctacgccctccatgtccatcccctaggccactcaacaaaagacagtctcttggggccatctactggccctagggtccctaaggcccttggcctcactaatgtgaatcactaggtgtcgaccccctaggctcgaggcctcccgtgggaacaagatatttgatatgggtaagtgtaatcctgtatacaagatagaaagatgtttttagtcccatcaagggcattacgatcgtgaagtagggaccccatgtttagggcctaatgtcagttccgtagtgcatgcatattggataagtttcctttacaacatattaaatgtgtgacgtgcaacattacatattgataggtgcactagaga

SEQ ID NO: 13146 - DNA, 2921 bp, Zea mays
  misc_feature (908)..(908): n is a, c, g, or t
  misc_feature (966)..(966): n is a, c, g, or t
  misc_feature (1124)..(1124): n is a, c, g, or t
  misc_feature (2914)..(2914): n is a, c, g, or t
cgtgcaatcaaaccatccagagcatccaatctagatccaacggtttcatatgtaaggggttaaaagtaaactaggttctatgtttcaggtggaaagggttaaatttaaaataacagtcatcattggatctagattagatgcaccaaatcgcttgattgcacgtttgtaccaatataagtgactgcataagatattttcccgttcaaactgtctcaaccgatattggacaagcttttcttcaattggttctacctttagtctatggcgtatattttcattcgttcattccggactcgatcccttcttgtatggccacaaatccaatgtaacacacatattttcgcaacacttatctgttgaacatgtcgtctttttgtagaccaatattctgcaccatacaacatagcaggtcccatcgtcatactataaaactctccttttagcttctgtggtatcctcttatcatatagaacgccagatgcttgacgcaacttcatctaccctactttaattttatggctaacattttcatcaatcttcgtctctatgtagcattgatcctaaaaacctagatgtgtccttcttaggcactactagcagcttactagcggttgaacaccaactggttcatagttgttccttctgagatttcatataacagggagggcaggatcaccccctttggccccaactaaccatactgacataatcctgtagtgtgttccttccaagaaaagttcaaactattgaatgcaattatgcaaagctatgcccatacaatcaatttacaccctgtttggacacatagttacaaagttacctgtgagagatttttacgtggtggtaacgagaatgaccccgcctatccgggtcatggacgaagttcccatgtggctaccactgtaccnattccttgtgactatggtttggaacacgagtgttacaatacaatttttcttcatgaantaggagcccccccccccccctaaaaaaagagtaattggggactttatgatttgtcatatgcaacccaacgatcagtttttgtgaagttcatagaattttaaaattcctctagatgttcaaatataaggaatgcgttaagccttattaaccaacaatancaacaagaagaactttatctaacattgttacttgttaagcctgaatgttttggtactgatgcacttaacagtactactgtattgcactttcatctacacaggaagaactttatccggcattgttactcttccctgcggagaacaaaagtgcaatagcatatgaagggggaatgtcagtgtctcacttaatcgaatttttggagtctcatgtgagcaattctcgctatctattggaatataaaggttagtggataaacatcttgtgactgcattggttctacttaaaatatttgaatttgcttatagttctgtaatgtgtgttagcttacactttacaacactattgtttcttagaagttgtgttaatcttctcatacatgaaagtactaagtatcaaccttgctcatgtgctgtttacctgtttggcataccagcctagtttaccattcttatctagactggcagctgcttggctgtggattacgttgttctagacgttcctagacgttccccaaacctgaagtgccaccacactaaggatatgtgctgtttggttcggcacatgtggttcggcctaatatataatctgtaacaaggatcgggtacgggttgtgcaatgctgataccacattaccgcccacctcccagctttgtctgattatgcccgcggactcccttctcctgttctcttctcacaactttgtcctctccactcaacttgcggatctcacattctcgcccctatgttccgtgtgttgccagcctgtttgttcccagccaacctgttacctttgttgctagccaaacacaattaaggaaatgcaagatgttaaaaattcgaaccaaacgaattgtattttgccttacactgtgacagattgcactgcaacctgattacattagcagtacgactcccaggaccgaaccaaacagcattagttaaaatgtcacatgcatgttctgaagcttattttcttcttggtactcaggatttatgtggaagaagagaatgacaccacagcacgatgcaccacaggcaattcagtttaaagtcagtgataaaggtagcggcaatgttggttctgagttaccaagtcatccaggtgtcgttacaggatccatccttactgccactaagaagctcgggaccgcagttccatttgataatgccaaggtgctcattgtgtcagctgattctcatgaaggatttcatggcttgatcatcaacaagcgattaagctggggtgtcttcaaggatctggatagctcgatggagcctattaagcatgcaccacttttctatggtgggcctgttgtggtgcagggttatcatcttgtaagcttgtcaagagtatcctcggaggggtacatgcaagtcataccaggcgtctattatggcaacatagttgccacaagccgggtagtcacacggatcaagttgggcgagcaatctgtcaatggcctgtggttcttcctaggctactcggggtggggatacaaccaactttttgatgagctaactgaaggagcatggcttgtgagtgtgaagccgattgagcatttggactggccgaagagttgaaagggttctgtggacctcacgcctcagctgtttctttaggaaaattcagttcatcttgcacatatctgccactctgcccacactgcaccgtgacattgtactgagcttttttttggaacatagcagcactgtgttttcataccattcaccccgtactatggtcacatattttttatacatagtacttttcttatagtggaaaaaaaantgagttg

SEQ ID NO: 13147 - DNA, 1357 bp, Zea mays
gatttaataaatttctctcaacgtctgcgtcctctctcgtctccacactccggcgcacgcggcacgccgcacccacgaatccttcctcctcctcctcttcgtcccgatccacctgcaatcggatggtctcgctccgctgcgccgttggtctgtgcagcagcgctcaggttggttcgagctggccgctcttccaatccccccaccgcatcgcagttccgtccgtggccgcgcgtgacgtgacgtctcctcgagcgcctagcgcgtggtctagatcggcaagcgcggcatccatggagacagccaggctcacgccgagggagcaggccacgaccaggatatgtcaggtgtcgagctttgcgacggaactgctcgagataaggtccaaagagccgtccctccacgtgctgcttattgctgggaacccagggcatcgctgcgttttataaggactgtgtcgaggcgctctatgaaaacctcggtggccaagcatctattacagcaatagggcacatttcacacagccagaaggattgcgagcatgggcgattgttttcgttgtatgaacaaattgaccacaaggttgatttcattgagcaagagcttcagcattctgaacaaccaatagttttggttggtcattcaattggtgcatacataggcttggaagtcttcaagagacttcagaataagataaaatttattgtaggactgtatccatttttaaagatgaacaagagttctgtaacacaatcagcaatcggatatatagcaaggtcatccctcctaagtaaatgggctagtttatttgcatctttcattgggtcactccgaccttcaataacaaggggcattgtgagaaggttccttggaccttcatggtctgtaacagctgttgatgctgcatgcagccatctcttaaggtacaacacaatgcgcaatgtccttttcatggcaatgacagagttccaaaagcttactgaagaaccagactggactttcatcagagcacaagaggacaaaatggcctttttgttcggtgtggatgatcactggggcccactatctcacttagaagagatatcaaagcacgcaccaagggtcaccctgtcggttgaaacagaaggtcacacacatggttactgctgtacagaggctggatctgtctgggttgcagactacatcgcaaatttgattaaaaaccaaatgctcctttggaacaactgaggttcatttggcagatgtatcataagactcttttctccgaaagaagtgaatagctggagtgtggtggaacttattgaggttccggttttgataatctagtccacatttttttggctcaaaaaaaaaaaaaaaa

SEQ ID NO: 13148 - DNA, 492 bp, Zea mays
aaaaaacaaggagcgctacatccaggccagcagtttccatttgcaatccgaccccatcttcatcccgttgtcgcagcagcagccatccaagcagcgatggacggcggcaagaagagccggaacccgcacaaggcctccgcggactaccgcagcgaccgcaagtcagcctccgggatgagcggcgaccccaagaagggcggccgcggcggcaagttcacctgggagggcgccgacgactacggctacggctacgccgacgactacggctacggctacgccgacgaggacctcggcctcatctccaagaaaggcaacagcaacagcggacgctctagccaggcccagggaggcggcgccgctaagaaggacgacgacgagtaggcctcgccgcctcggctcgcccgcccgcccgcccagtcccgtcgatcgccagcaagaaccaacgagcccttctggctgtttaattccagtctcagttcgattctcatgttg

SEQ ID NO: 13149 - DNA, 584 bp, Zea mays
aaaacaaggagcgctacatccaggccagcagtttccatttgcaatccgaccccatcttcatcccgttgtcgcagcagcagccatccaagcagcgatggacggcggcaagaagagccggaacccggaatacagctgctccagctcttcttcagtcccccaggcagtgatgagctgaggagccaggagtttgtcagtgtcgcgcctaccaaccggtccagcctccgcgtccaagatctctccctctcccatccactactgtctcccacagcccgttcgatcccccggccgggccggtggtcgccaaagtcgaggacgaggagcaatggcgaccgacgcgatcctggagacgatcaagccgcgggggagcgaggagcagctgccggtgaccacggcagggaccgggatcgagctgcggcggcgcatctcctccttctcggcgcacgtgaggccgtcgttcctccgtggcggcgttccggcgcgcgcggtcgatgccctccgtcaaggcgctggcggcggctggcgcgctgcggcggtggtgggagtgggggctcgagtgggtcacggcaccgttcgcgacccgccgc

SEQ ID NO: 13150 - DNA, 2955 bp, Zea mays
  misc_feature (788)..(788): n is a, c, g, or t
tctatgtatgatacaacaactacataacataggaagtagttagacctctgctagacagggcccactattcatccacatatgtagctctccctccttgagatataaaagggaggtttaggataatatagaaggggattcaaaggtggcttcacttagcctggcttggtttttttggctttgctctagttcgggtttaattcaagttagcacatagtaaaagctcttgcttgagtttgagctctctcgcttggcttaggactagacatcacaaggggcagctagggctctcttcactagctagatcaaacatcatatgagcatctaatttgtacccatacccacacttgcattgaaacattaacctacaaaaaatgtagggtattatgcccaggcggcccaaacctctctatattgtgtgtcttaaatgcatgtcgacatcctgatccaactatcccattcctacacccttctctcattgattttctctatatagtgacatttggcgcacacgaggtaggcgtctagtgcgctttgtattactgcatcgacatggcttcaccgacacatcaagtcgatggagtggtggctttgacatcggattcaccaattctgactatgcgttatgtccaaggtggggcaacaaccttgcttggtctatcccactgctaccttaggtaaggccatattattaggatgactctcttcttatagtgttgcccatacaacccctcagtcggtctagttcggtgaccccttagtggggccataaggtattactgccactagcnttctcctatttttgatcctactaacctggataacacctagggattctcatggtagacacattcatgagcactgagagaccactttcctttggcacatgcctcaaagcttggtggtctatcaaagaactggacacaatgacaggcacaataacaactcaactttggggttatagtactcattgcttctcttgatgttgtagaggtcgtcctcctcactcccttggcacttgatgtcgaggaggtacttacaaagtagtggtggaaatatgtcgccaagtttatattcatggtctgagttgactctaggtcttctcaagccatttgatctaattccatgaaacctacaaccggacataacatgacattaatgtgctctcatgcaccatcacggaatgatagggcctagttcctaagaccgtgtcctaggctccagagccatggtgcaagcctccacacccatatcgttaagacctatgggttgctgtaataaacctttttcttcacatgttgagcttgtacttcttctgcctttggctagcaacgtcaaacaactaatccagaacaagcatttggtaatccaagcatagtgatacacctagagctcctatctctttttctctaggagtacgtactttgatttggtgaccaaataaaataggattaattatatacatgtcatttaacttttacaaaattaaatccccatacaatcaatcatgttcacctccctcactactgctttctccccctttgggcgatgccctccccggccgccgggccaaaaacaaggagcgctacatccaggccagcagtttccatttgcaatccgaccccatcttcatcccgttgtcgcagcagcagccatccaagcagcgatggacggcggcaagaagagccggaacccgcacaaggcctccgcggactaccgcagcgaccgcaagtcagcctccgggatgagcggcgaccccaagaagggcggccgcggcggcaagttcacctgggagggcgccgacgactacggctacggctacgccgacgaggacctcggcctcatctccaagaaaggcaacatcaacagcggacgcgctagccaggtccagggaggcgccgccgctaagaaggacgacgacgagtaggcctcgccgcctcggctcgcccgcccggtcccgtcgatcgccagcaagaaccaacaagcccttctgtctgtttaattccagtatcagttcgattctcatgttgaataatcatgatcatgtgggtttaggtgtcgtgctcacgagtatgtagtgtagctcctgctagcacagagcacagcacagagccactgggcgatcgacgggccgtgcatggcctgtagataccatctcatatgttcaccactgctactttgctcatgttgggggcctctcctgaactgggttcctggatgaactgattttctattagtttccggaaaaaaaaaaaaaaaaaagacccctactccgacccgattcagacccagcccccgactgtgaaaccgacgacaaacgtctctccagtttcagatgagatgcaattatgaagcaaaactagtagtacttcgcagatccgtaaaattgaagcacacagaaagggaggattgcgatgtttttgttttttctttgtttccaagagattgcaaagtttatctttgcaggcgataacgatgactcagcaacttacccatcagtctctttcttgatgacaactctattgtcagttgtcacacatgccatgcctacatgtccgttcgttccaagtatgcagacatttcgctgcagcagtattgatcatggagcaagcaacccatgcatatactgaattatcctgacagaacggagtctgcactctgctttaaactttctcgccgctccattactctgagcagtagagtaaaagcatgccgttctctgtatttagtcattcacagttgcagagtcactctcgcgatcgttgtccaccactagggtaagaaagccattcgtcatcactgtctctttttctttttgacaagggcgatggatctcaattgaactctatctaaagctgatttgtcctcattcagcctctatccgcaatacagcgagttgttataatcatgtcgtatggaaaaacaattgttcatataagactgtgagcagcccctaaa

SEQ ID NO: 13151 - DNA, 3908 bp, Zea mays
ctgcagatgaaacaacaacatatatatatatactcgacgggtattcaatacccgcgcaatatccgacgggtatatgcatgggttcaaagttttacctgcgagcatagtcgcaagcgggcatgaataattcctgcggggtatgatcgtgggcggatatttactctacctgacccaaactcgaccatttgccatccctagacccacaacaacgtgagccctgtgatgtcgagctgagcagttaggggaggttgtcaatgccgttggagccatgactcggatggggcgacgaggcgcgcgctgaggtgtgggcatgaggttgcgcatggagcgagaggcggagggaggacggcgcggcggtgcggggacgggtggagcaactatgtttggtttattgaggatgaggattggggaaggggagaagacgaccaaagccgaaccaacattccaacgatgagggaagaggcggtggcctgtgaaacagagacgtcagtatccactctcgcggaggctgtttggcggcagatcggtcctgaggccgcgaggcgaggcacgttccactttaaaagagtagagtagagaagaaatgtttgaaccacgagtcagattagaaagaagtatatttttttttgaaaaatgacgtagtactacgaagttgatgttttgtaggagtaaagatacaatataaaataatacgcatagaaacaataaaatagaacttcctatccatattagaccactatacacgataattagggaataaggacgcgatgaggattatgtgcattaatatcataataaacaggataacgtgggtatgtacatacgtactcctacgcgacaacagttatatatagatgatcagacatcgattatggtttaacaagaacatttgatccgacagcacgaaatcccatggaatcatatcgtgctttctttttgtttcacaaaataaaagaacccgtgaacacaagtcatagtgccatgcagattgccacgcgtatcacatgacagaggtaaatcagagaggtcaaccaccgcatccgccgccgcagccaccgccaccgcatccgccgccgccgcagccgccaccgccaccgcagccgccgccgccgccggagtcgagcgccgagccgatgatggcgccggcggccagcccgccgaccgcgccgacggcgagccccgcggctcccgacccgagcccgctacggccgggcctccctccagcgccctgcgccgggtagccgtacgcggcctgcgcagggtagccgtacgcgcccgcgggaggcggcgggtagccctggccgtagtagtatgcgttgttgttgctgctctgccggcgcggcttcttggcgccctgcgcgcacccgaacgccgcgatggccgccacggccgccgtcgcggccaccgcgaggagcaagatcgccacgggaccgagcggggcggcggaggcgccgtgccgcgtggccgcagcagcgccgaccgctagcgcctcgcgcacggcgagaaggctcgcccgcaccatggctatgccctccttgcggatggttgtggggagcgaggtcggcacacggcgagggagaggtgggcaggcgcgtgatggagacggggggaaggaggggagtggagggcagttaagaagggagggtccgctctgattggctttgcgaggtcaaagtcttctgctagttctacttgtgctagtgctacgattcaataatggcgtactcggtcgttgcttaattgcttccctcgtagttgcaccgaaacggcgaagaagaattccccggccgctgtgcatgcgatcgtgcatatgtaggcatggattcgtatggtttttgtgcatgtgtgtgtggatggatggataaccactcagaatttccggcaattgccgcttactattcatatgcttggtacgtcgttcccattttcttcggagataagtttgcgcgtcctccgttgaatagcttgttgtttcaccatcagaaacaaaaaatatctcaactcagactggcgagatcatctcacgacagggctatatggagtatggatcatgtagtgatttgtgaaatccccagccccaggctacggtggtcggtgaaatctcaacggcagccatgtccgatccgtgtgatcgaaaagttcgtctccatgcttgttttgtgaagaaggtatggacactgatttagtgatttttcttctttttcttaatttgaagaatcatgtataatagggcgtgcatgtagccccgcccgcttttccgtctgcaggcgatagtgctcgctgaacgaccgaggagcatcgatgtggactggacaatgcccttgtgtactagtagctcagaaagaatacactgctgccgtggcatgtcaccatagaaaaccgccgcccttttgagggccacgagagcacgatggatagggacacacgaagatatttttttcgcggcggccggcggggcgacacgtttcgtcagttcggccagtcgtgctaagtgggctataaaacgagttttccgtgttgtgaatacgtcccgagacttatgaacagattgtctggccatacggcccaatccagcagagaagagatgcgtcatacggcccaatccaggagagaagagctgcgtcttgcgcgcgcgcacacactctctcttctcgagtttgtggaggtgggaggccgccatggcgggtcgagtaaggaggggagttttgggtgaggttcaagaaaggtggagcttttgcaataagcagtggcggctaaaaaagtgagtgagaaaaggcgtaactctagaagaaaggccgacgatgcggtgtttataacctattgaaaaaggtctacagtcacaagcaaaagacaaaacagtggggtattctctagaaatcactaagcaccgctaaaggctgaagtataaaatcgtaagtggtcgggctataaacagtaagcgaccgagttatgaacaggaaatagcctgccaccaccaacaaaacaggaagaaaaatggctcggacacgccgatgatcttcaccaaataacagctaaaatgaacttgctttcctttcccaatccaagaatatatatggatgctgggttagctcgaatgggacaaatggtgaggaaatctgagacgatacattaacctcaaaacgtcagtttggtgattcttaacaaaactgaacatagtaaaacgatcgattctcaggactcggaggctcaactcaagccccggtaattcgatagctagtaggaatgtctcaaaggcgacatcagaagaatcgaggataatcctcaatcatcagagtctgacttaatagagttaccaacttaggtaagtcagacttttactatgtccgagccatttttcttcctattttgttggcaatgaaatctagcagctgtggatgggactctgatcccagagaaggcgaagcacccaaaggaacctgatagtcgctatcagcaggaacagcctgatcagcatcagacgcgatgcaatatgtatcttgattaacaatcgcaagatgaggctctaaacacccggccggactgtcagtgcccagaaacttcagaaatcaagacatctccaccaggaacaagacggccgacaaccctctgattccaaccccaccaaaaagacaaactttaaaacttcagaagcaacccatcactaaaaggtcaagtgttaggctcgctgcaaagcaacgttttaagaccgggaataaccgagatgcaatatccaaagcccagaaaatcttaccggccaagcttaacaattcgacagcaaaaaatgtcggtcgctctagttcttctaaccgtgctgattttgatgattcacttgaacagatggcaagtattttcacaaaacctctccccaagaagcaaatggaagcaatcttggagctgataaatcaaga

SEQ ID NO: 13152 - DNA, 4562 bp, Zea mays
  misc_feature (59)..(59): n is a, c, g, or t
  misc_feature (2077)..(2077): n is a, c, g, or t
agtctgttgacttgctccgtgggacaccctaagacttctggtaagcgtcactctgacantttaaactactgctctttatggataacatgtaattgactagtgaatccagtggcagtgcatctttacagttttgttgtgacttgggtatttgtttggttccgtagtctttatttgtgattatcattgaccgaatgggtcatttagtatgtcccaccttaggaaatgcgaagaaagcgtgattcactttcttgagtttgcctgcaaggtcagcattgatcaaactgttgtcgtggataatgtaaatcttgcacacaaaaaaaattctgtaaaaccttactgacttagcattcctactttatatggttaaagaggaaacaccgacacatcgttaactatgtttggtgggtacacagttttttagacaatttaaccttatggttgtcatgtgtcgaaaaaggtcactgagagatggttgtcgtcgcggctgtgctgccggtctgactcatcatctctgggacactgccaagtacgattaaggaaggatttgtaaatgccactttttggagtttctggccttttggtttagtcatcaagactctagctagcaattatctaaagaaacaaatgaaatgctaattgccaccaagatggcaaaattgccggaaaacagcagttgagggagaaacttcattgcaatgctaacaataccagtgcccagatcatgacaatcagagccagtagcaactgaaccttaagtagccaccaagtttggcaaaacttctgcaactctaattgagggggaaattttttgatgcgacttgttgatgcacaagctgaacggcccaagatttctgtagttgctgcttgaaatattcttgataggaagggcaattttgtagatgtctcgagagtgtaaaaaacatgcactgtagttctctttttacctgtaagataagattgtatgcagtatgcactatttgagttgtaacgggataagttcacgaaagtatattttttttatttgatgtgtcttgattgggaaaaaaaaaaaaaaaatgcagtggtgagaactcactgagtcactaggtcgcgggttcgaagcagtctctcggcatttgcgggggaagaattgccttcccttttccagaccctactcatatgggcgccgagccatcagcaattggtctgcccttttgatgtgtcttgattgggaaataattgcaataagaaaagctgtgcataagaaatttctttgatgtctctttgttggactatatactctggtgaatgaaactgaattgtttgtgatgaaatatttggtttgcactttgccgtataaaaaatattcacgtgtccgctacattcagctgtctgctacattgatgccgttaaagaagatgcaaccagcagtcctaattaaagagagaaaatataataaaaaggacaaactgagtgccagtggctcccacatgagtctggtttaagtaagaaataaccgaggttacccctgtatttttgcagagaggctgcgtcgaatccaagacctttggctcagtgggaagacttctcaccactgcatcaggtctgtcctggaaaatacaataaaacaaaatacaatcaattaagcaacagaactaataaatgaaaatgcattgccaaaacaaatgtgtgtgcacatttgacatttgttccattttgcgcttggcactattacattgtgtatggctattgttgagtccgaacaaatgtccccatggattttgcatatccctgtttcctccaacctgatctactacagttactccattgcatggtagatggtctcctgattgtgctgggctgctggccatggtcctgacttagatactgcaccatctttttttccctgcatattctagtcttgcttagcagtatttaatcttgcctagcagtttcttaattggtaaagttcttctattaagggctagggtcattgtgtttgtagacaccggctggtttattttggtgcgtgaagaattttggaccccactgccaagtttttgaacaaccaacagttgccatgtggtagggagcatanctgtggagttggctagccacattctgccaatgggatgttcatagttgataatttttaaattagcttgaagtgttctctacctacaaacccctttacagttttgaaattttgtttgaatatttagaatctagggactttagagggtaagtttattgctgtagaactatgttctttgattaattataactacatacatattagtacttggctatttcagagattcagaagaacttttgcaagaagggaggtcttgtactttggaactactcgatagccatatttttagaggttagcaaaaggagatcagaatgactaatgaaactagaaaacatcgttccaagtgggacacaaaagaaggatctgatgtagttgagatcagtgatgatgagtctcctgataagacaggtgttcaccgtaaaggtggcgatttacacacaaaacctgacacatccatgcaccacagaggcgctggacatgagaaggaacatgctgatgggtccaatgaagatatgaaggaaatgcaacataaggcaccctctgaaagatcacaacctcttagaatggttgatgagcggggtggtgatgagtggagcaaggcaactggtaaccaaggcacaaacagatatgcagatgacagaagacgtggtgatggatggggtacagctcctagtcgtgattattcttctgctagggcgccttctgatccagatgcatggaggcagcgcagccgaagtccatctccaagaggggtttggaacaaatcacgcaggaacaggagtcgttccagaagcagaagcagaagcagaagcagaaacagaagtaggagcagaagcaggagtatagggcgaggcagaggcaggagcagaagtccatatattgctgaccgtggatctgagtggagggttgagagaggcagaacatctggaggacctgttcggccctgtagggattttgtggctggtaggtgcagaagaggctcaaattgcaggttccttcatgaagatggtgggcacaggccatttgatgatcactatcctgctgacccaagggaaaggtatggttatcagagcaaggagtttatggatacaagaggaccaaatgactatttgcggagtaggcaatctcgagatcgttatgatgataggccttgggagagatctgaacctcgaagggattaccggtatcctgaacaatgctttaattttgccaaagggaaatgcatgagaggtgctagttgcatatttgcgcatagtaattctgcttctcatggtagatggagagatgagactagggaaagtgcccatgatagatttggccctgattcatcctatgggaataggactgagcaccgtagggtaaacaaaaacccttgtaagttttttgctgaaggttgttgtcgccgtggtgaaaattgttcatatctccatgaggaagctccccatagtcagataggagtgagtgcacctgatgaggctttgaattacagtgatgggcatgcagcaagaggaaactattcaaactggggtgaacaaaataatgctgtgcatgcaacctctcagattttatccagggatgacagggaaagtcctatttctcagagtattggcagaaatgattctcgcaatgattatgaaaaccagcattcaaaagatgctggaaagagccagtaccaaattattcatcaggaagattttggttcaccagggcaaaagaaacatgaagatgctatttcacaacagccacagttattgactcctgtccagactactgctcttagcatgcataatgaaaaggtatctgaaatggacagtcagaatgctccttcaagcattggaggtttgagcatgcaatcaggggttcgtagtgctaacattatagcagagcaaagcctgggtcaaatacttcagagacatgatccaattcctcatattcctgggccacaaacgcttccgatcaccacacaaccacagaatgttacgtcttcattcccatcaaatagccacgtgcaacaaaataactttcctatacatcagaacaggcaagagcagtttgtagttccacacgcagctgcaaacatctcaactcccagcatgcagagccagccaattgcttctcacatggggcacatccaacgtggcggctatggtatagagccacaggcattgcccaatatctccacacataacgggcataatttcaatgttgccagtcaagttccaccaaacattccaacagctgtgcatgctgggcagactcaggtgacaattgacatgccaaggttgggtcaagacagtggtcctcaaagcatacacaacatggagatgcagccaatgtctccaaacgtgcaaagccaatccttgcaggggttaccccttgtgccggcttccagctcagctgatatggccggagttcctgttcctcacaacgctgtgaaaagcgaagaagttagccgagttactgcatccctggcacaatacttggaaat

SEQ ID NO: 13153 - DNA, 867 bp, Zea mays
ccggccgggatcatatggcatagccccaagcccccaacggatcgagcgcctccccgagtccccgttcccctgccccagctgaccgccgccgagacgtgtgccacaccgcctccccctcccgccgccacaaccttcgcctccacgcaattggccgcactcctttccacctcccgctacaggatagcgtgggccggtcggcggcgccgacgggtggagaactggagatccacccgcacgcggactgcttccttcgctagtcgatgggaagtaagcgttgttaggtctcatgatttcttttgggagatccggagctgtggtgcctgtctgactcatcatctctgggacactgccaagtacgattaaggaaggatttgtaaatgccactttttggagtttctggccttttggtttagtcatcaagactctagctagcaattatctaaagaaacaaatgaaatgctaattgccaccaagatggcaaaattgccggaaaacagcagttgagggagaaacttcattgcaatgctaacaataccagtgcccagatcatgacaatcagagccagtagcaactgaaccttaagtagccaccaagtttggcaaaacttctgcaactctagttgagggggaaattttttgatgcgacttgttgatgcacaagctgaacggcccaagatttctgtagttgctgcttgaaatattcttgataggaagggcaattttgtagatgtctcgagagtgtaaaaaacatgcactgtagttctctttttacctgtaagataagattgtatgcagtatgcactatttgagttgtaacgggataagttcacgaaagtatattttttttatttgatgtgtcttgattggg

SEQ ID NO: 13154 - DNA, 1652 bp, Zea mays
cattgggtacctcgaggccggccgggccccccaaccttcacatttccacgtatgtagaatactccacctccacccccgtccatttcccatccccaacctctctctctccccccctaggagtgggagctcctggctccatctatccgcctgcagatatcacaagcttttcctgctgctgctgctgcagcagcacctgcagcttctccgtctgcagtgcgagcagctgctaaaaattcccccataagcctctggcttcctgcccccctcactttcttggaagcccagcacaacacgaggatcatattcactccctacagtggcgtactagaataccagttgtgcgcaaacagcggcagcagccgtgatgtacaggtgagctggctctgccgctccactccatggaggatctgtacagcatccacccggggatctcgcgggtcgtcggaggcgcggcgagcgaggcgtccgtcgccggcgccggcgccggcgggccctcgccgtcggatctgacggagctcatgaaggcgcagatcgccagccaccctcgctacccgtccctcctctccgcctacatcgagtgccgcaaggtgggagcgcatccgcatgtgacgtcgctgctggaggaggtcagccgggagaggcgccccgacgccggcgccggggagatcggcgtcgatcctgagctcgacgaattcatggacgcttactgccgggtgctggtgcgctacaaggaggagctgacccggccgttcgacgaggccgcgtcgttcctgagcagcattcaggcgcagctcagcgacctctgcagcggtggaagctcgccggcggctaccgccacgcactccgatgacatgatgggctcctctgaggatgagcaatgctcaggggacactgatgtgccagacatggggcaagaacatagctctcacttaggtgaccacgagctcaaggagatgcttcttaagaagtacagtggatgcctcagccgtcttcgttcagagttcctgaagaagcggaagaaagggaagctaccgaaggatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatctgaggacatgcggttcgcgctcatggagggtgttgccggtgggtcttctgggacgacactctacttcgatacaggcacaattggaccctgaatcatacaccacttgggatgacaactggccagctcatattagtaataagatctggcatgtggagtgacgatctgctcggtgaaaattgaaaataaatctgctgagctgaggttgatcagactagtcagttgccctattattttacaagatcatgtgtatatggtgccgtcgtatcagaacaaactgtatgcatgtatgggcgaattgagacctgcaaaaggagtttaattagtagtttcaagtattggctcatggatttgtaatactcgctacccaatttaattgttagataggctgaagggcttataaaggtaaatttacttctgctcttccaaaaaaaaaaaaaaaaaaaaaaaaaaaaaaaag

SEQ ID NO: 13155 - DNA, 481 bp, Zea mays
ttcggctcatgagaagggtaatagtgaagtaatcatgggctgatgacgatatacactcgatggtccaagagaaatacgctgactgactgtcatattctccagttaactgaagtcagttcttctggtgggagggaagcctatgctatggtatttcccgtccattttgacaagtacccgtagtttcatgatgcagtgaaatatgcaacctttagggctagtctgggaactctatttttccaatggattcctattttctcaaggaaaaatgaactaatttcccttaggaaatgaaaatcccgtggaaaaatagggttcgcaaactagcccttagggcatgtacagcctttgtggtgcggtttttcatgtaaaaggcagttaagatacatgtaggtacaatgtggttaagtcacatgtgggttcattgtggagtatctaaactttgtatcttatttaataaaatttctcaagacatgattttttt

SEQ ID NO: 13156 - DNA, 3088 bp, Zea mays
tgcagtggtgaccacacaagtgaacgagatgcaaagaaggcaggtaagctactgcaaatttatacaataatttattgtcaagaaacggacgctagattactgtgccggatagatcttagcaggcaaacagtaggagaactgatgtaaatgagaagacaaagttcttcacgtgaggtaaaatgttgtccagtttttttttcttaaaatgaaatatctatgtcttcgctgatttatttgtccagttttttgttcttcaggtgagaagacaaagttcttcagataaacagtaggagtataaccagggagtgtggattttctgaatctaaatggaaaagaggggatatggtactttagaatttggttttcggtgaaactataaattccattggcatgcttgatttaatgttcacttaaattgcctagatccttatccacttgtcctcatggaagcctctcaaccctcaaatgtttgtctttgctgatttatttgtttaggcagccctcatttagctgcaccttttcctattaaggaaaaaaagaagctttgcgttcaatttctcctagaatctttctgtgataccagctgatttttttattctcttatttggaacgttatgacaacaagaagccactagaaagaataaaggaacagaatgcagtgacaccaccgctccatcatgtaggtgttattacaaatgttagtactaaccttttatgtttatatttgatcaaacctaaaatggctgactcattaaagaatgagaaatgacaaacttttgtgttagagggagtagataatggtgatctgtgcaagctaatctgcagtagtagtcaccagccgatgatcatgtgtttctctgaattctgaaacctaatcctgcttcaaaatggcatatataattcctggtcctctcgaaaaggcaatagaacctgagcttgtgatcttgttttaggagtagataatagtatataattcaagatgttaagtatatataaacaagaatcgtatatgaacccagtttctctacattctgaaacctaatcctgagatgatgtgattgtgatccactgactggaggatccatgcaaatctcagtgtcaccttctccagcaggcaacaactgactgtttgttggtgtgcagtgttcttcaaactattcagcaactaaactgttcaaacatgttactgaagattggcagctgaaacacatgatcaccggctgaacatggtaggcgtgaaaaataagatcaccgactgaacagtttatgatcaccagctgaaacacaagatctgggaggcgtggaacatggtagctgaactcttcaaacatgttaggcaatagcaggcaacaacagtgaaacacaatcaccgattgaaaagctgtccggcacctgaactgcgcaaatttggttgcctggtggagggaggtctaacggctgacactgctattcaattattttttactttagtttgtatcctccttacagatgttggatgaaagcaaaccttcattttttttgtttagcaggcctactaaaacaagcttagtgaacctgggtgaacaaaatgcactgattcaaaattttatttgcatttattgcatttagcttgccttgatgaccctgtcattctaatcacagtcttgggcattttatttgtgtcggaatccaaacttacaaatttttaacacaaattctttgaaggtgtatggtctggatataaacccaagagttgttctggtagggcgcccgaacgggtgcctcctgttctagtcaaactttaacatggcggggctgagcaggggcatcggcgaattccagcaggccatggtcagcaaggttgcggtgtagagcagcaaggcacgtagagcagcaaggcacaacatagatgaagacgaatgcgtggcatggaagaacgacttcggcaccggcgaggcacagcagcagggcgaacttcgcggcgtcgcggtacagaagttagcgttgaaatgatgagcaggccgcgtgtcgacgaagcaggtgaagtctggtgagcgatggcaatgatgcggcgtgacgccgcaacacgatggcgagcggctgcgcagaaggtgctagcttggcgtggtgcgcagcagtgagaaccgagggtagcgcggggttctcggcgctgtacaggggcttggctgcgggatatggccaacgaactggagcagaaaaggagagaaagggctctaggagcggttccatttataggtggaggagggagccgggaggtcgccggttgaactgatgccgattgaagatgagaaacggaggatttaaatgtcactaatggagaaaacggtcggctctaatggggtagtgattcgaacagtaaagaaggggacaggagaggacgcggcgcttcggctggcggcgtggggccaagaagcagacgactgcaggagcaggatgtggacgacggcgtgggagctgggttggcggcgcacgcaggaacggccagcgcacacagagcagaggctcaaacttgaagatgctcctgacgagttgggcccacctggaggacagacggggagagtggggaagggaacgcacaggctggatcatttggttccagtgttcgtcttctctttttttttaaaaaagaaattcttctatttttttgttggaccgtgcggctaaatcgttcatgtcttttccatttttttttcaaatttccatacgcatctgttttttttaaacaaacaagtagccatatatatatttatagacacatacaaattcataataaaaacctaaaatattattaacaaaactaaaatacatcattttgtagaaaaatattatttagcaattcattccatttcacgaaaatatttcacaccaacaaataaatctaaataatgcatataaaattgtatatatataatgaaaaacagaataatttgaagtttattttttaacaaatcaaaatacatagttaccgaatttattattttaataatttaatattattctataaaataacgttttattcacaaaattaaatccaagaattggattcaaatcaaacaaaacatatgcttcgacatgaatgcatcaaaca

SEQ ID NO: 13157 - DNA, 1681 bp, Zea mays
cgaggagcgtcgaaggaggagcgccgagagggagctccggcagcgacgagcgcggtcggacgagcgccgcagagaacgagccgcagcgtggatccgttctagttcaacggactgccgaaagctcagtcttggtgataccacggttccaataaactccttcttggcactccaagcggaaggaacggtggcgtttctccgttctacgaagtggcgcgccatctgcaccggtcggctgcggcggctttcctcgtcagttactcttcccgaacgccgccagcaccgctcgtggcatctgcgtctctgccttctccaaccgccagcaccgctcccgatccaggaccaagaagcgtgtgaggagctttcagctgccacccggtgccaccatgctccggcatctccagcgatccctccgtgccattcactacttacccatcatcggacgtgatgccgcctgcaaccccattcccctccaccggtcctgggattcacatatagagcatgccaccagagatttctctacttccacaagacttacaggacatccaatatatcagcagaatgagttagaaccaactacgcctgtgaaggatactgacataataattgaccgcatacgaaagagcacacggaaattggaggaaggccctgttggaaaaaatctgtcttcagcggagaaaaggaaatttcttgtcaacactctccttgagccttgaagattcaagaggaagctgtttatggcacccttgatgcctggagttgcctttgagcaggattttcctttggcttcactaaagcaagcactttcagttcttgagaaggaggaacagtggcatagaattgtccaggtgatcaaatggatgctgagcaaagggcaaggaaatacaatgagaacatatgagctattggcatgtgcactcgagaaggataatagagctgaggaagcacatagaatctggcagaataaagtgggccacgatctgcattcggttccttggcgtttctgccgtcttatgttggctatctactaccgaaacaataggctagacaggctcgtgaagctcttcaaagaactcgaagcttgtggccgtaaacctccaagcaaagacattgtgcggaaagtcgaagatgcgtacgaaacgcttggattactagaagataaaaaggcgttgcttgataaatacaaggatttatacaacaaaccgtctcgggacgatcggaagaaaggctccaaatccaaaaagatcgagtctgataaaccatctgatggtgacagtaaggaaagcaagatggaaacatctgagaaccttgaagaccgctgtttccctgtggatgcaaaaccagatgcctctgcttaggctcatcactgaaccaccgacgtcgccataagatttggccaaaacccggtgctgtcagcattagcgattggcgtgctctcagtacacgtttgctcccctaaccagttagtgttttttctttctctctagacatgttacaagggcatttgtatttgctgttttgcactgacatcatttttgccaagaccctaagcggtataatactgtgcgacggctatgtataatactgtgcgacgttcattactggcagcaatatacacaccccttgttcgaaataatataaattataaaataataaataataaaaataaataatattataaaat

SEQ ID NO: 13158 - DNA, 556 bp, Zea mays
  misc_feature (60)..(60): n is a, c, g, or t
tcgaagatgcatcgaaacgcttggattactagaagataaaaaggcgttgcttgataaatncaaggatttatacaacccacgcgtccgggacgatcggaagaaaggctccagatccaaaaagatcgagactgataaaccatctggttacttttccccattcctggcgcccaaagtcccttcagacaatggtgacagtaaggaaagcaagatggaaacatctgagaaccttgaagaccgctgtttccctgtggatgcgaaatcagatgcctctgcttaggctcatcactgaaccaccgacgtcgccataagatttggccaaaacctggtgctgtcagcattagcgatcggcgtgctctcagtacacgtttgctcccctaaccagttagtgtttttttttcttctctagatatgctacaagggcattcgtatttgctgttttgcactgacatcatttttgcgaaggccctaaacgagtgtttggcataatccaggcctcccgctatgtataatactgtgcgacgttcattactggcagcaatatacacaccccttgttc

SEQ ID NO: 13159 - DNA, 617 bp, Zea mays
agtggccactctctccgtctctcgactgaaaaaaaggacccttcttcttggcactccaagcggaaggaacggtggcgtttctccgttctacgaagtggcgcgccatctgcaccggtcggctgcggcggattgagcggtggctttcctcgtcagttgctcttcccgaacgacgccagcaccgcccgtggcatctgcgtctctgccttctccaaccgccagcaccgctcccgacccagggccaagaagcgtgtgaggagctttcagctgccaccatgctccggcatctccagcgatccctccgtgccattcactactcacccatcatcggccgtgatgcctcctgcaaccccattcccctccaccggtcctgggattcacatatagagcatgccaccagagatttctctacttccaaaagacttacaggacatccaatatatcagcagaatgcgttagaaccaactacgcctgtgaaggatactgacttaataattgatcgcatacgaaagagcacacgaaaattggaggaaggccctgttggaaaaaatctgtcttcagcggagaaaagggaatttctcgtcaacactcttcttagccttgaagattcaagagaagct

SEQ ID NO: 13160 - DNA, 1090 bp, Zea mays
tttccgagtgggtcaagtgggctatcttttgtgcacgagggcccatgtccctgctcgaaacgaagcccattacatgcggtgacgggtgggcgtctcgtcttctccgacgggtacctcgaggccggccgggaacaacccgtgaccctaaaaccaactaaagtccagaacagaggcagctctcttggcgtgctcacctgcttgctccaagatttacccctccctcggtgcctgatacctctatcctccgcatccgtctctaaagacaaggcagtcgtcaagaaagggagtttgaccaagagcctgtggtgtccgtcggctgccatccatggcaggggaggccaagaagctcttcttcgcatccgaggttactctccacgcctccaggaaggactgctgggtcgtcatcggcggcaaggtgtatgatgtgaccaagttcttggaggaccaccctgggggagaggatgtgcttctccatgcatcagcctctggggatgccacggaagcattcgaagaggtgggacacagcacttcagccgtcagcatgatggacagctacttgattggaagcatcaaggactatgttcgtccgagtgcatcgaaggccacagatccttggagcgctgatgttctaccaaattccaggacgatgcaagggaacaaagtcactcctaatccaaataccttcctggactttcttctcccattgtttgtgcttggcctggcatttgcagcttggtattacctaaccttcatctccaagaaccattaaatacagtgaagctgggaattatttctcactattatactgttagggttatatcagagaaaacattaaaagaaggcaaaccttgtattatggtattttgcacttgaaggttgctagctagggtttccttggatgtcctttcttacatgtaacaggcatgtcagtacgcagatgtatgaatgaaacaatttatccttatttttccaaaaaaagataaaaaaaaaaaaaaaaaaaggggggtttgtgcttcagattcattttcttatatttttttattttttagtaaagatcccaatgatttagtacaatttgattgtacatatc

SEQ ID NO: 13161 - DNA, 2822 bp, Zea mays
cattgggtacctcgaggccggccggacactccctagtcacttgctggttggtcatctttcatgaagggtgcaccactgactcaaccactggttaatatgttggtatcaactcctgcttccagaggtcgacaagttatttgaagttgcagttgatgggtcagatgacgacagcatttcagctgccactgttttatgtggagccacccttttacgaggttggaattttcaggaatatcggccgtggactatgctccaatcttctcgttccatggcctgattccagagctggctgcttctcttatggcaatctgtgaagtatttgggtgtctttctccaagtgtttcctggacactgagaactggagaggaaatatctgttcacacagtcttctcgaatgcatttatccttctgttgagactttggaagtttaaccatccaccacttgagtattgcataatgggagatggtgctccagttggctcgcagctaactcctgagtatcttctgctgttacggaattcccaggtcctatcttccagcagtttgtcaaaacaacgaaacggacaaaggcaatcacaagtatcaacttcacacccatcatctggaaatcctatttttatggactcgtttccaaagttgaagttatggtaccagcagcaccaagcttgtctggcctcaactctctctggacttgctcatgggacacctgtacgtaacaatgtggatagccttcttaatcagatgttcagaaaagctaataaaggaggcacatcaataggttctttatctggaagtagcagcataagtaattcttccagtcctggtggggatgattcacatctttggcctcagttgccagcttgggagatactggaggctgttccttttgtggttgatgctgctcttactgcttgttcccatggaagactatttccacgtgaactggccacaggtcggttgtgttcagttttaaggcaattttagaaaccagtgctacttttatccgataatcaagagtaaagagtaccaaccgtggcttctaacctttatgttagaaaatgctcattcagggtcagggtgtataactatgtcatctcatttttcaggcctgaaggatctggctgatttcctccctgcatctcttgctacaatagtaagctacttttccgctgaggtgacgcggggtgtctggaagcctgcatccatgaatggatcagattggcctagcccctctgtgaacctatccatggttgatgagcacatcaagaaaatcgtagctgctaccggtgttgatgttccaaagctagttacaggtgttggttcctgttcatctcctgccattgctacagccaacataccagttttcatgcagtgagtactaatccaggtctcatgtattgcaggaggaagctcttcaggtacacttccgttaccattggctgctttcgtgagcctcacaatcacatacaagcttgacaaggcatcagagtgtttcctcaaccttgctggtccagctctagagaacctggctgcaagctgcccttggccaagcatggcaatcgttgcagcactgtggacccagaaggtgaagcgatggagcgatttcctaatattttcagcttcgcgcactgtgttccaccacaacaacgatgcagtcgtccagctcctccgaagttgcttcgccgctacccttggcatgtcttcgacatcagtatgcagctgtggaggtgtcgccagccttctgggccacgggtactgccctggtggtttctcgccagttgcgccaggaatcctctacctccggatattccggtgcatcaaggactgctccatactcgccgaggacatactctcccttctgatgctctcagtgaaggatatcgcagaaacaactgtgcccagacaaaggccagacaagctaaagaagaccaagtacgggatgaggcatggccaggtatctctttccgctgcaatgacgcaggtgaaggtggcggcatctctgggggcgacactcgtctggctatccggcggcacggctctcgtccagtccctgatccaggagatgctgccgtcttggttcctgtccgcgcagaacctggatcagggcggggctagcggaggcgtggtgtacaagctgggcgggcacgcgttggcctacttcgcggtgtactcggggatgttggcctggggcatcgaccagacgcccgtgtcccggcgccgcgagagggtcatgcggtcgcacctggggttcctggcgagcgcgctggccgggaagatcttcctcggctgcgacctctccctgtggcgagcctacgtctctgggttcctaggactggtggttgaatgcaccccgtgctgggtgcaggaggtggacctgagggtgctcaagcgcctgagcagcggcctccggcactggggcgaggatgagctcgcggtggcgctcctccgccgcgccggtcccgaggctatgggcacagccgcggagatgatcttgggcagggagttgtgacgccgatgcgcgcgcgcgccgcgcggcgtatgctgttcgtcagcgatgatgcagtttttgtatataatcggttaaaatctggccatgtgtatgctcacgggtaatatttgaatgattttatctgtaaaactgttaagacgttttgatctctctaatactaaccttcatctacccgtttgcaaaaaaaagaaatgatgtcccagaatgtaaaacctaggtttatgaacggacatgtttggcacagttctcatgcagcttccactgagttgattaaagttagaccatgttccaaagctatagagttaattgtcag

SEQ ID NO: 13162 - DNA, 807 bp, Zea mays
ccggccgccacccacaacgatctagctacttcctctctcaagcccataggtgttgtagaacaactcaactagcaatggcttccaagagcacaatgcgtccccttgtcctcgtcatgatggggttgctgctgctctcgtgcagcggcatcagcagcgcggcgcggctgctggaggaggtggcgcccaaggaggagtacccgcaccctgaagtgccagagctgcccaagcctgagctcccgccgcaccctacggtgccggaactccctaaacctgatgagctaccgccacatccggtcgtgccggagctgccaaagcccgaggtgccagtgcaccccgccgtgccggagctgccgaagcccgagcttcctcctcaccccaccgtgcctgagctgccgaagcccgaggtgcccgcgcaccccgccgtgccggagctgccgaagcccgagcttcctcctcaccccaccgtgcctgagctgccgaagcccgaggtgccggagctgccgaagcctgaggtgcccgcgcaccccgccgtgccggagctgccgaagcccgagcttcctcctcaccccaccgtgcctgagctaccaaagcccgaggtgccggagctgccaaagcctgaggtgcctgagcaccccgccgtgccggagctgccccacccggacgtgccagagcaccctgctgccgtgccggagctgccgaagcccgaggtgcctgagcaccccaccgtgccggagctgccaaagcatgagctgccacctctacctgaacccgagttgccattgcccaccaaaggcgagagccactacc

SEQ ID NO: 13163 - DNA, 2479 bp, Zea mays
  misc_feature (44)..(45): n is a, c, g, or t
  misc_feature (47)..(47): n is a, c, g, or t
aagagcctgttatgtccgacggcttaagatatgccgtcggaganncnagttcttatgtccgacggctgacgctaggctgccggacataagggatgtgtgggccccacctgcgaccgttaaaacggttgacatgtattatgtctgacggactgatgtggtcgtcggaggtagcctatgtccgacggcgaccgtcggacataatactatttctgacctcttatgtttgacggtcaattgtcgtcggagataaacggatgccgtcggatataggctatctccgacggtttaatgcttatatccgacgactttggctgtcggaagttttgtgatttattgtagtgcatggagtagtagtatttgttggcgaatatgcatgtgcagcacctcatgtaccaaattaattaaagagtatatttttttgtcacttgtatgatgagatcggccggggaagctaagcttgctggcgggtgtccatatgatagcttaatctgatgaacttgcagaacaaaagttcaataaatgagaataatgatctcaaaacgtgtaatcgattttgtaagaaatctccttagtaacacaagtacttagggtgtatttggttgcgggacagtcaggacagagatatcccctggcgtcctctctttcccctccaattttgagctgggggcaacactggaataatcatgtcccaacccttgaccctgaaccaaaaccttatttgaggaatcgtctcatcccatctcgtcccgttattgcaaccaaacacacccttaattagctgatgaaagcgagttgtctgaaaaatggtcatgccatatttctgttctcaagttcaactcgctttacaactactacgcaaaaaaaggctccctgctatgttctcaatttgaccttgacatgcacatcgtgtcattattcgcgttatccggtggccaaacacaaacacatcgatgagaaaaatgagatgcgtcgcacacgtgtagccccacaatcgcaagcctcaaggtgattcaactacccagatctctcagcattcccaacaaactataccaaactatctctctctctctctcttgatgagaaacaactataccatacaacacatacatgagatggatgaggagagagcaagcacacccagagagatccaaagctgacaaccatgggatgcagcagatagccaaccaattaccaaacgatctatacggatcagctagtagggttccatttggcactatacaaataccaggcaccccccccggcccggccaccacacaacgatctagctacttcctctctcaagcccataggtgttgtagagcaactcaactagcaatggcttccaagagcacaatgcgttcccttgtcctcatcatggggctcctgctgctctcgtgcagcggcatcagcagcgcggcgcggctgctggaggaggtggcgcccaaggaggagtacccgcaccctgaagtgccagagctgcccaagcctgagctcccgccgcaccctacggtgccggaactccctaagcctgatgagctaccgccacatccggtcgtgccggagctgccaaagcccgaggtgccagtgcaccccgccgtgccggagctgccgaagcccgagataccgccacattcgaccgtgcctgagctgccgaagcccgagatgccggagctaccaaagcctgaggtgcctgagcaccccgccgtgccggagctgccgaagcccgagcttcctcctcaccccaccgtgcctgagctaccaaagcccgaggtgccggagctgccaaagcctgaggtgcctgagcaccccgccgtgccggagctgccgaagcacgagcttcctcctcaccccaccgtacctgagctaccaaagcccgaggtgccggagctgccaaagcctgaggtgcctgagcaccccgccgtgccggagctgccgaagcccgagcttcctcctcaccccaccgtgcctgagctgccgaagcccgaggtgcccgcgcacaccgcggtgccggagccggagccggagctgccaaagcatgagctgccacctctacctgaacccgagttgccattgccaccaaaggccgagagccactacccggtgccagggatggccaagccgtgatcggcctagcactacccggaggccggagctagagatgatcacgatgtgatcggcctgtattagtgaacacttcatgtatatgtatttacgtacgcatgctttatattttatactttgatgtctgcatgcgatgttgtggacgtgccccatgcacacaactcgctaggagcgtgatgatgtttgcagttattgcagtagtgtattggtattccctttgtaattttgtatgtaactactagtatagtgcccgtgcgttgcgacggcaacgacatgtaaattgttcgataaaatattagttcacaatgattacaatattttatgacgataaaaaaaaaaaaaaaaaaaaaaaccgatt

SEQ ID NO: 13164 - DNA, 1052 bp, Zea mays
ctgtgcggcgctcgaggcggccttccgggaccaccacacaacgatctagctacttcctctctcaagcccataggtgttgtagagcaactcaactagcaatggcttccaagagcacaatgcgttcccttgtcctcatcatggggctcctgctgctctcgtgcagcggcatcagcagcgcggcgcggctgctggaggaggtggcgcccaaggaggagtacccgcaccctgaagtgccagagctgcccaagcctgagctcccgccgcaccctacggtgccggaactccctaagcctgatgagctaccgccacatccggtcgtgccggagctgccaaagcccgaggtgccagtgcaccccgccgtgccggagctgccgaagcccgagcttcctcctcaccccaccgtgcctgagctgccgaagcccgaggtgcccgcgcaccccgccgtgccggagctgccgaagcccgagcttcctcctcaccccaccgtgcctgagctaccaaagcccgaggtgccggagctgccaaagcctgaggtgcctgagcaccccgctgtgccggagctgccgaagcccgagcttcctcctcaccccaccgtgcctgagctaccaaagcccgaggtgccggagctgccaaagcctgagctgccaaagcatgagctgccacctctacctgaacccgagttgccattgccaccaaaggccgagagccactacccggagccagggatggccaagccgtgatcggcctaacactacccggaggccggccggagttagagatgatcacgatgtgatcggcctgcattagtgaacacttcatgtatatgtatttacgtacgtacagtatgctttatactttgatgtctgcatgcgatgttgtggacgtgccccatgcatgcacacaactcgctaggagcgtgatgatgtttgcagttattgcagtagtgtatttgtattcccgttgtatgtatgcgtctgtacttttggttataatgtctatacagagtatatccatgtatcatacaggtttcatttatttatcttgggttaatt

SEQ ID NO: 13165 - DNA, 1978 bp, Zea mays
cctcgaggccggccgggtcgatatattccctacccaaaaaaaaaaaaaaaaaacacacagattcggcagagcctgccgggagagagtgaaaagagagggagcgcgctcaaggtgtggcgcaaggagatttttcttttatccagcttcttagcatgattctctttgatcccggagagcagccaccggtccaactaatccttgctgttggtctgccggaacttttgattgctctccagatctgaggcacctgctgggtggattccaggaacccgagcacgaagttgacaggggaaggaaggaagaggctgaaagggcggtggagagagaaagactataagggcgagctgagtcccttgaggatgccgtcaagaaaccgcgtggagaggagggcgatgagatgagggatgctggccgcggtgatggactacttcagctcctgctggggcccgcgatcgggcgccgggcaccggggcaagggctccgacgccgccggccggcaggacggtctcctctggtacaaggacgccggccagctcgtcactggggagttctccatggccgtggtgcaggccaaccagctcctcgaggaccagagccaagtagagtccggatcgctctccctggctgacccgggcccgcagggcaccttcgtcggcgtctatgatggccatggcggcccggagacgtcccggttcatcaatgaccacctcttcaaccatctcagaaggtttgcaactgagcacaagtttatgtcagcggacgtgatccggaaagctttccaagcaactgaggagggctttctttctctagtcagcaaggaatggtctttgaagcctcagattgcttcagtgggctcctgctgccttgttggtgtaatctgtgctgggactctctatgttgcaaacttgggcgactcacgtgcagttcttggaaggcttgttaaggcaactggagaggttgtggccatgcagttgtcatcggagcacaatgcgtgctatgaggaagttagacaagaactgcagtcatcacatcctgacgatccacatattgtggttctcaaacacaatgtttggcgagtgaagggtctcatccagatctcaagatctattggagatgtatatctaaagaaaccagagtacaacagagaaccacttcacagcaagtttcggcttcgagaaaccttccagaggccgatccttagttctgaacctcaaattactgaacatcgaatacagccgaacgatcaatttgttatatttgcttctgatggtctatgggagcacctcagcaataaggaagcagttgaccttgtccaaagtagtccccgaaatggaatcgctcggaggctagtgaaagccgcgatgcaagaagctgccaagaagagggagatgagatactcagacctcaagaagatcgaccgtggtgtgagaaggcatttccacgacgatataactgtcgtcgtggtattcctcgattcggatgccatgagcaaagctagctggagcaaaagcccctcggtttctctccgagggggcggtgtcgccctccctgcgaagtccctcgcacctttctcagctccggcacggctgaacagcacctactgaagttgctaccactcttgaaaggaagaacacagtgcagatctgcagtggtgagagagagagaaaacagcaaccaagtgtagcgttacagttacacctgctgtgttgttgctctttgcaaaactactgtctagactccgcctggtaattagtgtactgatagcgaggtaaaaaaagttagattatttgttagcgacacacatcctttcaccttctcttctctccctcgattcctatcccttttctcttcatccttgagagaacaggtggatgtaaattgttcagaacatgttttcccttatagtccatcatatcccgcttttttcgtgttaaaaaaaaaaaaaaaaaaaaaaaaaaaaaaaaaaaaaaaagcggcc

SEQ ID NO: 13166 - DNA, 2273 bp, Zea mays
ccggccgggaaggattggtagagcccatctctgcgccctgccttgctggctctgacctctccctcccttccccttcctcgattgttcctcccccttcttttattagggtttttttgtctccttagatttgcgcctgttctcacctgtgcgcatactagtctctgcatcagagagtagagacctcggagccgatcttcaacacgcagattgggcagagctgcctgccggagggagagtggagagagagagagagagagagagagagagagctcaaggggggcaaaaggagtttttttttatccagcttgttagcttgattctctttgatccgggagagcagccgccagtccaactaatcctagctattggtgtgccggggctttgattgttctccagatccgagccacctgctgggtggactccaggaatccgagcacgaagttgacaggggagttctcagggaaaagttgcgcaggggaggaaggaagagcctgaaagggcggtgcggagagaaagactataagagcgacctgggtcccttgaggatgccgtcaagaaaccgcgtggagaggagggcgatgagatgagggatgctggccgcggtgatggactatttcagctcctgctggggcccgcgatcgggtgacgggcacagggggaagggccccgacgccgccggccggcaggacggtctcctctggtacaaggacgccggtcagctcgtcactggggagttctccatggccgtggtgcaggccaaccagctgcttgaggaccagagccaagtggagtccggatcgctctccctggctgacccgggcccgcagggcaccttcgtcggcgtctatgatggccatggcggtcctgagacgtcccggttcatcaatgaccacctcttcaaccatctcagaaggtttgcaactgagcacaagtttatgtcagcggacgtgatccggaaagctttccaagcaactgaggagggctttctttctctagtcagcaaggaatggtctttgaagcctcagattgcttcagtgggctcctgctgccttgttggtgtaatctgtgctgggactctctatgttgcaaacctgggtgactcacgtgcagttcttggaaggcttgttaaggcaactggagaggtcgtggccatgcagttgtcatcggagcacaatgcatgctatgaggaagttagacaagaactgcagtcatcacatcctgacgatccacatattgtggttctcaaacacaatgtttggcgagtgaagggtctcatccagatctcaagatctattggagatgtatatctaaagaaaccagagtacaacagagaaccacttcacagcaagtttcggcttcgagaaaccttccagaggccgatccttagttctgaacctcaaattactgaacatcgaatacagccaaatgatcaatttgttatatttgcttctgatggtctatgggagcacctcaccaataaggaagcagttgaccttgtccaaagtagtccacgcaatggaattgctcggagactagtgaaagcggcgatgcaagaagctgccaagaagagggagatgagatactcagacctcaagaagatcgaccgtggtgtgagaaggcatttccacgacgatataacggtcgtcgtggtattccttgatttgaatgccatgagcaaagctagctggagcaaaagcccctcggtttctctccgagggggcggtgtcaccgtccctgccaagtccctcgcacctttctcagctccggcacggctgaacagcacctactgaagttgctaccactcttgaaaggaagaacacggtgcagatctgcagtggtgagagaaaaaaaaaacagcaatcaagtgtagcgttacacttacacctgctgtgctgttgctctttgcaaaactactgtctagactcctggtaattagtgtactgatagcgaggtaaaaaaaagttagattatttgttagcagcggcagtgatttgacatctaaggaacaacaacacggtgcccaccgattctgctatcctgatggctcgcggcagcctggctggtcggcacacgacacgaagtgaagctgttttactggcggcatctggctttgttttctcatgggacagtgatccacaagagtaagggatcagctcaatccaaagtcaatagatgttccttataaaaaatagaggtacagatgttcccatcggctatgtgtatttggggaaaaaatcaatataaggggtgtttggtgaaaaaaaaaaaaaaaa

SEQ ID NO: 13167 - DNA, 2141 bp, Zea mays
  misc_feature (47)..(47): n is a, c, g, or t
ccacgcgtccggcggcgtgcctcggagaaagcttgagtgcatactangtctctgcatcagagtagtggcctccgagctgctcttcaacacacagattcggcagagcctgccgagagagagtgaaaagagagggagcgcgctcaaggtgtggcgcaaggagatttttcttttatccagcttcttagcatgattctctttgatcccggagagcagccaccggtccaactaatccttgctgttggtctgccggaacttttgattgctctccagatctgaggcacctgctgggtggattccaggaacccgagcacgaagttgacaggggaaggaaggaagaggctgaaagggcggtggagagagaaagactataagggcgagctgagtcccttgaggatgccgtcaagaaaccgcgtggagaggagggcgatgagatgagggatgctggccgcggtgatggactacttcagctcctgctggggcccgcgatcgggcgccgggcaccggggcaagggctccgacgccgccggccggcaggacggtctcctctggtacaaggacgccggccagctcgtcactggggagttctccatggccgtggtgcaggccaaccagctcctcgaggaccagagccaagtagagtccggatcgctctccctggctgacccgggcccacagggcaccttcgtcggcgtctatgatggccatggcggcccggagacgtcccggttcatcaatgaccacctcttcaaccatctcagaaggtttgcaactgagcacaagtttatgtcagcggacgtgatccggaaagctttccaagcaactgaggagggctttctttctctagtcagcaaggaatggtctttgaagcctcagattgcttcagtgggctcctgctgccttgttggtgtaatctgtgctgggactctctatgttgcaaacgtgggcgactcacgtgcagttcttggaaggcttgttaaggcaactggagaggttgtggccatgcagttgtcatcggagcacaatgcgtgctatgaggaagttagacaagaactgcagtcatcacatcctgacgatccacatattgtggttctcaaacacaatgtttggcgagtgaagggtctcatccagatctcaagatctctatcggagatgtatatctaaagaaaccggagtataacagagaacctcttcacagcaagtttcggcttcccggccccgtccagaagccgattcttagttctgaacctcaaattactgaacaccgaatacagccaaacgatcagtttgttatatttgcttccgatggtctatgggagcacctcagcaatcaggaagctgttgaccttgtccaaagtagtccccgtaatggaatcgctcggagactagtgaaagccgcgatgcaagaagctgccaagaagagggagatgagatactcagacctcaagaagatcgaccgtggcgtgaggaggcatttccacgacgatataaccgtcgtcgtggtgttcctcgactcggatgccatgagcaaagctagctggagcaagagcccctcggtttctctccgagggggcggcgtcacccttcccgccaagtccctcgcacccttctcggctccggcacagttgaacggcacccactgaagctgctactgctcttgaaaagaagggcacagtgcagatctgctagagatgatgagagaagcagcaatcaagtgtagctgttgctcgtacacctgctgtgctgttgctgtttgcaaagctgccgtcttgactccgcctggtaattagtgtactgatagcgaggtatagaaattaggttatttgttagcgacgcaaatcctttctttttttttcttctccctctgttcttatctcttttctcttcatcatggaggaaacaggtggctgtaaatttgtccagaacatgttttccctaatagcccatcatatcccgctctttttcttttcggctcgagggctggcagcatcactgctcaagataatgtttggggcgcatgatttgaccagtccggatcattacttttgatgatgtgttgtagcagcacgttgctctcaacaaggttggtttctttttttcttgaaaaaaaaaaaaaaaaagggcggccaccgactagtgagctc

SEQ ID NO: 13168 - DNA, 845 bp, Zea mays
aaaaagcttgagtgcatactagtctctgcatcagagtagtggcctccgagctgctcttcaacacacagattcggcagagcctgccgggagagagtgaaaagagagggagcgcgctcaaggtgtggcgcaaggagatttttcttttatccagcttcttagcatgattctctttgatcccggagagcagccaccggtccaactagtccttgctgttggtctgccggaacttttgattgctctccagatctgacgcacctgctgggtggattccaggaacccgagcacgaagttgacaggtgagttctcagggaaaaaggggaggaaggaagaggctgaaagggcggtggagagagaaagactataagggcgacctgagtcccttgaggatgccgtcaagaaaccgcgtggagaggagggcgatgagatgagggatgctggccgcggtgatggactacttcagctcctgctggggcccgcgatcgggcgccgggcaccggggcaagggctccgacgccgccggccggcaggacggtctcctctggtacaaggacgccggccagctcgtcactggggagttctccatggccgtggtgcaggccaaccagctcctcgaggaccagagccaagtagagtccggatcgctctccctggctgacccgggcccacagggcaccttcgtcggcgtctatgatggccatggcggcccggagacgtcccggttcatcaatgaccacctcttcaaccatctcagaaggtttgcaactgagcacaagtttatgtcagcggacgtgatccggggaagctttcccagcaactgaggagggctttctttctctagtcagcaa

SEQ ID NO: 13169 - DNA, 1042 bp, Zea mays
gaccaccactacccaccaaattagaggattggtgccttgctccctcccccttcttgtcgttgctccaccctctcttcttttattattgggttctttttttctctctctccccttggatttgcgcttgtgctcgtctggccgcatactagtatccgcaccagagaggagacacctccgactccgacctgctcttgcatatagattgggcagagagtgagagagcgcgcgcgcgctcaaggggtgccaaaaggagattttttttttaatccagcttcttagcctcactgtctttgatcccggagagcagccgccagcccaactaatccttgctgctggcgcgccggggctccgattgcgctccagatctgaggcacctgctcggtggattccaggaatccgagcaccaactcgacaggggagttctcagggtaaaggaagaggctgagagcgcgttggagatttggactataagagcgagcgagcgagctgggtgccttgctgccttgaggacgccgtcaagaaaccgcgtggaggggagggcgatgagatgagggatgctggccgcggtgatggactacttcagcacctgctggggcccgcggtctcgtgcggggcaccggggcaagggctccgacgccgccggccggcaggacggcctcctctggtacaaggacgccgggcagctcgtcaccggggggttctccatggccgtggtgcaggccaaccagctgcttgaggaccagagccaggtggagtccggatcgctctccctggctgactacggcccgcagggcaccttcgtcggcgtctatgatggccatggcggcccggagacgtcccggttcatcaatgaccacctcttcaaccatctcaggagatttgcaactgagcacaagtccatgtcagcagacgtgatccggaaagctttccaagaaactgaggagggctttctttctctagtcatcaaggaatggtctttcaagcctcagattgcatcagttggctcctgttgccttgttggtgtaatctgtgctgggactct

SEQ ID NO: 13170 - DNA, 2102 bp, Zea mays
gcacgatttatagttatgtcatcgtagggtccatcatcagctgtcaataatcagtgtgattcttgtcatatatctcaaaatttctgtggatgctaagatgtaacttgtggtgcaatataatatgccactcactaccactcctcccccttaaccctcattgttcagcctttcattttaatgaaaggtgaaggtgagtgcaccaaccatatctaggagcaatgatgtatttagtgctgctattgtttatttcttcacaaaaccatcaagcaccctcagtttctattgttggttcttattcatgtagtcttgtcagcatactttatgcgatattacttatgaggtgaggtcatttctgcagatctcaagatctattggagatgtatatctaaagaaaccagagtacaacagagaaccgcttcacagcaagtttcggcttcgagaaaccttccagaggccgatccttagttctgaacctcaaattactgaacatcgaatacagccaaacgatcaatttgttatatttgcttctgatggtctatgggagcacctcagcaataaggaagcagttgaccttgtccaaagtagtccccgaaatgtatgttttcttctctcgcactacaacttctatgagttgaaatccacttttcttttgacgcttgttaccgttcaatctaattggctttttgataaatatatcctgtggattatgttgtgcttttattggatagcaattctcttaaattgatagtttgcagatttggcttttcaaatgctacagttgaatgaatcgagtcaaactggaacttttgagtaaaatatataaaatgtggatgtaactcacaagaatgtcatacaagcttttacataatctgcattgcgaagcttaagcatacctaatgcctgtgaaagtgtagttaatttcgacaatttcacaacgcttgattgttctgtgctgtgaaacatatccttcagtgatttgactagtttgttcttgtgaaataacccagtcactatcgcattataataccttcaagtttctaaccgtctgtctgtcagcatgtttcccctatcctcatttattcacttcctctgaacctgtaattccctttcccccgaaatggaatcgctcggagactagtgaaagccgcgatgcaagaagctgccaagaagagggagatgagatattcagacctcaagaagatcgaccgtggtgtgagaaggcatttccacgacgatataactgtcgtcgtggtgttcatgccatgagcaaagctagctggagcaaaagcccctcggtttctcttcgagggggcggtgtcacccttcctgcggagtccctcgcacctttctcagctccggcatggttgaagagcaccaactgaagctgctgctactcttgaaaggaagagcacagtgcaggtctgcaggagagatgaaaaaagaacagcaatcaagtgtagcgttacacttgcacctgctgtgttgttgctcttcgcgaaactactgtcttgactctagactacgcctggtaattagtgcactgatagcgacgcaaatcctttcacattcttttctctccctcgacatgagatgagaattgagatactccattcatccaggaaaataggaccgattatggagaaaagacaaaatttaaccaacaattactcaatgtatgtgtaagtttaggatacaacttatattagtagatttattatattcaattgactccgagattatattaacttaatttcttttagaaattgaaaacactccattcgttccaaaatagtagtaattttagagaattagtaggttcatataattcttgatgcatgtgttttatatgtgtctagatttattatcatccattctaatatagaaaaaaaatcaaaagttaaaaggactagtatttttttgacggagagagtatattatatggcagattaatgggtaaattctactccatcttaagatatactccttccatttcaaaatactatttgttttagctctaggttgtaatgtctacattcacatagctaatgatgaatatatatatctatatatatatatatatatatatatctatatatatatat

SEQ ID NO: 13171 - DNA, 2195 bp, Zea mays
ccccccggtcgacccagcgttcggtcgttgctctcctccctctcttttttttattgggttctttttctctctctctccccttggatttgcgcttgtgctcgtctggccgcatactagtatccacaccagagaggagacacctccgactccgacctgctcttgcatatagattgggcagagagtgagagagagagagcgcgcgcgcgcgctcaagggggggccaaaaggagtttttttttaatacagcttcttagcctgaatctctttgatccggagagcagccgccagcccaactaatccttgctgctagcgcgccggggctccgattgcgctccagatctgaggcacctgctcggtggattccaggaatccgagcaccaactcgacagggagagttctcagggtaaaggaagaggctgagagcgcgttggagatttggactataagagcgagcgagcgagcgagctgggtgccttgaggacgccgtcaagaaaccgcgtggaggggggggagggcgatgagatgagggatgctggccgcggtgatggactacttcagcacctgctggggcccgcggtctcgtgcggggcaccggggcaagggctccgacgccgccggccggcaggacggcctcctctggtacaaggacgccgggcagctcgtcaccggggggttctccatggccgtggtgcaggccaaccagctgctcgaggaccagagccaggtggagtctggatcgctctccctggctgactacggcccgcagggcaccttcgtcggcgtctatgatggccatggcggcccggagacgtcccggttcatcaatgaccacctcttcaaccatctcaggagatttgcaactgagcacaagtccatgtcagcagacgtgatccggaaagctttccaagaaactgaggagggctttctttctctagtcatcaaggaatggtctttcaagcctcagattgcatcagttggctcctgttgccttgttggtgtaatctgtgctgggactctctatgttgcaaacctgggcgactcgcgtgcagttcttggaaggcttgtgaaagcaactggagaggttctggccactcagttgtcagcggagcacaatgcatgctatgaagaagttagacaagagctgcagtcatcacatcctgatgatccacgtattgtggttctcaaacataacgtttggcgagtgaagggtctcatccagatctcaagatctatcggagatgtatatctaaagaaaccggagtataacagagaacctcttcacagcaagtttcggcttcgagaaaccttccagaagccgattcttagttctgaacctcaaattactgaacaccgaatacagccaaacgatcagtttgttatatttgcttccgatggtctatgggagcacctcagcaatcaggaagctgttgaccttgtccaaagtagtccccgtaatggaatcgctcggagactagtgaaagccgcgatgcaagaagctgccaagaagagggagatgagatactcagacctcaagaagatcgaccgtggcgtgaggaggcatttccacgacgatataaccgtcgtcgtggtgttcctcgactcggatgccatgagcaaagctagctggagcaagagcccctcggtttctctccgagggggcggcgtcacccttcccgccaagtccctcgcacccttctcggctccggcacagttgaacggcacccactgaagctgctactgctcttgaaaagaagggcacagtgcagatctgctagagatgatgagagaagcagcaatcaagtgtagctgttgctcgtacacctgctgtgctgttgctgtttgcaaagctgccgtcttgactccgcctggtaattagtgtactgatagcgaggtatagaaattaggttatttgttagcgacgcaaatcctttctttttttttcttctccctctgttcttatctcttttctcttcatcatggaggaaacaggtggctgtaaatttgtccagaacatgttttccctaatagcccatcatatcccgctctttttcttgttgatatgaccaaggctggcagcatcgctgctcaagataatgtttggggcgcatgatttgaccagtccgaatcattacttttgatgatgtgttgtagcatcacgttactctcaacaaggttggtttcttttttggggcccg

SEQ ID NO: 13172 - DNA, 1506 bp, Zea mays
cggccgggaaacttggagcatactggagatgatgtttggtgggcgttatgtaattactgactgactggcagttttttcatctaccaggattaatactacatgaatttttctctgttccatttgggcttttcggtaaatctgcctatgcatgccgtgattcttcttgcagtgatgctactaccgaaccccgcctccgcccacgcgtcccatacccttttggtgtggaccctgtctggcatggtagccgcagcgagctgccgtttctcaactcactgaagatgaagatgtcgattcttcttggagttgcacaaatgaaccttgggattgtgattagttacttcaatgcaaaatttttcaggaacagtattaatgtgtggtaccagttcattccccagctgatcttcttgaacagcttatttggctacctgtccttgctcattattattaagtggtgcacggggtcgaaagcagatctataccacgttatgatctacatgttccttagcccaacagatgatcttagtgagaaccagttgtttagtggccagaagacagtgcagcttgttctacttctgcttgctttagtgtctgtaccttggatgttgattccaaaacctcttcttttgaagaaacaacatcagcaaaggcatcaaggtcaccagtacgctatgcttcagggcattgatgaatcagtgggagcagaattgggggaacatcatgaggacgcacatgaccacgaggagtttgagttcggtgaagtttttgttcaccaactgattcacacgatagaatttgttctgggtgcagtctcaaacaccgcttcataccttcgtctttgggctctgagtcttgcacactctgagttgtccactgtattctacgagaaagtactaatgacggcatatgggtttaacaatgttttcatccttattattggtgtcgtcatcttcatctttgccacgattggtgtcttgcttgttatggagaccctgagtgcattccttcacgcgctgaggcttcactgggtggagttccagaacaagttctatgaaggtgatggctacaagtttgccccattctccttcgcgctgattcgtgaggaggaagattgagcttgtctcaacatttgtatttattgtagccgataaaaaatctttggtggcctttgttcccagaccaaatcattttttcatctgttgtgtcggatgtggatcataaaccaccgtccctttgtttaaactgggacgaacagcatcatttttccttagctatgcagaggattcttgggttggttggcaacagatatggggtgatgtcacccttgtatgatgctaataagtagttgccgattgggcggtgtgttggatataaataagcactgtattgaaggttagacaatctccatcacgttcattgtcaataaaataaagagtgctatttacgctgctggtgttaaaaaaaaaaaaaaaaaaaaaaaaaaaaaaaaaaaaaaaaaaaaaaaaaaaa

SEQ ID NO: 13173 - DNA, 1669 bp, Zea mays
aattaaggtaagagatgcatacccttttggtgcccacccttccgcccacgcgtcccgcagcgagctgccgtttctcaattcactgaagatgaagatgtccattcttcttggagttgcacaaatgaaccttgggattgtgatcagctacttcaatgcaaaattttttaggaacagtcttaatgtgtggtaccagttcattccccagctgatcttcttgaacagcttatttggttacctgtccttgcttattattattaagtggtgcacggggtcaaaagcagatctataccatgttatgatctacatgttccttagcccaacagatgagattggtgaaaaccagttgtttagtggccagaagacagtgcagcttgttctacttctgcttgctctggtgtctgtgccttggatgttgattccaaaacctcttctattgaagaagcaacatcagcaaaggcatcaaggtcaccagtacgcaatgcttcagggcgttgatgaatcagtgggagcagagctgggggaacatcatgaggaagcacatgtccatgaggagtttgagttcagcgaagtttttgttcaccagctgattcacacgatcgaatttgttcttggtgcagtctcaaacacagcttcgtaccttcgcctttgggctctgagtcttgcacactccgagttgtccactgtattctacgataaagtactactgatggcatgggggtttaacaatgtcatcatccttattattggcatcatcgtcttcatatttgccacggttggtgtcctgcttgttatggagaccctgagtgcattccttcacgcactgaggcttcactgggtggagttccagaacaagttctatgaaggtgatggttacaagttcgccccattctcctttgcgctgattcgtgaggaagaagattgagatcgtcccatgtagccgatgtacaatctttgatggcctttgttcccggaacaaatcattttttcatctgttgtctcggatggatcataaacctcagtcccctttgtttagacatgggacgaacagcaccatttttccttgtttagctatgcagaggatttttgggtcggttggggtgatatcaccattgtatgatgctaataagtagttgccgattgggcggtgtgttggatataaataagcactgtattgaaggttaaacattccgctacgttcgttgtcaataaagagtgctatttacgctgctggcgttagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttttaaaaaacccaaatttacttcccggggcttggaaaaaataaattttttttttgggcccctaaaataaaattccggggccgggttttaaaaccggggggatgggaaaaaccctgggtttaccaaattaaattgctttagagaaaaaccctttttccccagttggggaaaaaaaaaaaggggccccaccggtcccctttccaaaaattttccccaccttaatgggaaaggggacccccccttaacgggctaattaacccggggggttgggggggttccccccag

SEQ ID NO: 13174 - DNA, 6084 bp, Zea mays
  misc_feature (5846)..(5846): n is a, c, g, or t
cttcagcgttccaggaaattgttgatgcatatggtgtagccaaatatcaagaagcaaatcctggagtattcaccatcgtgactttcccttttctatttgccgtcatgtttggtgattggggccatgggatttgcttgttacttgcaacactttatctgataatacgggagaagaaactagcttcacagaaacttggagacataatggagatgatgtttggtgggcgttatgtaattatgatgatggcagttttttcaatctacacaggattaatatacaatgaatttttctctgttccatttgggctttttggtaaatctgcctatgcatgccgtgattcttcttgtagtgatgctactactgaaggactaattaaggtaagagatgcatacccttttggtgtggaccctgtttggcatggtagccgcagcgagctgccgtttctcaattcactgaagatgaagatgtccattcttcttggagttgcacaaatgaaccttgggattgtgatcagctacttcaatgcaaaattttttaggaacagtcttaatgtgtggtaagtttattcaccttttagtagacaatttgacattccattttgagatgaggactacaacaatcgtgaagaagcatgtgatcctttaacagcgttgttacagacaacagattatgatttttccacgcttactcctttgaaacaggtaccagttcattccccagctgatcttcttgaacagcttatttggttacctgtccttgcttattattattaagtggtgcacggggtcaaaagcagatctataccatgttatgatctacatgttccttagcccaacagatgagattggtgaaaaccagttgtttagtggccagaagacagtgcaggtctatattccttgttgataagttctcttctgtgaagcagactggtctatcatgcctaaccatttttgccttttccaatgcagcttgttctgcttctgcttgctctggtgtctgtgccttggatgttgattccaaaacctcttctactgaagaagcaacatcagcaagtacgttcatacagtatcccacattctatcggtgacttgatgttatgtggctgcagttcacttttacactgactgtttttccatttcttttcgatcagaggcatcaaggtcaccagtacgctatgcttcagggcgttgatgaatcagtgggagcagagctgggggaacatcatgaggacgcacatgaccacgaggagtttgagttcggcgaagtttttgttcaccagctgattcacacgatagaatttgttctgggtgcagtctcaaacaccgcttcataccttcgtctttgggctctgaggtaatgctattttaagcagtatctttatttacacagcctcacctatgcacagtcccatacttcctttgtttggctgcaccctaatccacataggtgcattggagtgcagccaaacaagtcatttttattacctcactggctactaacgtgctactgatattctcctttcagtcttgcacactctgagttgtccactgtattctacgagaaagtactaatgacggcatatgggtaagcaaacaagtctctggagccattaaaataaacatcttcgcgcattctgaaatgccattgtttcttgtaggtttaacaatgttttcatccttattattggtgtcgtcatcttcatctttgccacgattggtgtcttgcttgttatggagaccctgagtgcattccttcacgcgctgaggcttcactgggtggagttccagaacaagttctatgaaggtgatggctacaagtttgccccattctccttcgcgctgattcgtgaggaggaagattgagcttgtctcaacatttgtatttattgtagccgataaaaaatctttggtggcctttgttcccagaccaaatcattttttcatctgttgtgtcggatgtggatcataaaccaccgtccctttgtttaaactgggacgaacagcatcatttttccttagctatgcagaggattcttgggtcggttggcaacagatatggggtgatgtcacccttgtatgatgctaataagtagttgccgattgggcggtgtgttggatataaataagcactgtattgaaggttagacaatctccatcacgttcattgtcaataaaataaagagtgctatttacgctgctggtgttaatcatctcctggtctgttgttaaccattgtcagtgcttcatcttatcccattgatactctgaatcagctgtctcttataaccaaagcaaaagctaaaccagaatcacgttataaaagtagttaaacatgtcgagtctgtctgcttgtgggcaatctagtaacataggtagctgcagcctagtttcgtcagtcgtcaacgacgttgggaacgctgctggtgctgcgcctagagctgctgaaaggtcccgtgacagtccggccaacgaacttgccggccttgctgagtccgctaccgaacgcgccaatgccggagccgacggcgccgatgcccgtgccaaccatcccaacgccggagccggccgcgctgacacccgtgccggcaacggtgccggccgccgcgatgcccgtgccggccacgttggtgaccgtggacgccatgccgcttgccgcgtccgcggcgccgctgacggcccccgtctcgctcttcaccttccgccgctcatccacggtctgcttctccagctccagggcctcccgcgcctctgcgttggtgaactggtggtacgccacctgcaatacagcttgcaagaggaacgtcagacaaccgctgcgaactgaacacggaaaggacgaggttgatcgatcctgccttaatgctgagcacgcccctgtccttcttgtccttgaccttggtcgtgtccagcgacgacagcagctgcaggtccacctcctgcacggtttccatctccaggtcgctcaggggcagcttggcgatgccaagcctcttgtcttgcttcatcttgtcctcatcgaacacctgggagggcagagaaaaaaagaagtgggtccttgccttaggagtacctcgctggaaggaaacaaacaagcagtgaggtttgtcagctcgtgcccacctcaagaattagggactgcgtctccttgtcctccgagatcagatggaacgtttcgttccaatgggggttgaggttgtcgtcaatgacgctggtcttctccttgaacattgggcggatgaacaagaccacgtaggggtcggatttgccgatgagttccttgttcttgagggattccgcgcggaccacagtgacagtgagcttcccgtgcggcttcagctcgaggtcactgcacaagggagcagatcacatgtgtctgtcattcaaacaacttttccaagtcgaaaagattaaacaacttcatgcacacgattcttagtagtagatcagactctattaacctgacgtctacgtcgactccacccagtggaacaatgattctgtgtggccactggagcatgtcagtgatcaatgacgccaccgtgtcctacagaagaataacggtgaaatatggttattttttcccttccaagatttgtagatacgaataaaacaagaggtgaaaacaaaagaaattaatttcatacgtcaatcatgtctgaaagcccaggcattgcggtcaggcttcctcccacggctttcagtatgtagtcgatcctcggttttggctgcaattgcatgaaaaccacgcgtctcaaaaaaaaaaacgcaaagaaacaaggcatattttcccttggcattgaaacaaaaagaaagattgttctcatacgcagcatctctgacaacgaagtgtttacgaactagaattcaaaaatcgaagcctatgtaacagaggactagatgcgtttcagtagctaaaagaatcacacctcggccagaagagcaacaacgacagcagatatgcatggtatctcgtccgacaactggaagacaacacggatgatggtgtacacctgaaggttcttaaactgtacacacacatacaaacaaacacgggaaaaatgattagtagaagatgcggaaacgaaatttgaggtttaaacatgagctcctgttcttttggaagagcgtcagcataaaatctcataccgcaggcaaacaattgtaaaggagtccaaaatgatctaactaagaaaatgcgtttttttattggtatgcttaagctgtaattaacaacaccagtccacacatggccaggcagctgatcctagcccgtctgaaatcagacatcgcctggccaggaactcataccacaccaccatccattcacgccctatttatacgtgcaaatactttcacgataaaatttgacacacttcgataaaaatgtgggaaattaaagctgctaatatcccttttggccacgggtctgtggagatctgcaaacctgaatgggaagcgaagcaacaagtgtctcgactgcaagaatgatatttggatccccgccccagcggaagtccatgtccattgtaatctgccctttcttaaaactgtgaatccgaatgcctgagcacagaatagcttaagtcatggccaaatcctatgagagcgtatacaagttgacaccattttgtcttggcaaccttctattttcggtggaacagtcccaagggagagcctgctgaacttcagcgaggatatccctggtggtcgataatcatcgagtatcggttcgacagaatccctgatgaccatggttgctgcctgcaattagatgcaactgcgaataaggacggttgttggcatcaaaacggtagatctgtatgtttcttaaaatgtaagtaacttcgtcctaaactgtttgcccgcataatgaagttttctgaagaaaccaaagctatcaatcttaccgcttccacgaagggccaaagcttgctcaactgtttgttgagccatttgacctgaaaggagaaccaaaaaaaatatataacaagggaaacatgcaagcaacagatcaagggggcatgtatactgtaggagaagcaacagcaagatatggaataggtggatgtgtcatttcccaggttttatgcatcgaagagttatgaagttcatagatatgggctgcaaaaagttttctctctgcggaagtttttgtctagcaattacaacaataaaaattcagataacttatgcgatagtcaatagcttgatatcacgggacattttacggttccatgattatatctacaccaaggcaggtagcatttcacctgttcgtattctggaaatgatatccactggggaagactttctccacatattttcttcacgtcttcacggttgagagatcccaacgaactgataaccgcagcctgtttcaaaacatgccattatgttgaaatttatcccaatcaataatgcacaaattcaatcaaaggcatacagcacacttttaacaaccgatctgtatttaacaacacccaaaggcagaaaaatcaagaccagataaccgaaggatgaagatcgaaactttttatgatcgcatacatcgaatcggaatgatgtagcggcacctaccttgttgctgcgtttggcggcgcggcgagccatggcgcgtgcccagcctgcgatcagggcgacgccgacgatcatccccattacgactcccgatatgaatcccatttcttctgtcttttttttctcaacgagccgagaaagagaggaaaccacggaggaagacaaaaatttcaagtacaagattatctattacgtacggaaattcttggatcaaatcgtagacgattgtctctccaaattgtttattacttctaacactgcatttgggancaattttttcgcgtgctactagtaataataaagagaggggagagacgagagagagagagggtaatgtgcgaatggtgagaaggttgtcacggcgaattttgcatggctggatctctgcgatcagtgtgcttgacgagcctttggttccacacaggcccgatacttacatggaccaggcccatatagcgaaactaaacttgaagaatgaagactcttaatataatcatcataaaaaata

SEQ ID NO: 13175 - DNA, 1459 bp, Zea mays
ggagatgatgtttggtgggcgttatgtaattatgatgatggcagttttttcaatctacacaggattaatatacaatgaatttttctctgttccatttgggcttttcggtaaatctgcctatgcatgccgtgattcttcttgcagtgatgctactaccgaaggacttcttaaagtaagagatgcatacccttttggtgtggaccctgtctggcatggtagccgcagtgagctgccgtttctcaactcactgaagatgaagatgtcgattcttcttggagttgcacaaatgaaccttgggattgtgattagctacttcaatgcaaaatttttcaggaacagtcttaatgtgtggtaccagttcattccccagctgatcttcttgaacagcttatttggctacctgtccttgctcattattattaagtggtgcacggggtcaaaagcagatctataccatgttatgatctacatgttccttagcccaacagatgagattggtgaaaaccagttgtttagtggcagaagacaggcagcttgttctacttctccgtcccttgggcgctcgcccgggcgggcgcgtgccaaaacctcttcttttgaagaaacaacatcagcaaaggcatcaaggtcaccagtacgcaatgcttcagggcattgatgaatcagtgggagcagaattgggggaacatcatgaggacgcacatgaccacgaggagtttgagttcggtgaagtttttgttcaccaactgattcacacgatagaatttgttctgggtgcagtctcaaacaccgcttcataccttcgtctttgggctctgagtcttgcacactctgagttgtccactgtattctacgagaaagtactactcatggcatgggggtttaacaatgtcatcatccttattattggcatcatcgtcttcatatttgccacggttggtgtcctgcttgttatggagaccctgagtgcattccttcacgcactgaggcttcactgggtggagttccagaacaagttctatgaaggtgatggttacaagttcgccccattctcctttgcgctgattcgtgaggaagaagattgagatcgtcccatgtagccgatgtacaatctttgatggcctttgttcccggaacaaatcattttttcatctgttgtctcggatggatcataaacctcagtcccctttgtttagacatgggacgaacagcaccatttttccttgtttagctatgcagaggatttttgggtcggttggcggcaaacatggggggtgatatcaccattgtatgatgctaataagtagttgccgattgggcggtgtgttggatataaataagcactgtattgaaggttaaacattccgctacgttcgttgtcaataaagagtgctatttacgctgctggcgttagtcacaaaaaaaacccaagggggggaaggaaacccccaaggggctc

SEQ ID NO: 13176 - DNA, 1275 bp, Zea mays
  misc_feature (1263)..(1263): n is a, c, g, or t
cattgggaccctcgaggccggccgggatagaaagtgacattgcctgcattgcaaaagagaggaagcaccaccaggccgcgcgacggagcaaaacgaaacgcggcagccagcacaacccagcagagcgcgactcgactcgaatcgaatagtcccgtcctttcggttccacctttccctcccgcgccgccgcagccgcctccagggccgcggaaaccctagccacctcgtcagtgccgcgcgccgggtgtctcgccgccgcccgtcactgccgctgacaccgccggagcgatcggatctcgagaccgtcaggagacacgatggaggattgggattctgaagatttccagcccgttgctcctgttgtgaaagtcgagccacttaaaaatcagtgggctgatgaagatgtcgatgccgacgacgtaaaagattcatgggaggaagaagaggaagaggagaaacctaagccagcggttgtgcaaaagaacgcgacgaaacctagcgctaaggctcctgctaaaaagggaaaacagcaagcatcaacaagtgccgaggaaccagacgagcctttgagtcccacttcagagaaaattcgccaacagaggcttgtggaagaagctgacttcaagtcaactacagacctttttgcaaagaagagcggtgaacaaaagtcactagatacttttatcccaaagtccgagagcgactttgcggaatatgcggagcttattgcaaataaactgctcccctacgataaaagttttcactacatggctctcctcaagaatgtcatgagactttccatgacaccgttgaaaggctcggacgcgaaagacatatcttcctccgtgacggcgattgctaacgagaagatcaaggctgagaaagaggccgcagcaggcaaaaagaaacaaggagcgagaaagaagcagctccacatcgagaaaggagacgacgacttcatccccggacggggtggtggctacgatgacccggacgagtacgacttcatgtgatttggctggaagggagagtaagtagggttaataggtttccgtcttgtatacatttggcaagcagagaacatatcacgagagtttgcggcatactatactatggcatggaacatgcgttatctgtttgaggatgaattttgactctgcaggacaagaagagcacaagtgcttagttaattgttattgaatctctggtatttttttagcatacattgcattttcattaaaaaaaaaaaaaaaaattattttntgtcaaaaaaaa

SEQ ID NO: 13177 - DNA, 1051 bp, Zea mays
attgttccgtgtgttatgggaactaatctatgctgcatttcagattctgaagatttccagcccgttgctcctgttgtgaaagtcgagccacttaaaaatcagtgggctgatgaagatgtcgatgccgacgacgtaaaagattcatgggaggaagaagaggaagaggagaaacctaagccagcggttgtgcaaaagaacgcgacgaaacctagcgctaaggctcctgctaaaaagggaaaacagcaagcatcaacaagtgccgaggaaccagacgagcctttgagtcccacttcagagaaaattcgccaacagaggcttgtggaagaagctgacttcaagtcaactacagacctttttgcaaagaagagcggtgaacaaaagtcactagatacttttatcccaaagtccgagagtgactttgcggaatatgcggagcttattgcaaataaactgctcccctacgataaaagttttcactacatggctctcctcaagaatgtcatgagactttccatgacaccgttgaaaggctcggacgcgaaagacatatcttcctccgtgacggcgattgctaacgagaagatcaaggctgagaaagaggccgcagcaggcaaaaagaaacaaggagcgagaaagaagcagctccacatcgagaaaggagacgacgacttcatccccggacggggtggtggctacgatgacccggacgagtacgacttcatgtgatttggctggaagggagagtaagtagggttaataggtttccgtcttgtatacatttggcaagcagagaacatatcacgagagtttgcggcatactatactatggcatggaacatgcgttatctgtttgaggatgaattttgactctgcaggacaagaagagcacaagtgcttagttaattgttattgaatctctggtatttttttagcatacattgcattttcatttattttttgtcaactgtactgtaatactgtcgtcggtatgtactgtaatattgtcgccggtaccgggcgtgaaggtatgtcacacccgggttttggggca

SEQ ID NO: 13178 - DNA, 1396 bp, Zea mays
  misc_feature (1384)..(1385): n is a, c, g, or t
caaaacatcctcctctcgctctcaggcgcatcattcttctcgcctcgtgtcgctgacttcccccagctttgctgggttgccttcgagcaggagacaggctgtgtagtgtagtctagtgctaccaggatcggatcagcggctgctgcgcttcagttgccgccggcggcatgagggtggtggtgacgggcgcgacggggtacctgggaggccgcctgtgcgcggcgctggccggcgcgggccacgccgtgcgcgcgctcgtccgccactccagcgacgtctccggcctgccccgcgacatcgagatgacctacggcgacgtcaccgacgccgagtccctcgccgtggccttcgacggctgcgacgtcgtgttccacgtcgccgcggccgttgagccgtggttgcccgacccctccgttttcttcaaagttaatgtaggtggacttgagaatgtgttgaaggctgtcaagagaacaccaactgtgaagaagataatctacacatcttctttctttgcaattggtccaactgatggttatgttgcagatgagacacagatgcatcgagggaaggaattttgtactgaatatgagaaatcgaagtttcttgcagatagaatcgcactgcaggcagcagcagataaggtgccaatcaccattgtctacccaggtgttctctacggccctggaaaacttacgactggaaatcttgtctcacgcattctaatagagaggtttaatgggcgcttgcctggttacataggagatgggtatgatagagaatcgttctgccatgttgatgatgttgttaacgggcacatagcagctatggagaagggcagagtgggccaacggtatctcctcactggtgaaaacatgtcgttcgtgctgatttttaacatggttgctaatatcacaaacacaagggctcccatgttccacgtacctctctggttgattgaagcgtatgggtggatttcagtttttgtttctcgcatcactggaaaactcccacttatcagttaccctactgtgcgtgttctgagacatcagtgggcatactcgtgtgacaaagcaaagatggagctgggctataccccaagaaacttgaccgaaggtttgtcggagatgctcctgtggctcaaggaagaaaaactaatcaagttttagcgttctctactacacaccacatcacatatttaatgtacaccgatacattggggatgtgctggggattttgaagtgtatatgcttcggcattgcatcacgtcgtattatgctagaggaaatctaagatgttgacgtgtgatactgatgttggcaacaaagagagaaattatgcattatttttaaaaaaaaaaaaaaaaaaaagactcgggcccgggatnngaaaaaaaaag

SEQ ID NO: 13179 - DNA, 517 bp, Zea mays
tcacacaccattacattacagcaaagcagagcagggcgaaagccgctgagaagctccgaggaccggcagcgacgacaggtcaggggaagcaagagccgcagcagcagcagcagaaacaatgaggccaggaggagcagggttcaacgcggcggtgaaggtcgcagccgcaccagcggtcgccggcgccggcagcgccgccgcgcattccgcgtggcactcgccggtgccgtaccttttcggcgggctggccgcgatgctgggcctcatagccttcgcgctcctcatcctcgcgtgctcctactggaagctctcagggtacctggagggtggcgccggcgagggaggttccggcgccggcgccggcggcgacaagccagcggcctcggacctgccgccgccggtctgggaggagaagatactggtgatcatggccggggacgtgaagccgacgtacctggccacgcccatgtccagcagggcctcctccttcgggggaccgcagcagcagccagggtgg

SEQ ID NO: 13180 - DNA, 1286 bp, Zea mays
gcccccttattctattacattttttttcccttttagcaatgcacccgaacagtgacaaaaatttcccctcctccctccttataaataaccctctacccgttgcgctgcagcctcacacaccattattagggcatttgagcagaagcagaacagagcagggcaaaagcttccaaaagaaccagtaaaagccaagaagcaccgagggccggagaagcgtgcgtacgtacgtacaggagcagcagaaacaatgaggccaggagccgggttcaacgcggcggcggcggcggcgaaggccgccgcagtcgcaccggcggtggccggcagcgccgcggcgcactccgcgtggcactcgccggtgccgtaccttttcggcgggctggccgcgatgctgggcctcatagccctggcgctcctcatcctggcgtgctcctactggaagctctccgggtacctggagggcggcgccgccgggcggggaggcgaggacggctccaacgccggcgccggcggcggaacgaagccggcggcgggcctgccgccgccggtatgggaggagaagatactggtgatcatggccggggacgcgaagccgacgtacctcgccacgcctatgtcgagcagggcgtcctccttcggcggcgaccgtagcagcagcaaggacgtcgacgacgacgaggaggagagcaacaaggaggtgcaggcagacgaagccgccgtggccagcgtcaaggacgccggcggacagaatggtggcgagcacagtgagcgccggagagaaggaggagatcaggagcgccgcattcctgaggtgtgatttttgtttcggtttgctactttgctttgctcggagaagctgagctcgcttttgacgctggaaaaccatctccggccaggagaagagaaccccgacccgagcaagattttggtggggttgtaattttttttgcaaatgatgaagtggagaacgggactggtggtgtggctgtaattttgctgagttgcacttgcatgtaacttcttctacgatgggaatggattaacagcacagcatgcatgcatgaccatatcgatgaacagatctttcgcttggctgttgtttcttattggacaaagtttgtgcttcttcttatttttgctcaacttatcgatggaaacgggaacaacagccaagcgaaagatttgcttttccttttcttttcgttctcatcttccatggtcaactggcatgctgttttgtgtatttttcgattaggatgttctaggtaatggtctcgtgcgaattcctg

SEQ ID NO: 13181 - DNA, 1314 bp, Zea mays
ccattcttgtggataacccccatggtttccaatataatactactcccaaaacacttgagaaaaggagcaagcaaaaaaaaaaaccctcccacggttgtccgaaaagcaaataatactacacttgacgaggtccttaacgcaactttacaaccataaaaagctaaaaccgtgtagtataaacattgttttttttttttttttgacctcataatctattacattttttttcccttttagcaatgcacccgaacagtgacaaaaatttcccctcctccctccttataaataaccctctacccgttgcgctgcagcctcacacaccattactagggcattagagcagaacagagcagggcaaaagctcccaaaagaaccagtaaaagccaagaagcaccgagggccggagaagcgtacgtagtacgtacaggagcagcagaaacaatgaggccaggagccgcgttcaacgcggcggcggcggcggcgaaggccgccgcagtcgcaccggcggtggccggcagcgcctcggcgcactccgcgtggcactcgccggtgccgtaccttttcggcgggctggccgcgatgctgggcctcatagccctggcgcttctcatcctagcgtgctcctactggaagctctccgggtacctggagggcggcgccgccgggcggggaggcgaggacggctccggcgccggcgccggcgccggcggcggaacgaagccggcggcgggcctgccgccgccggtatgggaggagaagatactggtgatcatggccggggacgcgaagccgacgtacctcgccacgcccatgtcgagcagggcgtcctccttcggcggcgaccgtagcagcagcaagggcgtcgacgacgaggaggaggagagcaacaaggaggtgcaggcagacgaagccgccgtggccagcgtcatggacgccggcggacagaatggtggcgagcacagtgagcgccggagagaaggaggagatcaggagcgccgcattcctgaggtgtgatttttgtctcggtttttgctttgctcggagaagctgagctcgcttttgacgctggaaaaaccatctccggccaggagaagagaaccccgacccgagcacgattttggtggggttgtaatttttttttgcaaatgatgaagtggagaacgggactggtggtgtggctgtaattttgctgagttgcatgtaacttcttctacgatgggaatggattaacagcatgcatgcatgcatgaccatatcgatgaacagatctttcgcttggctagctgttgtttcttattggagaaagtttgtgtt

SEQ ID NO: 13182 - DNA, 1088 bp, Zea mays
gtagatttatataaacgctctgctttgacacgatacaacccctcaaagccagcgtagataaacgtcgaccattatgggaccttacagcaccgccgtcgccgtaagcgcatcgccggtcctgcaggcttcctcactcttgacgcgagcccgtggttcttggaggcccacggtggcggcgttgcggctttctgcttccgtgaaatgccgtcggcgggcactcaccgtgacctgtgcgctcccggagaaagaacggccggcggcattcaacatcccgcccactgctctgctgtgccccgtgcccccgccggacggcaaggaacggtgggacatcaaggaggaagatgaccgcgtcacgctgtggctccaggtgccagggctgtcggcgagcgacatcgaggtgaccaccagcgaggacgtcctcgagatcaaacgcagggtcgtcgccccacagcagccggcgcccgtggacgcgcacggcgtcggcgcgttccacatccggctgctgttgaccaaggagtacgacggcagcaacgtcacggccgatctcaaggccggcatgctggaggtcaccgtccacaagaacccgcaacgccccggcgaacgcgccgtgatgatgggggcgaccaagcccccgcccgagccccgtcaaaacgaggagagcagtaccaaccaaaggtcctcgaccgcaagaaaggaaaccggaacccccatggggagacaaaatccaaatggagtctagctggttgagggctcggaccctgctttgaataagcttctcatttctagctgcggatggactcaaaccagcaatcgccttctgttatatcaattgcctggagagagcttacgctgcttgtagtatcatgtgtgtttccttaaaaaaacccttctttgtttctttatttattatgagggtttttttttggtgtgcggtcacacagagtgaaaacaattccattttctaagcaaaattccaatggtcgtcttccctgtactgcaaaatacaccttagactttgtttaggtattgtaatattaactctaatccacgtgtgttgaagtggattgatatataaattagtttaagtt

SEQ ID NO: 13183 - DNA, 4458 bp, Zea mays
  misc_feature (161)..(161): n is a, c, g, or t
  misc_feature (3369)..(3369): n is a, c, g, or t
  misc_feature (3588)..(3588): n is a, c, g, or t
  misc_feature (3728)..(3728): n is a, c, g, or t
  misc_feature (3928)..(3928): n is a, c, g, or t
ttcaagaaagaaaattatgtgacagagttcattcttagagttttgagccaattgccctaaaaaatggcttcaacctcgaggcttgtgggagatacatatcccatgggtcaataaggtgcagatgcactccatggactgccaaagagacccccaataagtcntctagtagggcacatagtgggcctcaaaggcatgataagacatgtcctgtgtgcggcaagcgtaccaaccatgcgaatgtcacgcgaaggaatcgcctgaaatcataagacatgtcctatgtgcagcaaaacgccagattattcagaagacgcatcttgtaatcttgaatttagatcaatgcaatactcagcacaggacgaaggtaagcattcacgtggcccgaacctgtataaactccctgtattccgatgtgccaccgcacgtaccattgagcagtgatcgacgtcgccgtcctaccaaaagcattacgtgggcccgtagtgcgcatttgggagcaaacaccgacagcgatgaagttactaacctttagagcctagaatgaatggagaaatagactcttcacaaatagttcgagagcaagagcaaagcaagagaatagggagcttcaaaaattgttctgaatgactcgagttagggggtgatggaaggtgtatatatatgcagacatttaattagtactagttaatagcttggttcaaaactaaaggtcactctaataccgattgaaaccaccaactaggattaagggacacatagcatttattttcgattggtggccatatgtaactaggattgaagagtgacctttagtattgtttggagccatcaaccatgactagatgctcctgtgttgaatctaagaggattagtctcacgtccaactctaactaatcctacctccgttttcgaatatttaatgaccgccagcttatttttaaactaaaacatgacaaatagaaaaacagagaaagtatcaaattgctaaatttaaaaactgcttatcgattctctaatacagaaaatacatgagtgatgagcataactagtgagagtgcatgggagaacttatgaagcaacacaatgacaaggacagatggaacgaatcatgatcttcctactcatgaagcaaatcgagcaaagtaaaaacaaaaaggaaatgtccattcattcgggctgcaagatcggcatctttccacctcgtctgtcaagcatcaagttcaacttttcgtaccagaccaaagcgtgcttgcctggcaagccgcgccgctttattccatcacacccgaccaagcaaaggccactaaagcctagcagtgtctcctcctagccgtctgtagatttatataaacgctctgctttgacacgatacaacccctcaaagccagcgtagataaacgtcgaccattatgggaccttacagcaccgccgtcgccgtaagcgcatcgccggtcctgcaggcttcctcactcttgacgcgagcccgtggttcttggaggcccacggtggcggcgttgcggctttcgtgcttccgtgaaatgccgtcggcgggctctcaccgtgccctgtgcgctcccggagaaagaacggccggcggcattcaacatcccgcccactggtgagtacatgcacttccatttcacttagcatcattatgcaacaatataataatgcgtgctaagcagcttacgcacaagagcatgcatgcgtttcagctctgctgtgccccgtgcccccgccggacggcaaggaacggtgggacatcaaggaggaagatgaccgcgtcacgctgtggctccaggtgccagggctgtcggcgagcgacatcgaggtgaccaccagcgaggacgtcctcgagatcaaacgcagggtcgtcgccccacagcagccggcgcccgtggacgcgcacggcgtcggcgcgttccacatccggctgctgttgaccaaggagtacgacggcagcaacgtcacggccgatctcaaggccggcatgctggaggtcaccgtccacaagaacccgcaacgccccggcgaacgcgccgtgatgatgggggcgaccaagcccccgcccgagccccgtcaaaacgaggagagcagtaccaaccaaaggtcctcgaccgcaagaaaggaaaccggaacccccatggggagacaaaatccaaatggagtctagctggttgagggctcggaccctgctttgaataagcttctcatttctagctgcggatggactcaaaccagcaatcgccttctgttatatcaattgcctggagagagcttacgctgcttgtagtatcatgtgtgtttccttaaaaaaacccttctttgtttctttatttattatgagggttcttttttggtgtgcggtcacacagagtgaaaacaattccattttctaagcaaaattccaatggtcgtcttccctgtactgcaaaatacaccttagactttgtttaggtattctaatattaactctaatccacgtgtgttgaagtggattgatatataaattagtttaagttatactccaattcacctcaatacatgtgggttgagcttaatactagagtacctaaactaggtcttaatggacttataaaagttgtcatgccaaagatttagcaagaaaaagttgctaaaactagctagtacaaaaaaattaccatatacttagggcttgtttgtttcagcttatagattatataatctagattataatctaaattatacaatacagattataatctacatgtatctgtttggtagtctatattatacaaatgtagattatttacaaagacaatagtacccttatttgtttatttgaggtgagaaaaagggatgacatatattgtaattttatttacataaccatgaatagtgggtcttgccaaaaataatctcaaataagctacttttgagtagattatgagattatcataatctaggatttagattatataatctaaaatcataatatagatatttgtttacttgttgtattatttgcgctgaattatataatttggagagattataacccgagaacagtgcccaccagcgagcgtatgcgatgaatgagcggcagcccacaagagcccggcccatgaggagcacacggcagcccaggagtgcgcaacgagcgccgtacatccacgagattacgcggagcacaattttcgaattccgatgtctcacgttcgaggtaggttgagttttctcttctttcttttttttctaatttccctgttttattttattgagttgttttattcatatttcaacattttaaaatttaaattaatcatttattttctgtattattatttgtcccacattttttattagttgttccagactatagagcangcctttgcaggtagttgaatcttatcatgtgccagttggatctagatcaggtttggatctgatagagtaaatatccgtctgcgatcatatcctcagagattactcatgctcgcccacagttatacccgtgggtaaattttgtactcgtgtccatatccgtcgggtatcagatacccattactactctacaaagcgggacgcaaatgcgcgcaggcattngtccacgtcggcaaaaaaatatcgtacacaagctgttccatcaacggacgaagttgcctctcagtttgcccaagccgcctctacacactcttccagaaaataccggaatgacgaggaatatgatccacaccaccaggaanctcactccccttccccaaacttcgttgcgccgctaggatagcctgtggccccctttctctccttagacgtcatcgcgacgtctgcgcagccacagctatgagcaccccctccctctccctcccctatgatggtggcgcgatcgtctggtcacgacatcggttcttcacacccagttgtacatcgccgcgccgggaacccnatcccatcaaaagccttttctcgcctttctatacgtcgccagaaaccccatccttttcctcaacgttcgcgcgtcagcgcggccgtccggccacgaagctgcttcttcttgcagagctacatgtcgccaagaggctcaacccctcaaaatgtattttcttgccgagttgcacgccgccaggatctccaccccttctctcttcccctgggccttctcacgtcccacgacactaccggacatgagcagggccttgcaggcagcactcgacactaggacctggcccacggccgtggcgaccttctcctagaccatggtggcgcggacgtcgccgccgtggggagctgcgccatcgccaagaggctggtgtgtccgtgcctcgtctgcctgtcagcatgctccgctcctccctgcaccttggttttcctttcttctggattctataggccaatctcacggatgtggagggcaagaagcatagaggtgtctacggggagctcactgattccaaccagaagctgcagtactctcca

SEQ ID NO: 13184 - DNA, 1059 bp, Zea mays
aattcctatcgatacttccacacggcacaactatcggcggcggcaacgagccaggaccctgttgtgatgctaccgtcgccgccggtgctactacgcccttgcgctgcccgggcctccccgcttccgccccctagacctagagctgcaaatcctaacaccgagtcggcgacgacgacaaccgtcgccacttcagcggacagagcggccaccatgggcgcggcagcgtggtggcggcgcgccctggggcagcggttcaacccagccggtgtggccgcggtggcggccgtcgcggcgtccaagccgcgcctggcgtgccgcacgtgtcggtgcaagacatcaggtggctcgactgggctgagctccgccgcgccgggttccgcggcgtcgttttcgacaaggacaacacgctcacggccccctacgcgcccgcgctctggccgccgctcgctgcagcatttgaccagtgccgtgcgacgttcccgcccggtgcgctcgccatctacagcaactccgcagggttgacggagtatgatccggacggggtggatgcgagggcgatcgaagcggtcatcgagggggttcatgtgatcaggcatgatataaagaaaccaggtggactagctactgaaatagagagttactttggttgttcagcctcaaatcttgtgttggttggtgaccgttacttcactgatgtggtctatggaaacaagaatggctttcttacagtcctgacagagcctttaaacatcactgatgaatcatacattgtcaaaagggttaggaaactggaggcgtacatcatcagttattggtacaagaaagggcacaaaccaatagagcatcctttgctcccagatgcaagaagaatagtgaagtttgactcatatgacgactcagtttcaaccagaatataatgtaatgatgtatcttgcacctgctcatcagagagtgagatctactgtttgtagcttagggtgtgtttgtttccttctaaattatataaactggattatggtggaatggtaagaccgtaagagaggaaaaaaaaaaaaaaaa

SEQ ID NO: 13185 - DNA, 3295 bp, Zea mays
tgcagtatgttggccaataatcccgtcctgtttccggcggtataaaacgaaaatacggtacaggactggcaattcctatcgatacttccacacggcacaactatcggcggcggcaacgagccaggaccctgttgtgatgctaccgtcgccgccggtgctactacgcccttgcgctgcccgggcctccccgcttccgccccctagacctagagctgcaaatcctaacaccgagtcggcgacgacgacaaccgccgccacttcagcggacagagcggccaccatgggcgcggcagcgtggtggcggcgcgccctggggcagcggttcaacccagccggtgtggccgcggtggcggccgtcgcggcgtccaagccgcgcctggcgctgccgcacgtgtcggtgcaagacatcaggtggctcgactgggctgagctccgccgcgccgggttccgcggcgtcgttttcgacaaggacaacacgctcacggccccctacgcgcccgcgctctggccgccgctcgctgcagcatttgaccagtgccgtgcgacgttcccgcccggtgcgctcgccatctacagcaactccgcagggttgacggagtatgatccggacggggtggatgcgagggcgatcgaagctgtcatcgagggggttcatgtgatcaggcatgatataaagaaaccaggtggactagctactgaaatagagagttactttggttgttcagcctcaaatcttgtgttggttggtgaccgttacttcactgatgtggtctatggaaacaagaatggctttcttacggttaggacactggaggcgtacatcactgatgaatcatacattgtcaaaagggttaggaaactggaggcgtacatcatcagttattggtacaagaaagggcacaaaccaatagagcatcctttgctcccagatgcaagaagaatagtgaagtttgacccatatgacgactcagtttcaaccagaatataatgtaatgatgtatcttgcacctgctcatcagagagtgagatctactgtttgtagcttagggtgtgtttgtttccttctaaattatataaactggattatggtggaagggtaagaccgtaagagagtaaaatattacattgtgacaacaaataagctgaaataaactaatattggatagcttattttagcttatttgtaatcccaaagtggtaccataatccaatttatataaacatacagggcctcagcagaagattacaagggataaacatatggtgtgtagatttgctgtctctctctttcactctcgcagaatgcaatttttcagggaaatgtctgtcgtgtgcgtgagcattattttgtccttggtcccttgttgcacgaagaaaagatactactccgtacacaatatcacgcttcacgtggtcgttaggcagatgcacttcactacccattcacatcacatttctcctcaccatttaatgtgtcaactggcaggaccgcggaacgacggtgtgttcaatgctacgttagattgtttacgaagactgacaaagttgtccaagtttactgcctcagtatctgaaaagttatactgcgtatgaagttcacccagtaggctgcatttcgttgctaggcttgaattgctggatattttttgagaggacttccatttatattaaattaaaacaccgaaccatcttttatacatagagcggcgaagcctaccattgcgaatttgaacgcctcgaagcgcccaattgtgtgcctctgaattaagttgtgctccattttctctgatgtgcagaaaggaacatctggttttatctgttcaacagtccccctttcatgtttacagagatgactttggcttgacggatgaagacttgtgtccatatatgaatatgaacctgctccacgcttctttccaagcccatcagcatagggcactgtgaagtacccgaatcactgaaaggcacacatccaaccaaatgaaatgtgcaagctgcagagggcccatcaggtgacacttcatcctgtgtcaacgtcctctttgactaattcactacacactagttttgctctgctagatgtgaacaaactgattcaggtgaaagaacaaaaagctcgggtcttaatctatctccagcacagcagcagacgacagcagcctcagtgtccgcagacgttagtagagtagagtgtagtttgaatatgagccacaaaaaacactgttttataccgttttgtactgtatattgaattgtatgtagagtgtagtttgaatatagatatgaggctttctccagcggtgaagtatccggtgcacatggaggagaggtgcacatgatgcacatatacaatctcagccatcgatctttaatccaacagctgatctcccctcctttgtgatttctcaaattgaccctcccacctccctcacattgccttgtttcttttcaaaaaaaataaaactccggcgtccctcactcagatcaagaggactgcagcagcgaggatcagaaccacgtcggcgatcacagctggccagacccgctgtgtcatcccgtccaaaaacgaaagtgcgatgtctcaccttctagccagcgcaggtcttgcttgcctcccctttgtcttccccaacccagcgggcgggaaccggccgaccaaacgtggtggtctgcccttgtccgacttcggcgagctaagtcacacaagagaaagaatggcaaaaatgaaactaagaagccacgcaatccgaagaaggccaacaatgagactatggagcaagtatgatagatgaatttacagttgatctgctaatctgctatatatgccgcttgttactaataagtactttacatttttttttgtttcaacggtttttcagttctggtcagtacatcatgttcagtgaccaaaccattgacaattgtttcaccttcacacagttcctgcacttttcattttgacaaatcatacacaactctttctcttttcatttcgtgaaaacaagccactcgttcactacggtaaaacactacaagtccgacgactcgcttatgtccgacggccgcctggggaaccgtcagacataagcttatatccgacggctactggcggccgtcggacataatgcgggacatccgagggctggcagacaggcagtcggacataagcttatgtccgacggctggcagacaggccgtcggacataagcttatgtccgacggtctcctaggtgcccgtcggacataagagaatttaaccgacggcccgcgcccgcgtcagttcattctgttttct

SEQ ID NO: 13186 - DNA, 4468 bp, Zea mays
cggcaaaggagccgtctttgccgagtgtcacctagacactcgacaaagacgccgtctctgtcacccagcgccgtaacgactgcttttctttgccgagtgctctctggcacttgacaaagctctttgccgagtgcccgagaaaaaatattcgacaaagaaggctttgtcgatgcactgtatgccgagccctctttgccgagtgcgacactcggcaaagactgtgccgagtgtttttaaggctctgccgagtgtttctggcactcgacaaagccgtcgattccggtagtgactgcagcgctccagtgcacatcctttaacgtcggatcaaagccatcctagtgtcaaagccatcctagtgtcataccaactttcctttgacataatcataattaaaatggaacataacgttttattaagaaaaaacatcgaacatataaataagcaaataaaaaaacataattcacaaaataataaagagaaaactacattacttgaaagaaattaaaattacataatccacttaaacaaaatttatgttttgatttttttaaaaaattgtttaaaaattaaaatgataagaaccaatcagagagtcatgcggcaagaggtggtgagtatcgatcggcacaattctaacacggtcggtaccgactatatatgctgctcgttcgataatctaactgatcaatcagtctaaccacattggagctggatcggtcggtaccatctacccgagccgccggatcaccgcgctcggtaccgatcagttttttttttttttttttttttataattcaatagatcgcatgtgtcaaaaccaagtgaaatcaacattgcatatgtactacgtgcttatattattgcattttttcgacgataaataacggataagtacaattctctctagagctttgcgccaaaaatatctgttagaccgacccacaacctcgctctaacctgacacctggcatattatcaatttatcagaccacatatatacaaaagccattattgatacgcgaacgattcagaaagaaaaggaagagagaaaaaccactcgctcctgtgtgtgtacatatatatatgtctgtgtgttgtgatttttttctcgtcttgttaatttgttacgcagaaaataaacacataagctaaatgcacgcaacacacgtgttgataagatttttgtgtaagggataaagagccggcatgcactactctgtaagcagcacgagaaagcgaagtgttatcgatcgaataatcgctgaggaacacacgtcggcaacgacgtcgatcgctattatatatatcgtcgtcgttgctgatacagatggacttttgcaaggtcatcaaggtagaccaaataaaagccggcatcctcgcctgcgacgtacgtcaccggcggcgtcctcatctgcaccccaaccgcaggcgctgtgccgtgccggccgccatggtctgtagaagcatgaggccgttaccgcgttacctaccattacattcacatctcaaaaggccttcgacagcgaccgcaacgcgtcgtctactcttcgtcttcgatcacaaaactcaaaaggccgcagcgtacgtcctggccgacgaccacagactgtacgctggatgcatgcacgaacgactactactgggttgtcggctgctgaaatcatggatcgatccgctggtagagtggtagtacccttgatggatgatggctgccgctccatgcgatgcggtaagcgcgcgacgacgatagcagctagggtcgccgtgtctcgtcgaggacgcccgtgccgtgcatgcatgcgcgcgccatttccagctctcccgcccgtagtagatgtagattcgcgcttgcgtcgcgtgcgtgcatgcatgcatctatgcagaaaggagagcgcgcggtctacactctacagtaccgtgcggctgtctccggagtgagtcccggtctcccctccgcagctgcaggcgtggtctcattcctgccgcgcggcccagcggatcccctcctgccgctgccgcggccgcgcgttgcgtgtgtggggtggacggaagcttcgagaagaaggcggatttggcaggcgggccacgcaatcggcggcagcgtgagccggtggccggtggggcgtgggggctcgtctcgggagtcgggagacgacctgtcccgtcccgtccgcggtcgcggcttgtgtcgggtcgggccgggcctggtctagccgtgggcggtgcgctgccgcgtggcggtggtgggcgaccctccaaagtgggcagtggccaaaggccgtactgtacgtgccggccctgcgcacacgtgtcatcccgggaacctcgtagtacgtactaactatagtacctttggagtgtgggggggcctggcactggcaggcagtgccgtgacgtgcggcacccaccaatatcaactgctacgtgcactccagatccagaataaaagcggacggtgcactactcatctcgacgacgctggagtgttggcgaatagtaataaaatggatggcacggcacaccttcgaatcgggcgctcttccgccggctgcttcaattcttcggcgagtagatatatatatagcaggtttgcttagtaacaataaaactaattcctttaccagatcccttccgcgtgcaccaagctttttaacctgcctggagtgcgtgctccagcctcctccagtacgtgcgcatatatataccccggacgtacgtatgcaaatgcaattatgcatctcgccaccgactaccgtgtcacacggcatcagctagccgcctagctagatagctagtatatgcgtggtcttcctgccacggaatacctagcttgtgaaacacgtatgatcccctcaccttgttgtcccctaataaaataacttctgttggcgctacacagtactaccgttgatcactagcatacagaggagctctgtagacatgttgtgaacctatttatactagcattcaaacaccctcttaattaagtcacgactgtcgtttagccttttccaaaactgctctccgtgtttctgctgccttttctttttattttacaagctgttgcaggatgaagaaggatcaacaggaaggcacgaagaaagatgcccctcgcgtcggagggtgaaaacgactcctaacgggcatgtaacttggtatcacacgtgtaacctttgcatgtgacatggaatcactttcgcacctctcttctagctagctcgtcggccggccatacgataagatcgaccatgctgagacgacgatgcctatatatagcattctagctacgcgcgcatcatatatgcttgcctaggtgcctaggcgtggatgtggatgatctgcttttgcttgtgttcagtagtagcccgtactttttttctcttttgctaataatagaagcacaacatgcatgcatttgggcgcgattattatttagcgttagaggggagaggaagagagatgttttcgacgatggatggacagatattatgttgcatgcacacggtagtatacggagcgtaacgagatgcatggaatcagctgtgaggcggtaattcgggagtacatacagttgtttggaacgtttccttcgcgcatgcaaagactacgatgatctatcgatggacgaccgcgaacgacccatacatatatatacgattataattaggagctagccgtatgtccgcttcaggaccaataagctagctaggcttttcgatgacgtgtctgcgcgcctttgatttgctgcgaagtacgttctcatatgtttccctctctcccgtcgacttttcaaaccgcaccgcgcatcacatacacatcacgcgctttggaagtatcgtacactccacgtctcaacgaccagctgtgtgtgtgtgtgtaagaacaccactagccagttcattacattttcatgctttgcatagcgacgacggcgtgtgcgcgcgcgttttcgcacgcacgcaggcattggggcgggctcaggatccgcagtggcgcagtgtactcagaaaattccgaagggtaaacaaagatcattttgtgatagcataattcctagcagtatttgatgtaggggagcgcaatggagacagctaggacgatgaggtagttttttttatagtacttgtgcatagaccctgatcctatgccaaaataatggatatccaatgggtatccaagaatataattggaccttaaatattcacatccaaacataccctactatttcctaggacaaatcaacatgacacttatagggggtgttttaatacactagaactaatagatagttggctaaaattgttagtagaattagctagctaacaaatagctaattaatttaccaaaaatacctaatagctaaactatcagctagggtgtttagatgtctcaactaattttagctactaattattagttttagtaaattcaaacacctctatattctgggtctaaatatatatatata

SEQ ID NO: 13187 - DNA, 2769 bp, Zea mays
cctgtctttctccctctccctctgacaaaatttcctccacccattctcttcctcctcttcttccccaccgactccaccgatccacatctttctatctgaatttcctctcgtcttgcccaccggtccatctgtctgttgcctctctctctctctccctctctcgcaaccaatcggttcttgtttcctccgtctgctgggttgattctctctctcttcctctccgtggagaggagaggatcgagaaacaggagacaggaaagaagagaaatcagaacggagcctgttcttttgcctggattgcggttctcgcgagttgttcagaaactctgggccagtttctggtcctttaaaatactggaacgaggaaccatcagagatgctaaggcaacagaccaattgatgttatctcgctaccctagtttggatcatcacaatgcaaggacagaggaattctgtggagcattttgctgatgtttttggattcgacattgcatctagttcaggcaaccctgtgatggatcagcagtcatattggaacaatgttcttggatcagtagaatcgcagaatcttcaaggttatcagatgaatcacagtgatgctgccatgccatatgggaatgagacacagcaagatggtacatttcttggtttctgggaatcaggcgaagcaagtgcaagtggcagctctaacaatgccaaaacagagcatcttagtattggcggtggtctgaggattggtgaaaggcgactggtagctgacaatggcatttctctggatgtggatatcaaccttaacgccaacgttaacgatctatgtggtcaaagttcaaatgttaactgtacatctcagggccctgagcactatggtggcggtgatcgtagtgttgtaaattctcagccaactgacctgagattacacccatacaggactttcctactagatgcagagcaagcagattcttttactttgaaccctagtgaaaaccctttgtgtgatttttcactgatgcaagaaagcattgaccaaagacccggtagttccctggatggacgccggctagcctgcaagagaaaaaatgttgaaggacccaatggccagagttcagcaggtgctagcactagtttttcccacaggaacgacaatgctttccataacattgcttcttcaagttacaatcctgcacctatcagaaatccgtcctcacccaattgcttgccggttccaagttctatcgatgatcaactcccacgatatggaactaatgcagggctctcagccggtacctatgaccttaatggaggggtcaacaatgctgggaattcgcagagaagtttccgggcaagaattactacgtctcaacagattgctccctgtagtgtatggccctcttcaaatgctatcagacttcctaattcatggaatcatcagctacctcattttcaaagtgcatttgatgatacccaggaggttattcctgtggtcagcagcctcaacttgcaataccagcatccagtgaatgtttctagtgtgccaccggctgcaaaccgtttcactggccatggagcttcatcatcgagagctggcagtttggagaacagaattcttggtagtcaagaggctcctagaaggaatgtggtgcctgccaactactctgatttagttcccccgtctgtagtagacccgagacgtttgctgccagaaccatctaattggagttctgatgtccgaggcactgcaatatcaggaagtattcctcctgtatcaagagctaataacagtgcaactgttaatccgccagcaggattcagtcaccaaaacctcacccggcgccatcctcgaaatttatcagaggagattggtcggctatctggagcacttcgcggccatcaacccccacgcttaaggccggggtttctgttggagcgccagggcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccacgctggctgcatcaagcaatggctggtggtgaagaacgtgtgccccatctgcaagagcaccgcattgaagaagacctgaaacccgaacgaaggctcgtgtcagagacacccccccccccccccccccatgtttctatgttcactcgacggttcgcgagatcatttgccgattcgtattgctacgctttttttggtcgggaaaattttgccagccacctgcgattgggaaaggaaaagagagaaacagagagagagaggatgcggttgcggtcctctgtaaactgctgctgcagtaaataatccctggaatatgtcttccctgcattcaaccaaatatttagtagtagctgttatagtggacgtcgtaggattaaaaccttggaagagagcctgttggctgttgcccaccacttgccataattatgttcgatccggatttcaattttc

SEQ ID NO: 13188 - DNA, 1847 bp, Zea mays
  misc_feature (30)..(31): n is a, c, g, or t
  misc_feature (38)..(38): n is a, c, g, or t
attccttctgtatcaagaactaataacagnncagcagntgaggccacctgttgagattctatcaccaaaacctcaccagacgccatcctcgaaatttatcagaggagattggtcgtctatctggagcactccgcggccatcaacccccacgcttaaggtcagggtttctgttggagcgtcagggcgatggtgtttggggcgttcctttatcaacaaggggtagagaaggaagaaggttaatggagattcggaatgcacttgaaatgattcaaaggggggaaaatgtaaggctcgagtctatcttctatggcggcctcgacattcatgacagacacagggacatgcgccttgacattgacaatatgtcctatgaggaactattagcacttgaggaaaggatcggaaatgttagcactggcctcagcgaggaagctgtgataaagttgctcaaacaaaggaaattttcatcgtggagactaaaagcatctttggacccagaaccatgctgtatttgccaggaggagtacgttgatggagacgatctcgggaggctggactgcgggcacgacttccatgctggctgcatcaagcaatggctggtggtgaagaacgtgtgccccatctgcaagaacaccgcattgaaagcctgaaaccgaacaaaggcgacacacccatgttccatgtccattcgatcggtcgcaagatcatttacccgattggtttttactatgcgttttttggttgggaaaattttgccatttcacctgggaaagtggtgggggggtgttggaggtggaagagaagatggcggtccctgtaaactgctgctgcagtaaataatccctggaatttgtctccctgcatttaaacaaaatatttatggctgttataatggacgccgtcgtagggtttataacttgaaagatagcattgtgtgccaccacccgccataattctacttgatctggatttcacgtgctgccgctgctggtgcggtgcggtgcggaggctcatcacgcacgcctgtttgttttccaggaggcatgctgctctgctctcggattcgacctgattgagaacacaacatatccaggcctactgccgcgggcgtggggtgggtgtttgcatggatcccatgcgtccgttgcacctgcatatgttccttgccggcgtcaggcgccggccgggccgcgagaaaaccggcacgcaactgctcggccggcggctcggcgccgtcgctgtccacccatgaatgcgtccaggagcgtcatcggtcttgtcgtcgggtggcgctggccaacaagcctcgcgcgcgcgcgggagggcttccgtcgtggccacacgctggcggcgcgatcgacgaacacggctcgatctgatgggcacccgccgcgcccgacgccggacaactggtggcagggggagcagccagtgacggctcggttgtgggtcgagtcgctgtacattcagcggcggggtgccgtctccctgcgaactgcctgcgagggtgtggctatggactttctgaagatttggctgactgataatctgaagctttttcgttgctgcgatagttaaaatgagctcggtttatttcagaagacggggggctacggcttcggctcctgagagcccaaagtagcccaattcggtcggcaaccgtcaaatccaaagggtgctgctgactgttgaggccgtttcgacgcatcacgcaaacccgtcggttgacacggtggcgtcgtggtctgctggatgccgtgtcgggtcgggtgtgatcggtgttgggggcgtaggctgccaaagtggccgaaaagggcggcaatgcccacaaacatcaggggtaccga

SEQ ID NO: 13189 - DNA, 2901 bp, Zea mays
aattcggcacgaggaagggatccttgcgaagacccagacgccagaggggagtgagggagaggggagggagaaataaataaacccgaattcagccaaacttctctctcccaccgcgcttgcatcctctcatcgccaccccaccctcctcctccctgtctttctccccccctctctctccccctcttgacaaattttcctccacccattcccttcctcccctcttcttcttctccacccactccaccgatccccctctttctctctgaattctctctcgtcgtgcccacccttcccatctgtctgctgcctctctctctcgcaatcagtcactcggctcttgtttcttccgtctgctgggttgattctctctcttcctctccgtggagaaacaggaggagagagagggaagaagagaaatcggaaccagcctgttctttttgcctggattgcggttcttgcgagttgttcagaaactctgggccagtttctggtcctttaaactactggaaagaggaaccatcagagatgccaaggcagccaacaaattgatatctaattgccctactttggatcatcataatgcaaggacagaggaattctatggagcattttgctgatgtctttggattcgacgttgcatcgagttcaggcaaccctgtgatggatcagcagtcatattggaataatgttcttggatcagtagaatcacataatcttcaaggttatcagatggctcacagtgatgccgccatgccatatggaaatgaaccacagcaagatggtacatttcttggtttctgggaatcaggcgaagcaagttcaagtgccagtgcactaaactatggcagctctaataatgtcaaaacagagcatcttaacattggtggtggaggtggactgaggattggtgaaagccgactggtagctgacaatggcatttctctggatgtggatatcaaccttaacgccaacgttaacgatctttgtggtcaaagttcaaatgttaactgtgcctctcaaggtcctgagcagtattgtggcagtgatcgtaatgctataaattctcagccgactgacctgggattacacccattcaggacattcctactagatgcacagcaagcagaatcttttactttgaatcctagtgaaaaccctttgggtgatttttcatcaatgcaagaaagcattgaacaaagaccaggtggttccctggatggtcgccggctagcgtgcaagagaaaaaatattgaaggagccaatggccagagttcagcaggtgctagtacaagttttccccacaggaacgataatgcattccataacattgcttcttcaagttacaatcctgcacctatcagaaattcatcctctcccaagtgtttgccagttccaagttctattgaagatcaactcccacggtatggaactaatgtagggctctcagccggtacttatgaccttcatggaggggtcaacaatgctgtgaattcacagagaagtttccgagcaagaactaccacatctcaacaggttgctccctgtagtgtatggccctcttcaaatgctatcagactttctaattcatggaatcaccagccacctcatttccaaagtgcatttgatgatccccaggaggttattcctgtggtcagcagcctcaacttgcaataccaacatccaatgaatgttcctggtgtgccacaggctgctaaccgtttcactgaccatggagcttcatcatcgagagctgggagtttggagaacagaattattggtagtgaagaggttcctaggaggtatgccgcgcctaccaactactctgatttagttcccccacctgcagtagacctgagacgtttggtgccagaaccatttaattggagttctgatgtccgaggcactgcaatatcaggaagtattattcctcctgtatcaagaactaataacagttcaacagttaatccaccagcaggattcaatcaccaaaacctcaccagacgccatcctcgaaatttatcagaggagattggtcgtctatctggagcactccgcggccatcaacccccacgcttaaggtcaggtgtttctgttggagcgtcagggcgatggtgtttggggcgttcctttatcaacaaggggtagagaaggaagaaggttaatggagattcggaatgcacttgaaatgattcaaaggggggaaaatgtaaggctcgagtctatcttctatggcggcctcgacattcatgacagacacagggacatgcgccttgacattgacaatatgtcctatgaggaactattagcacttgaggaaaggatcggaaatgttagcactggcctcagcgaggaagctgtgataaagttgctcaaacaaaggaaattttcatcgtggagactaaaagcatctttggacccagaaccatgctgtatttgccaggaggagtacgttgatggagacgatctcgggaggctggactgcgggcacgacttccatgctggctgcatcaagcaatggctggtggtgaagaacgtgtgccccatctgcaagaacaccgcattgaaggcctgaaaccgaacaaaggcccgtcagagacacacccatgttccgtgtccattcgatcggtcgcaagatcatttacccgattggtttttactatgcgttttttggttgggaaaattttgccatttcacctgggaaagtggtgggggggtgttggaggtggaagagaagatggcggtccctgtaaactgctgctgctgctgctgcagtaaataatccctggaatttgtctccctgcatttaaacaaaatatttatggctgtttataatggacgccgtcgtagggttatacttgaaagatagcattgtgtgccaccaccccgcatattctacttgat

SEQ ID NO: 13190 - DNA, 1432 bp, Zea mays
ctcgaggccggccgggacgacacgtcattgccgtggcccagcgctagtttccagaagcagccgcgagcttccaccgccttcttcccgtgcattttctcgagcgacggagcgatccgttcgggccgtccaccacagcgagagagagcggcagaggcgcagagcgcaaccgagcgagagagagaggacggcgacggcggagatgatggggtggggagaggaggtggtggctctgtccctgcgaggctacggctatggcaacgaggaggacgaccggccggagaagccgcggcggtacggggtgacggagatgcggagccccttctactccttccgccccgcaaaccaggcgctccaggaaatattggattctcttagtccattcgttgatggtttgaagttctctggcggatgccatagtttgatgggaaaggagttggttagagagatcactgatctagcacacaggcatgacatttatgtgagcacaggtgattgggcagagcatttgctgcgccaaggaccctcttctttcaagcaatatgtagaggaatgcaaggccttagggtttgacacaattgagctgaatgctgggtctctcaacctccctgaagaggctctgttgagactagtccgcctcatcaagagtagtggtttaagggcaaagccaatgttttcggtgaagtttgacagttctgatattcctgcgtctggtgatagggcctttggggcttacatagctccagtcaaagggaagacctcagaaagagttgaagatgttgacctgctgattaggagggcagagagatgcttggaagcaggcgctgatatgatcatgatcgatgctgatgatgtttgccagcgtgctgaatctctgaggacagacatcatcgccaagattgtaggccggctcgggcttgataaaaccatgtttgaagcttccaactccaacacctcggagtggttcgtcagacgttatggcccaagggtaaatctctttgttgaacactctgacgtgatgaatctggagcgcctccggggcttcaacatgcgcagaagcaactcggcctcccgttttgcctcgccgttcttcctgatctaatgggctaatggccattccccttcctgagatgtgtaagatacttctacatgttctcaccctcgcagagcttgttatggcctagagatgtaaccgcctttgttaatgcctcgatgtagcccccagcgagcagcgcatagcacctgttatgttgtcagcgtcgctactgataatcggttctgttggtcaatgctactataataatcggttgtggtgcaagtaatgtgaatagtgtaagagtgttttgtgttccattgcatcggtgagccaggtccttggattcatgtttgtactattgtatgcgtgtgaaatatcggaactttcagtttccagggc

SEQ ID NO: 13191 - DNA, 415 bp, Zea mays
gcaagaacacccagcccactgcccacgccgtgctggaagtggcagcggcggcgggaggaagagggatgcgaggggatggcgcagccgagcaaggagccgtgcaagaaggaggcgtgcgacatccaggcctgcctctccaagaacatgttcgactccaggaagtgtgtgagagttattcagttacttcagtcatgttgtgagcagtgtgagtacaaatcaacacactgtggttccttgtccggattactcaagaacatttctaagtgaggaacaataccgacatagtttactgcagccattgaataaaagttcttgtaggttagtttagtaccttatggggctcacggcaatctctcttacggatcaaggttccagtttcgatgctatttaagaatgtttcttcttcaaacatgat
